United States Patent 12,344,895 (LONG NON-CODING RNAS (LNCRNAS) FOR THE DIAGNOSIS AND THERAPEUTICS OF BRAIN DISORDERS, IN PARTICULAR COGNITIVE DISORDERS) - sequence listing, part 4

SEQ ID NO: 2689 - DNA, 1656 bp, Homo sapiens
gtgtcaagtcccacgcgcggcccgcggagaacccaggggcggcccgcgcgcgtcggcctagcggggagggctgctccgggacacggtgcggcggccgcgggcgagttggacgcgctggcagagccgggccgaaggcggcgggcgtctccgggcagccatgttcgcggcgcccgcccgcgcagcaggacggagccctgacagcaatgtttgctacggcctccctctgcagtcagcctaaagcaaggagctggaggtagatgaggcaaaggtaaaggagaccaaaacagtattttaaagaaaaaatcatttatcttcaaataggctccaaacctaagagtgtccaggctggaggtgatctcggcttaccgcaacctccgcctccgggttcaagtgattctgccgcctcagccttcctgggtagctgggattacaggcacgcatcaccacgcccggctacttttgtatttttagtagagatagggtttctccgtgttggtcaggctggtctcgaactcccaacctcaggtgatccgcccgcctcagcctcccaaagtgctgggattacaggcatgagccaccatgcctggctattaaccttgtttctaacttcagcattgcacatctccttagtaaagcagtagccattaacaagtcaggtccaacaaccattttcctctggtcctcaagcagagactcagagccagttacacataaactatttcattataacatgaaaatagcaagccttgggctattgcaaaaggcttttcaaatgttgacctctaacttggagaaaatagagggaagcagaaatatagggtgctaatttgtgctataacctggtctcatgtcgtggtatattcccagttgcaacattttaaatttataagtgagaaagtaaaacaaagcttcatatctgtgaaagtgaaaaattgtccagaagtcttctattcaaagaccaattagctttttcttcccaataacttatcagaaagaaatgggtacttagaaacctaaggggttctttaaataggagtcagaaaaaatatataaaaataaaaaacaaagcaagaaagaacattgtataaaaataaaatgttctttaaagatgactgccctctcttgaaagatgagtgctatattaaaagggtagatgtatctctataactcatcgtgtttatatgtaaattctctggcagatataaacccatctttgtcttcatcttctttatcaaaaatatcctccaccaaagcatcatgatgactttcattcaccaccgcaccatgtttttcaaactccttctttaaatatgctttaacctacaaaataacagatcccattaataacttggattcataagatacccacattgagccaatcaatatcacagacatggactgttattatatttagttcattaactaaatataataccttctaaacagccattttatgacatagttttaatgataattaaaaaataatagaaactttttcccttaaaaaaactgttgctaaactgctaaagtggagacacaaaatattgctcaaaggcagggccaggtgtggtggctcatgcctgttatcccagcactttgggaggcccaagtgggaagattgcttgaggtcaggagttggagatcagcctggccgac

SEQ ID NO: 2690 - DNA, 1255 bp, Homo sapiens
tttaatttacaaaaggtaggctccgtttattagagtcacacacaactgactatctcagtgtgactcaagaccacaaaaaacccatttctccttcacttctgagtcctggggttaatacctagaccagcaagtgtactgcttggggtccattcacaggtttacaagtttttcattgagggcaatctgtgactgtgtgaggttggccaggtaggtcaccatcaaaaggtcattgatgttgctgttgagcatggtctcaaagtcatcgggaactattttcggtactcggttaaccaggctcatcaggaagcggcccacagtattgtcagctgacacctttccagacagtacatcctctgcatattgcaacactgtactcagggcatcctggatgcgagctgatgcccctcctacttgctgcaagtcacttaagagtccaatcactctgttggggctaaagcaggtcttcatgatcagctcaactccgatgcgttcagtgtcatagtatgcgtatttcactgtcagaggtgtgaacatcactcccatggtcctcccagggacacccattaaagtgctgacataggctttgatgctcatgcggccgttctggagacttgtgtccacagtgaggtggatggggttgggggcctctcggctgtagtactcatggatcagcacagagtgctctgtgatgtcatggcctgtagcgtaccagcccaggatgagctcatttggagaaacttttttatgcagttcatacatattcttagcaaattccatgtcaacagccacttcatcttctgactcattgtgcggcactgaaaagcaattggtgacctccactgagtgtttgtcgacagttcccaacagggtcccgataactcgggcagcaccctcgttgcgtctctcgtagctgtccacaatggaggccaaaatgactgggtgcagcctgaccacgcggccgccggggaagggccctggaagagcaggaccaggcagagcgggcgctggggtctgcgctggagcttgcgctgaggccggggtctggccaggagccgcagttgtagccgatgctgccgcagggtctgaggatgaggctggagccgcagcgggaaccggagccgcagccggtgctggcgttggcgctggaactgaggctggggcagaggctgggaccgccgccgggactggggctggcgtggccggaggagcacttgctggtaccgccggactgctggtggtgcatgtccttctatga

SEQ ID NO: 2691 - DNA, 697 bp, Homo sapiens
caccacgcccggctaatttttgtatttttagtagagacggggtttcaccatgttggccaggatggtctcgatctcttgacctcgtgatctgcccaccttggcctcccaaagtgctgggattacaggcgtgagccaccgcgcctggccttctgctttctttatcatattgtagttcagttcctgtagtttcaggttacttattgttagggatgggtgctgacatttcgggtcccctggctggcagccaagattcaagagcactgttttcttgctgtcaaatcacattgcaccaacatcaagttggatataaaagtccccacaagtatcaataaaagactgatggtgccttttattattctttgggctgaagtgagaaactggaaggctaaaagacatgcggataaatgtgacaggccgagtatgctctgtagtgtcagctccttcccaaaaccccgctaacactatggcaaagaaaaggtataaacttacaagaacgaagaaaaatggagagaaaaagatatcagagaagaaagatcagcagaacttgggaacgtgaaaagtggaaggctgagtgctgtcttggcagaagggaaagctgagaggcagcaggccagctcacatccaagaacctcggaagagctcaggaattgaagggccacagctcctcccacctgttttattgttcctgctggacttt

SEQ ID NO: 2692 - DNA, 2503 bp, Homo sapiens
atttcgagtaggtcactaattatcaccgggctctgaacctgagaattagttctaggaatattccagacctgatccagctccagaaacttacccactttggaactgaacatgagtccaagaatgctctagaaacaaatgctaactctagaatggattgtctgctccaaaaaaaccctagagctgactcccagttctccccatagagccgagaatgaaatacaccaccagctcccaacacactgtaaacctgagccccccttcccaacccagcaattgaaaaatgtgaaccagctcctaagcactagaattgaccactagttcctggagttggctactggttccttatcactgtttttctttctttctttcttttttttttgagatggagtcttgctctgtctcccgggctggagtgcagtggcgcgatctcggctcactgcagcctctgcctcccgagttcaagcaattctcctgtgtcagcctcccaagtagctgggattacaggcacatgccactatgcccggctaatttttgtatttttagtaggtctgatcctgttggccaggctggtcttcaggtgatccacctgccttggccttccaaagtgttgggattacaggcgtgagccaccgtgcttggcctccttaagcactctgaaccaagtattgtttccagcctaatacattgtggaacaagtggcaatttctatatgaacctcaggaacaaagaactactttccagcaccttctgagtctgattttccagtttgtaagccagtatggtccagataagcgtgaaacccaacccattctagaacagttactagccctttttctggtctctggcactgcagggcctggagcatagtttattttttgaggtggagtctcgctctgtcgcccaggctggagtacagtagtgtgatctcggctcactgcaacatctgcctcctgggttcaagggattcttgtgtctcagcctcgtgagtagctggaattacagatgtctgccaccatgctgggcaaatttttttttttttttctaagacggagtctctgtcgcccaggctggagtgcagtggcgtgatctcggctcactgcaagctccgcctcccgggttcacgccattctcctgcctcagcctcccaagtagctgggactacaagcgcctgccaccacgcctggctaattttttgtattttttagtagagacggggtttcaccgtgttagccaggctggttttgaactcttgacctcaggtgatccgcctgcttcggcctcccgaagtgctgggattataggcgtgagccactgcgcctggccatactttttactcccctctaaccttcagcaccagttcccattccatgttgatctagaacagagtatcccatcccaacacactgtggacccaagtaccagctcccagtgtgccttgtgccagaaaactagttttcaaatgcgttaaactcaagttccatttcctaaaattctttaccagagcagaatgaggtcatgttcaatgtgaattgggacgtgccaatttgaagtaatgcagaaacgatatcttgccttatgtgcaggtctgaaacaaagcaaatccctctaacataaaggaaaagaaaaatggaattgcctaattccaaagctgcatcagctgaatgcattgtggactgttgctgttgagcgtggggtggggtgccaccatgcaggctttgaattcttttttttttttgagacagagtctcgctctgtcacccaggctggagtgcagtggcgcgatctcagctcactacaacctccacctcccaggctcaagcgattctcctgccacagcctcccaagtagctgggactacagttgtgcaccatcacgcccagctaatttttctagtttttgtagagatgggtttttttcaccatgttgcccagactggtctcaaactcttgggctcaagtgatccgcccgcctcagcctcacaaagtgctgggattacagacgtgagccaccacacccggctatctttcttccttttaacatgggccccacgcctggcctctgttcctgcaaactgactccctaccccaaccacctctttttctctccacagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaac

SEQ ID NO: 2693 - DNA, 838 bp, Homo sapiens
gcacgctgcgcccatggatcatgtctgtgcgttacaccagaggctccgggctccactaattccatttagagacgggaagacttccagtggcggggggaggacagggtcgagaggtgttaaagacgcaaagcaagaaggaaataaaggggggccgagagggagaccgagaggaagggggagctccgagcccacgctgcagccagatccggatgagtccgtcctccgccccgggcgggctctcgctctcgctggccctcagcgccgcgcagccagcagcatccccaccgtgacgctcgcatcacacccgggcgccggccgccaccatccgcgccgccgccgtcaggaccctcctcccgggcatcgtcgccgccgcggggtcgggaggacgcggcgcgcgggaggcggcggtcgcagggcgagccccgggacgccccgagccggggccggggccggggagagggcgcagcgaggtgggggccagtccagaccgacggcagcgacggagcgggcggcggcggcggcgccggcggcggcggggtggctcagtccccagtctcagacgcgccgcgcagcaggtcggagcagcctccccgggaggatgtccagcggcagcgctcctcgctccagcccttggggatcttccgctgaggcattgaaggcaggaagaaggggtccgtcatcggctcgccgggctgcgcgccacctctgctatcttgcggaaagaggagcgggcatacaacttaggattcataactacatatatacggatagaagtgcatgaacagaaaatctgcccttctggaataccaaatgcaaaattaaagtgactacaagcaga

SEQ ID NO: 2694 - DNA, 1388 bp, Homo sapiens
ggacaagatggcggcggcagctgtacagggcgagagaagcggtggtagcggaggctgtagtggggctggtggtgcttccaactgcgggacagggagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaagggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctggataaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacattttgtgcttttaaccaattaaagaagccaatggcattttagttttatattgtgtttcccactagtatatccctgttgatttgtttgtgccttttattaactgccattttctaaaatttttttcaataaaaggaaggaagatgtgaaaaaaaa

SEQ ID NO: 2695 - DNA, 1628 bp, Homo sapiens
tccagaacattttcataatccaacctgaaactctgtacccatgaaacactcggcaaccaccattctactttctgcctctttctacatatttgcctattctagaatactactcttttcgatctctcaattttcctgaaaaagacttaaaatttctggcaaattttccaagtaaccttttcaataaccaggtaaagtgagatggggtaaacataaccgaggttctaattttttaaaataactttgtgaagaagcagaaaagttgtcatctcctagcaaccactgtccaaaaggcttcaaaccactgatctgtagggcacagagtaagtatttgtaggtgagggaaccccatggggaaaaaacaaggacaaggaaagtgtgtggcttctgcagcttaaaagtgttccactgatactcataaggctctctctaccctgtattttactgcatgtaaactatacctcaaaaagttgtgacaaataagtaaatcccctagagaccaatgtacttcaatagcgacgctcccctcaggcctcctgggtgcttccctcacatcacctcctgcacggccttacctcccctgcttccctcgtcccctccaccctctgcacctccatcatccaaagacagaaatgtcatctttagggcaatgtgccagagaggaaaagcaagggcttggttacatgtcaactgtgcgctcaggcagtgctactcacttcatcagtttctgctttgtggcagaatctttgaagcttctaaattcttctcctgctttgatctcataaaactggggctttaggactgtctgctggtcctccttgagtcgttcctgccgcttcactttttcctcctgctggaggagtctgcgttgcttcctgacctcttcaacccaggctttttcatcatctgaactctccgaactttctgcatcacttggttttccttccggctcttcctcctcttcctgagaataaaaatagtaagcagcaactcctttcccccagtcaaacacagaccccttggtttctctgaagcagcactggcccattaatgagtgcctaacagctgctctactgcatgcatcaggagaaatgcctttaaataaataagataatactcctaagcccaatgtcaaacacttaatatggaattaattacatctcaagtataatcaaagactcttctaacttacaaagaaaacattacattaaagaaacagtagcaaattctaactgataaggagtacattactttttcacgaagttcttgttgctctaagagtcttagtttcttcttccttttttcactaatttttgaaacaagtggattcagaagcctaaattcttcactctcttcatctacttggaagtcagggttctcaaacataactttaaatcgatcatcggtgagaatattaggaagactctacaaggaggaaaaagcttggaagccagatgaaacggcttactcagaattgtttgtcaatcagagtaaacagccctgaacactgctggaaaaagctgacctgtttgtgatggactctgactctgctgaacagactactttactatttctccactgttgagagtaaacaagattgcaggcagttgagttctgaatattatttgtgt

SEQ ID NO: 2696 - DNA, 2089 bp, Homo sapiens
cttggctcggactccgggactggcaaaaagaaagtagaaaaattcgtaagacctcagggctgtggaagagaacgggacatcaaggaaaaaagatatatatagcaaccaacccagaaggctgcatgatgagtgaagcaaaggcaagtttggctaagatagtattatatgctctgaaaagagaatggctggataggtacccacttatgtgactgcttactagcaggcagccttactgtatgcctcatggaatggaggcaaaaagccagggaaaggtgggaggggagaaggaagagaactgtataaaacccagggtaaacaaatgagtggggcagaattacagagagaggactctaaagtcttttgtttccttgaaagtctaaaataaaccttaagtttttaactatgtcagtcaaattcaatgaacacataatgagtagcactaggcactgtaaaggaatgatagggggaataatttataaaaataaaggaatgacatggatcctgctctcaaggagcttacaacttatacggaaagacaagattccacacaaaaacaactgcaaaccatatttacatagtaacatacataaaaataaatatacatataaatagacatatgaataaccaacatatgaaaactaaggaatattgtgttaataactgcttagcagtacctaagtctgttactaaagaaaaaatttttggacttttaagtataattagtggagagtagggcatgtgcaaaggtatggaactaggaataaatatgtcacattcagtaagtagattagcctgattggagtagaaagtctaggtctagttaagaagggagtttgatgaaacagtagaagtctatctggtgaaagacactacaatgttagatctggcccctaaaataaaatgaacagggaacaaatgttttctttaggtaataataagtggccacatgtccctgaccaacttcactgctcttaaaagttttgaagttacactaagagatagaagctaataataggatagtagagaagtactcagtgctcttgggcaagtagaggaaactgccttctacaagaattcttaggaagtggcaagcagacacccaaaggcaaggaagaaaaaaactcaatgaaattccgaggcagaggatctatcaaccaaaggccaactagatctaggtaattgcaagtgttcaaatagaatgtctttgaccctaattcttagtgggaagtggattgtatatgcttacgaaattatttatttaggccaggcacggtggctcacacctgtaatccagcactttgggaggccaaggtgggcggatcacgaggtcaagagatcaagaccatcctggccaacatggtgaaaccctgtctctactaaaaatacaaaaatgagccaggtgtggtggcacatgcctgtagtcccagctactcgggaggttgaggcaggagaactgcttgaacctggaaagtggaggttgcagtgagccaagatcatgccactgcactccagcctggagacagagtgagactccatccccccaaaaaaaaaaaaaaaaaaagaaaaaaaaaattatttatttatttgagacagagttttgctcttgttgcccaggctgcagtgcaatggcgtgatcttggcttagcgtaaccttcacctcctgggttcaagcgattctcctgccttggcctcccgagtacctgggattacaggcatgcaccaccacacccagctaattttgtattttcagttgagatggcatttctccaagttggtcaggctggtctcgaactcttgacctcaggtgatctgcccaccttggcctcccaaagtgctaggattacaggcatgagccatggcgccccgccatgaaattattttttaactactgtgataatcaactttgatcctaacaatttaagaaatttgtataggaggataagaagaaccctaatctatagggaatgctcatgtccctgaaggaggacaggtcagtaagggcccaaattctctcctggtctttaggtggaaaggcaaaacatcacactttaaaaagaggctgctctcagccaaagcaagaaagacctct

SEQ ID NO: 2697 - DNA, 652 bp, Homo sapiens
tgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagttg

SEQ ID NO: 2698 - DNA, 2928 bp, Homo sapiens
ccatgcctggccgcatgtgtcattttcttgggtgttatactgatcgtatatttgcaggtttgcttttgtgacagacttcttctgggggaaaaaaagtatccttctatctttttacttttgtccagttccaggtatccctgtttttttcttcactcttccttccttgttcatgggagtttttcttgaggacttcaagcccagcttcggagaatcctggttgtgtcatctcatctcctttctgctctcttctctacctaggctttccaccctcacacctcccggggtctgaaaatggaaagataagggtgtttccctgaaagttgctcttctgtgtggggatgacaggttctaaagactcttttctggtccctgccctcattgccatgattaatcagttaagtggcccgaggttttgtaacagcacagtcttaaaatgcttctcccaagtttaatttctctccatttgaccttttaaggatgtgaattggctttaagcagtagactccctttagtacggcactgtgagcctctcagtgaatctgctacatccattccacccacgggtctggaaacttgtctgtttacctttccctaaaaacctaagatatatttttaagaagtgccttgtaacttttcatatagcctttcccctactttgggtagactgtttcttacaggaatttggtagatctttccaaagagaattctgtatctctatttttaaagcataaatcctgtcaactttggaggagaactgatttggcttgagtcttctcagacatgggaacttttgacctaagtttgtattttacattgttgaaagggaactccgggatcccagaaaacatatggactgcaattgggtaaagtttctgtttcagtacttattcctacttactagccgtttaatcttggtcaagtcagccatgtggctctcaacttcctcatctgtaacataaaaggattagagtagacaatctctaacaagtgctataataccactgacaaataataatattagctaatatgtgtaaggcactgtgtttagtgctttttcccttaatacaatagctttgagatataatttatataccatacaatttacttcttaaaaaagtacacaattcagtaattttagtagataggagtaaccatcaccacagtcaattctagaatatttttatacatcagaagaaaccctttacccattatcaattactctccattcctcctaactccctcccagccctaggcaactactagtctactttctgtctttatttgcctcttctggacatttcatacaaatggaaacatgcagcatgtagtaatttatgacagcttctttcacttagcatgaggttttcaaagttcattgatgtggtagcatttatcagtactctgtgcctttttatggctgaataatattttatcatatggatttaccacattttatcattttatttatccatcatcagttgattgacatttgagttgcttctactttttgagtattatcaataattctgttatgaacattcttgtataattttttggtagacatttatcttcatatttcttggatatatacctaggagcagaattgctgcgtcagatggtaatgctgtttaaccttttcaggaactgtcagactgttctgaagtgggtacattattttacattccaaccagcagtgtatgagaattccagtttctccacatcctcatcaacagttgttattgtctgtcttttttattatattcgtctgtaatgtgaagtgtttatctcattgtggttttgatttacatttccctgatggttgatgattttcaacatcttttcatatacttattagtcattatgtatcttctttggagaatgtctgttcagatcctttacctactttataattggtttatctttttaatattgaactgtaatagtttttaaaaaatatatcctaaatacaagtctcttatcagataatatgatttgcagatattttctgtcattctatatactgtcttttcacattcttgatgatatacttttcagcccaaatgtttttaacttgatggaatacaatttattttttcttttgttgcttgtgctttcagtcatatttgtgaaaactttgcttatcccacattacaaagatttactatttctaagtgatttataattttaccacctacctttaggtctccgatccattttgagttaatttttatgtgcgaggagggagtctaacttgattcttttacatgtggatatttagttgtcccaggaccatttgttgaattaagtgcccagaacaagtacatctatatatagagaaagtagattagtggttgtcagagactgcaagaaggggggaattgcagagtgacagcccataggtgcaggcatgctttttggcattatgaaaatattttggaattaggtagtgctgctggctgcaaacttttggaatatagtaaaaaatactgaaaggtatgcttaaaaatcgtgaattttgtgatacatgaattatactgtagtaataataataataacaacagtaataaagcaaggtgtctttccacatctccatgtcctgtattttcattaaaaaacaaaaaacacaaacaaaaacaaaagcatttcagggctagcctaagtggctcactcctgtaatcccagcacttttggaggcctaggtgggaggattgcttggggccagaagttcaaaaccagcccgagcaacatagcaagaccttgtctctatgaaaaacaaaaaaactagccagaaatggtgatgtgtgcctagagttccaactagtgggaaagctgaggcaggaagatcacttgaccccaggagtttgaggttgcagtgatctataatcaccactgcactccagcctgggtgacagaacaagaccctgtctc

SEQ ID NO: 2699 - DNA, 1234 bp, Homo sapiens
gggatgggctgaaggcagcagttcctttcccgaggtattcaggttcttccgggtgcaggtagtgcctgtgacagccttccgccggcagctgcacggggggctgcagctcagccagggtccctgcagcagggctgcctaggaaactgcgtttggtcgcgttggagatcggtacaggaggccggctgctcttctggtgtaacactgttttcgcgtctttcagctcctgaacatccctgggctgaacaaaatctggcttgacattctcgaaccaccaaaaaagctccgcaataaaaaccataacattcggcttcaacactaatggcgcatacagcatatcttccaaggtgagataaaaacatttattaagatattcattggagaattctctcagaagccgaatattatacagactgtcggccatcgacgttacctcctttaagcatatatcatccagtttcatctgctctgggcaataatagtgaatcacagctaagagagcagcaccatcactgccgtctctcatcaaatcctccaacaacgggaagtagggtgactgcctagcagaaaggtgctctcgtcgatagcggaccttttgatgagctggactttccaataactgttgttttaatttaacttctttctctgttatctctctcattttaagatttaccttgttgatccagaacaccatggcatcctcgaggtcgtacggaagttctttcgaggcactgaacgttgagaagcgcttgacactggccaccaccttctcgatgctgatcatctccacagtgtaggccatcatcagggcatccaccattgccatgtgggcactcatttttatgggtgcgcgactgaggtcggactctgtcacgggggtgtcatcactctccatcacatagatccctttccgggacagggcctggatgacagactggtgtccctgtaaggcggccacctggtcccctttcaggatgaggctgcagacacggcagtacagctcgctggacaggagaagcttgataacaggcggcttaatgtgctcctgctcatactggtcaacgtagaaagggtctctgaggtcctcagggatgttatctcggccgtaggccttggcgcagatccactgcaggttggcggcgatcttggcgcgcgccgcgtcgtagcggtccaggggcacgaggtcggcggcgccgtccggcggggcctccatcttcctccagccctcggcggcggc

SEQ ID NO: 2700 - DNA, 677 bp, Homo sapiens
tatacataaagaatattaccactaacaaatgcagacaggctaggacatggtactgggtggaggacggctagctctttggaaagtgaaaggtttgggtggcgtgggcctcatgccacactgattggtcagtagacagggggcacatgccaaacaccacagggcatcagaggctgtgggaagagaaggcagcaccaatggtggcaccttctaatactggttgttctaggggcagggagagggaaaggtctttttttaaaccaagcccctcatttcaatgtacaaaagaattactctgatcgatattaaatcgtattgaaaacaaaatggactaaaaagcaaatactactctatgttggggtggaagtgggaggaaagaatgagtccttcgaagcaggaagggagatagcaggggaaaggttctgtgcctgtgaccttgggcggtcactcacgttgctccatttttactttcggtggtctcaggaaggtccgatttttcttctctttcttccccttcgtattggcttggaagtttcgccagctgtccacacgaccatctcgactttcctaagtacaaaagaagtttgaggtgaggagaccagtcaatgagtggaaaggcctaaacctggtctgccatccactcaccctcctgtagcccagcccacttcagtcctctggaa

SEQ ID NO: 2701 - DNA, 397 bp, Homo sapiens
gaggccgtgtagcgtcgccgttactccgaggagataccagtcggtagaggagaagtcgagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctt

SEQ ID NO: 2702 - DNA, 817 bp, Homo sapiens
gcaccatgcgtggggcgtgctcagagctccgggaggctgggagaggaggtgagagtgtgtttgcttgcatagggcgagggggagccaacatccgtgatcacagaatatggcacttgagatggactggcacccaggaggcccagctgccagtcccaggaacaaatgtaatgcccttgactggcttttggaaaaattgctggggttggtcaaggttgggcagaactctagccaggacctcccatggcccttcccaagatgagtccagggctcaagcaggatctctgggcttaaaccaatgtgcaccattggctctgcagggaggaaaatcaacaccagcccttccctcccctcccctcccccaagaccaccaaaaatgctccctccccacaaatcacccttcactgtgcattcacctctgatacttttaagtgaaaacatgaattaggcaaactaatcaatttgacaactgttgggatccgggctttctcactgtagtggaaatggcttctttacttgaagtctgctaagatgtcactgaaaatattgaggaacaggtgagcgtggtgatccctgaagaccagcgtgggacggaaacgaatggatttgtcaccacagccacccaacaccacacctgaaagaggcaggaggacttaaaattgcaatggattggttgtgaaatgccatgtgtaaagccatgccttcctgctacactgcatgcttcctgaaggaaggggctctgatggtcttcatcatcactgtaactgtctccagtgtccacttacaactcacctcctcagcgaacgcttgttgagtaaat

SEQ ID NO: 2703 - DNA, 2792 bp, Homo sapiens
gccacttgggccatatgacccagcagatccaatagtgcttgagggatgagtggcagatagggatgctatttggagcctttgccaggccaccataaatgaatcacagtggaggcctctaggattttggagcaagaccctgccttcttctgcagataactactctccttttgagagacagctcttagcctgttactgggctttggtggaaactgaacgtttgactatgggtcattaagtcaccatgtgacctgaactgcctatcatgaactggatgctttctgacccatctagccataaagtgggtcgtgcacagcagtattccatcatcaagtggaagtgttatatgcatgattgggctctagcaggtcctgaaggcacctgaggaataagttacatgaggaagtggctcaaatgctcatggtctccgctcgtgccaccctgccttctttgccctagcctgcaccagtggcctcatggggagttccctatgatcatgatcagttgacatgatcagttgacagaggaagagaagactagggcccggttcacagatggttttgcatgatacgcaggcatcatctgaaagtggacagctgcagcactacagcccctttctaggacatccctgcaggccagcaataaagggaaatcttcccagtgggcagaacttccagcagtgcacctggatgtgcactttgcatggaaggagaaatggccagatgtatgattatacactaattcatgggcggtagccagtgatttggctggatggtcagggacttggaagaagcaagattggaaaattggtgacaataaaatttggggaagaggtatgtagatggacctctctgaatgctcaaaaactgtgaagtgctaaccaacgggtgaccttagcagaggaggattttaataatcaagtggataggatgactcgttctgtggacaccactcagcctctttccccaaccacccctgtcatcatccagtggacccgtgaacaaagtggccatggtggcagggatggaggttattcatgggcaacagggacttccactcaccaaggctgacctggctacagccactgctgagtgcccaatttgccagcagcagagaccaacactgagccctcaatatggcacagttcctcatggtgataagccagctacctggtggcaggttgattatattgaacctcttccatcatggaaaaggcagaggtttgtcctcactggaatagacacttactctggatatgggtttgcctatcttgtacacaatgcttctgccaagactaccatccatggactcacagaatgccttatccactgtcgtggtattccacacagcattgcctctgaacaagatacttactttatggctaaagaagtgtggcagtgggctcatgctcatggaattcactggtcttaccatgttccccatcatcttgaagcagctggattgatagaacagtggaatggccttttgatgtcacaattacaacaccaactaggtgacaatactttgcagggctggggcaaagttctccagaaggttgtgtatgctctgaatcagtgttcaatatatggtactgtttctcccatagccaggattcatgggtccaggaatcaaggggtagaagtggaagtggcactacttaccgtaacgcccaatgatccactagcaaatatttgcttcctgttcctgtgacattacattctgatggcctagaggtcttagttccagagggaggaatgctgccaccaggagacacaacaatgattccattaaatgggaagttaagattgccacctggacattttgtgctcctcctaccttttaagtcaatgggctaagaagggagttagtgttgcctggtgtgattgacccggattatcaagatgaaatcagtctactactccacagtattcacaggagatccattagggcatctcagtgttaccataccccgtggttaaggtcgatgggaaactacagcagcccaatccaagcaggactataaatggcccagacccttcagaaatgaaagtttgggtcaccccaccaggaaaaaaaaaccacgacctgctgagctgcttgatgaaggcaaagggaatacagaatgggtagcagaagaagatagtcatcaataccagctatgaccacgtgaccagttgcagaaacaaggactgtaattgtcatgagtatttccttcttttgttaaaaacatgtttgtgtaggtgtacacttgtactaagaaaatatcttcattttatttcctttttcctttatcatgtgacataagatttattgacttcatgtcagcatttaagtattgttaactttatgtaacagcatttggattggggaaggatagttgtattatgttaggcggaattctgatcttattgtctttatttgaagattacgtatgttctcaggagatgtgtatgggttcaagttgacaaggggtggacttgtgatggttaataccgagtgtcaacttaattggattgcaggatgcaaagtattgatcctcggtgtgtctgtgacagtgttgccaaaggagattaaaatttgagtcagtgggctagggaaggcaggcccacccttaatctgggtgggcaccatctaatcagctgccagtgaatacaaagcaggcagaaaaaatgtgaaaaggttagaatggcctagcctcctagcctacatctttctcccaagctggatgcatcctgcccttgaacatcagactccaggtttttcagttttggggctcagactggctctccttgttc

SEQ ID NO: 2704 - DNA, 715 bp, Homo sapiens
tactagtgacagttccacaaccaaggagaataggaagaaattaaaaatgaagtttccacctaaaatcccaaacagaaaaacaaaaagtaaaactaataaaggaggaataactcaacctaacataaatgatagcctggaaattacaaaattggactcttccatcatttcagaagggaaaatatccacaatcacacctcagattcaggcttttaatctacaaaaagcagcagcagaaggcttgatgagcctttttcgtgaaagggggaaaggttatttagctttgtgttcataccactgcaaagaagctataaatattttgagccatctaccttctcaccactacaatactggttgggtactatgccaaattggaagggtctattttgaactttcagagtacatgcaagctgaaagaatattctcagaggttagaaggattgagaattatagagtcgaaggcatggaaatctactctacaacactttggcatcttcaaaaagatgttgctctttcagttctgtcaaaagacttaacagacatggataaaaatttcccagaggcctggtgtgctgcagggaacgtttcagtctgcaacaggaacacgatattgcaattaaattcttccagagagctatccaagtggatccaaattatgcttatgcctatactctattagggcgagagtttgtcttaactgagaattggacaaagcatt

SEQ ID NO: 2705 - DNA, 3503 bp, Homo sapiens
aaaagtagtggagctcaggtacgtcaacctagttgcagtggccagagatgcattaaatttctagatccctgtatatagttgttgacatatgcactagaagctataatcacatagaattctatgtatatcctcccacaccctgggtagctactgactgaaggggtcaagcaagggctatttgctgtcccccaaaaagtacacctggccagaagggcacaaacacggcttcttaaatcactcactttctcctgttcccctcctgtttctgaaatataagtttatgacgttctttcacaaaagagtataatcattcttagactgttgacatggctgtggaaagccttaggagaagtagaaacaatttagggagggtggggaatgtactcatcccctcttctttccatcctagtgcccccaccaaagaggcttcttgttgcagccctcagtatctggatatgggccagggaggaaggaagggaaagagcaatgctgctgtgcttcaatcctggccttcccctcacagaattcttttaggaagagcaagcttttgtaagtagagtggcaagtgtttttatctttttttttttcctgctcctcaaaatgttgtcttgttccggcaatcacttttgccttccctctttcctgagcctgtagtgacaaagcccggcgatttgggatgaaatctgttgtaacaccagagctttgattacacatcctctggttttgagttattctacagaatcagaaaggctggaaggtgggcttcacactcaggattgtgctttgagaaccagctaatagaccagccgagggaaggttgaattggctgtctttacttttcccgataagccctacttaaatgcagcctgtaattgtataaaggagatgagaaacatcaagagaaatgacatacatgtagctctggggtagcaagaactagacttcctcaatttggattccatttccttctgccatttgcttttaggcaattgagtgtgggtagtgatgagatatcaaatcccttagtgtttccattttgggaaatgaggcactatttttttttttaaaagacaacttacccacctgagtcctgaaacagtttgtctctccagttttctggcctatactctagttagctctgatccaagtttacaggacaacagccttgctttaagccatgtcctgttgtgggcacgataatagcaactgagctgtcacagcctaccagcaggctggtaacacctccagggtctcttggctagagcagatttcttagcagctgactaggacttcagtcattgggaagcctatgaggcctttacatttttggtgtgagatggggaagaaacataaaatgccactttacaacttcaataatagcctgtaatttatatttactgtgtgaatttttagtcctatattttaataatttgtaaattgatctcttattccaagaatcctttgaacttgtagaacatctgggagtccacttccctgtcctcttcctgatccctgctttctggactgtttaaatcctctttgggatggatcagagagtctagagaggccactcataggtccagctgctggcctcctgactctccaaagccttcactggaattgggacatttgctccagccctagctgtgaacatgaccagagacattatttataattcagccatttaagatatacctgtactcaaaaagtcctgtatatttttaaaaagttttatttttcaggtgaacaaaaatacatcctaattggtggggccccctgaggcctgcacttcagcagagccgttggggggtagctactgttcttttacattaccttgtagtctgcagggaggcatggaaaaagtctgcccttcttttatttccctcttcagcctacacaatggctttctgagagagggcttggtaaggtagagcagaaggggagtgaaagagtttccaaggctcttttggtcggcccctcctttttgcagacagtgacatgtggcttctacagctgcccacggcggcttcacatgttgggcacatacagcaatatgtacagtgggagcctgctagccgacgagacagggcctggttggctgaggagcagtggtctgaatagctttatttccaagggttagaaatcagctgcaaaattgtccatcaagttttaagccaggaaggagagatctgtgcagagggggttactttccttcaaaggctttgcaccgggactaccaggaccctttctaggtgtttgcttatattagaagttaacggtgtgcattcatttattccctgacggcctgaacttgaagaaagagataagcctgttttgaaagtgaagttttggggggtggaggatcagggaaggaacccattaggctgagtttgtgagggtatcttcactttccccattaatgttaaggtacaatgaagtgtttctctgaggttttaagcataagaaatatttctcttcctaacagccctagatttccacatggtatgagaccatgttttggaagcttttctgtctaccttgttttttcagttttcactggggaattctgagatagcgtgttctttcgtggagtatttatatcctgtcttgaaatgctgaatgcatagcatctacttgtttctacatgtttctttaaggagagctgaaaggtcaggtcacaagctttaggactaccacagctatgtaaaaggggtaataattgtcctctctttcctgtctacagagaatggaggtatttctggaatttcagttcagtaacaaaagggccacagctatacttttcgttttccatctccctcagtggaaggagaaactgcagtggctttgcctgtttctcatgaccagtactcactcagtgcctggcagtgggtactcagaatttgttgatctctgagttgatcagcacccagtgggtgctgggtgctgatggaatcagccttagtgtcattgtggtgtccctgtcataatctacttgcatacccgtatccacagcccataatctggttcaaggaggtgggttgctaaagaaaacccctgcaaatcatagctgcactgatctctctagcctcagtttttttatttccaagttgaaggactcggccttggccttcctgttctttccgggtgccgcaagtccacagtggtattccatatggtgcttaacggacacaccataggatatgtgatccattcattgtctcctaggtcccagccctgcagcctcatgttaagctataaaaatatctgctctgtcgacagtttttttggttacctctgttttacttgctgacatagcctgtggttttctgctgccagaaagcctgtgttatgctttttgtcccctccagtagctaactgaaaaagcaaacaaacttctctttacccctcacctagactctaccaggctttccaccctaaatgcagaaatacccagcatgggagccacctggtcagtgctcctcactggatcctgtgccccattc

SEQ ID NO: 2706 - DNA, 394 bp, Homo sapiens
ctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaag

SEQ ID NO: 2707 - DNA, 9494 bp, Homo sapiens
atgcggagggttggagctcgtgagcgaaggcgctgaatcctgagggtcagatctccaagaaggagggaggctggtcctagttcccgaggtcctagactaggtctagatcactgggtaaaagaaggggagcggcagcacgtatggggtaggcgctctcactactcacatctcgagacctttgccggcgtagggctgtccggggggaacgacccgccttttccggtatcggttgtcatggcggcgcccagcccagcctggttttttccggtagccaattgaactaacaaccccgttccctttaggactaatctgtcacggcggcgccctacctcttcttccggcccggctcgtcatggcggcgccctgagtagccacttccgccctcttctggctaaattgcttcatccctatttccggcttgccatggcagcgctcggggtttaacggaagtaagcaatggaaagtatggtggtgcctcgggtccaaagagaatgcgccgctgagttgcgcggcacctgacgggattgagcctcagacacaagcgctccaaatctccgactgtagctgatctttcaagactctagtcaaaatgagcagaacattttgcagttaatcatagagttgaagatgaacgagaagatgaacgagagctacttgattgtgaactagtaacgaccacttggagtcgcagtgtgtctgtaaaatgatgatgacagtgacatcatagaggacatagtgcaagtgaacagtttgatactgagcttggagcctcagtagttctggataagtgagagctgtacgggaggttgtaaccatgagctaccctggttggcagttgacatccgaggaccagcactggtcatcgcacagaaagaaaactttacaccttgagatccctccattcttcttaaacttccaagtgtatgtttgatgggagaagaggggaagggatcaacatttaaaggctctggaaggagtcagataactgtttttggcttcaaatgtagaatgaatccctagattttcctctactgagagaatgaaatcttaacccattccgttcccttgttggtactcagaaacggataccccaaagatgcattttgacatgctgaaaggccttagaagctgccttagaagatctgtctaaccttgtcttgttggtgtgtggaagtgggaatgcccacaggtgcacagggagggagtttctgaaattatctgaccgagaaagcaaaaaaaaaaaatcaattgtcttaaacccggtttctagggatctcattaaagaactaggaaaaattaaccacctgttaacagaaaaaccaaactgaaatgttttaaagagatttattttgagccaatatgagtgaccatggcctggggaacacaggctcaagaggtcctgagaaagtgtgcctgagacagtagaattacagtttggttttgtacattttaggtggacaggagttacagacaaagacataaatcagtacatggaaggtacagattgtgttcagctgggtgcagtggctcacgcctgtaatcccagcactttgggaggtcgaggtgggcgaatcgcttgaggtcaggagttcgagaccagcctggctaacatggtgaaaccgtgtctctacaaaaaatacaaaaaattagccagggatggtggcaggcacctgtagtcctggagctactcaggaggttgaggcacgagaattgctgcggaggttgtagtgagccgagaccacaccactgcactccagcctgggtgacagagcatgactctgtctcaaaaaaaaaaaaaaaattctacggtatttttataatacattttgtagtaccacttataaccacttgggtgcgtgggttgcccattaaatcaaacagtttacagttcacccttgaacaacatggatttaaactgtactggtccacttatactcagattttcttctgccgctgtcactctgagacagcaagaccaaccccccttcctctcctcagcctactcaatgtgaaaaggacaaggatgaaggcctttatgatgatccacttccacttaatgaatagtatattttatcttccttacgatttccttaataacagtttcttctctctactttactattgcaagaatacagtatataatgcatataacatacaaaatatgtgttcatctatgtcatcagtaagacttcagatcgacagtaggctattaatagttaagttttgggggagtcaaaagttatatgtggattttctactgcattgtttaagggtcaactgtagattcaacgactacctaggattgtagagttgactgatagcactgggactgatgataacatcataacctgtaagaagtgtcaacaatggtgatggacccccagcaaccctggagtggggatgtctaaagatagatgtcatccaccaggcaggagttggtgctgccagtgtgtcatgtactgcagcctcttttatttatttatttatttttatttattttttgagacagcatctcgctttgtcacccaggctggaatgcagtggcacaatctcggcttactgcaacctccacctcccgggttcaagcgattcttctgcctcagcctcccaaatagctgggactacaggtgcgcaccaccacgccaggctaatttttgtatttttagtagagacggggttccatcatattggccaggctggtctcaaagtcctgacctcgtgatccgcccatgtcggcctcccaaagtgctgagattacaggtatgagccacagcgcctggcctgcagtcccttttactacaacaaatatgggaaagagtcacaggtgtggcatacggtggtggcttctgcgttagaaacataggccaagtacagtggctcatgcctataaatctcagcactttgggaaactgaggtggccagactgcttgagcccaggagtttgagatcagcctgggcaacatggcgaaattctgtctctacaaaaagtacaaaagttacccgggtgtggtgatgtcataggtagtagatttatccttcaaacatcaacaactaaaaaatctggacaaaataggagacaacagagttcagacattggaaacaagcattgtagcacagtggtccccaagagaaaggagacaaatgaagtgaccttagtggcccggcttatgtctggagagttagtttctaggctacatagcccaggggtgtccctgagttgggacaaagttgagaatttggagaggccaaggcagctagtttgtaaggcagggtaccagagagtagcgcagcacagacctgcaaagggtttcctgcacgtgtagcgcacagcatgcctgtgaacacactcctggaaaccaagggaactaccaggaaggtgcaggcagagcaatccccggagccatagtggagaccatcactgtgcactggctaaactactcaaagatactgcctgtctagtgaggcaaaattagccctaatggccgctctggtctcacctaagtaagctcagaaacactgaagcaagctctcagttcgaaggaaaatggaaatctggcatatgaaatcaagatctccagatacagtaaatataactcttatgacaaaatagcacaaaggccaagagacaggaaagtgtgtgctgttgctaagttgttctactacctgtgaagtggtagaatattacataaaagtgtgacaagtctaaagatgtacactagaaattttaagagaaacaacaaaaaatgaaaatggaggtagggttaataagccaacaaaggagataaaaatgaaataatacaaaataaattagccccgcacaagtatggccatctgatttaaaccctgtcactccagctggagtgcagtggcgtgatcacggctcactgcagcctcgactcccaggcttagacgatactcccacctcagcctcctggggagctgggactacaggtgcacaccaccatgcctggctaatttttttagtagagatggggtctggctgtgttgcccaggctggtctcaaactcctgggctcaagcaatcatcccacttcagcttctcaaagtgcagggattacaggcgtgagccagtgcacccggcctatggccatctgatttttgacagaagtgcagaagtaattcaatagagaaaggatcgttttcaagtaacagtcctggagcaattggatatctattggcaaaaaaaaaaaaaaaaaaaaaaaaaaaaatcttgatctaaaccttacactttgtacaaaaatgaactcttaagtggaaaatggatcatagatttaaatataaagcataaaactataaaacctttagaaaataacatatgagaaaatctttgggctaggtgaagagttcttagacacaacaccaaaaacctgtcaattgggcttcatcaaaatttaaatttgtttctctgcaaaatacctgtgaagaggatgaaaagacaaactatgaactgggagaaaatatttgcaaagcacttgtatgacaaaggctttatatctggaatatataatgaagtcttgaaattcaacagtaagaagacaaacaatccaattaaaaaatgaacagcagacatttcactgaagatacacagatggcaaataaacacatgaagagatgttcaacattttcagccattagagaaatgcaaattaaagccacaatgagatatcactacacatctatcagaatggctaaaataagaaatagtgggctggtccaagtgcaatggtgttgcaacaaattgatcacaaccacttacagatttatttgttctttttccactcccactgcttcacttgactagccttaaaaaaaaagtgacatcaccaaatgctggttggtcagaatgccaagaaatgaatcacttatacattgctggtaggaatgtaaaatggcacagccactctgaaaagtttggcagtttattaaatgaaatatgcaactaccatatgacccagcaatcccagtcttgaacacttgtcccagggaaatgaaacttatgtttacacaataacctgtatagtagtcctccttatctacaattttgctttccttttttttttttttttttttttttttttttttgagactctagtcttgctctgttgcccaggttgctgtgcagtggcgtgatcttggctcactgcaacctctgcctcctgggttcaagtgattctcctgtctcagcctcctgagtagctgggattacaggcgtgtgccatcacacccagctaatttttgtatttttaatagagacggggtttccccatgatggccaggctggtctcaaactcctgacctcaagtgatctgcacacctcagcctgccaaagtcctgggattacaggtgtgcaccaccgcacccagccagttttgctttatgcagtttcagttacccacagtctgaaaatatgtgagaacagtacattttgaggccacattcatttaattacagtataattgttctatttattgctgtcagtttcttgcagtgcttaattaaacatcaaaggtatgtatgtatagaaaaaatatatagaggacatatagtacatatagcacatatggatagtgtatatactatccatggtttcagacactcactgggagtcttgggatataatcttcaaagataaagggggactattatacctgattgttcagatcagctttattgttaatgcccccaaactggaaacaaccaaaatgttcaaggtgaatggttaaactataaatatatatgctatgtacatagtatattcatactatggagtactgtgtagcaataaaaaggaattaactattgatacatgcaactacctggatgtatctcaagggaatggagtgaaaaggccattctcaaaggttatacttcgtgatcctatttacgtaagattcttgaaataagaaaattatgaagaacagattagtggtttccaggggttagaaatgggggacagaggtagagatggctataaaaggatagtatggcagagctctgtgatgacggaacagctctgtatcttgcttatgttgctgttttcatccatctacacaggtgataaaatgaaatagaactatatatcacatgcaacacaaatgagtgcatgtaaaatgggtgaaatttgaataagctctgtggactgttccaatgccaatttcttagtggtgaatctacagttaaaaagctaaaaaacattttttttgggaatgtttttagtgctgctaaaaatagaagtggagcgatgacaatagacctcagctgtgggatcattcagtagccagaacctggaatagtgtgtgaaagtgtgtggttgggattcttaacagcagggggaaacgtcagtcagtagaatcgactttttccttcttcttctcaaccagcttcctgaagcaaagcctatcttttctattaaattggttttttcttatgcctccccgctttttttttttttttttttttgagacagggtctcattctgtcgcccaggctggagtgtggtggcacaatcttggctcactgcctggaccttccaggctcaggagattctcccacctcagcctcctgagtagctggaactacaggcatgtgccaccacaccaggctaattttttttgtagagctggggtttccccatgttgcccagattggacttgaattcctgggttcaagcaatctgctgagccaaagtgttgggattatgggtgtgagccaccacacccagccttttttaatttataaaatagagacagggtcctgctctgtcacccaggctggagtgcagtggcacaatcttggctcactgcagcctcgacctcttgggttcaagcaatcctcccacctcagcctcccaagtagctgggactacaggggtgtgccactatgcttggctaattttttttgtcgttgttgctttttttgtagagatgaagtctcgcccaggctagtctagaactcccaggcacaagtgattgctcctgcctaggcctcctaaaatgttgggattagtggcgtgagccactgcgcccatcctgctaagcctatcttgaaatgatagatttttctgtctgttcctatctgccttataattagtgacagaccatctgaaccaaactcaggaaagaattaccttaggaaagctttcatcatcaaaaaacatcttataattgcagaagtatatacaagatgatctattatcaacagtttataatggccaaagataagtcaccagaatatttgcagaaaaaagttataatggccaaagaatggaacaacttaaatacacaggggatggtaaatccatacaataaaatactgtacacaagaaagaaaacataagtggcactctacacactgctatgaaagcagatcaatataaaagcagaaaaaagccaagtatggaagtgtagactaaatataaaatactcaccggaggccaggcacagtggctcacacctgtaatcctagcactttcggaggccgaggtgggtggatcacttgaggtcagggtcttcaagacagggtcttcctatattacccaggctgtccttgaactcctgcactcaaatgatcctcccacctcagcctctcaaatagcagggactatagatgcacagcaccatgcctggcttccaaaatggatgaatcttatttcactatgctaagtgaaataagccagtcacaggacaaatattgcatgatcccactatatgagatatctgtaatagtcaaactcatagaaacagggtagaagggtggttgctaggggccagggaaatggagagttgttcaacaggtataaagcttcagttatgcaagacaagtaaggtctaaagatctgttgtacaacatggtgcctggaattaacaatactatatcgtgcacttaaagatttgttaagagggtaggtcttgagttaagtgttcttaccacagaagacaaaacaaaaactcaacagcaaccaaaaagcaaaaaacaaaggggcaggaggaaacttgtggagatgacaggtatgtttattaccctgattgtggtgatggtatcaaaggtgtgtgcatatagtcagacccatcaaattgtattcattaaatatgtaacaactgtacttctataaagctggtaaaaaacactgtacctgtttgtttttacttcaacgtggctataagaaaatataaaattacattacagcttgcattctatttgtatagtactgtcctgctcaagatggattaacaggtgtgtgacactcactgcctgctgagagcagggtgtagggaacctggggttggaaaggagacttgtcaccgtatgctcttccatttatcaatatttcatattttgagaagacatgaactttttgaacaaagataacagaaaatcattgtcaatagttaatctaccagagagattcagaaaccttgcatacttggttttcaggtcttggttgagagttctaacaccgttgaaaaatctcaagagtaacctggtaatgatatcttcattgaattaaaattacattttgctttaatctgatagtcctcttaatccaaaaggtcaacatcaagttaaacaacatccagtttcactttgatgttcatagctgccagttcagctacaaaataccgaaaaacataaggcacagaaacagtatcgatagtgtcactgcgactacacagagtacagttgtattttctgttgcgcatggcagaccaagaagggggtggcttctccaacagtggagagagtaaactgccacacttcacacacacatgggctaccgaccgatctgagcagttgaagaggcggtcatgaaggagaaaagatgtaccatgagctaaaagcgcatcccgttccatctccccaaaacggattccaccctggacatttcttcccccaataggctggttggtgactctgtctcgggctccagttgtccttacttgaaatttgtctgagaccatatggcgtaagcgctgataataaaccactcctatgaagatgtctgcttccagttctagcccactgatgccactatataacctctcggtgccatagaaattgtagccagcagcctttaacatctcaccaaagtattctaaggccgagttctcctctgagaagatgaagggtgtagcatcatggcagagaccatgcaaagctgcagacttcccggccatactctcaattaacatcccaatggtcatgcgggatggaaaaccatggggattgaacagaatgtctgggaccatcccactctcagtaaaaggcatgtcctcagccggccacaatctgcttaaaatgcccttctgcccatggcgactggcaaatttatctccgatagttgggttccgaggcactctcatagtgatgcaaacacacttgaattttccactcccagtgtcattactgcacactttgatgttatccacaacacaattttctttactcctaggaaaaagtaaaccatataaggtcaac

SEQ ID NO: 2708 - DNA, 1480 bp, Homo sapiens
ttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacatatttgccttttcatcccatctagcaagcacagtgttaattttagaaattatagaagaaaaaatcagcaaggagtgtgggaaaactgcatgccccaggcctcccccgccccagggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggttt

SEQ ID NO: 2709 - DNA, 423 bp, Homo sapiens
cccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcctaaaataacacccacg

SEQ ID NO: 2710 - DNA, 4926 bp, Homo sapiens
accccggccgacctacttgaacggacacttctgtttctgttctttcgcgccctgcgccttaaaagggtcgcaaaacatcaaatcagatagggatcttagacttctgttgctcaagtgcagatgttccccagataaggaaataggcccagagaggttaatgatttgcccagagtcacacattcttggtccgccgatgtcaagacaaaagctggcgaacgggggaggaggagtgaggggatagagtcaccccaggctttctggagaaggtaaattccaatctgcccttgcggggcgagcaggatttgaaccggcagagatgaggaaaggcaagaggtgcctgataagtctttctgcttggcatagcctcagtctatctgcctcctgtggttaggccccagctgaccaaccacccagagatggcttccccccgccccacacacccagttcctcctgcccaaagggtggagggcctagaaaagctgggttccccctccaggaaaggaagagaaaaatgatgtgttggttataaaaacagcattgcgcacacctgcaaaaatggctaaaatgaaaatgatggaaaatgccaagtgaccctctgagactcccctacactgctcaggggagtgttaactggtgcagccagccacttgggagctcttcggcagtatgcacgtacgtctccctgtgacccacaatcccaccccaggagtgtgcaggagtagacgggctcagtataatgaagtctcctttcctaatggtgtgaaagtccatgttatttctcttcccgttccagtgtgcagttctggagaagtacttacaattcaacatgagcagggtgggttgcttaagaaccttctgcaatattgaacaattatatttttaaacacttttatttcaagatttgatattaattataatttatttggcttttattttactaggcaattttgaatttattttaatatctttaaatgtgaaaaatcattttaagttttacttttatttttatttagatttttattaaaatgttgaaattctatatcctttgaataaaactattttatttctaaaaaattccttagatcaataatgtctcatccattttcatgttaggacagtcctgaaaggactccaaatccgttcttccctcctccccgaccaattcatcctccccactgctgcttcagtcattctttctttcttttttctttttctttttttttccagacggagtctcgctctttcacccaggctggagtgcagtggcgtgatcttggctcactgcaacctccgcctcccgggttcaggcgattctcctgcctcagcctcctgagtagctgggattacaggcgtgcgccaccacacccagctaatttttttatttttagtagagacgaggtttcaccatgttggtcatgctggtctcgaactcctgacctcgtgatccgcccgcctcagccttccaaagtgctgggattacaggtgtgagccactgcactcggcccagtcattatttctgaaaggcaaatctgactgtgtcccttctcttctcaggacacttcagtaggctcttcatggcccttggaagaatttcccaaacagttttcttttgaaaactgtgtctgcacaataatgataatagtttatgtttgttgagcactcactatgtaccagttagttctaatttatctcatggaatttattcaccaatttagtgagataggttctatagttattcagaattttcacatgtgggattcaagggactgagatatcaaacagcttgtccatggtcacacaactaagtgagtgttgggccagaatgtgagctgggggcagaggcagattttctacatagctaatgaagcttcaagtgagtttagcccctttctctgttgggctctttaagtgccctgcaagaggccctagtattgtgtatgtatgatcatatatttttcttgctttattaaagttcatttctttgagggaaataaattttgcatacattaaaatgaacaaaaatgtatagttcaatgggtttcgacaaagcaatatccttttgtaaccccaacaccaagcaagataaagaacattttcccctgactccacaaagttcccttgcatgtcatcccggtcatcccaccctccacaaccaggcgatcactattctcatttattttcctcttagatctagactgttgtataaatgaaataatgtaatatgtactctgtgtctgatgtctttaattgaccataatgtgtgagagattaatccatattgtttcacatatcagaaacttgcccttttttgctctgaagtatcccattgtgtgaatatactataatttattaatttattcactagttgatagacatttgggttgtttcatattgtagaccattatgaataatgctgctgtgaacattctcatacatctttttttgtagctatatgttttcatttctcttgggtaaatatctaggtgcggaattactgagtcaaacaatagatgcatatttaattttattagattgtcacaagtttttccaatgtggtcgtattattttatgttcttaagagcaatatataagagttctagttgctccacatccttgttaacatttgatgttgccggccttccagattttagctattctaatagttgtatctcattgtgacttgtatgcattttcctggtgattaatagagttgattgtgttttcatgtgcttagtggtcatttgtacctcttcttttgtgaaacatccacattttttgtctttgctttttaatattgaattataggagatttagatatgctggatacagtcctttgctaggtacatgtttcataaatattttcttccagtctgtggcttgcctgtttgttaatgatggttttgataagcagaaatttttaattttgatgaagtctaatttatcaatttgttttttttctgggttctaaaaaatctttgcctactctcagatattcacccatatttttgtccaaaattttagtagttttatgtttaggtctatgatgcatcttgaattaacttttgtgtatagttttaggtaagagtcaaagttcattcttcccatatagatatccagttgctacagcatcatttgttggaaaaaagtagggcttacaaaaaattactgccattgatcagctctagtgcctttgtcaaaaataagttcaccatataaggtggacctatatctggggtctctattctgttctaatgatccatttatctatcaatctttatgctagtatcacacttccttgatgactattgcttgaggataattcctgaagtcaaataatgtatattgtctaccctttcttctttttcaaaattgtttttctattccaggttctttctatttctatataaattttagaattgacttatcaactttgtaaaaatacctgctggaattgtgaacctgtagtttaatttggggagaattcatagtttaaagcactgaatgcattttgataaatatattcctaagtattttattctttgagtcttgtgaatgttattttattttccattgatttgctgttaatgtagagaaatataattgattttgtatagtgacattgagactttcacttattagtgctattatttgttttgtaggggcgggggttgtagattccttaggattttcttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgattccttaggattttctgtattaatatgcatatactttgtaaatagaatcagttttacttctttctttccaatatttatgcctttttcttttacttgtgtggttgcgtagtctaggtcatcttgcacaatattgaatagaagcagtgaatgaacatcttgccttgttcctgatattagagggaaaagtgttcaatgtttctccatttagtgtaatgctaacaaattcaacttggttttgtctttcttatattctgctggattttatttactaacatcttgataaagatttttgcctgtatgttcatgaaaaatgaacatacaggcaatcagtgtattgttttcttttcttgtatctttgccaggttttggcctggctttataaaatcagagtttctttcttctctattttctgaaatttcaatatttgtaagattgttatcatttcttccataaccatttgatagaattcaccagtgaattctggagttttctttgtggaaaagtttttttgcagttgcagagccatccatgctttctatttcatcttttgccacttttggtaagttttgtttttcagggaatctggccatttcatataagttatcagatttattgttttaaagttgttcataatattccagtagtattatttgaatatatgtataagatctggaatgaaatctcctctttcattcctgataccagtaattagtttttttctctccctctcttttcttgattagtcttgctaaaagcttaccaattttatcaattttgttaaacataaaagttttgggtttgttaatgttctctattattttgtctattttctattccattgatttccacttttatctttataatgttttcctttttacttactctgggtttaatttgctcttcttttttagcttctcaatatgaaaatttataagc

SEQ ID NO: 2711 - DNA, 2841 bp, Homo sapiens
caatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttc

SEQ ID NO: 2712 - DNA, 4443 bp, Homo sapiens
actttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaataaagcgagatgttgccctcaaacttcacctggccccggtcctggtttgctaatggctgtgggtgggggttgctgtgggtgatgactgactggatacaaaatcctaagtggcttcatgaaattttgcctaggactggactgtctttcttttaactgtgaaatgatggttctccctaacgtctcctcaaaggatacaagaaagttgttgttgctagtagaccgaggggtgggaatcactgaaatggaaaatctagatgacagtgctggggaagagaaaactagaacagctcagttgaagacaacctttactgcatgttgacgctgatttaggcaatagcttcctaaaaatcatgtataaagttagttagttagacatgaaatctcttccccaatgttgatacctgcccacaaaatattctcaccttcagagtataagaatcattcttaaagccaaatattcagttcaaggcacatacgtcatctgcagttgtaaatttgcatttaatatttcacaattcctgtaagagaggctagtcaggagggaaaccctcaagtttaaatccccacacttacttacttactgctcatccgtcactttcgctaagtgagattaataattcagtagctggtccagaacgcacagcttgggaacgcagaggcccaggcctcatgtaatttcccactcccgtaactgaacgtgctgacccatgttgatgtctgccttcatccaggtggcaaatcagacatgctacgctgcccccttcaaacgagttcctcgtgttaggggcaaaggtcacagccaaactctgccactgacagccagtgccttggcctggatcctctctgtggatgcaggcctacccctcctcagtccagcctcatctactagaccagcttggccattcacttttcagatgtctgtgagcagaggactgcagactgaactctcactcaagttcttccatttgccaagcccgaggccttttccggctaaccagccctctctgcgctgtcttgtctcctgactcccaccctcaccattcacagaccatcacgacacagaggatgccatgttcttttagtaattcaccagctccatgcagggacatcacagggctgccctccatgagcagaggaggagggctgcctggcagagcgtttcacactccaggttagccagaaagagcatcttcatttttgtttccacacaacacttctctgtgagcctgttggccaacaaagtggcggccgattgttggaggagccagccaaccatcttgtctaacttcagattcttcagggctagaatatgttcaccccagaggcttagatgaagcacatttgcggctactcgggcagatggtctctgcaacaggaagggaagctgtagctagaacatctgttaacacagtctcaacccaaagcctgctttgttagtgagggtcttcccttctctggtcccaacccaattcttcctctaccctatctcctactgatgcccttcactcaggtgacaaatactgcctgtcccctgcccgtgctccaagcttttccatgtgtacacctctgcatggggcagcatgcattgttgaaatagcctttccccctgggtggaaagcctagtgcctcttgtgcacagctatctggtcccttgaaccaggtaagtagtctcctctatcatttcataactggttgcagctgttgttctaaccttcactgcgcaccaagatagcaggccacgtacagagagcagttaacggagtggcagaacagtgctggggtgcaggtatggctcagctctttgcactaagcctgcccctgagccagctgccactccaattatggcttcggataggtctgcctttgcattcctttatattaatttcacaatgtccagatctgctctcaggagatgttttccatctctctctgatcagttctcagctgcttccatgagctacatctccattaaacatttctcaaaaatgcctccttttctctctctgaatagccttttttttttttttttttttttgagacaaagacttgcactgtcacctaggccagagtgcagtggcgcgatcttggctcactgcaacctctgcctccagggttcaaacgattctcctgcttcagcctcccgagtacctggaattacaggcgtgtgccacgacactcagctaatttttgtatttttagtacagacggggttttaccatgttggccaggctggactggaactcctggtcccaagtgatccacccgcctcagcctcccaaagtgctgtgattataggtgtaagccaccgtgtctggcctctgaacaactttttcagcaactaaaaaagccacaggagttgaactgctaggattctgactatgctgtggtggctagtgctcctactcctacctacattaaaatctgttttttgttctcttgtaactagcctttaccttcctaacacagaggatctgtcactgtggctctggcccaaacctgaccttcactctggaacgagaacagaggtttctacccacaccgtcccctcgaagccggggacagcctcaccttgctggcctctcgctggagcagtgccctcaccaactgtctcacgtctggaggcactgactcgggcagtgcaggtagctgagcctcttggtagctgcggctttcaaggtgggccttgccctggccgtagaagggattgacaagcccgaagatttcataggcgatggctcccactgcccaggcatcagccttgctgtagtcaatcactgccctggggccaggacgggccgtggacacctgctcagaagcagtgggtgagacatcacgctgcccgcccatctaaccttttcatgtcctgcacatcacctgatccatgggctaatctgaactctgtcccaaggaacccagagcttgagtgagctgtggctcagacccagaaggggtctgcttagaccacctggtttatgtgacaggacttgcattctcctggaacatgagggaacgccggaggaaagcaaagtggcagggaaggaacttgtgccaaattatgggtcagaaaagatggaggtgttgggttatcacaaggcatcgagtctcctgcattcagtggacatgtgggggaagggctgccgatggcgcatgacacactcgggactcacctctggggccatcagacagccgtttccgccccgatccacgtaccagctgctgaagggcaactgcaggccgatgctctcatcagccaggcagcagccaaaatctgcgatcaccagccaggggcagccgtctgggaaggagcaagcaaagtgaccatttctcctcccctccttccctctgagaggccctcctatgtccctactaaagccaccagcaagacatagctgacaggggctaatggctcagtgttggcccaggaggtcagcaaggcctgagagctgatcagaagggcctgctgtgcgaacacggaaatgcctccagtctctgtgcgcgatgccctgttgaaccagatggtccacgccttccagcagctgcagcagcatcatggcggcgaggcgggggctgggtgtgttcacacaaagtctgcagtggagaggaagccacgatacttcactggggccatgaggagccagaggtgagcaggccaaagggaagcaggaacaggagatgcgaggaaagaacagcatgtggacagtggaaccacgttcctacaagttcaagaatcagtaactgatggaaattcccgtggctcactcctgtaatcccagcaatttgggaggctgaggcaggcaattgcttgagcccaggagttcgaggccagcccgggcaacatggagaaactctgtctctacaaaaactacaaaaattagctgggcatggtggcatgtgcctgcagacccagctacttgggaggctgaggtgggaggatcacttgagcccagggaggttgaggctgcagtgagccaagatcacgccactgctctccagcctgggcaacagagtaagaccctgtctcagaaaaataaaagaaaatttgagtttgc

SEQ ID NO: 2713 - DNA, 3813 bp, Homo sapiens
gtcgctctccgcccgccaccagtgcatgaggatgggcaggaaggacaccagggccgagatggcccacacggtgcacacgaggccccgcgcccgcgcgcgcgtcagcaggctctggtagcggaagggcgaggtgatggcgaggtagcggtccagggcaatgacacacagggtctcgatgctggccgtcacgcacagcacgtccactgaggtccacagctcgcagaagaaggagccgtactcccagcggccccacaccacgatggtggccccgaacggcaccaccagcagccccatgaccaggtcggcgctggccagggacatgatgaagaggttggtgagcgtctgcagccgcggcgtcttggcgatggccacgatcaccagcacattgcccgccacgatgagcagcacgatgagcgccatcagcagacccatgcccgctgtccactgctgagacagcggctcggggctttcgctggcgggaggcagcaacgaggcgggcggcgacgcgggcaccagcagccgcgccgcggtggccgcgccgtcggggagcggtgcggccgacgacaggttaccgggctcggaggcgcccaggacgagcacccccgcgcccatgccgagctgcggaggccgggggcggggggtgtggcagggctgggccgtggttggggaacaccccagaagcccgggcggcgtggtgcgcagagggaggtcgcggccgggtcagggcagccgcggcgcggggccggaggcatgggcgccgggcgcctttcccgcaggagccgagcgctgtcgctgccgctgccgccgccgccgccgccgccgctgctgctggagccgctgccgctgctggaagagccgccgggacttcagcatgtttctgagcgcgccgggcccgcagctccggcacccagcacccaccccaccccgctcccactccccaagccaacccccggggcctcgcgtcaggctcctgcagccaatccgggcaaaggcacgcccccgtctggtctgcacccccacctccaactccccgcacccccctcccgttggcaattgagcggctcctgagagtcccgagctgatcgcgtagctagtgcctcccgtgcgcccgcgggttcctgcggacgcaccccttcctgcgcccgctggttcctggtccctgttcccccgcgcccccttccgcgcctggctccccccggggccccgtcccctccctcagcccccactcgctcccgcacccactcctgcgccccgtttgcctcccgcacccgctcctgcgccccgtttgcctcccgcacccgctcctgcgccccgtttgcctccagcactcggctccctcctgcgcccccgctccccccgcatcccctcgacctgcagttccggggttctctgcggaacagagcgctagctcccttgagcggggaggggaccttggtgttcaggaagcgccagagcgcctgggacagcttgtccgccaggcttggaggagtttgccctgcgagcttggttgtgatgtggggcagcctagcagggtgtgtgtaaaacccttcccccgtcaagacgggacccagccagcatgcgtcgtgacagcttgggggattggaggtgggtgttagtggttagaagaaacttcccagcagagcgggttgctggagccaagcgcgcatctgtcaagaatgctctctgggcgctgttcttgcaaggatcctctgttgaacctcgagtgcagtagatgtggaaaggaagcgaaggtttgtgcatctaacagctaacgctgagggccctttggaatcgtacacactcctcagtcctagctaatgaacgtgtgagcatgatgcaaaaatgtatgctcatgatatgaaaggagaggcttagggagacagaaacgttgagatacagagtaaacgataccaccgcgagggggaaaaaacgcgtttaattacattttagacttttcaatgataacacctgtattttgtgttttattactcatgtgattttataatttgagctgggtcaatacaaacaaaaaggtactgtcagtttatgctgacgtaatgaactgcgatttcagattccttggtctgcgtgcttgttttctcctttgcccaagttcccagattctcaaaactctgagattagttttgaagggatgagacaagaaaacatataaatactccagaggattaaaatccaaaagcatttaaagttgtatctgtggttttttttttttttttttttgagttggcaaatgaattgctttgaaattagtgagttgttaacctggcaaaaaggattatactgggggtgaggggacaagaaagccatgaatatgcaatatggcaggactgcaagccccttctctaatttggctcctgtagtgtcctcagctcaggcctgaaataaaaaaaaaaataaaaaaattaaaaaaatctctaattgagtccttgaggagtaaacagcttctaattgtttatgtaagggtgcatgaaaatgttatataatgctcacaggtccttctagcattggaataagaacagcgcccgtaacgaacatcatgttcgttgatggtcatcaatatgaccaagctcatatccttaccttgcaaggagagaccgacttccacagctgtccaggtcaaaagcaaaaagtaatgtttttcaagtttatataaaatcaagcagttttaaccactttctcttacataaatgcaaacatatgaatttgctttaggcccaaacctcagcatcagtatgttaaaactggggagtgatttgtttattcaccccctgcccatgatttatcagctgattttccaacttggggaggttgaggaggagtggccaggaaacaagaggcgttagaaaggggaggaaggagactacaccccaagttatccaagtcactgaaagcctgagactcctggcttctttctttttatttttttgagacagagtttcacttttgttgcccaggctggagttcagtggcgtgatcttggcccactgcaacctctgcctcccgggttcaagtgattctcctgcctcagcctgtcaagtagctgggattacaggcgtgtgccgccacacacggctaattttgtatttttagtggagatggcgttttaccatgttggtcaggctggtctcgaactcctgacctcaggtgatccacccaccttggcctcccaaagtgctgggattagaggcatgagccactgtccccggcctcctggcttccttctggacccacaaggggcagtctcaaaatagccaagggattggaagaagttgaaattgacgctgcccaggaaaggagttctgagtgctgagctgcagggtgaggcatagggaatgtggggaagaggcttttccttgccatctttctgtcaagtggtgttaccggaatagagtgtgtcaaccttaaatgcccccgaagggtggaaggcattgcttttctgtgtgcgataaggccagaacttggtcgtagaggttcagggcagaagccagattgccagtaactttgccgtatcatcattatatatataaacacatcgtgacattggaattgttggaaaactttcctgaaactttttttctctgctcattcagagatacatcaagtttctccgaatttctgtataatacattaaattataaaccctcgaaaccagaaggttattctagcaggagtaccagtacagggatctcaggaattctgggggatttccttcaattttactgacagaagagtttggaatagtacatgttcaactagagttggttgtctaataaaaataaaatgttctcagaa

SEQ ID NO: 2714 - DNA, 825 bp, Homo sapiens
cagaaatgtggctcaaggagcatatctctgaggatggggccggatagtgtcttcgctgacaggataggaattctggagttctccgctctggggacggaggaggagcaagaatgctccgatccacgccgctaagaaagtcaaacccgaagttctcccaccctccgcagaacacccgatactcacgttcgccctcttggccgcttgcatcgccatcttggcgggctgatgaagttaccgtagcagatactgaaattcctccggagctcgctcggcttcgggggttacaccgcgttagatgcaggacatcaacatccaggacccgccggaagctgttacagcggaatagcgccgtcttacgctgagacgcgctgacgtagcagcccccttcgaatagactccggggtaaaaccgagcctgagcgagactcgaggccggaagatggaaaggcgagagtccaagacacttccgggctctgtaccgtaaagggcggggcgtagcctccaaaaggcgagatgttccggtcggggaggccctgagcagaggaacccgggtggagagggcggggcctgaggagggcggagagctggggcgggtctcagctgctccaagcttttctgccatttgaagcttcttctgggagccagctgtgaccagaggaatagctccagccatccgggtgagttggatagcagctgtgcccacaccactcagtcctgcatggattagcacatagtctccagcctgaacatttcctgtgacagaaagtacagggttctctttactttgcaactgctacacattccccacacaggcatattctatcaa

SEQ ID NO: 2715 - DNA, 1206 bp, Homo sapiens
ctgggccacggggcgatggcgcgggtaggacgcatccctcagaggccaggaggagcgcgagaaggtcccaggacccccttgggaggcgccgctcccgagaatgtagagcctgggagataccaccgcacggaatgggggtgattaaggcctgggcggtaccactagaagagggacgaggggaggcccgggtagtaccgtggactgaagggaggcgcgcggccaataacttatttctctatatacagaagcaacggccgggttgagtcgggagggagggcgagggtgccgaagggccggcgagtgcttagtgttcttggctctggggtctggggaggccaggccactgagtctatggtggagactccagccggcacctcctgctggcccgaacctagggaagagggccctgctggaaggaataaataagggatggagctggagtgggcaggcccagcctccagggctcaggctgagatgacaagggagaaggttaccctgagattgaacagaaaagacaggggctgtgggagagacaggcgggacaagcagcaggcccatgcgcagggctggggtgaggggggtgtgccaggtgggcgctctggtgactggctgccccttcagcattagcccaccagggagcttcgtcgggagaggtccatggagctggagctgagagtgcggctgtcagagagacctgtgcctccaggctgtgggcagagggggcaggtggctcagccctgtgctgctgccagtctgtgcctccctggcctgaaggggtctgacctggcagaggcagccggaatccctgagctgggcagaggcaatggcagttctgacccaaggccacaccctggtgccctgacactcccgtccatctccacagtgacggtgttagcactggccgtttacacgtccacccccaggagaggctgggttcccctcgtgtctccccgttgtccagcccaaagtaggcctgagacagagccaggaactgttgctggatgaagaggcatgctggagggaagcttggcagcacgcatgcagccccggccgcagctgcccagtgcccagacacccgcctgcccctacctgggtcggctcttccacgctcttgttgaggaagttgagggaactggcccgcttcatcctgagggaaaaggacagcctgggatttgcccaaggaggaactcacgggagatgggggca

SEQ ID NO: 2716 - DNA, 1618 bp, Homo sapiens
cctcagtcagatttcactttatttgtatcgatgacaatattaactcttcagatttataaaatgacaaaacttgataattacctggaaacaatttattattaactaggttaaccctaaatccatcaagaaaaaccacctaacatattcagtgttaaaaagagacattacgactagcctggccaatatggcaaaaccctgtctctactaaaaatacaaattttagcagggtatagtggtacgtgcctgtaagtcccagctactcaggaggctaaggcaccagaatcgcttgaatctgggaggcagaggttcaagcgattcccccgcctcagcctcccgagtagctgggatcacaggcatgcaacaccacgctcggctagttttttatatctttagtagagatgggggtttcaccatgttggccaggctggtcttgaactcctgacctcatgatccgctagcctccgcctcccaaagtgctgggattacaggtgtgggccgctacacctggccccaatctggtactttcaatgttgcctataaacagatttcagctgaagctcagatggtaaggttaagatgcctggggactgggatggatggacgggcaggagggttggaagagaagtaatccaattagcattgaaaataagagcgccaatttggaaaatcgaatgtctatgatcattttcttccctaaaacagggaagaaagtgaatgtggaaaatccgattttcagcaatattcgcaggacctaaggcaacaaccacatgcctggggcaactatactttccaaatcctgaatattaaaaaggttttcacatggtaatcatcttaatattttctgttttttagatgaagttttgctcttgttgcccaggctggagtgcaatggtgcaatcttggctcacctcaacctctgcctcccgggttcaagcgattctcctgcctcggcctcccgagtagctgggattacaggaatgtgccatcacccctggttaattttgtatttttttagtagagatggggtttttccatgttggtgaggctggtctcaaactcctgacctcaggtgatccgcctgccttgccctcccaaagtgctgggattacaagcatgagtcaccgtgccaggctaattgtgtcctttttaaaggaacaaacaatttgactgttgtgcaaatgaggcttacctggtctgaatatgaagcacctgccctgggctgctgtctcagggcaggaaagtggggtggtcagaaaggcagccaacactgtttctgctgccactgtcactaagcctggagtgcccgttttcaactgcagtgatctggtccctaacatttagcctaaacagtgagctggtaaacaaagcccctgccagcagagaaaaggggctctagagctgttgaaggattggccaggccggttcttttcttatctctgttgttctcgaggaaattcctctaaggtgagccaaggtcagtggctcattttaacttagagtaactctctggggactctaaccagacttccaacagtgctctgggccccttagtaagttcccagggaagcagatgaaactaattaggacatggcccaccaaaggcgacacaagcattttc

SEQ ID NO: 2717 - DNA, 4209 bp, Homo sapiens
agagagatccatcttaggaggagggtcgtcagatccaggcagcagagtccgggagatagccattctcaacagcgattccagggatctcagggtacttttctcagaaagcccctatgatctcttttacagactctatggtggccacgcgctgggtgccacatcctctttctgcccccggcctctgcctctggccagggtttccctggggctgccgaagccactttgggagcttccctttcaccctccttgctgggccaccagtgctttgtgttcgcagcgttatttgcagtggctttggggactcagcagtggcaagtccctgtgcataatgtgaacctgcagacttcaagatggggcccctcctgcacccactaacatgtctgcctttttttgtttttatcctggaacaagtggagaaatggcagagctggctgactctggggacccttccctttttcccatggcttcatttcttcctcaccacaactaattcggggagctgagaagtcacacagggtattcctctcccttctctgatgttattaattaatagaccagagaataaggttgcagatattacatttgttgtgtttttgtgttttgtttttttttttaaggaaaatcccaaacaaagcccagcatgatttgagaaaagaggatgttttcccagggaaaataatttttttaacctgcctgagaatgatttatttatttgttggaggccattggtcagacagcctggagcttgggctgtggaagatttcaaaagcatagggctgtggtctctggaaacctattacagcctgcagctgtgagctgagccagtgacgaggtccctggaaactcaggaaggctgacaggtgggccttggggtattggtttgtggagaaggaagcattctttaggctgcggcactccttatagtttcccacccaccgagtgacattcaggcagaaattgagctcaggagacagccagccttcccacatcccacttcacttcccggtccacacgtaaagcagtgtgtctccaaggaggcagtgagcaattcccaaggtccccgtgttgtgagaagcgcgctgctttctccctttgcaggggaaaaaaaaggctttcctggtgagatcatgagtccttccggcttcatttctcattgtgggtttaacttctaaaacgcaaatggagtttagagaggatgagcagaaccacaggacctgcccccatctctcactcactgcaattgcttctactctgggcacaagtagggtgtctgaagaccatgtttccctctggttctctagtttgcagataacacagaagacactggctagaaccttaagctttctgccaaaaagatgcagagagcagggcagtagctactggcagtggggtgtgaataaagagtcctttcacaaccaagttcactgaggatttggagcaccagcttcccagcagtatcgaggggtggagaggtgtacattcaggtggaggggtacatctaggggtggagaggtgtacattctagaaacagctgttaacacactccactttaaagacagcaagctagacctgcaggatcaaagccacacactgtggtaggggttacaaatgtttatggggcccagaatactagcatagatgcgtgaaatggttggtgtgaggcaaaagggcatggtgggggcaaggatggggactgtggtcttactggcatgcacgtgacctacccagaatgagcagctgctactcagccccaacctgtcattgtttgtaaaaatgtaagcacagtgtagtggaatcttccaatttggaagggaagccggaaatccagatttaatggaaaaaatctgatttttcaacgtcgggttgtttgtttgtttgtttttgttttttttaacagatagtgggcaaagaaaaattccactgttccacgtgtacactgccagcaacctctgctctctggagaggtggtttaaagtgagattatgcattgccctggtagaagaggaaaaaagccagcatcaggtcagggcaaaaataacagcccatgttgaactcggaatggggacctcttgctaagtcattccactcctcaagagaccattccacagaggggggatggatcattcagctctcctggtcccaagattgtgctgaagggaagaaggaatagaatctggagatctggactgctgccccttagatatgcagaggtccacatctgcctggggctacagcttgtgggactccatcaaaccaggccgaaatggcaaagacagtctaggaggaggaggaggtagggtgtgaaacagccaggctctctccaaatcccaagtgttgacacagccatcttgtcccatccctggaagcctctttggaaaccacatagagctgtgctggctcacgggatgtcctgtttgcttctgcctcagttaccttactttgcccatgggtctaccacaggcgctacctcattgtgtctgctgagaagtttacctgggaggggggaacaaagttgtccaaatctgcttgagctgaatgtatgatctatgcaaattctctctctcctctctctcttcctctctggctctcttagaagtttttttgttttgttttgttttgttttgtgtttaccttgcaaacaagatactgtataggaccctcttaagatggaggagggctttcttgcgccacctgtgtctacccctcacgttgtctttggctctggtcttaccaggcgtatgcagggagaaagtgacctctcttccctctccacttggctgggaatattccaactgcctctgcctacagataccaccagaaagcgggttctgcaccttgtcatccccctccctaacgtcatctactccatccctcatgttcctccaacttgcttctcccatccctccttcaaaaacaaaacaaaacaaaacaaaagccttaggtttctcctttttgaaatgtggccttaacattatttttgggaagctgaccatccatcctttccctcccatctccaccaacatcagagaagacagcatcgtgaagcttctgtggcagcctcctaaggaaggggctgccaatctgtagttggcagatgctataggaattgcttacaaatgtcgtctttaagaaaaatgttcttatatttttcctatgggcaaaatgaaggcttgggtgctcatctaaagctcagccaactcctgaagcactctctcagagcatactgctgctgtaatgggctggcttaattatcggcagagtgcttgaaaaggctttgcagacctcccctgcccccaagactgggtgactttatatgtacttcattcaagggtaaatcaggagacgttctccatttatctcttcgtccttcctgcctggaaagtgatagcactaaatattcccagcagatgggtagtgttctcaaaggaatcaccctttccctaccttcagactctattctttacccttccattgctccagtgctgatggaggccaaagacaaccccagggttttcataggaaattcactggaattgtgcgcaattgtctttgtagtccttttgccttttttttttttaaatattatgttgtcaatagcatttgtttgggtatttgttttagaggcctcactctaagttattaccgtccccttcattgttttcaaagacatgtggtgatatagtttttaaaaataactattttgttatagatcataatatgcataaaactgtacagaaatattttgtaatgtgttgattttaaaaaaaatctgtaaataaagttttaaaaaaagaattcaaatggcacacgctgaaatatgtagatattttgctatttatttaaaggagtattttaagagatattgaactatctgaaattgaccagtaatcaaagttccaatcatctgaatgcttttccttgaggtagaatgtgagtctcagaaatgactgcattacctgcccttttttgcaccttttctgtctttttattttgcagaacaacaacaacaacaaaattgtgccttagctgtatttttttgtctaggggagtttgtttctgtctgacaaagcaacattttttgcagaaaacagtggatgtattaaatactgtatcataccaaaaacactgcaggtgtatatagatgctttctgtcatactgtgttttcagatgcagaattttaaaattaaaaaaacactgcctttatggaa

SEQ ID NO: 2718 - DNA, 535 bp, Homo sapiens
cggcgcgggcgcaggcgcgcagcgcaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcaggg

SEQ ID NO: 2719 - DNA, 3026 bp, Homo sapiens
tttttttagattggcttttagaaaagataaaataaggcatgattttcttgttaaagttcatattagtctatttattgtttatctcctttttataaaataaattacttttaaacacccctgctaatatttcaggatattattcacttacgtagaggtagttgtgttcccattttgcttctgttccatttcctggtgttattcatgtgtgaagagaatctttttggctgggttggcctgcctcaaagctgctccaaacttataattcaccaaaagtgacatcatcccagccaccaccaaagaattatgattggagtcgaggcattgcccatggaacacataactctgcagtggtttcccctacaaaatgtcagccactcttacgatggaatgtgcccttgcctgctgtgggcaccgctcaaatctaacccatcatttttcttttcattttgattcacttttcctttcagagattcaaacaaaaagaaaaatgggaactgaaaaaatttggggtttttgaggggtgagggagagaccttatggtagaaaataaagtgttttttttgatatctgaaattttatatgctcaatttaaatgttttattgcgtttgttttttccaacctgtggaaaccccttaaattcttactgaatgcatagatcttttatttgcatgaatgtcctgtatgccggaagactaagtgggagcactgaatgctttgaagttctgtgcctgtgagacttgggtattttaatacattgttaccctattgcatcaaatcacgcctagggatgcattcaataaagactgccccctccccgcttagctgcgctgggactcccttctggagggccagagtttctactttgtttctactttgactcctaaaatgaggactgaagggaaagcagatggcattttgtacctctgacaatgaagcctaaattgtttacgttggagagggagtgggagataagctaaagaatgtgatttgtcttccatttgaagataccagggaaaagtcttgtcaagtagcaggccaccggtgtctagtgtagaggagacgatttctgtcgatagagagcaaagccagccaggcaaacgaacccgtaagccgcctgagggacagacaggcataaaacctaatgaatgggtaggtagactttgggcaaggctaattgcagcaagctgtgttcagttccccggcctctgttaagtagtcatttttatacaatctgtcggagggaagaggaaatagacccacacggtaaatgaacttgtggtgtttagctaggaagtggagtttgctctaagtagctctggtagcagactccagggagcacatggcaggcggactcatctgagtatctgtgctgaggagttgtgttaaactgttgaaacacttagaaattgctatagaaaaagagtactcccaaagttgccagctaatatggtaccgaatttcctgaaagacctttcttttgccatgtggtttttctataaagctgagtcaattaggcttctttatctccctgtccttggcaataaaacgacaaaagccgagggttgaacaggtagacactgttatctcactgaatcttcaccgctgccctatgaggtggctattgttactctccccattctatagatgaggacactgagccacagattggttgagtaacttgctcaggctcacacaactagcaggtgataacagctgaggtgaaagaacattttttctgggaagatacagggtgtttaaaggtacctgtttagtgcacagcaagttgcagtacttttaaattggagactggaatatgtaagtagatgtttgaatctctctctgtctttcagtgttacaggtgaatcaacaaaattagaatatctttctatttagtgactgaagaaggcggtccatgcatatatcagatctagtttggagtcacagactagattctggaccagagatgaaagatatgctttgggtacctctttttgattaaatgtagtttttaaaatagtgacttgactatacctcaaggagtcttcataatcttctgcatgggtatttataggcaataatgctaaagaagacagtgccagtacaagtgaaatgataacatgattgcagtgttacggcttttgttgatgaattatttgaactgggaggaaaaacactttgagaactaaatttaaagtaattcttccgatattatcagtaagacctaaagatggttgcttttagaggacctaaatgtattaaattcctgatttagcatgcttatagcaaggcttcaaatatgtttaattctaccagcttcttgagcttcttaaggagagtcatagaatcatagggaattaaaatgaatgttagaaatctgtatctcctctgacttgactggatcacacctagagcaacccaaatgaaaaatgtaccttgttttaaagctctccagggaaaaatattctaaaacttcccctgataacttactccaatgcatagtaaccctgagacttaatatttacaaattggtttcttatatatggatgaaaggaactctaaatgtatcgtattataaaaggtatgcattacataaaggaccttttatacaggaaaaaaagtatttagatgaaaaaacttcttaattatggaggtacatctacaatacctaaaattaaaaataaaatgaagtgcattttcctcctaagattttctcatcaaccccgagaaccactgctggaaattacctgaagaagaaatcttaccttgctctgtatctttaggaaatgttttacctaattttagaaggaggggaaaagaacgataacatcacagacacacacacacacacacacacacacacacacgacacaaacacaggcacacactgtagtttcctaagcagtttgttctaattcttcacatccccctgtcaaaatgtttgcttatagctttctttgtattgtcatttaagcccatttctaattggtgattgttggaaattgaataaatgtgttcagtttttcat

SEQ ID NO: 2720 - DNA, 1997 bp, Homo sapiens
ttccatgttgtatgtagtactttgcctctcataacatgttcaattaaatatctgttaattcatagctaatgatttttttaatggggcctcgttcttctgccacaagtgcatcccacctttatctttcagggaagaggttggttgcacgttgttaggccaagagactggccctccattatgccctatgctggacttgctttgtcggtccattcattgatgtcctgttgaatcaaaaggtattgttttagtagaagttacatgaagtatattcatttatcacttgctaaacataggccttgctctgtttaataaataatgggtgtctctttcaagattttaggataggcctttttaacagagcagaatcttctgttaaagttctcacaaacagaccaactcccaagagagatgggctggtgggtcactgacataaagcagtccacaagatctattttagaaaagtatcaatgacatttccttagttggtttgattctcttgagaatacatgagtttaaaagaactgaggtcaaattgctttatgtggaaagcaataaaaacaagtatttttgacttgcaaattagaggtaactgtaagcaatttttgctattgaagcctatggcccaaattattccacctgcaaaataactttcacccttgcaaggctgatagacggctcttcattggtctttttttatggttttgttttgtttttttaagtcattggtcttaaatctgtatggtgacaaatctatttgagtttgattgagactttcttggactcctttggacaagaggtcagagcacaaaggctagtcaccacttctttgacttcttgaggtatgagccaaaattttacttttccattgatttaaagcagaatttttggagatgctgtgttctagttcctgacggaatcggtggtggttgctgactttgacactttggagagtgatgtggggagttatatagaaggggaaacactagtttaggtgtgaggagttctagtatgccacaaattagctgagactttagacgaagcacaatatttgagcatcaatcttctcatctatgagatagacctgtcaggattattgtgaaaattagatgagataagttgaaagtacagtgcttggtaaacagttagcactcaaatattagttctttttcactttaattaagagcagactttgaatggtctgatgccaagtgtagatccttaagagacaaaacaaagaaactttcctggcttcaaagaaaagaactccatttctgaaagggtgccttaaaaggaattcatttgtctgatccatccttttgcctttgggcattactactgtcaccctccatttctttacaaacttcaggcaaggtggtctctctctctctcccaataggcaattccagggttgtaaactcattatcaggaagcttaatcttagaactgaaatacctcacagagcaatttaaacctctttcttcttgttcctattcttcatgggaagaaaactgggttgatccctatcttctttttaaggagccacatttgccatttattattgctcttttgcctatttaaaaaaaataacagtcagaaaaaataatgattattaaaatgatagtcattatttacttagtgaatgtcaggataggtatttattactcttagcttcttattggtatcagatgtagatcacggtcttactgttgattaactcttcagttatatatacatactttgattctttagttacataattgataacaaagtgtgcttctgaagaattattctggctgtatggctcttgtttcctccccttggtaaaaatggaggcatgaatctcggttttgtgatctgcttttaatttcatatatgacattatttgatgtacataattaccaacatccaaaagcgtttcttcccctttctacgtgtgcactaaattctaaaacaaaaattggaatacaaaatgcctaataaagaaaaaattcatgtac

SEQ ID NO: 2721 - DNA, 1044 bp, Homo sapiens
ggctcctcccggggccggttcccgctgtctcagccgcggcgcagagggcacatcggcctgaccgactagccggctgccagtgccgggagccgccgcgtccatccccgcccgcctggccggggacccaggactgagtcgtccagctgcgcccctcgcccatagccccagcgggcgccgggcgggcgagcagctcttcggcccttcccggacagcgacgcagtcgcagcgcgcgccctaacacagatgtgggaagataaatgaaggggtctagatgtaaatgtcagtggaaaggagagctaccatcactaagggtctcactctgatgcccacgctggagtccagtggtatgaacacagatcactgcagcctcgacttcctgggctcgggtgattctcccacctcagcctcccaagtagctgagactacatgcatacatcatcacacagggccaatttttgtattttttgtagaaacggggtgtccgcatgttgcccacgctggtctctaactcctgggctcacatcgttcacccaccttggcctcccaaattgctgggattacaagcatgagccactgcgcccgtccaggaggaaagtttttagaaaaaggtgcacaagaaagagcataggattgtgccagcattgatgttatcttctggttatatgagagtgtttgccaagaatcggtcaaatgttttacattagggaaaaagcattattgttactggcatagggagggccccagttaaaatagcagtccaattcagagaccttcgtatttgtcgttaagatcaaaaggactcttggaataatggactatgctacaggattattttaagttcagatagataaattagcttcttcccaaattctcattctgcttttcctgtggtactatatagtatcatgaagttatatctttaaactcttagtttgtactatgtggtgtcttatgaaaaccttgatttgtttatacttagtgaatgaaacacttgggtttaaagttctttaactgatgtcacttcttaggctagaaagctgttga

SEQ ID NO: 2722 - DNA, 562 bp, Homo sapiens
agtttttggcttactttttggcggagtctcttggacacgtttttgctggtgctggaagatcagatacatggaacctttgaaaactgattatttttctccgatatgacttaaaaaaaaataaaaagaagaaaagaaaatagagtagtgcacggcaagctagaggattgtaaattttccttggtgaactttgaggatccataaagaagaaaccaaatgaagtgtttactgtcattatccgtatttgatgaagaggatactgaggctcaaagagaattaataatttgttcaagaccgtctaatgtggagtaatcaagagtgaatgccctgaaagtacacaccccagcctggaccagcattcttttttttttttttttttttttttttgagaggaaaaactacagagacagagtagcagcagaaatggttctctttactgcgaggctgcaaggtcacccaatgagagaggggccaaataagctggaacatcatctaatacactgaatgtaggagttactggaaaagcaagaataacttatgcggattaacaatatggaaacatcct

SEQ ID NO: 2723 - DNA, 796 bp, Homo sapiens
gagatggggtctcactctgttgctcagcaggaatgcagtggtacaatcacgactcactatacccttgaacttctgggctcaggggatcctcttgcctctgcagcctaataatttttttttaatttttatttttttgtagagttggggatcttgccttgctaaccaggctggtctcaaacttgtggcttcacgcaatccccacacctcagccttccaaagtgctgggattacaggtgtaagccaccatgcctgatctggaatgctttctaaaaatatggcattataaacataatactaaagagaaaaaaaggttaaatttcacttcaagaaattatcagtctaatagcatcagtaaaaatggcacttttagtcatggcataaaatatacaataaggctatttttcaattattgttttcaagttggaaaatgcattatgaaacactcaaaaagatgctactgggtttactcatcaagtgcttttgacaccatataaatgacagagtaacaccacagttatgtgattgggactcaagaatccttaaatgttaggactgaaaacaggtatatgacttatttgtccagaatttatatttttctgtatcccaataaaataattaagccatgtgtattgtgtaaaattacagtctttcagtctgtcctatgtgcttgctctcctggctagatattagctaaaaattagcaaaaacagccatttcccctattattccccagcaaagatgtgaaaccaaaacgcctaaccttttctgcctggtggactgccctctactggactat

SEQ ID NO: 2724 - DNA, 1165 bp, Homo sapiens
gcagcttcagcgaagccggagatgggcagagagcgcgcgcggcgcagcagctccagattcactgctctcccctgcagctccccgcgcccccgccgctgtcgctgcctcggtgtcccccagccccagtcgcgctcttaggacagcgccgccaccgccgcctggccctgcctgcctcctgcgccgcgcagccctcgcgagcgccccggatggcgctttacccctaggaccgcacatcaagatgcaaatttggatgagaggaaaactacacttctaaggctcccctgacatagtttctttggagtgcaattcagcctctctttattgagggcctatggggcaagaactgaagtgatgatggcaggcacaagaaaccttaagtttctttcactggagagctcttcagttcatccatgaagctgagtcccagattaaaaaccattgctgtggtttgtctgtattttggtgtatcaaagcagacaaaagaaaaggaaagcacctccaatccatcttaataatcatcccaccttcctttctgctttcatatgacatttatttaaaccaagctatagctgtgcttctcaaaccttacagtccatgtgaatcacctgaagatattattaaaatgcagattcttattcaatagatctgggttgggatgggagatttctaacaaactcttaagtaaactcctactctggaaaccacactttgacaagcaagggtctgtaaaactagaaagctagaggccttttagttcatggctcttaaccaagagcctgcgaatctctgggacatttatccacaggttttaggattctatgagtcccaagaaataaatgcaaaattttatatgtatgtgggtatgggcatttttttattttctggagagttaacagttattagcctttgtaagaggcttatgaagacctaattaaaataagtgggtagtgattgaatcagtcccatttttagatgagtaaactaaggtctaaggaagctaaattatctgcgaggttcacagagtttgttacaaacctaggaattgcatccaggtttctggtgcctaatccaggggctttgattgtactagactgtctttcaaactttgatttgagagaaataagtgtaataattcagtaaataaatttaataatgaaagaacaaa

SEQ ID NO: 2725 - DNA, 2049 bp, Homo sapiens
ggtggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgcggcggcgtcggcggcctgtgcagcaatggccaagatcaaggctcgagatcttcgcgggaagaaggaggagctgctgaaacagctggacgacctgaaggtggagctgtcccagctgcgcgtcgccaaagtgacaggcggtgcggcctccaagctctctaagatccgagtcgtccgcaaatccattgcctgtgttctcactgttattaactagactcagaaagaaaacctcaggaaattctacaagggca

SEQ ID NO: 2726 - DNA, 303 bp, Homo sapiens
atgcccaagaggaaggtcagctccgccgaaggcgccgccaaggaagagtccaagaggagatcggcgcggttgtcagctaaacctcctgcaaaagtggaagcgaagccgaaaaaggcagcagcgaaggataaatcttcagacaaaaaagcgcaaacaaaagggaaaaggggagcaaagggaaaacaggccgaagtggctaaccaagaaactaaagaagatttacctgcagaaaacggggaaacgaaaactgaggagagtccagcctctgatgaagcaggagagaaagaagccaagtctgattaa

SEQ ID NO: 2727 - DNA, 1528 bp, Homo sapiens
atcatatagtctagtctttattgaaagacttacttcaactgttgtttacagctttggcttaagttggccattttagcctctcactgccagcagacataaaaatcaagtgggaatggcacgggggttgggagtgaaaatactagtagagaaattatgagaacaaagaatatggcagtcagtcagaaacacatcaccaaaataaatctcaaaataattatgaaataaaaaacatttccttgcatgcccaaaaagtctctgctgatgtttttgatgaacggggtggggagcaacgattcttaggcttaagttggatcaagatagcattgggtcatgttataaaatcatctgttagctcaacagccatacttttaattaattcatttattttttgagatggagtctcgctctgtcgcccaggataattttattaaatcatagaatatacagtcaggaaacactacagctatatttagctgttagttatctcaataagctacttaatttactggcagaccaaaacaggcatactaagcatttttatcaattaaaaaaagtcttcagttgttcaagtttcacatatactcataaaatttttaactcgggggcacagttaacataatttattgagtgttctccctataaaatataaattaacttttccaaaaacattcctcaaagatactataaacaaaagaaataagggtatattttataacagaagagtgtaatagatgaccattatggtaaaactaaggtgccataaaaaatttggcccagctatgaatttcagaccctatgaatttttatgttgaatacatttggctatattgctaagtgggaaaaggaggaaagtaataccaaaattattgtgaccaccaatttataaaatcattattttaaagctaatcgtaaaacttcaaatgtttagaaaacagtaatttgtgggtactaatcgcatcttactatgtaactgtaaaaggctattttctctttggtgcccaggccagcattttgaatacattgccaaaacatttgcactccctagctctgacaattcaaatacataggattttatctattttacattcctgtttgatagaaatttgaggcaaattttacccacacagcctgaaaaataccttgaaagcaaacctcggtcttctgcatcttccaattgattcctttacaaactctgcacacatacaacttaagcctctgctcaggcttattataccatgcacactgcccacaaggaaaaaaattaattgaaaataaaagccacaactctgtgtactatttaaactgaatatccaattataaattggtacattgaagtgtctaaataagatgtttttagcaatcttgttaaaaaaattcttgggcaaaatatatcttaatttttaaaaacaccccaagatttttaaaaaacacttgtactatacaacttatagtaaccttgaaattggtttacaaggttttaatcaaggtatttacataccaagtaatgtaaagcaaaaaaaaaaaaaaa

SEQ ID NO: 2728 - DNA, 1629 bp, Homo sapiens
ccaacatgcagcctcgactgtcagaaaggaggcacacataatcaaatccatgtacattaaaaagaggtacacaaagatgaatgagttgcgaaaaaagcaactacacaaattcaatgagagaaagggaggagtcctgactcatactgtatactattatccttttccttatctacaccgagtattttatataaagacatatgctctatcattcaattgcacaaaagggcacttggccacttctactctcaaatctgctctggagattgtggtaaaacattctacatacctccctgaagaaattctcaaagcgaagtacattttagagaacaaagtggacttaacaattttaagaactttctcggaactcggcacaatagggtaattacaactttacagccgcattttccgtgctccaccaggactgtccccgcgccccagcccacatcccttctttaaagagagtcagactgagagagacggttcggccagctatcccgattctctatgtctgggccgtgaatcgccgagcaaggctgaacccccgcaaaattacagaagaatctaaagcgcaaacgagggaaaagaacaaaaaagcaaagggggggaagttgggtcgagacccacccccactctctcgaccccacccaagcctacctctcctacgctggaccataaaacaaaaccgaaaacgtaacaaaaataaaaactaaaaatagaacaccacgagaaaacaagtagggcttccttactgtctccactccttctggcccagttctctactcaacctcccggcccaccccaccccccaggggtcccggcgccatttagctcctccgaagccgccgccattttccgcccccgccggatcgccgctgtgcctcggcagccgctcgcttccctactctgcagcctgagccacgggcaccgcccggccctaagagggaggccctggccggaacgtgcggggacggcagctgcaacgtcaggaaggccaggctccgaccccgcccgcagtgccccggcgccgacagcttgcgccagccggcgggagctagcgggcagcaagggggccggacaggctccactgggcggagcggccctggcggcggttggaacctgaaggttccatcgcacttacttcctgttttgggtccgggcactttggaagaaccaggatggaagctccaaaaaataccaggatggaggaagcagccacgggcgagagtggctgcagctggagtgagcgagcgcgacgagccaccggaaacggagctgcggccgcgccccgcccccagctccccgcacgctgcccctcccgctcgtctgtcccgctggcggcccagcgtgctggctgtacgcgtcacttccggctgtgtcggcgcgcgaaaaaaggaaccaaagagaagtgaaggaatgtgtccaagggctcccaagttggcggtggaattagaattgaagcctcagctccaaagcctgtgttctgaactacccggttgcagttcacaaaatacactttggcagtactttcataacgaaaacaaatgattacaaccagtttacaaatgctttgctttactggaggatcgacatgtttgactaattttcaaaaataaatctcagaagcagcat

SEQ ID NO: 2729 - DNA, 1060 bp, Homo sapiens
gtctgggcggtgacgtttggtctgagctgacctttcctcacaatcgtgaatttgggctgtgaggatcaggccttgtcagaacccgagatgagaggagagaggtgggtcctgaataccatcccaagtgtccttataagagagaggcaaaagaggcaatagagacacagaaaagaaagccatgtgaagatggagcagagagatatatggccacaagccaaggaatgctgacagctgccagaagctggaagaaggcaaggaatggactctcccctacagcctccagaggcaatgcagccctgccaacactttgattttagacttctggcctatagaactgagaaagaataaatttctgttcttttcagctactaagtttgtgatcacttggtgcagcatttacaggaaacaaatacacctctccttctagaactccaattatgtgaacattagaccatctaatattgccccacatgttcctgaggctctctgttcattttctttttaatctatttttctctgttcttcagattggacaattgctctcttttttgtttgtttgtttttttgagatggagtttcgctcttgtcgcccaggttggagtgcaacggcgcaatcttggctcattgcaacctccgcctcccgggttcaagtgattctcctgcctcagcctcctgagtagctggtattacaggcacccaccaccatgcccagctaatttttgtatttttagtagagacagggtttcttttttttttttttttggcagtttttacttttatttaaacagaaaacatgcacacgagctgtctactcattttctttgctgcgcagcctggcattggggttggtgactttgatggccagttgggcagctctttccacgatggctttgcggttcttggaggaaacatggtgagtgatctcggcacagtaagatttgttgcacatcagcagcacttccagctccttgacgttgtggaccaggaacttccggaagccactgggcaacatgtgctttgtttttatttttatatttttgcaacggagtcttactttgtg

SEQ ID NO: 2730 - DNA, 1551 bp, Homo sapiens
tgatggtttgttggttttaattcactcactgttgcagccgctgctgcctctagtccctgttggctcgggtttgggctgactggggcctccacaggttgcccttcctgatagtgaatggaagaaaagaagaaggggaaagaaaacaaaagagggagggagtgaagtggggagacaaatggagggtacatggaaggatgaagatggtcagaaaagggagaaggagggtcttgtaactcagctgctctccacgggagtcatcatctaacagccgtttaagagtcatgcaacaagatcgtttgggttttcccaggcagtgtaaagtaagtgctattggatacccagaaattatgcatgatactgaacatctcgcaaatttaactctgtgtgtgtgtgtgtgtgtgcgcgcgcagaattcatggttttttgtttttgagacagagtctcactctgtccccatgctggagaagaattagccaggtgtggtggcgtacacctataatcccagtgacacaggaggctgaggcaaaagaattgcttgaacctgggaggtggaggttgcagtgagccaagatcgtaccactgcaccccagcctgggggacagagcgagactccgtctcaaaaaaagaaaaagaaaaagaaaaagaatatatgggttttgccatgttgcccagactggtcttgaactcctgacatcaggtgatctgcccgccttggcctcccaaagtgcaggatgacagatgtgagccattgtgccaggccttaaacttttgaaccttgaacggctccaataccatccccaccattctctccatgagaaagagaatggaaaaatctagtacattttgagaccacagttcataacttttttttttttttttttttgtagagatggggtcttttgccgtgttacccaggcttgtcttgaactcttgggctcaagtgatccgcctgccttggcctcccaaagtgctggcattacaggtgtgagcccccacacccagtccacagctaataattttatgtgagttgcacatcaaggaaaaaaagagacctcacttattttgatgaaaattgctcaagtttttttcaaggatctttactggaacagtaaattgttaaaggactaatattaagtctaatttaagaccatcaacattttttttttttttgagatggagtcttgctctgtcaccccgactggagtgcagtggtgttatcttggtttactgcaacctctgcctcctgggttcaagcaattctcctgcctcagccaccagagtagctgggattacaggtgcacgccaccacacccggctaattttttgtatttttagtagagacggagtttcaccatgtgggccaggctggtcttgaactcctgacctcaagtgatctgcccgcctcatcttcccaaagtgctggattacaagtgtaagccactgcacccggccagaccatgaaatttatttatttatttattttttttgaggcagagtctcactctgtcgctcaggctggagtgcagtggtgccatcttgtctcactgcgac

SEQ ID NO: 2731 - DNA, 1844 bp, Homo sapiens
gcagaattgtcaaatgacctgctgggggaggttgtaggagtttagcagatttgagtgtggctgcagagagagagagtgtgtgtatgtgtgcacatgtgtgagagtgtgagcgagagtgtgtgtgtgtccatctaagtgtgtgtgatgaaggtgggataaggctcctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctggagcagcggtgtttcaccaccaaatgcctttccaggctgcccttccaacactcaggagagcatccagatccctgggcagaggctctacattcttggctttagaggtggtggcagcggcagcaggtcagagccacttctggcggtttccctcccctttttagtgcccatagtttttggatcctcccttgagttttaccagcacaagccattctttgcccctgttcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtataatgaaaactgtaaacttttttaaataaacgtgtatataccttggc

SEQ ID NO: 2732 - DNA, 691 bp, Homo sapiens
catgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattataaaaa

SEQ ID NO: 2733 - DNA, 703 bp, Homo sapiens
caaaggcccccagctgcctggcccctggcccactaacccaggcatgctccttccagcactgggcagaggagtcaggaagatgcccttcctcacccccactgacgccacctctccagggaccttaacgcaggggctgggaatggaatcggaagctagaatgagcaggcagcagcagctcccctaggtatctgcctctgagaggacctgaggacagaggcgaggcccaaggcagaggccggagtagggccccgcttcacctggggcctcaaaggtgtcgtttattcatttggcaaatctccactgagtgaggaaatggatgggtgagaggatgggattagagaatgaacaaatgtcacctgcatattttcccaattccagcctgagcaggaacccggcaggagccaagagtcctttcaaggtgggagaacaccaggtattgctgatggggaaagtgaggtctgggaggctgggttgggcccagtggggacatgcagatggtggtgggaacggtcagagccaggtaggtgggcaggtgtcagacagccatgagggaggtgctgctgagaatgtgcacggccacagtgcctggcaggttgctgggctgccggctatttcggtcccggaggtggagggtatgcagggcctggaggttgtccgggtcagcctttaggtgcacctggcccagaaattcatccttcagcac

SEQ ID NO: 2734 - DNA, 572 bp, Homo sapiens
gtgccacagggaagagaaatgataaccagaaatttgtatttctagctagtactatttaacacaacttcacaatactaaaacaaatacaaataagaaagggttaggtagttgggcttcatttacttttttccttttctttttttttttaatatctcaaaaaggaagccacttgcttgatatcaaaagtgctgtggaaagaaaggaggggaaaaaaacccacaaataaatgtagaatctagtttattttaccaaactgtatatttttccacttaacatttctacattagcaatgatgtaactctccaacatttccttataaaaaaggcaaacaagaagtgacaactcatgctccaaatattaaaaaatatatttaaacatatgatcaagaagatttgggccgtgagtggtagctcacatctgtaaccccaggattttgggaggctgaggcaggcggatcacctgaggtcaggagttcgagaccagcctgaccaacacggcgaaaccccatctctactaaaaatacaaaaaaattgccaggcgtggtggtacacacctgtaatcccagctactcg

SEQ ID NO: 2735 - DNA, 2040 bp, Homo sapiens
ccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatgag

SEQ ID NO: 2736 - DNA, 786 bp, Homo sapiens
ctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaattt

SEQ ID NO: 2737 - DNA, 429 bp, Homo sapiens
ttttcatattcctgcaaaattcctaagatttattggagactaggcctcttctctggatccacaaccgtgtccagcccagaatcaggacccccaaacgtgtctgggaccctgtccctttcattctggtctagacaagtccccacacgtggccaaaggacagcacccagactctgcccctgaccagtcaatgtgcagcaaacccacttcagtaggcagaagagtctacccctagggagaaggcggcagtatgtacgaggacacagataggagatactcaactttggagaggaaggaagcgcagaagccagcgacctggagccctacgcgcggcactctagtaagcccaggttccaggtccccattactggatgttaggagaagttcagtcctagactttccggatccctgaggccactgcacacacctgtg

SEQ ID NO: 2738 - DNA, 1423 bp, Homo sapiens
aggttagagggaagtgggaggcactttgctgtcttcaatcgaagttgagggtgcaaaaatgcagagtaataaaacttttaacttggagaagcaaaaccatactccaagaaagcatcatcaacatcaccaccagcagcaacagctgcagccgccaccaccgccaatacctgcaaatgggcaacaggccagcagccaaaatgaaggctttgactatttggcctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggattaaggatttggctttatccgcttggaaacacgaaccctagcggagattgcgaaagtggagctggacaatatgccactctgtggaaagcagctgcgtgtgcgcttttcctgccatagtgcatcccttacagttcgaaaccttcctcagtatgtgtccaacgaagtgctggaagaagccttttctgtgtttggccaggtagagagggctgtagtcattgtggatgatcgaggaaggccctcaggaaaaggcattgttgagttctcagggaagccagctgctgggaaagctctggacagacgcagtgaaggctccttcctgctaaccacatttcctcgtcctgtgactatggagcccatggaccagttagatgatgaagggggacttccagagaagctggttataaaaaaccagcaatttcacaaggaacgagagcaaccacccagatttgcacagcctggctcctttgagtatgaatatgccatgcgctggaaggcactcattgagatggagaagcagcagcaggaccaagtggaccgcaacatcaaagaggctcgtgagaagccagagatggagatggaggctgcacgccataagcaccaggtcatgctaatgagacagaatttgatgaggcgccaagaagaacttcggaggatggaagagctgcacaaccaagaggtgcaaaaacgaaagcaactggagctcaggcaggaggaagagcgcaggcgccctgaagaagagatgcggcggcagcaagaagaaatgatgcagccacagcaggaaggattcaagggaaccttccctgatgtgagagagcaggagatttggatgggtcagatggctatgggaggtgctatgggcataaacagcagaggtgccttgacccctgctcctgtgccagctggtaccccagctcctccaggacctgccactatgatgccggatggaactttgggattgaccccaccaacaactgaacgctttggtcaggctgctacaatggaaggaattggggcaattggtgaaactcctcctgcattcaaccatgcagctcctg

SEQ ID NO: 2739 - DNA, 361 bp, Homo sapiens
ctcagcaatgtgtgcacttggtcccttgtttgttcctggctgggtcagggaaggcctgccgggggtggtggcactgagagcctgggggaacaggcgccaggtggggtgagtgaggctgtccatcgagggctcttgggggggtgtgggctctgggcactgcccgctgagacagaaaaggcagaggcaggacaatacccagcctcctggatggtactgaggtgacttgagttttggcaatttggctttccccaagccgccggagccatctccacagccctgtccagggaagggggcaggctggccaggcactggtgggctggggagcagcagcagcacaccccacgtgtccctgggtcactgg

SEQ ID NO: 2740 - DNA, 488 bp, Homo sapiens
ttttttttttttttttcagtggaaaataacttttattgagaccccaccaactgcaaaatctgttcctggcattaagctccttcttcctttgcaattcggtctttcttcagtggtcccatgaatgctttcttctcctccatggtctggaagcggccatggccaaacttggaggtggtgtcaatgaacttaaggtcaatcttctccagagcccgccgcttcgtctgcaccagcaaggacttgcagggttgatgctcttgtcagataggtcatagtcagtggaggcattgttcttgatcagcttgccatccttgataaggtagccctggccaatcttatagatcttcttgttgatctcagtgcggtgatggtagcctttctgcccagcgcgtgccacagagaatttgatggcgtgatgtctcacagaaagttctccgctcccagacatgggtccctcggcttcctgcctcggaagcgcagcagcaggcatc

SEQ ID NO: 2741 - DNA, 410 bp, Homo sapiens
ttttaaatgcctggtagctataggttgtactttccattagttatataaaacaatggttttgggggcaaaaaaaagaagcaagttctgaagttcactcttgattgcacccaccctgtagaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaa

SEQ ID NO: 2742 - DNA, 362 bp, Homo sapiens
ctgcgcgctgcggtccactcacacacagtgcgggacacagaggcccctggaaagagcacactgagtgggagagcaaattctggaactgtcgcaggcggaaaccacacaagggggaaacagacaaaacagcaaacccggaagaaccattcccgcttccgaagctccatgatcacggcagacgcttcttaaaacctcccgtttaatatcagatgccacacatacgagatcgatgtgcacgtcgggagaaaccacagcacagccaggagtactggcgcacagtgaatacgcttccgtcctttcaaaagcctttcccgaacggtatcttgtaaaaaatgccaaaaataaaatgaaaaaaactgcca

SEQ ID NO: 2743 - DNA, 2135 bp, Homo sapiens
ataaatgaaattgggccaggcgtggtggctcacccttgtaatcccagcgctttcagaggccgaggcaggcggatcacctgaggttgggagtttgagaccatcctgaccaacatggagaaaccccgtctctacttaaaatacaaaattagcggggcgtggtggcgcatgcctgtaatctcagctactctggaggctgaggcaggagaattgcttgaacctgggaggcagagggggtggcgagccaagattgcaccattgtactccagcctaggcaacaagagcgaaactgtctcaaaaaaaaaaaaaaaaaaaaagtgaaattgcttacccaaatctacagttaactttcgttttttaatgcttgatgaatttgcatgtcattcttgggcagtggccatgctgtcttctctgtattgttccaatttgggtatatgtgctgccaaagtgagtactgcagaattatttcttgagagaggcacttacatgtgctgattggcactaaagcagtggaatgggaagaagagacttggaaggcagcccagacgatccaggcgtgtgctagatggcaactgaggagcacggtgctaccatctttactggtgtttccacctatgtgccaggggttctgtgagctacctgagaatactgaagtatataatgctctggcacatagttaggcactaatcagtggtatttatcaaggtgattaaaagcagatttaaaaagcagctcacagttgggcgcggtggctcacacctgtaatcccagcactttgggaggccgaggcgggtggatcaccagaggtcagaagttcgagaccagcctggccaacgttgtgaaaccctgtctctactaaaaatacaaaaattggccacgtgtggtggcgggcacctgtaatcctagctacttgggaagctgagacaggagaattgcttgaacccgggaggtggaggttgcagtgagccaagatcatgccattgcactccagcctgggcaacaagagcgagactccatcttgaaaaaaaataaaataataaaaagcagctcatactagggaacttggtaaagcaacctcatgctgttgtaggttgaaagcctggtcagctattctgcaagacagtcaaaaattgtttacagggctggacagcatattgctattgaaaaatagctattaggagaccttgcacaatttgtgaaacattgttaggctcattgtactgtgtaaaatcaggaaagaatttgggaacatactgatacaacaaaaagataggttgtcaaaccctcacttcaccagaaagctaaattaaccagataagtctttctgaaagttttagtgtcttagtttgttcctgcgctgtaacagaataccttagactgggtaacctataaataataggaatttatttctcacagttttggaggctggcaaatgcaagatccaggtgctggtacgttcagtgtctggcaagggcggctttctggtccaagatggtgcctttttttctgcatcttccatagggaatgaacactccttatggtagaagggatggaaggaccaggctttttttttttttttttttggatacagcaggatcttgctctgtcgcccaggctggagtgcagtggcatgattaaggttcactgcagcctcaatctcccactctccagcgatcatcccacctcagcctcttggatagctgggaccacaggcacgagctaccatgcctggctaatttattttttgtagagacggggtttcgccatgttgcccaggctggtctggaatttctgacctctagcagtccacctgtttccgcctcccaaatgctgagattagaggcatgagtcactgcacccagcccgcagcctcttttataagggcattaatccccttcatgagggatattctctcatgacttaatcacctgccaaagaccccacctcttaatactacatcagtgatgggttcaatgtatcaattgggtgggagggggcacattcagaccatagcatctagtcattctggttttattaagatttattagacctgaggcatgaaaaatagcatactggatgggacttcagcatcgatgagttgccttagtaatactgttaataaaaagcactaaatatgc

SEQ ID NO: 2744 - DNA, 2036 bp, Homo sapiens
ctcggttagggcctcaccgacctgcttccacccctcagggaggcctcagtgattcggccacagcctcagcctccgtcgctctgtgacctgcgggtattggatgattcgtagctaagactctacgacatccctgaagccgggaaatggtgtgtgttctcattttacccaagatctttggccagtgcagggcatagaagattcattccacaaacttatactgagaagatatgagaaatgtggacagaagaatttacaattaaggaaaggctctaaaagtgtgaataagtgtaaggtgcagaaaggaggttataatggactttaccaatgcttatcaactacccagagcaaaataattcagtgtaatacatctgtcaaagtttttcataaattttcaaattcaaacaacataagacatactggagagaaatcatttaaatgtaaaaaatgtggcagatcatttcgcaagttcctccaactaacttaacataagggaatacatgctggagagataccctacaaataaatgtgaagaatgtggcaaagcctttaataggtccacaagcattactaaatataagaaaattcatgctggagagaaacccctcatgtgaagaacgtgtcagaatctttacctcatcctcaagctttgacaaacataagagaattcatactggagagaaaccctacacgtgaagaatgtggcaaagccttgagacaatccacagttctgaatgaacataagaaaattcatactggaaagaaaccctacaaatgtgaagaatgtggcaaagcttttagacagtccagaagcctgaatgaacataagaatatgcatactggagagaaaccctacacgtgtgaagaatgtgtcaagcttttaaccaatcctcaagccttattatacacaggagcattcattctgaacaaaaactttacaaatgtgaagaatgcagcaaagcctttactcaatcctcatcccttaataaacaagagaattcatactggtgagaaaccctacacatgtgaagaatgtggcaaagccttttataggtcctcacaccttactgaacataagaatattcatactggagagaaatcctacaaatgtgaagaatgtggcaacgccttttatagatcttcacaccttactaaacataagagaattcattctgggcaaaaaccctacaaatgtgaagaatgtggcaaagcctttagacagtcctctgcactgaatgaacataagaaaattcatactgcagagaaaccctacaaatgtaaagaatgtggcaaagcctttagatggtccagaagcctgaatgaacatacgaatattcatattggagagaaaccctacacatgtgaagaatgtggcaaagattttacttggtcctcaacccttactgtacaccagagaattcagacaggtgagaaacatagttgataacatagttgaatgacatttctagtaatatgtttcctttggctttaaacagcaaataaagtgaagaatattgttccatgttcttttctttatttcttaaaatttttgtaggcacatagtatatgtacatatttctggcatatattagttatttgaatacaggcatacaccatgtaataatccatcagagtaggccaggcgcagtggctcatgcctataatcccagcactttgggaggccaaggcaggcggatcacaagttcaggaggtcaagaccatcctggctaacatggtgaaaccccatctctactaaaaatacaaaaaaataactgggcatggtggtgagtgcctgtagtcccagctactcaggaggctgaggcaggagaatggtgtgaacccaggaggcagagcttgcagtgagcctagatagcgccactgcactgcacgccagcctaggcgacagagtgagactccgtctccaaaaaaagaaaaaatccatcagagtaaatgagatattcatcaccttaagtatttattctttgtattacacaagtccagttatacactttatttttcaatgtacaattattttttac

SEQ ID NO: 2745 - DNA, 995 bp, Homo sapiens
gcgcagcctccggggccaggccgtgtggcccgctggggactggagtctcaacgacgcgcacacgagaagtaaggagcggaaggtgggaaagggccggaaaacacacgttcctccgaaaccggtttgcaagtccttgtagagttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccc

SEQ ID NO: 2746 - DNA, 5662 bp, Homo sapiens
aaccatgtccacggcgcccgccattctgtagcctatgctcggagggcacatgagcaagagcttgaccatctgtaccgttggttgacttgctctattaagggctatgatttcaggtcgtcctgcgtgtttagaggaggcgagtggaatcttgagtctcggctggagaaggcagagcacgggcatgcagacctcaaagcctcaaacctgcgtgtgagaggagaagttggcgagctccagcgtatggtccacggaagatacaagacaacagcttctgcgaaccagtaagagtggcctcattagacattggatttgccagtgacttgatcatggacttcccagtctccaggactgtgagttataaaggtttgttgtttaagccacccagcctatggtattgtttgttatagcagcacaaatggactaaggcactcacggagtctgcagcttcacatggcttgatgatggggaaacatgggctggattccagattccacttgacccttcagcagagagcctctgcacagtgaaaaatggagttcttgtagctctcagggtctttcaccatatttgctgtccttgggcaagatcagagtcatctttggaaggaaaagcatctctggattttgttaaataccatcttaggaaagtactctctgctcttcaaagtcagcgacgacatgagtcactgttacagaacccacagaatgtgtcccttaaaatactgagaatgaacactattttactgcctgcataattagcactagacaggtgaatttattactacttcattaaatagatgagtttattaactcagtgaagacttgtgggaaccttactaaaagagatgcaattccccagcctcaagatgctcacagtctagtgatgaggaagctggcaattccactatacatggctaaatgccagagtagtgcacagcatcctttagcggcatgaggaatgggctcataagcccacagtggaatgcaggggttctacacaaacgtagcttaatctgagccctggagggtgactgagctctattagccagagaatccaaatcactataaaactcccagagaacaaatgtcatgatgtgaagacaaataacaggcagaaagagatgggcaggaaggcagaattcaaaccatgatgacgttcaagtcacaaaattatctgcaagtcagcaggagaacactgaaggacttctggaaaggagagtaaaaagattcctttcatgttagaaacagattaccctctcaaacgggaggaggcttgagggggaggaggctagggccagagagactattaggagagccacactaagaaactctttcttctttattcaaatgtcaccacctcagagtctctctctagccatcctgtagataatttcggtctcctaactgcaccccaacacttcctatccctcatctctgcttacttcttttctctaagcccttattcctctctaacatccttctaggtatttacttacttatattcattacacttgtctaatgtggagtttcgttacctgctccatccccaacacctactaagttgctacaagcatttggaaggaacccaaagatttgcagaatgactactttaatgactcagtgaatagttgatagatacaccatgtggatcagggcctcattatttatcacctgaaccattcattcaacatatgattgttgaagggtctactctgtgccagccaagggtcctagatgtgaaatatacagcagtgaacaaagaccttgatctcacaaagatgatattataatgggctacgagggcatagcaaacccccaatatatagcgagagacacttttaagaacaatagggcagggtaaagaaataaagagatgaaaggaggggctgtcacagaataagtttttgtcatgaaagatttctcttatatttgaacagagacctcaaatataggaagagaaagccatgtagagatctgatatctgaaggcatgtaattcagccctgaagaacatagaaaatttttttttgttaaaaagccataggtctggtatttagcaaagacatggaatcaacctaaatgcccgtcgatagcagtctggataaagaaaatgtggtgcatatacaccatggaatactaggcggccataaaaaagatgtcctggctgggcgcggtggctcatgcctgtaatcccagcactttgggagagtgaggcaggcggatcacctgaggttaggagttcgagaacagcctaaccaacatggagaaaccctgtctctacttaaaaaaaaaaatacaaaattagccaggcatgatggcgaatgcctgtaatcccagctactcaggaggatgaggcaggagaattgcttgaacctgggaggtcaagcttgtggtgagccaagatcgcaccattgcactccagtctgggcaacaagagcgaaactctgtctcaaaaaaaaaaaaaaaaaaaagatgtcctttgcaggaagatggatggagctggaggacattattcttagtaaactaatacaggaacagaaaaccaaataccgcatgttctaactcatcagtgggagctaaatgatgagaatacatggacacacagaggggaacaacagacactggggtctccatcagagggtggagggtgggaggagggagaggaccagaaaaaataactcatgggtactaggcttaatacctgggtgacaaaataatctgtacaacaaacccccatgacacaagtttacctgtataacaaacctgcacgtgtacttctgcagttacagaagatcaaggatgggactaagaacctatttctaccaatatcccaggtgatgctaatgctgctggtccctaaattacaatttgatagcatcagttaaaacagctctctagatattttcagacagactaacacttgaggttttcacctccaatttttctactaaccccaatatactatcctattgcctaagggcaaaaagaactaaagaaggtaaaaacaaactgcaagcttctctttctctctgatactaacaaacaggaatgaaggtttgttaggatcaggagtgccaagatcaactctatgctcctaacattaaccacgaaaaaacccaggccactcataaaatactccctataatgacagcaactgacatttagagcaactgactggctgcctaccaaggcactgtttacataaattcttcacatgtagtatctcatttgattttcataacgatgatagagattgagaaaataattatgcccattttacagacaaggaaatagaggcacacagaagtaacttgttcatgtttaacaagtggtcaacagaaaagtcaggattttcacccagtgccttatctactagaacactggctgcgccaggcaatgaacccaggcaatctgacacctgtgcccatgttcttaaccgctcgacagtggttctcaaaccctggtatgcatccatatcaaaaggcctgaggttccatgtgctgccttgatacctttgagactcacagggccctgaaggcctagccatgagctcccggctctctccagatatgccctctcagtgggaaaggatccctgcccgcctagttcctcgtgtgttaaccatgttttatgtactggctatttgatatctgctattcctaatctctccctaagtctgctgaatcacagggccagactaacaaccaaaattatgtgcatcttccctgcaagcagctttcaccggtgggagaaagacatattacaaaagcataggccccagttcctttctctgtctgcttcctgacccttgcctgtagtgggcttcatgtggtctggtgtggtgtgatgtaccagtggaactctaagtattaaaatactattcattggcattaatctctccatgttgtcactcagccgcttttataaaattaagacttaggcacaattcatcctatttagccagaccacctgtaccccaccaggtcctccacataacaggttttgcctccctgccagcctgtagaattatccaaatggtcaattaaatcttcttgcaggaaccaagggtcaccctgctaccctcctgtcactacaaaatcaacctaccatggcccctgttggttcaatctattctcaagtgcaagtcccctgggctgtgaatatgtgactaataaactgctaccaacctcttctgcataggctgactgtagggtttgtgtgttcagccacctcctgccagttcaagtgatgtcttagtccatttttgctgctataacaaaataccacagttataaagaacagaaatttctcacagttctgaaggatgggaagtctaagatcaaggctccagcaggttgtgggtctggtaagggcctttttgctgtgttctcacgtggcagaagggtaggggaaaagggggatggaggaatgctgtgtcttcatagtcttcatatggcagaagaacaagggaggtgaactctctctctgaagcctcttttataagagcattaactccttcatgccctcatgacttaatcacttcccaaaggcctcacctcttaataacaccacaatggggattaagtttcaatgtttgggggacactcagacagcagcaggtgggggaatccctccttcaccaatggggtgaataggtgaccagaacccccgaattactaataaagaacacagaagttcaagctcatagaagtagtgtagggcctgggtcttatgattctgatgtgaccacagttcaagaaccactgcattattctacactgcctcttaaagagttgacggaactgtccaagggcacccaggaaaccaggggcatggctctgcctggcactcaggcctactgattatcagctccctgctcctctccagtataagatgcccctagagctctctataagaggaaagggctgcagaatgactggtaatgcctctggaggcaaattctcagaatgaaaggggaggcttcccttagatcagtgctgtccaacagaaatataatgcaggcaagctattcgtgtaatttaaatttttctcatagctacactgaaaaaggtaagatgaagcaagtgaacttaatttcaacaatatattttctttaacccaacatatccaaagtattatcccctcaacttgtaatcagtataagaattattgagggattttactttctttttttcatactagatctttgaaatctgttgtgccttaccattataacatatctcaattcagactagttacgtttcaggtgctcaataatcacatgcggctaatggctacactattggatagtgcaggtttagacctttttattaaggcaatatagactatataatcatctcacagggacttgctaagttcaaaagacagcaaattagttgtaggtttcaacaatcactatcatagaaactatgcacatttgtttaaatatgtaacagaattaaagtatccatagaaaaagtggaaagtggggaagaaaagaatacttaaaaatatacctttgaggctgggcacggtggctcacgcatgtaatcccagcactttgggaggcccaggcgggtggatcacgaggtcaggaattcaagaccagcctagccaagatggtgaaaccccgtctctattaaaaatacaaaaaaattagctggg

SEQ ID NO: 2747 - DNA, 3592 bp, Homo sapiens
acagcccacaaattccctacagaaatggaaacacaaaatcattaaatgtgccaaagcagcatgactaaagcatgggcaagacagtctgactctgagataaagccttctgtcaggctgggtgtttccacagccaccaccagcagtgcctccttgtcctgccacttccctggtcttccgcaccagattcatccagggcatccgtctgaatggcagtggatggaagaccaaccagtgagacctatgggtcaaccctggtttgaatcttgtattctggacagtgagttcagggctgtaaaccagccgcagtcttagagattaggttgggtgactgagcacatgctgcaatatcacaacaagtgggaattacagatttggcaggaataaagagaaaagccttcatgacctcctcctgtgtttacaagactcctccgagtctcctaccttcagcgttcatggaaatctcccattcctctggctggatgagaatttgctaaattcctctgcctcagtgcaagataattttgtttacaactatagctcacttttatgttttccagtcaaatctcatgagaccagcaggatgaacaggtaacagaggtcaaagagaaagaatgaatgcccacctatggatggaggcagtttagagaaatatgcttgtccaaagtcacaattaactgcactgacacagagaagcagatattgcacttttgctcaactaaataccactttgatgactaagaacgggccctctgggatcagacaaaggtcagtaactcttacctcagtaaaacggcattatttttagctttctcctctactccaccagggggaatatcagtgaagttagtcagatcattcccactactgtaatagtcaccatttcctataagtaagaaaatcaacagatccctcattcaatcatcctataattcttgagtatctactgcatgccaaactctatggttaggcaagggaaatacattggagaacgagcaatggttcctgccctaacttacaaactagtgagtacgctggacactgatctataaaaacacaccgataaatgtagctaatgctactgttgaaatagaggagtggtgcgtcatgaaatgagggtatgtaccaggagggttggtctaatcagggagttcaggaaagaactttcctaaggaagcgacaactgaattgagatctgaaggagaggccaggtgggctagaaaaagagggctgggaagaacagtttacacaaaggaacagcctgtgcaaaggctctttggagaggttatccccactgtagatgaagtaagagccactgtagctgactcagggaaagccagggggaagtcggtgcaggatgaggactggcagaatagacctgacagtgctttgtagatcccatgaggaagttttttctttattctaagagccactgaaagtatgtttctgagtgtgtgtgtttaattaaagtacaatttatatacaataaaacaaccagtttttaaatgttcatttagatgagttttaataattttaaatacccacaagatcaccatccaaaacaagatacagaacatctccatcaccccaaaagtttcccgtaggctccttcctagctatcccaccccacctgctccaaggcaatcactttctgacttcaatttccacagagaagaacttttgtctactgtagaactttctacaaatggactcatacagtatgtacactcctgtctttattttgctgaactgtgttttaaagatgcatccacattcttgtgtatatcatttattccattttatagctgagtattccattgtacaaatagtcaacaatttgtttattcatccatgtgtttttgaacatttgttttctggttttggccgttataaatcaggttaccatgtctgctcctgtaaaagtcttttggtggacatatgtgtcttaattgatgttgggtaattgcgaaggagtgggtatctgtgtttttttaaacattttttgtatatttataaatcagagtatgacagtactggaaaagatcttagagccttttttttttttttttttttttttttttgagacagagtctcactctgttacccaagctggagtgcagtggcgcgacctcgggtcactgcaaactttgccttccaggttcaagtgattctcctgcctcagcctcctgagtagctgggattacaggtgtgtgccaccatgcccggctaatttttatatttttagcagagatggggtttcaccatgttaatcaggctcatctcaaactcctgacctcgggagccacctgcctcggcctccaggtcttagagctttttaactcaatttcctatctattaagaggcccctcaaaatagaaatttaattaggatgcctgagaaaatgtcttacctgttaaaacagtgatgattgagtcatccttgctggcagctttaagtgcacgcataatttcatgatacatctgtgtaatgggaagacaaggaaaagaaaagaactctgaacacaggaatcatcaatcaatggactcaacaaatgtcaggctgcaagcttgctctcagcaaagtgcctaacatttattttggttgtattttataaccaaaaaggtggaccaacataactgaaggaatttttattcctttcacagttacctggtgcatattatgtacctggtgctatggcaggagctgcaggctataaaccactttttttccaaaagggaccaagaaagaaatagtccttgagcttttggaattaacagaggacttaacatgttcaatttggaattaacatgttcaaatgaggagggggttggaaagtacaaagtagcagggaactcagaggaggtgctgaggcttatctagtgtgggcagagtgggaggtggtcagagaaaactttctacaaagcaacgtctctgttgtgacctcaaggaagcccctggcagtctgggaagtgttagtgactgccaaaaggctggaattttcaagacactgtaatggtattcaaggaaggtggctcaaaattttaaatcagcaacatttctgaaaatcttggacaagcagctatatagcttttaatgcatttaaaacaggtgcaatttcaaccttagatgagatttcagtgtgggaaagaaatgaggaagagggctgatacttatagatacaaatatactggaaaagacacatggactttacataaaacagcctgccctccgtatccacgggttccacatccatggacaaccaatcacagatcaaaaatacctggaaaagaattctgtatctatactgaacatgtacaggctttttctcttatcattagtccctaaacaatacagtataacaacaatttaatatagcatttacattgtattcagtattataataactctagagatgatttaaagtatatgggagtgtatatagaggttatatgcaaatattatgcctttttatgggggacttcaggttccgcggattttgttgtccacacggaggtcctggaaccaatccccatcggataccaagggatgactgtacatgaataagcgtttaagcatttctcctgagggaagtgat

SEQ ID NO: 2748 - DNA, 1448 bp, Homo sapiens
gctggtgaggcacttggatacatactgatgctgcaagttcaggggatttttcttactcttaggtttaaccaagaacactgagcagggaaaaaccctgcctttcctaactgcatgtattttttcctttttggaaaggtggtagagactcagaagctttccttgttttcttcaggcctgctcccagttttcttaacagtttcttttgttgctttctctctcccttgttgctttccatggcagtaatcctcctagagtccaagcagtctgttgtatggagcagggtgtgtgggttttctgggcccatcattatggctgcttcagagtcagaagaaagccatagggcagtaggggagctcctattgcctagcccctctccctttgtggctcccactctagctgcctatttttgctcatcagctggtgagtcagtatgggccagcagttctccctccctaagcccttgctactttatgggttagctttgcaggtttggtggcttgaggggtgggggcaactcaccactgccaggtaactccctgaagggtgggagtggattatcttctaggctcttacccgcggtagggaagggcatcaacactgtcttccttccattctcctttcccccatcccatttagtgctgccacagggcagaagcacacaaaccaaccacacagtctctgacttctcctaagcactttgagttgttgaatggggctcaggggcaagagtttttgctgccctccccagcgtggtcacagggttattgaactgcctgcacttgtttctcatgcaactccagcattttccccagaagttgaactatggatagcagcttggtatggatttcctaaatcttaacatttgaagcagcttcttgaggctggcaactatcctggtttctgtcttggagggggtggtttgtttgctggggcccaacgtctgtcccaagtggtggggtgagagtaagttaactttggtgccaggtgagaggtgggggctctttgcttagactccctatcatggaaagattggagttttctatgcagggcactgtggaaaaggattgctgattctgactgaccctgatcagagagattaggattgtattttgacataggatttggaacccatctaaatgttgaagttccctgagacagctctccagctgctgagcctgcgccaggggctaagcagcccctaatgagaggctctgctccctttcccacctcgccaatgttgttgttgctgcctttttgatttgtatcctctgttatagacattttttaaaaacgatttcctctttcattgtgcacaagtgctgagagtctgaggccccatttctgctgtgtatatatatcctgactcggggcttttattcagcaaactgttcattcttctgtcagacaatgtcatattcaactctgttcatattaaaccactgtgaagc

SEQ ID NO: 2749 - DNA, 1580 bp, Homo sapiens
gggtctcaccacattgcccaggctggactcaaattcctcaaatgatccttccatcttagcctcccaaatagctgggactacaggtatgagccactgtacccaagggtttttctttcaatatgtatgtgaccagctgacttaccaccttcacagtcttatatcactgtattcatttatcaggattattacatatagagggtaaaagacataggcctatatatttactgagatgttacaataatttcaaagcacagtgtcaccctggaaaagtcacatggcaagttgaatgattttcaaaagccccaggcccccaacactttaccttaacctccttggagctactggaagtcttcccttcggtcttcttctgctttgatgtggaggaactgtttttgctgctgccactcgtctccttgttgctgttactgcttgactttaaggaagaagactgactaatagtcctcttccgagagccatgctctgtttttggatcttttgaaggaacaggcccagcgggagaaggcaacaaatccttttcttttgcagcactctgcttagatgacctgccaaaccaaacgaatgccttcatttctccacacagtaatacaggggagagaacattcgttgccgaaaaaagctatcttcttcctccactgaggagggtttaacaggagtcctattgctctcggggtacttaggagtttgtgaggaaggaggaaggctctcactttcatctgaatctgaggatgaggtatctgtttctatgatttcccttgatttctgggaagatttacttgttgacttatatttctttttctctgctgtaggtcgaggggaagacttagactccttctttatattgggtttccttgagcctttggtggctgctttgtgtctgctggagggcatgctgctagccaagtctacaggggtttcactttctatcttcaggcctccacgaggctcttcagcagctgccttctcagcctttttgggttgttttttgcctacagttcttctctgtgttgtgctgtcactctgtgcaggagatttctgcctcccacgcccactttctgatcccttttggatggttttggagtctcgtcccggagtagcggaactcgtttctttaggtccacttgtatcagtgtagctattcccagtgccctgctctcggccttcctttttgtagccttgagatgatgggatgttactgtccactgaagaggcgggtgacactttatgtgggttcactttattcagccaattatcaagttgccatttgtttgttggcgggggttcaggctgaaaaacagagaaatatgtatgcttttttcgatactgaatgcttttttcgttctccctcctttacaacctcaaagaagaggaaaaaccacaatgcctaatgcaacaaaagcaaatggttctctatgaaccaaagcaaagggctgagtattgactattagctcttatcatctgaataagaagataagtggccaggcacggtggctcacacctgtaatcccagcactttgggaggctgaggtgggcggatcatgagatcaggagtttgagaccag

SEQ ID NO: 2750 - DNA, 1027 bp, Homo sapiens
acggggctagaattccaaggccccctctctctgataccaggttctccagggagacagatctgggcttctcagcagaggccgcagctgaaacgatgatgccaatggtttggattgacagcagcttaaggaggaaaaaaaaaaaaagaaagaaaaaaagaaaaggctggtgacacccccctggcgtggttgacctggtcccagtcgcagtccctatgggacagcagagctgtcaaaacagaacccaatgatgacggctgaaaatcaagccagactgctgtgcggtcagcttgccgccgtggaatgccttgtgtcttggccatgtccagccaagggtacaacgtgcttgttcccgatcacccaggtttgccattggaagtcaaagacagaatcgcttcatggcactacagatgtggaaaaataaaaatctcagctagaaagaacgtccgatttggagatagcgggaggacacgaaggagtgggggccattttggtgctgagaggagggtgccccaacttcaggaggaccatgtgacggctgtggttgttttcggggtcacttgcagcacacacagcgtccccttgatgctcgatggggaccgcagacgggcctgcagacctaacccctggctgtggacaggagaggctgctccaggcttctttccttctcaatgctttacacaggatttccttcatttgtgctttcctttggtttaacagttaaaaaagaagagtgagggggcaaaatggtttgtcacttgtccaaaactgagagaagaggtggaagtgggcgccaaatctcctgggtgatgcttcctggtcctggcgatcggttgccttgctcagggtttgggagctgttgctcctggaaccaccgctggccttctgggacctcgcttccgtggtaggggacgtgaaccagcctcctggtggagctttgtgttgcagtgaggccacaaagcaaaggcccagaggcagaggcctgacactggctgtggtcgacggtcacaccttgactccctctctctct

SEQ ID NO: 2751 - DNA, 3680 bp, Homo sapiens
ctatctcagattttattttttttaaaaaaggctccaatacaaggccccagagtagtgcatgcaaatcaacgaccctcaaagtgacagtcattgtcagataacaagcacaatctgctacagtctgtgacctggtaaagagaccaccttttcattttgagtcccatcaccaactatgccaatgtccaacctaccacacagctcacaatgactcagaggtacattttagtatctgaacagcaaagacatattgagctgcaagtacaatgagtaagtatccttagtgtattagacagggtaaatacaaacaaggcataaaagggaaaagccaacttcatctgatgcctgaatccctaagtctcttccatcttttctcatgatctgtgtctagggagatctgctatgccatatcaagaccttgctcatctggtgatgagacggggctgtttgccttggaagactaaagaaagggtgaatattcacatgaggtaagaacttgaagttgtggttataatacataggccaagtttgcctgctgtcaacccatctctgtaactccaactttgtgcctgcatgaattctgcgacatggtacagctgatgggtagagaattctaactcctgtgatgtatttacaggagaagataatcgtggaagaattaaatggaagaattcatagaagaatacagccatggataaacttaatcaaaagaatatgattttagtttggtttagtatattcaatcagtcagttttgtttgttttttgtgagacggagtcttgctcttgtcacccaggttggagtgcagtggcgcaatcttggctcactgcaacctccgcctcccaggttcaagcgattctcgtgcctcagcctccctgagtagctgggattacaggcgtctgccaccacgcccagctaatttttgtatttttagtagacacggggtttcaccatgttggccatgctagtctcaaattcctgacctcaggtgatccacccgtctcggcctcccaaagtgctgggattacaggagtgagccactgcacccggccaggcctttaaaaatagtttttaaaaatgtttcttgtgtgtttttcaatgcttttagttacttacagattgctacctgaggtgatttgagggaagggtatgtttagtgaattagtcttaatcaaaatcactagctaattaaaagagaaatgttctcacaagaaaaataattatgatggaaagcagcaattagcttctggaactacctgcttttcagttcatcctcttttcagagaaatgagaccctaagcagggaggagcctactggccatctgagaaaccctctagagtaacagagaaatgtcatgggcctcagggaagaaaagaggcctgtaccaggcaacatcttagatgcctggttgccaacttctcaaaacaacccataacaaccagcagggttggtaactggctgacattcattaacacactcatatggctgtttgtgaacagatcccaaatgcaaagcgtccttcacacacttctacccactccccatctccacacccctatacaagatcttttcattcaaccaaaaggataagaaatgtgctacagaaatgtgaacatcaacacaaatacagattattttttcatcaagagagttaaaacattcccattatcaagaggggtcttcaccagaatgtaacaaaatgaatttcagctttcacaccagtaaccagtgaaagtatggcctagagctagttacacggcataaagtgactagtggtcagttattgttcattagttcagatgagtaactgcagaaactctacccagagctgagcacatatggctatcatgatgtcagatgtcagttaagagttatgttcctgtaaaccaaagcaccagagctaaattaacaatttccctttctggccttaattgaccaacagtttaagtactgtggtgctaccagcacgatcctgggttgtgcttcttcaaacatttcagtttctcaatactaacattggtaataaaatatctcatcagggcgggcacagtggctcaccactcttattttctaaaaagctcaggaccagattcacattgataccctgcactgggagcttaacttcctgaaagagacaaaaaagaacttaaactgagaaaatagaccctggtgaaatattcccatcaccccaccttaaaaagaggtgctgggctctcctgggtctaaactctccccttcatagcagcacctcccccttctattgtacagacaggaagtgcagagcaggggagaggcggccccaggtgaaatggaactcacagcctactagggatggacttctgtcagagcagaatagagctcagtggaatctatcttctctgtcttggctaaaggaagggctctaaaaaggctgccctataatactgcataaggaaccaagactaggcagtagcaaatggacccaagaggtacacagcagccatttctgccctgggcccaacagagctgcatttagttatatctcggtagtaaaaatgtaaagtcccttcaaaaggggtaaacctccgattacaaaagatagtaataataaacaggaaaagcagcaactgaatgctgattctccctgttctagtttctattttattattcaactgtagtggaaatacctcaaagtgcgcaacacaaaacagcagattcctgcccctcacctgtgtgcatctgagttctcaccctgccaccttccccatccatcctgcctgccctctgtcctgctccactggctcctgccagacccctgggcccaaaggtgccctctccactgctggtcagtcagtgccccccttctgcttggccagggtgtgcttcagctcccgcagattctctgtcagcacctctacctcatccaggcggccgcactgcttggcatcaaagatgtatgccttgatgttatcgatctgctgcaggaggagctcttcctctatgggctcctcagcctctggcccactgtcactgtccatctcaaaggggttgatacaggtgggttcctcaaaggggttaccaggaaccagagggcttgagagcctctgctggggatgttcgtcttcctcactgaaggggttaggagctgggctgtctggctgaatgaatggattccctgccactgcttcctcctcctcgtcctcttcctcgaaaggattgtactctttcaggatgcgggctgaagggtctaaggaaacccctgcagcaggaggaccagtagtggcctcttccatggggctggagaggtcttcctcatcaaaggggtttaaggagggcccctcatgttgctgtggcatgctgctctggggtaagcgctcctggccaacggctgggggcccagaccacactctggtgggttgagttgagctaagtgaaggggtcttgggagctgtgctgcttggaactggggaagagcctagatccaaagcataagcaaggtgggtgcgaggctctctgctgggctccagctgaaaagggccgatttctctgaagtccagggaccgagtccgtgtgtgcagggatgccacccgaaactgctccctttctcgttccaactcccgttcacgcaacatctgcagctgttcccgctgcaggtcctcctcctcagcctgcctccgggacagctcgatggccttctctgtct

SEQ ID NO: 2752 - DNA, 1594 bp, Homo sapiens
ctggtacactggggtaaatcagtgtggtggtggaagaaaagccgggaggcctatttttataggaaaatagtaccattaaaggtgcaatgctgtcattttggacaaaaggaaagaaatttggaagagctgggattattggcaaaaacttgctgaggggtgaatctttagagctaatcactgcagaatcagagttgcagcaatatgattgcaagcaagtctgaatgcatagttttactttaattcggcttgacaatttgaataggtaaccccctcgggactgactgaatcgttatgcatgtgtcaatcaatgggaggtgtgcattctctagaagtagttttaggctgtttggtttggttttggttttgttttttaaatgcagcctgttgaggcactgtcatgtggtgtgaaagatttaaatgtagcaacgctaaagagtaataatttggggataagaagtggggacattggccgggcgcggtggctcacgcctgtaattccagcactttgggaggcctaggtgggcggatcagctgaggtcgagagttcgaggccagtctgaccaacatggtgaaaccccatctctactaaaaatacagaaaattagctgggtctggtggtggatgcctgtaatcccagctactcgggaggctgaggcaggagaattgcttgaacccaggaggtggacggtgcagtgagctattactccagcctgggcaacaagagcgaaactctgtctcaaaaaaaaaaaggggggggggggacattaagagagtggtgatgacccaaatgttgaaccaattatgttttggtggtggtgttcttagctgttgaatcctgaatggtttataaagtgaactagctggcttaatgcagccagcgttctgggcagcagaacatattcattcttactgtaaattctatttgctgcttccaaaggtgatgattttcaagcagacatgttctatatggtctgtgttttaggatctggtgcccagcctctatcagagcttgcctacctggcaaagctgcctacccttcaagtgggaaaatataatccactgtttaacaaggctcaccctctccaccctgtcctaacgaccttttgtgaatgtgctgtgatattttcttgctcaatagcaaggtggtagctctgctttcattttaagaaagtggaggctgagggcattgtatcaatactgttgcaactccaagaagttttccttgtaaaattaaaggaaagatcttgttattgattaaccattttcttatgccttgctattgacatattcatgctctttctacgtctagtggctgaaaatgtttgcatttgttcatttgactaatggtgtgatttttgtttctatattattagacctgtaatgttttaaaatgtattttattaaatttggactggatgtatgtctctagcaatacgaggtactttctaaactattaagggaggggttgtatcctcatgttgagataagatgatggtcgtttaaattttgcaattttttttggcctgcagggatattttgtgtttatgtgtccaaaaaaggaataaattggcattcttgtgccaaaagttgtttt

SEQ ID NO: 2753 - DNA, 1300 bp, Homo sapiens
ggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggttggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagactcttgagaaattgttactcattgaactggagcatcaagacatctcatggaaatggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaataatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtctgtggttcagagtaaacttgaagcagatctctgcatgcttttcctctgcaacaattggctcatttctcttttttgttctcttttgataggatcctgtttcctatgtgtgcaaaataaaaataaatttgggcaaaaaaaaa

SEQ ID NO: 2754 - DNA, 1638 bp, Homo sapiens
gcagagctttccgctcgtcccagctgcacctcggtcctgcaggccgtccgcctggcgcagctgtagccatagcaactcacgcaggaccgcgctttacagtttaccaggcactcggacgcctttggcgcgagcgcccgtcgctccttcctcaggtcactgcggtgcaccgtgcgggtccgcgtcgtgtcctccgctccggagcagggaccgggcgtgctcgttcagtcctgtgcgcactcggaatggggccggggaaggctgagcctcagggcgaccctgatgtggagccgtgcgaccgctcactgcggttgaagagacccaggcgcagacagcgcaggcgggtgataaggagcgaagctgggagacctgttcttcagagatgagcccaaccaggaagtgagaaacaaggttgtggatgatgacacaagtctccctagcaacaactctgcagaggcgcgcaagcccctggcctttgctgcgtgaagcgggaagtcatccagctgcctaacgcctgagagtcagcaacctcaaggccgaggactcaccaagtgggagtgagcagatactttcctgaatgcctgagcaatggtgaaacagagaggtctgagcaagggaagtaaaggatggtgtaaaacaatcccaagacaactggcaaagcaactgaagtcactggaggctttctttttcccctctcatcctggaaaacttactggcagctgaaagagacagacttatcttctctgatgatctcggaagccagatgacctggtctgtcagaaggaaagaagactgtccacagtgagcttcctcctttctccctgggcagtgtttccacaccagatggagaggagcagggaacacgcaacaaagcctggggcccgggctccctggacgttcatccgtgcccctaggcatattgtgttttgtttggagtagtggtcacggttagttttaatcctgggatccagaaagcaaagcctgccacatttgcttatttatgagtatagagagcatcactgaaagcatcttcaacctgacaagcatcaatgaaaacaactgctggattcagagggagacttccaggtttatgcctgaaagctatatttctttgatcaaagggagctgtaacaatcacaaggtcactacccagcattattatttttttttttttctgaggcagagtcttgctctgtcacccaggctggagtgcaatagcgcgatcttggctcactgcaacctctgcctcctgggttcaagcagttctcctgcctcaggctcccaagcagctggaattacaggcatgtgccaccatacccgactaattttgtatttttagtagagacggggtttcatcatattggccaggctggtcttgaactcctgatctcgtgatctgcccgcctcggcctccccaagtgcttggattacaggcgtgagccactgtgcccggcctgcccggcattatcttaatcataacaatgaccatcaagtttatcaccagaaagtgaaacactcccgccttgtggaacatttgtgtatgacatggcactaattccaactgtaccaccaccatcactaatgccaaaagcagaactgagacactcctagaaaagagcttccctcccaacagagaaaaaa

SEQ ID NO: 2755 - DNA, 1029 bp, Homo sapiens
cacgctttgctcgaagggctcttaggaaagaattctgagttttaaaaacaggagtgggagggtgagatagtcctgatgattaaaaactaacgcaaccgcagtaagtcactttggcacactgtgtcatgtaaacatagctcaccgcaaaggacccctccccggcccacccctgctcttgacgcccggaccatccaaagccgcctcccagctcagggacaggacgccgcccccagggcatgggccgcacaagggtctgggtagacacgtgggatgataggaaggctgagagggcctaggggtgcgggcggggtaaaggtgaaggggcaaaggattcgtcagaaaacgtgattttaaaacgagccagattcatccatttccctccttacagtagtagcagctcgcaggggtgacgaggaacattcctgagcacccaggtagaagccaggcacctctccccgttatgactttcagttcataactgtctgtggtttaacaggaccccaaggctcctgtctcccgccctgaatcctcagtgtaaatgagcaggtattgtttggttctgacccttcctaattctttccccaaagccccctgaagcagtcatcttggccaggcggggtgtgggagggagctgcgggcggggcaggactcgctgcctggctggagctccccaggccagcaggtgtgcaggactgtgagccaggcctgtgccctggctgacgggctcatccctgacactgctggccattaattctgaaggcccagcgtgcagggctcagatcacaatgaagccaatactagcgtgtgacagctgcctggcatcattggtctgccctgtcgccagggggcagcggtattgctggctcacacagagctatggggtatgtcttatattccttagagaaaagaaatttaatgtaaaaagacccaaagtgatatctgtcaaaataagtaaccgctccaggttcacagatacgcacagcacgcaaggtggattctgacgcacagtagggactctcaggctgacgc

SEQ ID NO: 2756 - DNA, 566 bp, Homo sapiens
taaagagttctatagattgagaagctatctgcagtggagccgccaccaaaatgcagattttcgtgaaaacccttacggggaagaccatcaccctcgaggttgaaccctcggatacgatagaaaatgtaaaggccaagatccagggtaaggaaggaattcctcctgatcagcagagactgatctttgctggcaagcagctggaagatggacgtactttgtctgactacaatattcaaaaggagtctactcttcatcttgtgttgagacttctggtggtgctaagaaaaggaagaagaagtcttacaccactcccaagaagaataagcacaagagaaagaaggttaagctggctgtcctgaaatactataaggtggatgagaatggcaaaattagtcgccttcgtcgagagtgcccttctgatgaatgtggtgctggggtgtttatggcaagccactttgacagacattattgtggcaaatgttgtctgacttactgcttcaacaaaccagaagacaagtaactgtatgagttaataaaagacatgaactaaaaaaaaaaaaaaaaaa

SEQ ID NO: 2757 - DNA, 884 bp, Homo sapiens
acttagcccagctccatggggtactgagatacatggggccgaaaaggggtaatatggccatcttttatcagaaaaagtgacaaaacgggaatttaaaaaatgaattttccatctgactttatttccaaatacactttcttttttaaaaaaccaatacactttctttgaggatgacagtattaggaaatccaattatacaaaaaatactacatctagtctggggtagatatatttatttttggtaacatacattaagtggcactaattacacagtaactataaggtaactaacatgaaaccacagaactgtaactctgccacagctgcatgaacttgggcttttctggttgagcccattttcaaaaaactgcccaccccagagctatgccaacaaaatctgttacggagtaaagccctgaagtggtgactcaccagagtaccttgcagctgacagataataggcaggacatgttagttataaagtagttacagcctaattcacaaaagttaccaactgtttctctttctagaaagaagcaagaagttaagaaattccttgaattagcgcctggtgtgtcaggtgggagtgcagaggagggctgttagagcagtgtcaaaaggaccctggtgggccagacgggttggacatcgttaataatcatagttggcttctaaatactggtagcaagatgacttctgatttgtaatcttaggtaaattatagataaatgaaaaaggccagtaatcatacactaagattaataaacagcacttcaaaattaaccgcataagggctgtgcttgcagcaaggtttcacaagacaaggcacccagattttttcttcccacgtctagcttgcagagcagctctcgtagccatttcaa

SEQ ID NO: 2758 - DNA, 4246 bp, Homo sapiens
cttcaagcagataatgtgagttctactaaagaatatgttactctacttctgttgattaaactcttcactctgacaactactctctcttcagtttttctttttcttctttagatggagttttgttcttgttgcccaggctggagtgcagtggcatgatcttggctcaccacaacctccgcctcctgggttcaagcactctcctgcctcagcctcccaagtagctgggattacaggcacctgccaccacgcccggctaattttgtatttttagtacaattggggtttctccatgttggtcaggctggtctcgaactcccgacctcaggtgatccacctgcctcagcctcccaaagtgctgggattacaggtgtgagccaccgcgcctggcctctctcttcaatttcaaaacaagatcaatttttcatcactctttgctaaacaacaggtattgctctttgatgcataagagggcgaccttttcccctgcagtatttctaccacacaatcagtgtctaattacctattactctcctcccacaaaaatcccaatgtcctaaggtcttggcctgctccatttcatgttcagttgatagaccatttctttcctctaagccacagtactctcctggtaggagaaaggcaccctgaacattatcagaatggtgagtgacatcatagttttacattgtttttcgccactcccaaatgctaattcagatgatacttaattttaaaagcaaagtcctccttcttcacaaattggatagaaataatccttcacctaatcaatgatcttcacccaatcaatgatccttccatcccaatgatctttccaagaaagcaccatggaaggtgtgtaaggatgcacaataagatttcaaagttcacattgaaacgcaatagtaggctttccaaaaaacctcaaataactcagtgaaacatttcataaggtgaaggtaactgactgcctacaaatatcctgcaaccttttcgtatgtgagttaaaaatatataatttttagcatatttggacttgtgagtattctacagtgtataatatcaaaggcaaacagggaaaccagagactgttattcctcctaggaatcctcacttaccatcggtcactgggtaatggcctcaggatgcatattacatttgtttcgtttcatcaaagatataaatcttgatgcctagtaacctgcgaggcctggatagaccctctgccacatatgtttacatgatgtctcttgcttatggcctctcatatctattaatgcttcaactcatgagggattggccactgtcactacatttgtaaggattctgtcaagaatgaaattaactgatgtgaaaggagtgaattgtacctaatgacctcaccacactcatttgtaaggtttctctccggtatgcattctgtgatgacttgcaagatttgaactctgcctgaagaccttgccacactcattacatttgtaacgcttttctccagtgtggattgccatatgggtagttagacttgatcttaccctaaaggctttcccacactctgtacacctgtaaggtttctccccagtatgaattcttcggtgatttgccaggtgagcattttgagtaaagaccttgccacattcattacatttgtaaggttttttcccagtatggattgcctgatgggtggttaggcttgaacgaacactgaaggctttcccacactcattgcatcggtaaggtttctctccggtgtgagtcctttgatgatttgcaaggtgtgagttctgagtgaagaccttgccacattgattacatttgtaaggcttctctccagtatggatgaccttatgggtagttaggtttgaatgcatactaaaggctttcccacactcattacacttgtaaggtttctctccagtatgaattcgccgatgagttgcaaggtatgaattgtgcctaaaaaccttgccgcattcatgacatttgtaaggtttctctccagtatgtattgcctgatgaaaagttaggcttgaacgatcactaaaggctctgccacagtcattacacttgtaaggtttttctccagtatgaactctccaatgccttgcaagttgtgatgtttgagcgaagactttaccacattcattacacttgtaaggtttctctccagaatgaattccccgatgacttctaaggtgtgatttttgagtgaagctcttgccacattcaatacatttgtaaggtttctctccagaatggattgcctgatgggtagtcagacttgaacgaacactgaaggctttcccacactcattacacttgtaaggtttctctccagtatgaattcttcgatgatttgcaagttgtgaattttgagtgaaaaccttgctgcattcattgcatttgaaaggttttgttccagtatggatgacctgatgggtagctaggtttgaatgcatactgaaggctttgccacattcattacacttgtaaggtttctcaccagtatgaactctccgatgccttccgaggtatgaattgtacctaaagactttgccacattcattacatttgtaaggtttttctccagtgtggattgtctgatggattgctaggcttgaacgaacactaaaggctttgccgcactcattgcacttgtaaggtttctctccagtgtgaattctccaatgacttataaggtgtgaattttgagtgaagagcttgccacattcattacatttgaacggtttttctccagtatgaattaactgatgggtagttaggtttgaatgtcctctaaaggcttttccacactcattacacttgtaaggtttctctccagtatgaattcgccgatgagttgcaaggtatgaattgtgcctgaagaccttgccacactcatgacatttgtaaggtttttctccagtatggatgacctgatgaatagttagatttgaacgaacagtaaaggttttgccgcactcactgcatttgtaaggcttctctccagtatggatgacctgatgggtagttaagttcgaatgcacactaaaggctttcccacactcattacacttgtaaggtttctctccagtatgaactctccgatgactcgcaaggtgtgaattgtaactgaaaaccttaccacattcattgcatttgtaaggtttctctccagtatgaattctccaatgccttgcaaggcttgaagtctgactgaagactttaccacattcattacacttgtatggtttctccccagtgtgaattctctgatgagttgcaaggcttgaagtctgactgaacaccttgccacattcattgcatttgtaaggtttcttgccactatgaattacctgatggttggtaagtgttgacctcacactaaaggctttgccacactctttacatgtgtaaggtttctctccaatatgagttttctgatgtagtgcaaggcatgaatttcgactgaagaccttgtcacactcataacatttgtaaggtttctctccagtgtgaactctccgatgtagtgcaaggcatgagttgcgactgaaacttctgtcacattcattacatttgtatggtttctctccagtatgaactctccaatgacgcgcaaggtttgatttttgactaaagaccttgccacacagatcacatttatatcctttctctccagaatgacttacctgacgtacagtcatgtgtgagccatgattcaaggctttgtcgcactcaatatatctgtaaggtttttccctaatgcatgatttctgttcttgtgtgagtaatgaagaacagatgaaatcagtcccatatttattagaaacatgggttttgatggtagaagaaattatttggggtggtgaaactgaggaaccatggttgacagacttctcaacatggttacattcataaattttcccttcagcttgaaactgctgcagttcatggggatgtggtagaaagcttaatccaagctgatgtttaatagacttgtttcctatacctcttctatcgcgttggtctctcctacaagtaagattttcttttggggccgtagtcactttgttgcaatttctttcatcatctctccactgacagtcaaagtcgtgtatttttttcttgatttccctgaagcaaaactcttcaatgtcatgtttttcatgttgttccaatgtcactgtgtggaatacttctcctgggttaccttcctgttgtggtgctagttccttgattacacagttac

SEQ ID NO: 2759 - DNA, 2677 bp, Homo sapiens
gtgtgtgagtcagggtctggctctgccacccaggctggagtgcagtggcaccatcacggctcactgcagcctccacctcccagactcaagggatactcctgcttccgcctcccaagtagctggaaacataggtgcatgtcaccatgcctggctcgccctgcaattctaagccctctgtggatggaggtgggatgggagcagatccacagcgaccatgaaatgcccagcttgcaactcacagtggaaggcaggcactgcagggacagctcacggggaagaactgacacactttctgtgaccagtgccctggacatggcccggagtcacatcctagggtggaggggggcaccaaccttgcagggcttcagcaccccaaccccagagggccctggaggagggccggtatggggggcccggggaggcctgagagactgggcccagggccgagacacagaaggcttcgtggggggtggggacacagaaaccgagcagagacaaagccgctttctgctctgcccttgggaacagagggttgcagcctgggcaccgtgtccttggatctgcagcctggtgcgcagatgggagtgcctcccacactgggcaggggagctggagcctggacagcaggccagggcctcatttcagcaccacctttctctgctcccatgacgacagccagcgaggccgtgcgcagcctggagatgtggcagggggcacttgcctccctgggctggccccagagcagggaggccactcaccactccaggctgtccccctggtgcagcgcacgcagggcggcatccgggttctggtcgtggagatagatggaggcggccatgagcaggaaggtggtgttggtcacgtccacgctcctgctcatctctcggtccagctcggccacgatgctgtccctgcaagacagagatgctcacgacccacagctggggtggcctctgtgggacctcagagggtccccttccttggaagcagacaggtccagagagggtgagccaggccctgggggtgcagagcagcagcaggccgagcatcgagctgtcccgacatgtcctccctccgttcctatgaagcacctctcatgctgggccaggcaaggacccgaggccgggagatgtggggtggggcgctccaaggggacatgaggaggcaccgtcagtctcacaccaacctcacccgccttcctgaggaggctggtgggcccagctgggactcctgaccataacccatcaaccctgtgggcttcaaggccacgtcttctagcaggaggtcggcctgggtgccgaggggccgtgcagaaggatgggagccctggggcacccccactgccagggcagctgccctcagtccctgagagcccagggtgctggctgcaccctgaagatggccagtgtgctgcgggccagggccaggcttgagcccaggcaaggctgaggaccggctcagctccgagggcacaggtcacccatgcctccatgtccctaactggacccagaccctccattccccatggctattgagcagctaaaaagagaaggcaggtgagggggccaccctagaccaaagctggtgttcttctgggttcaaacgtggctctgtgaccccgtaagcatccacgcgcatctgggggctgtctgcccagggcccgtgtctgaggtgtcactgagggcatggcatgtctgataccaaccaggctccactgagggctcgccacagtgccaggtccaacagacaagtgacttcaggtctgagtctgtttccccgtgctgagggaccatgttacagggatcatgcaggggaggagcaaggagctcccaagaccatcttacaaagcttcctgaggctccagcacacaagggtgtataaacactgccagttgtcgtagcgttggtactgtaatgttgtcatcctaaggtgttacaattaccaatggggccgggtactgtggctcacacctgtaaccccagcgctttgggattacaggtgtgagccactgcgcccggccaggcaaaaccccatctctaaaaaatatacaaattagccaggcatggtgatgcgtgcctgtagtcccagctattcgggaggctgaggtgggatgatcacttgagcctgggagatcaaggctgcagtaagccaagattgtgccactgtatgccaggctgaacgacagagcaagaccgtatctcaagaaaacaaaatcaaaaccaaaaccaattactaatggatgctccttgtccccggggcgtcctgccaatgaggtcgcggctgtgcagccagatgaacggaccacaagcccctgcctggaccgcctgctctccggggctgcttttctgtgatgctcacagcagctgctgctcctgggggacccagggttccctgccttcactccagctggtgaagtaagtgcagggtgggagaaacagtggccctgggaggtcacctgtctcaatgtcctggagctgctgtggcaaagcaccacagcccgggcagttaaggacaacagggattcgttcctcacagctctggaggccgtaagtctgaagtcaaggtggcggcagggctggctccagctggaggctggagggcaaggccgtcccaggcctctctcccagctctggtggctgctggccactcgtggtgctccttggctagcagacatgtc

SEQ ID NO: 2760 - DNA, 542 bp, Homo sapiens
gctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggggtcggcccgaaataggcggagttgggattcgaactcatttcacaggcagagggaggagagcagccatagccacctccactggttccgactccagctcccgggctcgcaggagtaaacgcgcatgctcagggagctcggtcgcgcatgctcagcgcaacggcggggaagactccagccgccagggggagcgcgtgccgttcttgcctctctggcctgcgcctcctgagccgagtagatatcccggagttccgcgcggcgccagcccttccgccacggccgtctctggagagcagcag

SEQ ID NO: 2761 - DNA, 1626 bp, Homo sapiens
cccgggaggcagagattgcgatgagccgagatcgtaccagtgcactccagcctgggcgacagagtgagactccatctcaaaaaaataaaataatgaagtggaatcaaggtggcaagaaaatttagaatcgtttctgatagggactttcccttatcctaaatgtgttttgaaggcacacgttatttccattgtcattctgactttagaaaggcaggttggggcatgagtgggcattttcctaatgacttgctgctaggaggttataggcagggaacagtctgggagtctctaatccagagagactttcagattccctctcttcacatgaacctccattagttagattttgggaaagtgagcatgaagaagggactcagagctgccaggtacccgagtctcaggtctgacatccttgggccccttctgccacaacttcttgccacttcacggacttgaattatgttgcttcttcctggaagtctggcctgcagcacaggcctttcctctccaaaaagctgctgctcatttctggccccatctgctgctatctttgccatcagccatcacagtttggcatcatcagagtctcagctagaggagctgtcattctgccttagtgtttgcctgcgacctgaccaggggcatgaccagctgggatgtcaagtgacatttgggaacttgtagaggccaaatgattgaaagtttaattcttctcaagacccactgatttgccagtgtgcatggaaataatagattagagcagaaactagcagggactgttgtataatcgtgatctactagcagaattgggcccaaagagaaagaatttctgaggctgggtttcttctgggagggtagcaggttggtcttggccagtgctctgtttcccaccagtgttgttcccttttccagcttgcctggcccggctctgtcttccagggtcctgctccagacccctctgcctggggtctcccctccatccagggggttctgggcatcacagctcctttttttcctttctcctcttccagatccagtttcagctggtttgcttcttccagcaggcacccttaggcccaggagcagctcccctgagagaatttgagtcactcatttccttgaacagcacccccctttatactagcagccatttgtgccattgcctgtgccctagggtttgtggggagagagcgagggatcactgagcagttttcccagagctccatgggaaggcaagctctccctcccaatgggagccccactgtcactaactgtaaactcaggctcaggcttcaactgcctacccccatcctcatatttctgtctgtcccagcacctcaggagcattctcattgtggccggctaactccgcctggatgtgaacaggcaagcacagtgggaaatgagtcacgtacttgtattgcacagtggacacctctagaggtccattggtttaaagggatagggaaggaggagggatgagaccatcaccccctcccagaagtaaatctagtatctgagttttctttatgcccttgagtcaaactaataactgtctagtacggaggtgtttgctggttttcttcggtgttttttctaatgcaataaactcatttctgcctgctg

SEQ ID NO: 2762 - DNA, 2528 bp, Homo sapiens
cttcagcctccgatcctgaccggccaatgtggttcccaccgttttctacccccgatcagccggagctagttcgccctcctccctcagcgagcacccggggagagctgtcctaggagagtctgtagagtccctcgattaccggtcgcaaacgcctttgggagcgcagtctgctgcgagcgccgaagggtgagacgcacggcgttcccgagtccccggcgagggtgtctgggacgcgcccctccctgcggctgcggcggcgcacagacctcggtcgagcgaggcgacgtgaggagaggtggctacaggcttaagccatggcgcagaggaggggccgggcggtgtggccgcagggtccgcggaccgggctcgagtctccttcctgccggcgtcctagtgcagccggccacctagcagggctgggaggccatcacctccagcggagaccgagcattgctgcctccgccgctgcccgcgaggatgccgcagccgccgccgccaccgcctcttctcctgggaagcgaccccacccttttctgcagctctcggtctccgccgctgcccgcgaatgatgctgcagccgctgccgccgccgcctctgcctctgctgcagggaagcggccccacccttttatgctgctcagcagtgagaaaaaaatccaggaacgatgctgactgaaagagtgctgcagaaaaaaacaaaacaaaacaaaaacacctgctgtcgtcagcttgcgctgctgggagcttgccttccctccccaccaccctccgccctggcagctcctccctcctctactcccgggcaacagcagaatctggggacgtagtgggttcaagtcccaagctcgtgaggactttctgtccttgtgcttgtcgcttcatccccaggagtcggaggctcctcttttgtaaaatagggccaatggggggggggggtgctattaaattttaaaacatggaggaaactcctagtgaaatgtctgtcccagaatagatgctttgaaaaggggagctgctggaattggtcaaaaccggcgggctgtgtttgagcccagtttggttgcctcctggttcaagcacttgccagtcttacgcacaggccttgctcagatgtgtcggaatgggagcaccagggctggtggtgccctggatgttcctttcctagggaatctttgcgaaggtatgttttagactcccccaagaaccgcccagtccctgttcagttcaggtgccacactggggcagaggtagagaaaagaaaattctggaaagtggcttaattgtggaggttgggagtaggtaggacctgtgccctaggaaacggcagtgcctggcctgcaggggccttctggcacgttctcactcctcgccgttgctcttcttctatcttcaaagcagaagagattttgaagtccgaaagacctggtttggctctgctactctctgtgccacttgggcaagttgagtcatccctgtgtttcagtctcctcatctgtagaatggaggaaatactacctgcctcaaaaatggttttgtgggccgggcgtcgtggctcacacttgtaatcccagcactttggtaagctgaggccggtggatcacctgaggttgggagttcaagaccaccctggccaacatggtgaaaccctgtctctactaaaaatacaaaaattagctgggcatgatggtgcgtgcctgtaatcccagctactcaggaggctgaggcaggagaatcgcttgaacctaggaggtggaggttgcagtgagccgagatagtgccattgcactccagcctgggtgacaagagcaaaactccatctcaaaaagaaaaaaaaagtggttttgtgaggatagcgaaggacccagggcagaagctttgagtcaaatctaatctgcagagattcaaatcctggcttttgtagctcttaactgtatggcagtgggcaaatcactgcaatcttctgaccttcagtttcatctatgaatgggggtaccaatactgaacttgcaaggttgttctgagaattaaaatgagataatgcactaaaaatgcttaccacaacatctggcatatggcaatggctcaataaatggtagctattagtatccaaaaggcccacccagaagacccataagtggagtgtcctaagaagccacttggacaccttctccaggagacctcttgttcctccaagtaacttttgttctgtctttgctatctctccatttatgtctcctgcactcctccactagctacatccactggacttcagctcttttcccctccaatataggcagagttttcagtatcagttaagctgggagcattggtgtttcagggagagaaagtcatgtatgtgtttagattataaatgggttgcacaacacagattttctttaatcctagaatcaaattggatgagaagacagctctgattagtcaattatctactgaacttcctcctacttaggactttgcctcttggtgatttgatttgagttccataaataaaataatgtctggtgctg

SEQ ID NO: 2763 - DNA, 870 bp, Homo sapiens
gcacgtcctgacgcagcttgggcccgcggcggcggcaagggcgggagggagcggtcgccgcgggatttggagctgcctagcctcgcggtcgcttcaagagatggttccgttgctttggggtgaacttggtaccagtgccgtgttacttatccagttctaactcaagaaagttctggagggcataatgatcttagataagaccaaggccccgaacctgaccatgttctgtcttctctctttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccaggtaggaggatcctggaagctgtgagcaccaggagccttgccagaggaggatggggccagatatgaactctctaccatgaacatggttctcggcttatgaaggaattttaagtaaaacagttatttaatttccacatattcaagtcaaaagccttctgtgtgaagtgccagtgattacccctccacaggagttatcaggatttttctggcaccaagtttaattcttcttcgtacttctggtagtgacagatctgcaggacagatttatctgttgaatgctcttgggcaggaaaaccatgtaaaacctctggaagcagcatcaggacagcagagcagagcccccgtcctcactgctcacttgcacagaaactccatctggactcggatgcttttactgaagacccatctagcttcaatcatctttagagtccatccattctggagagacct

SEQ ID NO: 2764 - DNA, 2253 bp, Homo sapiens
agcaatacaaaagataaatatttattcagaacaaaacttttaacaatcaattttacattctaagccacaaggaaatagcaaaacatatagcaaaggaaaagcaaacactaaaagaaaagcagtgtactgtcttttctactggataacacttagttggcccatgacctctcgcttggcctatctcccaagtacattttagagttaacagctcactcataattttgggttaaaatccatctttctcctgagaatcaggagttgcacatgagctccagctagctgcttctctagggttcgtagctattgaggctaaggtgcaaatgtaaacctttggtaggtttctttacacaggggcacccccatttctcactggtggcaatgaatggggaaggggtagggcctccaaaggacctggcacactgtaatccagaagtggtgccccagggagcaacgaatgcaccctggagtgtggtccttggtccgttccgtatctcccaagtattcagaagcccctccttaaaaaccttctctttctgctccctcctccaggtgatttctcagcattcctctgggctgatcattctggagagatcagactttctgggccctcaagtgttgaggaaattgttgtgaagtgtgagaggtagtggaatgagcaccgggcttggggtcaggggactctactataggctggctctggcaccagacagctatgtgattttcacccagtcatttaacctctttgggcctgtttcatctgctggaaaaccagggaattggtccaaaccaactctcaggttctttccagcaggaatattctagattccatgattctataaaaaatggcttctgagccaccaaaagagctgtcatgaagtccatgcatctttgtgccataagagaggcccttggccaccattcagagcttattgattcagattatatacacttctaacaacactggtttcacaaattctcagaccacgtagattaaaagcagcaaattaaatgagggaggggaagagctgcaaaaggtagacactctgatagaagccacagtcaacaatgttttcaattcagcaaacactgatggagtgcctaccacgtgttgggccccgtacctagtgctggggcataaagatgagcaaggcagcccaaagggtgaaaatccaggggaagaaaaggtatggggcggggagggcgggaggggggcaaggagagagagaaaaagtacaagaaacaaaacaaatacccaatagaaaaacgaaaataaaattttaaaagggaggggcaacacatctgcacgctacagttctccgcagtcgttattggtgacagagtcaccaattcagaacaggctgaaatggagtaaactcggtttaagaaggcatagagagatgtctcttgtaggttttaaaaagatctccttcaaaaacgataaaaaatggtttaaaaaaaagttttggcacttaagagggataagctggctgtgtgttcaccctggcaggcaggcgggtgtttagtgcccggccacgccggttagctgagctgccacggaattgtgcactgctttgggacactgggcaaaggcgtgtcctcgcttgccacagaggttgcacacgatgcccttccggcagtaagggctcaggtgcccctcctccccgcacctgaagcacctgtcctgcgtgcagctgccgctcatgtgggtccgggaaccacatttaaagcatgtcttgggctgccccttgtaccagctgtagcccctctcggcccccaggaagaaggcccctggcaagtgcctgaccccgccctccccctggcgcagctcgatctcgcatttgtactccccggtccagatcccaaacctgtcggtcactttcaccggcacggccagcacgtcgcagtggcgcttgagccaagtcacaatgtcctccacgtccaccgtctcgttccggaagaggatgaagagcgtcttcaagctggacttgctccgccccagcaccacaaagttctcccagcagtcctcctgctcccgcttctcctcgtagacgcgtaggaacagggccagcttctccgctgagcggaagctcacgtcggctagattcttcaccacctgggcccagcccatcttctcgcggccgccgtcggcctcctcgccccgggccgcgggccgcgcggggggcagaagctgcggccgcccccgtttcctctcttcctccgcgccgccgccggtggccattttacctccttccc

SEQ ID NO: 2765 - DNA, 774 bp, Homo sapiens
acgaagcaaggcagtgactagagtccagacatcagaactagttccatgttttttttttcactaccagtccctaggccccaaaccgcagatcctgctgtgtgaccattaagcccctgactgttctaggctcaacttccaaccctttctgcaggtcctattacctctgcctcatcctcccaacatgataaccagagtcttccttcacattgtactgcctacccccttatgttcccaggctctcccttggttttcttacctccttgcagtccattttcagatcctgtccattgatctccacccgcacaatgatcacctcataataccactcccgccggatgggtgtataccagagactgcctgtgtacagcgagtggtcgatacctccaatgatctagggaaaaaaagaggcaggtacccgtgtcctggcacagaaggagagtgagtcccccaaggaccaagcaataagatcagtgatttcttggggtggcaaggtcttctacaggctacccttttcatcttcctgcttctaaacaaatcatacccaaagtgatttctagtttcttaaatgtgttcaggagaaaagactttccgggatttttaattatttgtttcagaatcatacagcccttgatataaagttatttaaatctaaactgccacaataaatgttgaatgaatggttatttgtttatattataagttttattttctctgcttattggagaaccattcaccattgttctaattaattaataaatagacaaacttcttata

SEQ ID NO: 2766 - DNA, 4163 bp, Homo sapiens
accatcagtgcttcagttttctctctatccaaagcaaggttttaactttccttcattctccagtaaaacagaccgagacaacttgaactatattttgagtattgctatatcttcaacatatagctccaaatgatggattgtatacaaagcatagtacagaaggtttcagtaattggaaggtgaacacagcaatgctttacataatttgtgttttttagtaaaaaatattggattcaaagtaagccaatgagcttgtatacaaattttatatacaaattattgtatagaacagtgatatggaaaataggtaagggtgatattaatatctctgggtataaggactaccttatcgtttaaatattttatttccatctatagcctaatatagaacattgattttctagtagaaattctgggaagggcttttctgtctctgaaattgattcagtacagttgacagttcatcacggttacctggttaaacactttttttttttttttaattctccagtgatctaggaaattgtttcatttttaacacaggcttatttctgatggggatgggggcatagaataatatgcctaataagctaaacgttcttaacgtttcatgtcttaaactgtctttttgaacattgagaccacctcaagtgctgtaaaaataagaatgttatattaggggtgtgtgagacgccctagtctaaaatctatctttaaatatatttcctttgtaattttcaaagacttcagtaattgtgtgttatggtggaaataatactttccattggtccacattgctctggaccaaacctggagcatttctataattagagctatctatgaatcattaaaaatggatctagaataattttggggagagggagtgtatcatttagtttaggcttacctcagcagcacttcatagggtgaggagttgtttgtttctttaaaggtataactgcattgtaaaatgactgggtttattgtaacagtaatttatgggggcaccctttttggattctccattgcctcagtttcctcaaggaaaaagttacagagattaagctaaattttgaatttagagaataactgctgtgtaattttggtataattaccataaatttagtgtcttaaaacacaacatacattatttcacaatttctgtaggtcaagagtgtagttaggttttctgctcagggtctcacaaggctgcaataaaggtgtcagccagagctgcagtcttatctgaagctagggggtcctcttttatgcacatatggcaaaatccattgcctagcaactgaagaaatcatgggaactgaactataaataggccaactttaattgttaactcctcgggtttggtggattatctaccatttatatataaaatttcagttagaatccaccattggcgttttgaaggccaagatagctgagtatcttatcctttttgtaacttcttgattattttacttattggcaaaattcattaactgtcagccaataatttaatattatgggaggaaaaaattttgcccagatatctgaggcaatactcccaaacactaacaaactgatgcctaacaaacttgacattttgaacacttaaagttttccctaaactttttaataagcacattaataaagtatgcttttaaatatatatgtacaataatttttaaaagttgctgcaagatgccttcaaatcaatatgcacgttggtggcattagtgcagtcttctatttttatttttttgagacacagtctcgctctgtggcccaggctggagtgtagtggcgcaatctcggctcactgcaacctctgcctcaagggttcaagcaattctgcctcagcctcctgagtagctgggattacaggagtacgctaccacgcctggctaatttttgtatttttagtagaaatggggtttcaccgtattggccaggctggtattggaatcctgaccgcaaatgatctgcccacctcggcttcccaaagtgctgggattacaggcgtgagccactgcgcccaaccagccttaattcttaataaaggaagttgaaaaataatgaacattggtaaaactattctagtgtgatcagaagcaaatttggactgtagtgtcaaattgataaaaaactaagcacaccaatcatgtataagaaaagtagatttaacatttttttccctaaacacttaacccagaagttaacaataatcttgaaaattccttttaaatccaggccctttaggtgatggcagtttgactcaggatgtccaagtccagtgtattttcaataaaattgacttgacagctactgctctgggtgtaagagcagttgactgtgaggaaaagtaaatggttctacagattctttatgatctacctcccaccagaggactgcagtactcccttgttatttatattttctgccccaatttttgccttctccacaaattttataccttttgtagctgcctactccagattacttcacctttccagactatcagttcttccacttttattcttcataaagaaaattccaataacctgtttcacttaggtttttctattactcttcaagcatgaatcctaatttccctgactatatcttacctctgatctccataactgatggattcctatcctagactatgttactctaatattacccaagattttctccagcctgtttttactcttactttgaaacagctgtttaaaatgactcgtaatctgcttaaatctacatgctttttgtggttctcaatccagttacctaccttccagataattccctcactgtcctgtcctctccattcctctgatgtttaagccctgtgagccacctttcccccatcctttgtgcatagttaccattttactctttcttgttgcccaggcaggaatgcagtggtgccatcttggctcactgcaacctccacctcctaggttcaagcgattctcctgcctcagcctcctgagtagctgggaccacaagcgtgcaccaccacgcccggctaatttttgtatttttagtagagatggggtttcaccacgttggccaggctggtctcgaactcctgacctcagatgatccaccctccttggcctcccaaagtgctgggattgcaggcgtgagccaccgcctggccaccattttactctttttaggtacagtaatctaatatccaaagtcttggactcagctaaagagggtatttaccttaaaaaaaaaaaaaaaaagactccatcttttgattcataattgtggtgggggcggggaatcaagacaaccttagtcactttggtattaccataattcttgtcttttcagggttgtcctgttcagctgcataaaacatcatgtattctaggtatttcctaccttcacttacatttttacttgccgatgtgctgccttcataaatgggtatattccgccacacatctagtaagcccccaatgcagtacacaatgtgtatcactgataaaactcgcacttctgccatgtcagtattatattcagttgagtggtctttagcatagtggcagtcctagtcatcctaaccttttagttaaggtaaaattacatatgtttatagaactcatatagacaagctagtttttaaaatcttccttttaaccagtttaggatgatctaggatagctaagttacctacatggtgactgttcggtctaattcagaaacagaagtactaaaagaatactaaaaagtttttacccattatctctatccctgttttctttttgcaattctcagctgcagggagcaagaaaatacacagcagataggaaatgtttgtttgcatcctggctttctcaaccgcactttacgtccttgaatattctagatatttactccttcaagaagtcaggagtatatccaggcctacctatcatccttgccatccccattaaccctcatttttcagtatgtgttttacatttatggttatttttcagtctatagtatctgttcactcattgctctatcacatctgagtttctccgtctttctttccactagattgtaagctccttaagggcaaggtcggcatataagcaaagttctgtaaacaccgtgaaggtaccatgagttctatgggtactcaataaatgcttgtgataatg

SEQ ID NO: 2767 - DNA, 349 bp, Homo sapiens
ggatgtgggcagggagggaagcaggcttggagggttaatttacccacagaatgtgatagtaataggggagggagcctgagcctgggctggagccttctcccctccccagttggactaggggcagtgttaattttgaaaaggtgtgggtccctgtgtcctcttccaggggtccaagggaacgggagaggtcactgggcctgttttctccctcctgaccctgcatctcccaccccgtgtatcatagggaactttcaccttaaaatctttctaagcaaagtgtgaataggatttttactccctttgtacagtattctgagaaacgcaaataaaagggcaacatgtttctgtt

SEQ ID NO: 2768 - DNA, 740 bp, Homo sapiens
gccacaccagtgagatgcaggcacctggcagaccctctggctagcctgcagccccccctctcccagcccctggtgggctgcggtgatgggtgttttgggagaacgaagacagccaggctgatggccagggccgcagtgcccctccccccgacccagccccaaggttgatcccacgggaacaggcttccaccccagcacttgcgcacctgggagggagctgccatccgggctccattacctgttgctgaaggcgggtgctaggctggctgggtgtcaaggagcaggctccaggccaaggtcctggcccagccacggccattgcaagggctcagcctggcaggctttgtgggggacgccgccctctctgccgcaggctgggtgcacggccgggcaccacagtgggactcaggcccgggaaggtcatgttctcgaccagagctttgctcccagtccaggcgcctcattcggaggcctcttgactgggaccacagagatgttttctccgctctgacttgtggctcaggactactttctgggtcgtgctcctgccccactgtgcctgggcccataaacaacaggagccttttgttccgctgacctgcccatcccagcagacccacctccccgcctggtgccttccatggagggaaatgggacaggggccgtcatctcccctctgcctcctgctttgctgttgccgagcacgagtaaagcttttgttcttacttcacgtggctcct

SEQ ID NO: 2769 - DNA, 5784 bp, Homo sapiens
ctcggctcggatctaccttccagtagcagcggagtggccaatgggaccgggaccagagccgggggccggaggccgccgccgcggggaggttcccggcccaggtgcccagcgctcaccagcccggcggcgccgcggcggccccgcagctgtttcctcgggggggcgtggcgtcgggggccttcgcggcgcagtcctctttcagcatcccgaacagcagcagcggcccgtaggactcgcaggactcggtgcacagcagccctgaggatggcggcggcggccggcaccggccggtgggctggagccccggcgggccgctcctggtgatcggctccttaccagctcacctctcaccgcgcatgtttggaggtgctgagaaacataatgtctgttccccaagagccagctaatcatttttactaagtacgataattggctgccctgattcagataacatatccttattgtgacataggggtgactattgtcagaaaaccctgaaaatgttttaaaacaagaactaatggggcttggcgattcttgccacgcttttccagagctcggaccttgctattatttgctactagacacccacaaacccttgcttgttaaactgatcgccttcaagactcaagaaaagcgccatgcggctccctcctagggctctcctgacctttcctcaccaatgccgagagtggtcctgctggagaacgcacacgcctgcagttcgtgcaccttttcccggagctgcaccaggaaattatggatcaactggaagcagccaagaagaagggtcttggcgatcacatccagctattcagccatctcagactgcggacctccgtgcaccccctggcaggttccctccgcctagggtcgaaagcttcagaggcagccccaactcttccacttcttcctccatctctggctcccaggcttgggaggccccgcgccaccgcttcaactggctggggtgggaagattgaaacggctcttgagactctgcttttgcgcttactgctcgtttgcccgactattttctcatagtccctattccagtcaatttctggcacagcccagcttgaaactgctcttgagcctccgattttgagcttactcctggtttgcccgactattttctcataatccctgttccggtcagtttccggcacagcccagcttgaaacagctcttgagcctccccttttgagcttactcctcctttgcctgactcttttctcatagtccctgttctggtcaatttccggcgcagcccggcttgaaatggctcttgagcctacgcttttgagcttacttctcatttgcccgactattttctcatagttcctgttccggtcaatttccagcgcagcccagctgagttgggcgaggtctagaaaggcctgactcgcctcttggcctcaatgacttgtacccgctgcttttgcagacctcccggtcttcatggcaactgtgaaatgtggggtggggggcgtagggttgaagccattcgcgccggtagtccctgcatgtcccctcatgtgctccccagtgcgcacagcaccccagcctccgcgcttctggaagcagcccagaagggtcttggcaatcacgtccagctgtaagccatttcgcggtctcagattgcggacctccgcacgccccctggcaggttccctccgcctagggtggaaagctgcaaaggcagccccaactcttccaccacctcctccatctccggctcctgggcttgggaggccccgcgccactgcttcgactggctggggcgggaaggttgaaatggctttgagactccacttttgagcttactcctcctttgcccgactattttctcatagtccctattccaatcaatttctggtgcagcccagcttgaaatggctcttgagcctccgcttttcagctgactcctcgattgctcaactattttctcatagtccctgttccggtcaatttccggcgcagcccagcccagtccggcgaggtctggaaaggcctgactcgcctcgcagcctgaatgacttgtacccaccgccgatgcggacctcccagtcttcttggcgactgtggggtggggggcatgcggttgaagccgttcacacgggcagtccctgcatgtcccctcacgtgctccccagtgcacgcggcacccccgcctccacgcttccctgagcgtgcagcctttggtgagggcagccccacgcacagccccccacaccctccccagcgcctgcagcccctggtgcacgcagtccccaagcccgcacgtgcagcccccaccttgcacacagctccatgtacagcccctcatacgttcacagccccagtggcgcagaacccatcactactcgctcttcacgcgcttcactgggcgtgcagcccccacagcgcgcagctcaatgcagcctctccacgtgctccccagggcctgcagcctcgtcttaacttcttttgccaggcccacacatacctgcctatggcctgagtggattggcaatgacagtggtgacagctgacatttactgagtacatgctatgttccagatgctgcgtttccattctccaatgaagaatcttaagtctcagggcctcatgcaaaactatacagctaataaacagtagagttgggatctaagcccagggaattttactctagaactcgcagtattaaccacagtgctctcttggcttatatttctaaggcacatgctgtaaccacttttttttttttttttttgagatggggtctcactctgacatccaagctggggtgcagtggcgcgatctcggcacactgcaaccttcgcctcccagattcaagggattctcctgcctcaggctcctgagtagctaggattacaggcacatgccaccatgcccgtataattttttgtatttttagtagagacggggtttcgccatgttgcccaggctggtctcaaacacctgacctcaggtgatccgcccatctcggcctcccaaagtgctgggattacaggtgtaagccgccacgccctgcctataaccattctttttttagggaggtgtggtatatggtgctaccctggatctgtagtcaggatttgaagaagggagaaggtatttgcttgtgaagaaggcaccatgcattgtgctctgtagtggtgactggagagagagctgggaggggcacaggcagcaaggtccctgcttaaagacagttatctagtttggagaaacttagctggatagtcagttcttacatgcatttggcaagcacttatcatacactgtaaagaggcaatatgtctagcttgttagagggtgggctctggagtcagacttctggctttgaaccccaacttccctgccattttcaaatgacactggagaagtcacaaaacctatttctgtctcagattcctccccagtaaaagtgggatattaatagtacctcctttggcttgatatgaaaattcaatgagttgatatatgcagaacatcttagaacagcaactagcttagagtaaatcttcagtaattgtaaactgtgaatatactatgtttttggcactgaagccacgtcgtggtaagacagtgcctgacctcaagaagctcagagtctagtactggagacaggtgaacaaatacttgcaaagtgtgtggtgtgagagaggtgtgacaggtgggcgggagcctgcagcaggcacatctgacccatcctaggtgtgtgttgtgcagaaaagttagcctaggctttctaggggcactgatgtctgggccgagtcttgtagggcagggaattagtcaaggggagctgtagtgatccagctggggctgagcaggagctgaaagtgaacagctcacatctgtagggttgccagatttagcaacggaaagtacaagatgccctattaaatgtgaatttcagataaaataataactttgaagaatatgtgtcatgcaatatttttagtataagtatgtcccaaatattgtataaccacacacattattcattgtttatctgaaattcaaatttcactgggcatcctatgaaaagtctgtcaattttatctgtccgcatttaggaaggtgcagtatgtttcagagtagctggagtgatgcagggaggaaaggcagagtgggccggatggggctgagaggcacacaggaggcagtttgtaaaaaacctatgctatgttaagggatttagattttatcctgaaattagtgatgagcccttggagagctttaaccacagggatgtgaaaccacagagacagcagtgtcgggcacgaagaaatgagtgtcactttctatggctgaatagcaaattactccaaatttaaagtcttaaacagtaaacattatctcccagtttctgtggctcaggaattcagaggcaacttagctgggtggttctggctgaggtttctcatgaggttgtagataagatagtgaccagagtggcagttatctaaaggatgcactggagctggagaatttgcttctagggtgactcactctaatggttgggaaggtactgctggctgtcagcaggagagctcagttccttgctacaggaccccccataggacaacttgagcctcctcacaacatgacagctggcttagtaatccaagacagcaaagtgacattaactttggaagtcacatgccaccttgtcattcccatatatcccagtgctaacacagctcagccctgctcagtgcaggagggtcctacacaaggatgtacatacaagaaggtggggatcatggggttatcttggaggctggttttctgggatgggaggcttacatggtgatgcctgtgaccttggaggtggaggagaatgatgggcgtacagaggagtgaagaaaggctgggaggaatagagatgtgggagaggaggtgaggcaaagaaaaaagaaaggaggaaggggtgttggagcagattgtagttgatccacagcaaagagcatcaccaaagccattccaggaggaactagatccaccacttcctctgctgggcatgctccaaaaatggttgtggcctccagagaggactccaaaagaaagcacaaaaactagacagtgggagggcatacccaaaagccctgagtttctgaaaaaatattgaaagtttctatggtgaaataggaagttaatgtgcttaggaagaaaaaagtggtaatgattcaaggaaacataatcacacacggttttagttttaatggacatgggaggagccataaaagtagtctatctatcatcagttacatatctaatgaactgtctatctgggataccctatcctgttttaatctgagtgactctctctcagctgagagagctggacagactccattttagcctcttcacttgcagtccccttatccccctcccttaagggaataactagtgcaagctgactccaagcacatccaggaatgcacttactgataagatattgaggcaagctgtaccagcagctcctggggacgtgctcagtggatggtacccaagcccctgcatttatctctttgtgatagtttaagcccctgcacctggaactgtgtatttttctgtaactatctctgtaaccattaattttttttaactttttgcgtgttctgcttctgtaaaaattgcttcagctaggctccccctgccctatttagaccacggtataaaaagaaatctatccccttcttcggggctgagagaattttgagctctagccatctctcggtcactggcaataaaagaactcctgaatta

SEQ ID NO: 2770 - DNA, 2902 bp, Homo sapiens
ctctgccctcatgcgcatcctcacgcgctcccgcgtgctcaacgaggagcccctgacactggcgggcgaggagatcgtggcccagggcaagcgctcggacccgcggagcctgctgtgctatggcggcgccccagggcctggctgccacttctccatcccctaggctttcagcagggccccggctaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgccatcaccgtgaaggtgcccaacaactcggactgggctgcccggggccaccgcagctctgccaactccgttgtggtccagccccaggcctccgtcggtgctgtggtcaccctggacagcagcaaccctgcggccgtgctgcatctgcagctcaactatacgctgctggacggccgctacctgtctgaggaacccgagccctacctggcagtctacctgcactcggagccccggcccaatgagcacaactgctcggctagcaggaggatccgcccagagtccctccagggtgccgaccaccggccctacaccttcttcatttccccggggaccagagacccagtggggagttaccgtctgaacctctccagccacttccgcctgtcggcgctggaggtgtccgtgggcctgtacacgtccctgtgccagtacttcagcgaggaggacgtggtgtggcggacagaggggctgctgcccctggaggagacctcgccccgccaggccgtctgcctcacccgccacctcaccgccttcggcgccagcctcttcgtgcccccaagccatgtacgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggatggcgacagagccttccaccgcaacagcctggacatcttccggatcgccaccccgcacagcctgggtagcgtgtggaagatccgagtgtggcacgacaaagggctcagccctgcctggttcctgcagcacgtcatcatcagggacctgcagacggcacacagcaccttcttcctggtcaatgactggctttcggtggagacggaggccaacgggggcctggtggagaaggaggtgctggccgcgagtcacgcagccctgttgcgcttccggcgcctgctggtggctgagctgcagtgcggcttctttgacaagcacatctggctctccatatgggaccggccgcctcgtagctgtttcactcgcatccagagggccacctgctgcgttctcctcatctgcctcttcctgggcgccaacgccgtgtggtacggggctgttggtgactctgcctacagcacggggcatgtgtccaggctgagcccgctgagcgtcgacacagtcgctgttggcctggtgtccagcgtggttgtctatcccgtctacctggccatcctctttctcttctggatgtcccggagcaaggtggctgggagcccgagccccacacctgccgggcagcaggtgctggacatcgacagctgcctggactcgtccgtgctggacagctccttcctcacgttctcaggcctccacgctgaggttatcaatactctggctgaccatcgtcatcgtgggactgactttggtggaagtccttggttacttatcattactgtgtttctgagaagttataaatttgccatctccctctgcacaacttacctttgggttatcaatactctggctgaccatcgtcatcgtgggactgactttggtggaagtccttggttacttatcattactgtgtttctgagaagttataaatttgccatctccctctgcacaacttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaggttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtcagaatggcggcagcggagcatcgtcattcttca

SEQ ID NO: 2771 - DNA, 5032 bp, Homo sapiens
ctgcatgattttattactataaatatacagtaaaaacgaaccaacgatgagcccatctgagcacatcagacggcagcacatgggagtcccagcgggccactctgcggcccgaacttcacgcaaagctctggcaccaggactgatggccagaggctggggccttggtgggggcggggggcgggcggtgcagggggctgtgtgtgttgttggggagaggtgcatggggggagagaggtgcttggggtggggtagaggtgcgtgggagatgctcggtccgagtgcacacacatgcatgggaacatgtgcaggagtatgtgcgtgtgtgtatgcgtgacagcatgtgtgagcgtgagtgtgcatgtgtgaacatgtgcgtgagcatgtgcaagtgggcgtgcatttgtgtgtgtgtacgtgtgagcgcatctgcgtgcctgtgcacgagcgggaggggtggctggcctgggtgtgcagggagctgggtgtgaggaccatgctgtccactgctgggtctcgcccaggaggcggacctcatgctcggagccaccgtgagcctcagggagggtactgagctgccccacagccgacctgtccccaggcccagctgcagggcagccctccagagccaggtgagcagcagacacctgcctggcccagggctccgcaggggtggatccagccctgggtcaccaggcccaggcactccctttgccatctgcggcccaggaggtttacctttaaaaaaacaaacaaacaaacaaaaaaaacaggacgaggtcgcccagaggccaagcctcccggccgggaccccattccccaggtgtgctgctggcttcctcctccctgggccagtcctgccacagaagcctgagacagaacaaaccaaatcagagagaactgcaagggggccgggcgcggaggctcacgcctgtaatctcagcactctgggaggccgaggcaggtggatgaccttaggagtttgagaccagcccggccaacatggtgaaatcccttctctactaaaaatacaaaaaaattagccgagcatgctggtaggcacctgtaatccccagctactcaggagcctaaggcaggacgatcacttgaacccgggaggcggaggttgcagtgacccgagattgagccactgcactccagcctgggcagcaagagtgaaactccatctcaaaaaaaaaaaaaaagagaagagaactgcaaggggacattccaatggcaaaagagaatgaggaggccaccaggtcctccctggcaggggcctgccaaacagaagcccctgcacctggaggggccttgtgatgtcaccaaagccagcaccaggaggaggtgtggagcttggtgacaaggccactgaatgctggctgctggaagcagctgtgcctccgcccctcggccaggcccagcaccgggctgagacactctagctgcccagggcggcacccatgcaccccaaggccccgagcactgagggccccagcgcagacgcaccagggagggcactgaggccgcgcaaacacggcagaggacaaaaagcagcgacagccaggccgccacagtgacacgcagggcctcctgagttctccgggcagggaccgcactgttgcaggagcaggcagagccagcggaggccacacgtgggcagccccagccccagccgctcagcccacaggaccctggggaacgggggctctgaactagggatggaaagctgctgtccttcatcttgtaccagttacaaatatatcaactgtagaaaagggagactcagaagggacagttcactgtgctctttgatcaagagtcaccacggcccctcggagcctggtggccacagggggcatgcagacaggaggccggctcacaacggggtccggagcagcccctcggcaaagtctggggagccgagggctccatgctgccagctcggccaggctctcagagtggggtcagctcggcggcgctgggatcggggctggggccaccaagtggaggccaggtggggctggtggtggcgaggccgtgggccgtctccatggaggtgggccgtcctgcaggtgggagcagagggaggagggtcacactcggatgcctggtgccacgccacccgctcctaccgatctggagccccagaggggctgggccatccagcacccccactcccgccgcctgtggccacaacagcattcactcagatgtgagcacaccaagggcccggggactccctaactgtgccaaatacgctgtgtccctcttgggacagacgatcccagatccccggacacccacagcagatctgcagccccgagtcagagcgcgacacggcaccgcggtggatgccctctgggcctcctgcccttgccctggttccggtttcctgggatgtggccagccactgtcctgccaaggttcttacggctgggttagggtggaactcggtcaacccagggtgcaggggtggggagcggccctgggtgagaacaagcccgtgctcagagtagcccccggatggctactgcaaggcaaagagaggagcctcccacagagccccaatgcccagactgtggcctgcacgacgccgccgggcgctgtccccagatgggtctggcgtccctggggcttgggcaatggtgctggtgcagagcctgggacggggccagcatggcctcagggctgcctgacacccagccaccagccctgacacatggctcccagcagacacggcccaggccccactctccggtgaagggcgtctattttcttcgggggccgcggcgagagcaggtttccgaggctgtgagccctgttctagatcacacctgcactccccagctccggaagcttgacctgaatcgtgacattcgcacggcaccttccaccgatgcgcaggccggggccgtctgaaaggtgctgactgtttcaatctaggggtataatggctcaggacaggggtcaacagagggactcgctgggctcaagaagacagaggttcatgggaatgcagagcgcagtcaaaagaagcgaagttctccctgacccggctcaagtccacccaaggggaaagggcctcttagagcctgcacccccggccaggcacctcccagcaggctgcatgggcctcggcagaccagagctgcacgcagcttgtgtgccaagaccctctgggaaggcagagggtccccaatccgtctgcctacattttggtggcactcctggagctgccttctctctctcccccgtgtgtgtgtgtgtgtgtgtgtgtgtgtgtattttttttttcttgagacagggtctcaggctggagtgggtgggtgggtgtgtgtgtatttttttttattgagacagcgtctcaggctggagtgggccttgacctccccagctccggcaatcctcccacctcagcacccctgagtagctgggaccacaggcacaagctaccacgcccaagccaattttttatttttcatagagagggggtctatgttttctacactgatcttgaattcctgggctcaagtgatctatcccctcggtctcccaaagtaccgggcttataggtgcgaaccactgcctggacagagccgccttctgtaaaacactcacctgggccaccctggtagagggcgcctcttgggggggatgggggatgccaacctcacagggcctcctatcttttagtgctggtgttccagaaggttccagtactgggagggacaggtgagtcggcagcagtgggctcatggcacaaaggcagcccacgagggactgtgtgccaggcccatggtgatgccaggcccacggtggccatgctgacaagggaaggagggagcgggggagcaggtggctgtgtgagcggacgccctcaggacaggacgcaagatactctcccctgggcaccagagggcccctcgaggacggactccctccaagagacagggactgagcttgggaagacgtgatccaggggctctcccaatcggggcgcattctttccccatgaattgttaaagccacgaccggaacacgggagtggacctgctgagcgtcctaacgtgtctgctgcaggaccgatgcgaactcatggtgggaccatccggaacaaggccaggcccaggcctctccccttgggacgctcaccccatgtctccctggggttccctccacggtgctgccctcatccctcaagctcctgcctcccgcagtggacagtggctctggcgcacctgggctgtgtctgtctccctgcctgggctgggactgttccagggcccctcaaggctggaagaagagcctgaccggccgcctagtccagatggagagacctctggccccgaaagtcaggaccccccaggaggccactttctgggggaaggtgcagcagccactggagagctctggattcggaatccagggcccctgggaagatgcggatgcggacgaagacccaaaaaccagaaggaacccccgccagagagcaggggagggctcctctctccaaggacgcgcgtcagagcccccgaagcgcgtctgggaggtcacgtaccggcttactcgtctataccaacagagcaggagtcgggccccagggctgcgcggagagggggagagacagacggaagctcggttagcaagcgcgcagcagccagcacagccacagcaagggcaccagcttggggacacggtcgaggccgtctagaaacaaacactctgctgcaaccacagagaaccacaaggagaaccacagctgggaggcagagcgcagccagaattcaacgcggaggagcgcactggccctgcccctccctcccatacctcccgctgccgcagcctagggaagggcgcatgaaggacctaacgggcgcagtccacctctggtttcaggagtgaaggccctgggtggggggctgaggctagacaggaccgagctcagggccaagtccaagacaccagggcccccagtgttcaccatctcatgggccctcccatctacagggacagcagggttcagtgatgccgc

SEQ ID NO: 2772 - DNA, 825 bp, Homo sapiens
ctcccgtgttcaagcagttctcctgcctcagcctcccaaatagctgggattacagttgcctgccaccacgcccagctaatttttatatttttagtacagatggggtttcaccatgttggccaggctggtctcgaactcctgacctcaagtgatccacccgccttggcctcccaaagtgctgggataataggtgtcagccaccgcgcccagcctggagtggccttttatgagaggggacccgtcaaatctgtgccttatggaggggtccggcagcggccacaattgtcttgtcccctcaccccccaactccccctggaacacctctcccaggcaagacattttcacagcaccattcacaacggttgggccaaaaagaaacttttccttcatcatttcctgcactcgctgaccacaactttggacaccccaggctgccacccctccccacccgttcacccccaggatgctgttgctgtaggacgcctgctgccctggagccctccccaggatgtgagccagtcccctcgctggtacggaatgccgctgggtgcccggaggcggccatggtgtctcgatggacggcagccaggatggagcacccatgggtctcacggccatgcttcagggtcttcaggtcctgcccccggccagtctgccaagaggcacccccttccccagcctctcgcctgcactgatgcagacaaaatctcacctggcaggcccaacccccccccacccctcccccgccgtgtgtggcccctcgccgcatcgttggggttttgttatgtgaaaatatcctggaaataaatacatgtttctgcactt

SEQ ID NO: 2773 - DNA, 1946 bp, Homo sapiens
cttaatgcatcttaaggcacctcttcacagaaggcggtggaaggctgcttacgtgatggcatgtggatagcgatgccatccgtttgtttttttctcctccatgacagagaagcaggaaaacattcctaaatttatttatagacgttaaaaaaaaatcaggcttggttttttcctgtaactgttcttcagccggcagcaagtatagcagcaagtatacagcagcaagtatacagcagcaagtatacagcagcaagtacagcagcagcaagtacagcagcagtactttatgagttgttgtgtttattccctgccttttggctttactcaagaaaaccagttgtgtttctcagagcaactgtattgttttatttgccactctcttcactttgtccattatagtacaatagattgtccttgtcccgtctccaaattggaagctccctaggtggtggtcaggctgttgatgagatttgtattctatcaaagctccattttagataatctatcatcattttttatacgcagtaagtcgctgattttgtttctttttttcaaacagttttgatttgaagttcctttaaaggctgttggagcttttgcaaatacccagctaatgaaaggcacttaagattgggcccatgtgcatcatcacattgaagttttctgtctaaaggaaggttccagctacctgttacccttttgctaaacacagttgcagtgttgcagtgtatttcatgacaaaagtgtactctagttttctgtgaaatgattattttctctgaaatgattcttggtcatgttgagcttctaaatgttaaagagaacatagtgcttttgacctgtggaaatctcatcttggtaccatggtgctgcacagaccatcaggaagaactgaaaagttcaggcaacttgagaaaataaagtcaccaccagcaagaagctgtctaaaataaccggaagattataacccaagcacgtggaggagtgtgctagtgagtagaatgttatgaaagctactagaggtcctccatagatgcatgtgctagtcctaaggagaaggaagaggagaaggattgccacggaggaacacctgaagtttcagttgagcactttgtttggaaagttgtccaaggctggagttgtgagagctgggaaagacctcacaagcttctctaattcaagtccttgtttcacatatgagaatgcagaggccctgagaagttgattcccaggcctgcatgctggcctggaactagagcctgggtctcctcttgctttttccagctgtctgcccaggtagctccccaaggcaggcatggaggcagagctgctttgggttccagggggcaggtttgggctggggcctgctgtgtgaccacagtctcccatcttagattgaagctacatcgctgtgtgcatctaactcttgattcacggtctgaccgacgccttggtttctggagaactgccctcgtttatggaagagtcactgtcatcaggagccatcccagggagaggctcagtgggaagtgtaaaggtggagcaagtaaaccggctccagaagagaaggcgaagaaggactatttctgtttagatttgcttaaccgcattttcactttcttgggaacccctgatggagttcaaggtcatagaagagaagaaatcagacactgctacaggactcttgctcttggttcagattattcaatgggaggggagaagagagtagtcgcaagtgattgttgtagattttgtctcagctttttgtttttctttgtatcaaacctgttttgagatcatacactgttacagagaaagagaggaggcatattataaacgtgtggacttcagtgttattccttctcttcaaaatgatgttccaggtgtctagagggtgaggtatgtcatttacatgaaggttaagaataaaacagaaagtgcctcta

SEQ ID NO: 2774 - DNA, 748 bp, Homo sapiens
ttaataccagaggatggagggtcttcctttccactggtggctcctctagccagagggctctaaggggcggatgctattgctgcttttccagggcacagggcagtcaggacggagccttagcacacaccagctggaggccggcgtccctgcgcttggaagtgggttccctggccaccggggttgacctctctcgctagcagggcccacccagctcactccccgcgtcttccatcccctctaggattcccattgtcccctactccagcactaggcaggcacccccagcccactgcgactcccaccacgaaggaccccagccctctctcagccaacacggccccgcccaccgtctcagacatcgtgcttcttctggtgggccaggagtctctcctcgtcgtcgaaggtctggccacagatggcacagcagaaggcgccgtcccggatgtggctcttgcggtgggtgatgaggttggacttctggctgaagctgcggtcgcagtcgggacaggcgtagggccgctcgcccgtgtggatgcgccggtgcgacaccaggttggacttctggctgaaggctttgccgcagtcggggcagacgtagggcttctcgccggtgtggatgcgccggtgcgccgccaggtagggtttgtggcggaaggccttgccgcagtcgggacacacgaagggccgatcgggggcgtggtcgcgccgatgcgccgccagatggctgccctgggagaagcggcggccg

SEQ ID NO: 2775 - DNA, 2866 bp, Homo sapiens
gagaaagaataggtcagaagcaatagtaaaagacataataacttgagaatcttccaaaactaatacagacttgcatatttgagaatcactgtagctctaagcagaatcaataccaaaaaacaaaaataaagggaaaagagaggaaaaattgccaaaacaaagaaaatcttaaaatcagccaaaggaggaaaaagatacattaccttcaaaggagcggcagtaaagacggacagtctactttgcaaagaaatggaaatcaaaatacagtggaacgatatcttcaaagtgttgtaagaaaataactgccaacctagaaatctgtatgaagcaaaaatatctttcaaaaatgaagtgagaatatagacatcttcagacagacaaaaattagaattcatcaccagcagatctacactagaggtactataaagaaagttcttcaggtaaaaggaaaattatcccagctggaagcatggagatgcaggaaggagtaaagagcactggaaaggatagatagacgaatacatctaaaataatgtgaactgtgtaaaacagtaaaaatattgataggtgcagcaaaccaccatggcacacgtttacctgtgtaacctgcacatcctgcgcatgtacctggaacttaaaaatttttaaagtaaaaataataaatggcaacagcaacacagaaagctggaagagagttctgatgggggaaaaacacaggttatttttcctcggctctcactctacaacagtgatcatcacagaggacttctttgaccaaatgtgtggatttctccccacgtgccaagcaagcagtcagttctgcagtggacaccagctgggtcggtctcaacacagaagacttctgtgagcaaatgtgtgagggtttcttctcacacatcaaacaagcaaggagttctgctgtggatatcaggtgggtaccctccaattccatttcaacattatctacctggagataactcagatctcacaggttgaagactcagtctccaggactgtccctccttgagacaccagttgcaagtctgggcctccagaacttctgacccactagcttcaagttgggattcccaccacccctctttgggttcagttaatttgctagagtggctcacagaactcagggaaataattacgtttaccaggttattacaaaggatattatgaaggaaacagatgaagaaatgcctagaacaaggtatggggggtgggtgcttccatgccctctctgttgcaccgccctcctggcatctccatttgctcgggcatttggaagctctccaaacccaatccttttgggtttgttttgttttgttatgttttttggttttttggttttggaggcagtctcactctattgtccaggctggagtgcagtggtgcagttacggctcactgcagcctcaacctcctggactcaagccatcctcccacctcagcctcctgagtagctgggactccaggcacgtaccatcatgctaggctaattttttaaaaaaaattttgtagaggtgggggtcccactgtgttggccaaactagtcccaccttggcctcccaaagtgctgggagccactgctcctagccccttttgggtttttatgagaacttcattatgaaggcatcattgattaagccattggccattggtgatcaacttaaccttcagcccctctaccctccctggagattggagggtagggctgaaagtcctaaccttctaatcctgccttggtgtttatggagaccagcccccatcctgaagctaacaagaggctgccagctatcagtcaactcattagcatacaaaaagacattactttggagtttggaaggattttaggaattatatgccaggaagcaggatcgaagaccaaatatatatttcacaatattacaaagataaatatagtttaaatgtcctcaggtctttgtaatttatattagattttaatgagtcagagatagtaatatctagggtagtccttctcaatcacatttggtgagagaatcacatcataatgttcaaagacagcaaacttcaacctgtgggtcaaatctggcctgccacctattttagtaaataatgttttattggtggaacaccgctatgcccgttagtttacatattgtctatggctggattcatgctgcaccgccagaattgagtagctgctacagagacattgtggtccacaaagcttacatttattgtctagcccttgatagaagagatttgacaacccctaggtattgtggactgagtgtgtgtgttccccaaagatttgtatgttgaaattctaacctccagcgtgatggtgttaggaggtggggcctttgggaggtatttagttcgtgaaggtggaaccctcacaaatgggattagagacacagagttcttgcttctttctgtctactctctgccatatggggacacagcaagaagaatgccatctgcaagccaggaagagggtcttcaccagaacttgaccatgatggaaccctggtcttggagggtctatagaacccagcctctagaactatgagaaatgtttgttgtgtgagccacccggtctatggtatttttgttagtagcagccagaactaagacatctgtgctaaggcatctattatatattatgaattaacttctttacatttagaatgccttgtaagaactgaaaaaaaaaatagtcactcagaatgttttctgcaggacataattctttcatagaacttgagttgattaactctagagtaatcactaaaaggatagaaagagaatttatagctaccaagctaatagagaaggagaaaggaaataaaataataaaaaccatttactgtcc

SEQ ID NO: 2776 - DNA, 6976 bp, Homo sapiens
ggagctttgctgaaactgcacaaaaaatcgagccggggggttccctggtccccggcgatggggcggggagcgctgcgccgggggagggggcgggcgcggcggcgcgggccccgccgaggggggacacctggctgaggcacagctgccgccgtgcctttccgcgcgagcccagagctccgatccctgcgcgggctcgagagctcgccccgaacgggggtcttcctcctccgccgttgacaggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtggataattactgtaccttcctcatggaaaaagttttatttaaagtgttatttctcattgaatactatcaaaaaggaaaaaaaaatgacctaaacttttgagatagatttggctctaggcctactctaggtgcggtacttcactatagtttataaaagatggtccctgtcagcaaagaactgtaacctgtatgagaatattatactaacatacaagaaacaagtagagaataatggaatgtaaactctggcttgctaacttaagtgtggtagaagcttgaaggaaatgtggacttaaacttatcagagaagacttataagaggatatgaaaggtgtaaattttgataccaccattgccgccttcccctcaaaaaaggtgagaactgactaaactactggtacttagaccatgtggagaaggaactgaaaatggaaacagaaacacgtctgtacagagcagagtgtcagataatagctcattttagtagagggcaataaatgccacatgagatgatcacctcagcagaaaactgtaagtaactggggacttacaggagaattgaacagttgtttctgctgactcagtaaaaagtcttcattttataatttgtggcctgcatgcttgtaaattaaaatgcattgagttgtcaagtaatggacttgtctggtttgtaggtaggaatttaagccaaaattgaatgcaacattcccccagaagtaacctgggatctgtgccataaaacctaaggcaaaggttacatgaatttgtattactaggttagaactaggctattgagcctttgcctagaaaaccaattagaggattttggtcttgatatagcagggaatagggaggcattatagcctattgatttgtttggaattaaatgtggcaatactatatatagaaatgtctaagaaataaaatatggtagcaaggaaactgggcatgtgactactgtagtaatctaggggtgaagaaacctgaacagcaatagtggcaggagaatggaggtgaaagaataaatttaagatatttcaaaggaaaaagttgttgaatatcatgatgggttggataaaagggaggtgtaaaagattatacattttctatactggaagacaatggagttaccaatgaaagaaaggagatagttaagaaactagtttaaggccgggtgcgatggctcatgcctgtaatcttaacactttgggaagcagaggtgggtggatcccttgaggtcaggagttcgagaccagcctggcaaacatggtgaaaccccacctctactaaaaatacaaaaatcagtcagacgtggtggctcatgcctgtaatcccagctactcaggaggctgaggcaggagaatcgcttgaacctgggcagtggaggctgcagtgagccgagatcatgccactgcactccagcctgggtgacagagtgactctgtcaaaaaaaaaagaaaagaaactagtttaagagggggaaaatatgttccatttctgcaatgtatttaaggtgatatttaggcgttcagcttgaaatgtcttcatttaaggtggctggatatacagaactggaattctatgtaaaagtcaggctggagaggtaaatttggcagttacataaggctgataagggtagaaaagctgactgaagctctttatgaaggacagtcggtccctttcttttagaaaaaatatgaacacacatttatgtaaataaactatatcattagtatgtaatcttaaacatttctagaattgaataagaactctcccttttttccttagagtgtcatatctcaagcgtgtgcctgttagaaaatccctacgcttatatcaattataagagtcaatgactgaaatgtgttaatactcttaaaccttaccttctctcaataaaaccaagatctttcccagtattaggctaagggaatgaaattgagaacttaaagtccaaataattcagtcagttaaaactttataaaattgacctggctttaatttctcaaatggaaagcaagtaattgaattgggggaagtgtgctagtctccagtttcaagaaacagtacagcacaaagacctggcattctagctgaagagctgtaataataaacagaaatttgaaaaccaggaagacaagttttccaagagtgcaactgtggcatttcaaaggagatttaacaagaaattccggaagatggccaaaaataggtttagataattgagattctttatttgaatacttgtttttgatggagaaacatacttaagaggaaatgaaggttctgtctaaggtctgaaactttttttcaccctaaagcaggtttgcttctgaagaaaactattagcaaaaaaaaaaatcaaataggaattcagtgctgcttagattgtaggagtttaaaaagtgaccaatgcaaccatttttagaaaattaattgaaaggaactatttttgttttctaggagcaaaaccttgttttctaggattcctatttgtaaagttaaagtatctctctgtttacccagttattacttgccatgaaaaaatagcctcccagcatcagacagaaatacaatgttactctacatctttaattgttttttattccagtcataaagcagcttctgaaattgatttttaatatggtctattttaatgatatgtaaggaaacctagaatgttaatctgcatttcaaattagccttgtaaaacctcagtaatatgtcttctggatatatcaggatcttttggaccattttaccttgattattgaaccaattgattaatccaaattcagtaaacttaaaatgacctcaaattgggttacccagaactaggaatatttctgtattccatcctacttacatctgatttacatgcctggtctgctaacttctttcttttcatgactcctaagttatggaggtaagtgaagatttactatcaattatagtcatgtgacactcattttgaacttacattctcttagtttttttaattttaagcatgctggtagcattacattgttcttagcaaattaagtatatcccaattttaactggactattctctgcttaaacatataattttgtgtaatctgcaacaagtttatatccccatatacatctatattttcatctcctttccatatggcattacccaaataaacttcttttttttctttaatggagtctcacttctttgcccaggctggagggcaatggtgcaatctcagcttactacaacctctgcctcccagattcaagcgattctcctgcctcagcctccccagtagctgaaattgcaggtgcctcccaccaaacctggctaatttttgtatttttagtagagacggggtttcaccatgttggtcaggttggtctcgaactcttgacctcaagtgatcctcccacctcggcctcccaaagtgctgggattacaggcgcgagccactgcgcctggccccaagtaaactaattgaaaatactctggggtagtttctgtaatctgtaacttgagtcaactctttcagattgtattatttaaattatcctcttccatctttgaatctactataaatcttgtttttccaagcatctattcactgagactatagtttccaaatgtttcagttcagttcacttgagcttgttagatgcccagcactatgggggagtatgacatagaccactatagcagtctcagtcctcatcttaaaagaactcatggaaccttaaacattgcagccagatttccttggaggtctcttattacagaaagcgtagaccatgtgcagtggcacacgcctgtaatcccaacactttgggagggtgaggtggaaggattgcttgagcccagaagtttaagaccagcctgggcaacatagtaagacttcatctttacaaaaaaaattaaaaattagccaggcatggtggcatgcacttgcagtcccaggtactcaggaggctgaggctagaggatagcttgggctctggattttgaggttacagtgagccatggtagcaccactgcactctagctgggtgacagggtgaaatcctgcttaaaaaaaaaaaaagggtaaaacaaatctctcctatttggcctcatactcatgaacctgaagaaattcacattctttccagaagtgttgtgagatgatgaagaataatatgaaatgaaacacttatttggtatgttttaccctactgataaaaagccatttgtttaataaaaagccatttgctttaatgatttctggattttgaggtgttggtgtgaaatctgaaggtacagaagactacctacctaaaagccttgtgtggttaggcaagtcttaaacacattttagttttgggagcaaggtcctatttattttgctacatgtttagttctgtttttattctgtgccatgcgtaatatcattttccattttcacccatgtaagattttagctttttatccatgaaaatatttttgtgattggatctcatagtttagttaaatattaaggtattttcgatgatgaagtgttttgataaaatttgtacttttcatttataataggcccaaaagaaatccttttttttttttttttttttttgagacagagtcccactctgtcacctaggctggagtgcaatggcatgatctcggcggaggctgcaacctccgccttccagactcaagcagttctcctgcctcagccttccaagtaactggggactacaggcacgtgccaccatgcccagccaatttttgtaatttttggtggagacggggtttcaccatgttggccaggctggtctcctgacctcaggtgatccgcctaccgcagcctcccagagtgctaggattacagacgtgagccacctcacccagccagaaatcctagtaagtcttgaggtatatagttctacagcaaagccggtaattgtgatttttggggttttttgttgttgatgttgtttttaaatcatagacagatgggggtctcactgttgctcaggctgatctcgaactcctgggctcaaggatccttccgccttgacctctcaaaatgctgggattataaccaccaggccagcccagtacttacgttttttactaggtcattgatattccagaaagctaagtatttttagtaattttaaaatgtcctatctttatttctgagcatttgtttaaaaatgctaagtctgatgccacattgctgtctcccatgggtcctttggttccaggaaggtaatacaatttcataaatttatttttgaagatttcctcacggtagcttctacgttgctaaacttgccattacagtcaacttccctagcacagaggaaaaatagcagtagaatataagagattgagtgctcttagcaaatcttttattaccccagcatagtctctagtggtgtaattctctattgatgtgaacatttctattacttatgatagagaatcagtacaaaagtttataaagcaaagctgaagtttgtcacttgtaaatggtataaaggacaaattagaaacagattttgatttcctaaaccatgtatttctcaagctgctttcttgtgaccattttatactacttcaggctcctgatttcaaatacatttttaaagcacctaaataggccaggcatagtggctcacacctgtaatcccagcactttgggagactgaggcgggcggatcacctgaggtcaggagttcgaggccagcctaggcaacatggtgaaacaccatctctaccaaaaatacaaaaaattaggtgggcgtgatggcacatgcctgtagtcccagctactcaggaggctgagatgggaggatcgcttgagcctgggagatggaggttgcagtgagctgaaatcgcaccactgcactccaacctgggtaacagagtgagaccctgtctcaaaaaaaaaaaaaagcagcctaaattaatcttgactttaccataccctaagaactctttgtaattacaacttgtatattaaatccaagagtaaaattaagcattagagctgtttttcagaaaagatttgtagggagaacttctaatcacttataaggtaaattattgaggttcaagaatcataagctaaaatcttggtgccttggctaggcatggtggctcacacttgtaatcccagtgctctgggaggccaaagtgggagaatcacttaaggccaggagttcgagaccagcctggacaacatgtgagacctcgtctctacaaaaaataaaaaacaattaccctggcatggtggtatgcgcctgtagtcccagctacttgggagactgaggtgggaggatcacttgagcccaagagtttgaggctgcatgagttatgattacaccagaattcactacagcttccaactcctgcactccagcctggtgacagagtattatataaagagtattaaataaataaataaaatatttggtgccttgtcagaaatgaaactgtgattgataaaaacat

SEQ ID NO: 2777 - DNA, 480 bp, Homo sapiens
acatcctgaggttctggatggatatgaattctggggagacactattcaacccagtatactttttgcctttcttccttagagctccagctaatccagatgcaacattgacgaattagtgccggaatgagtatcagcacttgacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttg

SEQ ID NO: 2778 - DNA, 3049 bp, Homo sapiens
ctctagggtggaaggctgcgggcgtcctaccagtgccaggactgccagagcgggaggagcgcggcgcgggccagccgggactgctggacagcggggtccaggctagaggcgagcgagcggtccacctcctaacaaattattggaaggaatatgagaaaagtgtagacaaagcggtcctggctctgcgtgtgcagctccaccagcatgcacatggtggaccactgggctcttcggagtgaagagaactccaggtgcttgtcccttgccagcgtgagaaacgcatcccgaccatccatcagatcgcaggggatgagaggatcaggatcaacaatgggaggcagggagttggcagcagggccagcaatgaggcggatcacaaagaagacctgaaaaacagacagtctcttttttttgagacagggcctcgctctgtcatccaggctggaatgcagtggcgtgatcttggctcactacaacctctgcctcctgggctcaagcaattatcccaccatggcctcctgaatagctgagaccacaggcccacaccaccacacctggctaatttctgcattttttgtagagacgaggcttcgccatgttgcccaggctggtctcaaactcctaagctcaagtgatctgcctgcctcagcctcccagagtgctgggattacaggtgtgagcaggtacagcaggctgagcaccaatgagactggcgaatgctgagttagtttcaccaccatacgcctcctgttccttttcctgctttacctctttggtctcttgagactgactataaatagaactgaaatgcacatcctgtgatttttttctccttcattcagtaactccttcagagtaacaatggtctgggtgaggtatagcaccatgcacagtggacattttgcctcaaggcagtctactttaagatgcaatccatggtttaacctcaatctaattacaacaaaccagacaaatccaaatatggagacagtatgaaaaacaactggcctggactcatgaaggtcccctatgcaactttcctgtgtaacttttcctacaggtttggaagggaatggaatggataaaaaatcttagtctttgttgacaaagcaataaaattcttgttcattgaagtttgaaaaaacttgtaacaaccatcaattctcataaccattagtgtaaaaggtataaaaagctggtattacatatgtatttgacattaattagtatataactataaacacctattaaagtaataaaatgtaaaacatccccttaagaaattaggaacttgtgagaaactgctgtactgataacagattattcaacatctgtgcacactggcagccacactcacagtctctggccagcaatgttcgctgcttctgtcaccctacaaccaggccaatacttggatttacaacctaaatttaaacagccatggaatgtgtccacaatttaagtcaaacctattacaatatattctaagggcttttcccaactgcctaggattctgtggcattacttactgcttgaaatagctagtaactattaattgttaataatcattacctaacgtattagaactcaggaatccttccatttcactagcatggctgagataatggttattaccattattacatcgtagcccattattctaggctaacaaaaaaggggtggtgatggggggagcagtgggggaaaagatactttgaacacctatgtatataggtgttcaccatgataacatcattataacaaattcctctctaaaaaagattttgttaactatttctctcccaaagagactgtttaaccaatttttaggtacggaattacaacctgaaatcaagccttcatttccctctcaacttaattaccacttcctataagaacttgattatatgtctgagaaccgagatagtaaaatgaggagtctgactgaacaatcgagattactaccattggacaaaccctgagaggaattactcttcaattctcctggctttcgttatcaattatatgatattaaagagagaaaaaaaaaaccttacccagttattttcccaaatgactgcaagaacaactaaacaatgtaaatgatgaaataactcaaaaagttttgagaagggggttgtaagtccatatgtggaagtttaacttttctccaattctatttactaattcactttcagaaaggttaaatctttttattttttgaaacagagtctcgttctgtcacccaggctgtaagtgcactgcaacctctgcctcccaggttcaagtgatcctcccaccccagcatcccaaggattacaggtgtgtgccaccacgccaggctaatttttgtatttttagtagagacggggtttcggttcgccatgttggccaggctggtctccaactcctgacctcaagtgatccgcctgcctcaacctccaaagtgctgggattacaggcatgagccaccacgcccagcgaacagtcagtgtttttattcatttcttatttctttttctgaggtggagtttcgctcttgttgcccaggctggagtgcaatggagtgacctcggctcactgcaatctccgcttctcaggttcaagcaattctcctgcctcagcctcctgagtagctgggattacaggcatgtgccaccatgcccagctaattttgtatttttagtagagcaaggtttcaccgtgttggtcaggctggtcttgaactcctgacctcaggtgatccacccgccttggcctcccaaagtgctgggattacaggtgtgagccaccatgcctggccagaaatcttgccgtttttccccaactctgggtggctgcatcttacctctttatgcttctccatggtggcatatagtttctgtgagaggtcgttagatacattgggcatcccgggtttcttcttgttgcccctactcaggctgctcttatttttgctggttttcttattattcttctttttagcatttttgctgtctcccttggtcacctgcagagtagcacaaaggagacaagaaaataaggtttt

SEQ ID NO: 2779 - DNA, 548 bp, Homo sapiens
caatgtttcaccactttaatagaatattctaactattctgtacaaattgaaaacactgtattcagttacaaatgtgttctaaggttaggccgagcactctccacaggcctggtcagtgcggacacggccatccccggctgccggagagcgccgtcacccacttgaaaaccccacccaccagccgccaagcggtcacaccaaacccaggaccttcagacaggatgaatgggaagaattcagtccaactgcaggaggggtgggagaggttccagatcctgggaaccacatcaccagacctcggccctttttgccaagtgacccccaccccaccctgatgtggtctacagggccctcccacagggaaaggcccagggaagtccagagctacaggcaccaaggctgcagagggtgctggacgaaacctcctatttctgaaatgcatttcagttgccactgtacaagttaagcaaaataataaggaaaaaggaaaagtgaaagtgaaaatcatgcacttgaaaacgagttagatggagtaagctctgtccacg

SEQ ID NO: 2780 - DNA, 1644 bp, Homo sapiens
caggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattaccaacgacctcatgtacattgctgacctgggccccggcattgccccctctgcccctggcaccattccagaactgcccaccttccacactgagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggttgacccctccggtggccgggccactctgctagagtccatccgccaagctgggggcatcggcaaggccaagctgcgcagcatgaaggagcgaaagctggagaagaagcagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatc

SEQ ID NO: 2781 - DNA, 13454 bp, Homo sapiens
gcaatgagctaagattatgcctgtgaatagccactgcactctagcctgggtgacagagcaagaccctgtctcaaaaaaaaagacaggtttaagtaactccccacccccaggtgctggggttagtgatgtgtctgggcttgaatggctctgtccatttggtgctgtgttcactgagccaagttgagtgcgtgtggggtcctgtgctgggccctgggattcggggatggataagtgacttccctgctatgcaggatttgatttatgttcctcctggatgtctgcagtgccacccacccctgcctttgctgctttgctgccaaagacccccaggctgttttggccttggtggggcgagggctggctgctgcatgtcttccaggtttcagattgagaagaaggccacattgaggggcatggggtggactgatgggaaagctaattagcatcctttggggcaaagtacaactatggggcaaaatacaactaagaacaggaaggagctgaggaataaatgcctctccccgacttccctgatgtgggcttctgagaccatggctcatggagatgggctgcatggctgatcatcagctgggttttcttctgaagccatagccagctcatgcacctgcctcacctcccttcccctccctgttgctcgtctagggtgccctcccctcacccccaaacccctgccaaagaaaaggcatcagcagtgagctttgtcctggctctgtttttcagggaacctgggccagaatcatggtccccaaagatgaccatgtgataatccctggagccattgactatcatcttacatggcaaagggacatggtgggtgtagttagtgaccttgcaatgaggaggtcatcctggatgatccaggcgggcccagtgtgttcgctagtgtctgtataagagggacatggggagctttgactgcccatgaacatggcagcttgaccctggaggcaaggtggtagcttctggctctgaagatggaagaaggggccatgcactaatggatgcaggcggcctctgcctctagaagtggaaaagacaaagaaatggattctccactagagaacccagaaggaaccctggagcctccagaaggaaccagccctgctgacacctggattttagcccagtggaacagattttggactttgacctctaggactgcaagagaatccactgagccgttggaagcccctgggtttgtgttaatttgttacagtagccacaagcaactaacaccatcctgttctccaggctgctgcctccagctgcagctggcgtgccctggccactggggccaggcagggtgggttttgatacctgcagcggcagcatccttggccatttcctggaagggccagttgccagacactgagatgcctgttactgcaactgtcccaccagcctggagcacgtgtttctggagacaggcaaattctggaaggctccacctgctctcagactgcaggttgcgtctcaaagcaggctggcagacattttccactcttgatcaatcattttccaaaataagcatagacacagcaacccggagagcagcttcggtttggctgtcggtggcgtgttagttactgtagtggtggcacagaggcgatatacgttaaatattagttctcactgactatagccttttaaacagagcagcgtgtgggtggcagcaggtgagttggctatactgagcttgggctgcccttggttgattcttgtttgtcaggcatgcagggggctctctgtgcgtccaggcatattccctgtctggatttgcttgtgttcatggattttcagcacctcctttcttctggtttgggaatgagtcaggtcctcactacacaaggccagagcagtatgcgtgtgtgggtaggggtgagcaggtgtcattccctgcctcccctcctccttcactgccccagccaccctgaccaccttgctgttctgaggacacactgagccagtgcccactgggcatcaggtgaaaggggacatcccacaagcccaccctcacttctgacaccaatggcaagttcaggatctccaacactgccctgaggtttggtcatttgctagagggactcccagaacccacttaaagctgtcaccctcacagttacagtttctgatggtgaagggatacacatgaaaatcagccgagggaagagttgcccagggcagagttgaacgcacccacacagcacctccattgtcctttcaccatggggtcataggcagcgttactctcccggtgatgtgggacaatgcgcatgcagtattgccagccggggaggtcatctgagcctccgtgtccagagtttctgctggagctcacttgcatgggtgtggctgactgtccacatggctcatctgtctccagcccctccagcagctggctgatagagtgcaacccaaagccccctccctgaatgacatagttactccctggctggcccgagggccccaggtaagcagaggtactttatctggcagggcatttcggagcttaggagatcacctcccaggggctgaggtcacaggcccaacctctctgtgggcaaggttaggttcattatcacgtacctggtctttggactttcaaaggcccatgcctggagctgtcttcaacacttctttcagttttctctcaatgcttcctccttggagacgtatttcctgcccctgtcactccatcactctcctcctaaccccagttactttttctttgctgggcttgctgctgcctggagtcatttcctatttactagtttgtttttggtctttctcctcccctagaatgtaatcttatgctgtgagggaccatgaccattctcttcccagctaaatccccagggctggagttgtgctgcacatgcagagctaattcatccttgatagatagtaagagaaccgatgggggtctgtgtcagcagcaccaacatgaggttcacaccagcgtctcccaagatggcatgcggcttagagacaagacagatgtggttgctttttgttgttgttgttttgtgttgttgttttgagatagggtcttactctatcactctatcacccaggctggagtgcagtggcatgatctcagcttactgcaacctctgcctcccaggctcaagtgagtctcctgcctcagcctcccaagtaaatgggattataggtatgcaccatgatgcccggctaattttttgtatttttagtagagagggggcttcaccatgttggccaggctggtctcaaactcctgacctcaagtgatctgcctgtcttggcctcccaaagagctgggcttacaggcgtgagccattgcatgcccagccagatgtgtttttttttttttttttttttttttttgctctaccccaaacctgtgagatggcagggaggaggctctgggaagagggggtgagggttggggtaaacctgtggattggatgctgatgtaggtggtcccaggtgctcccttgggaggagatggacagtccggatggtgcagacaaaacacctccatccacattacctgcgtaattctctttgctttccagaacatcctttgtgtactgtggactgtgatgatctaatgctagtggattacatctaagtaggccttagtagaagccacctcccagtggttcctcggaggcatttggtccagaagcagatgattttagtgcaaagcacagaccgtatgcaggcctgagcagatcaggggacagacagatctggctgacatcctgatccgctggctgtggtggtgtggccattgcttgtagccacattgcagtcttgaatgtcccccttggaaatgggggacatttccaaggatgcctgcctggtcctctagttttctctttctctgttctctgtcatctgcacttttttcctcttgtcttgattgcttgtcctgtctcccctagtagacaccccctctgacctctgctgcctcaggactgttgctgtataaaatattgtgagatgccctctgctcctgtttaaaaaaaaaaaaaatccttagctctgggtaagctaggcactgagaatgaggccagtcattcaaaacttgtctctgagcattgattatactcatgtattatactgttaaggggtgaaggtcggctctagggtcagcttcctggatttaaatcccaactcagattaaagtgggagaataatagcaccaacgtgacaacctcaaagtgtcatttgtaaggataatgttagatcatacacttgatcacccgttagcagtgtaagggcagtgtgggaacatgagcatgaacagggcagcccagaagggagttgaatggacagatgggcaatgccagtttggaagtgggtgcatgcatccggtgggttcaggagcctggaagacttatccaaaagtcatctttgctggtgtttcttcctgtgtattttctctaaccttctccagcagtgacctgaattacttatgggtgaacactgaatgctgcccaggcaactagaggtttatagatgagatactttaaatttttaatgattcttaaaagagggagtggctattcttatgctttccagaatgaatagccaagggaaacctgtacagttgccatataaggagaaacctagacctggccttagcctctaggtcctggtgcagattcttagcacgtagcgcctaaaacctttgcgatttcctgagtgataggagcgtcttttgttattcataatgagatctgggtttatgctaacgaggtgactcagggtgggggctggccccagagtaaccaacacaggattagagggttgggtctatcagtcctacccacccccagcctctgggtggggtggagaggggctggagagtgaatcaaatcaccaatagccaatgatgtaatcagtcacacttacataatgaatcctccgcaaaacccatcaacagtggggttcagagagctttggcgctgggaaacacacatggaggtgctggagggggacacgcagggagagggcatggaagccccgcctccctccccgaaaactctgtcctgtgcagtgtttcttattaattacactgtccctgagttctttttttttttttgagacggagtctcacactgtcggccaggctacagtgcagtggtgcaatctcagctcactgcaacctctgcctcccgggttcaagcgattctcctgcctcagcctcccaagtagctgggattacaggcgcccgccactacgcccagctaattttttgtattttagtagagatggggtttgaccatattgccctggctggttgcgaactcctgagctcaggcaatctgcctgcctcagcctcccaaagtactgggattacaggcatgagccaccaccacgcctggcctgctgtgcctgagttctaacctttatagtaagttggtaatcctcagtaaaatgcttttctgagctctgtgtgttctgccaaatcactgaacctgaggtgagggccctgatttgtaatcagtgggaagaggctcaagtagcctgggagccccatctgcagctggtgtctggaatgaagtcaatttggtgggactgagccctcagcctgtggggtcaactgtagctagtgttagaatcagactgaactctaggacaccccattggtatcagataatcagagaattgctgttggaattttcatgtgcgtccgtgtgaagagaccaccaaacaggctttgtgtgagcaacatggctgtttatttcacctgggtgcaggcgggctgagtccgaaaagacagtcagcgaagggagataggggtggggccgttttataggatttgggaaggtaatggaaaattacagtcaaagggggttgttctctggtgggcaggggtggatctcacaaagtacattctcaagggtggggagaattacaaagaaccttcttaagggtgggggagattacaaagtatattgatcagttagggtggggcaggaacaaatcacaatgctggaatgtcatcagttaaggctgtttttacttcttttgtggatcttcagttaatttaggccatctggatgtatacgtgcaagtcacaggggatgcgatggcctggcctgggctcagaggcctgacaggaatgacacgttgggtgtcagaaaaaaaacacagaaaactccctaagcagattggttgaaagcaggctgactgcatgtcatctgggggtgcgtctccccccaagagcaggtttcacatctcattccccggttgattggacaagacccttcctgtctttaagttctgttttcttcctccctttgtctctccgaagaaaatcagctgcatgaaaacgatcctctgggcagaaattggtgctgttggagccgcacagaggtgccctcccgtgccccctggcccccaccgggccgtgtctcctcctgcctgttgcaatcagccctcgtccgactctttttggaagtgattaaaacataactgtcatagctctgggggagacaggctgcagatcctgattataattcagaaggatctaaagaaaaagtaattttttaaaaaaattctggttaaagccaaagctcataagacgtgtgtgatggagtggtatgcaagagcacaattaatgtatgtcctagacatctgcccacaggattcagggctggcaaatgagtgcgtccctaaaaataatgactagtgctatctttaaaaagtcttttgtggcatagcagattaagatggatggcctgggaagtacagtggcagcgtgtgctgtggtatccaggaataagttgtacctcctcggggtggcagtggaactgggccgtgaacagcttttgcttcccagagaggactgccatggcctgctgcatggaatttgattttaatctgtttgttatttttgggtttggtcttggactgggtttgaaatccagatgtgacttttttttttcttttttcagttttctttatagcagcaatgttgtatcttgtgtgtttcctaacaagactgagctctgagcaaggcagcctctggaaccaaatgtctgcaggcccaggagacctttctagaaagttcataggtgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaagaaagttcataggcggttctgcagtttgagccccttctgtgggtctgtgcctgctttagccgcttgagatatggcattgaacaaaacacaggccccgcctgggagaagctgccaggccagctggggagacagacctgataagtgaaaatgagatcgcgtggcctgcatgctccgaagaagactaaggcaggaaacaggactattttctcccgactgaattgtcctggtatccttgttaatatcagttgactgtgacttgagacttatcttggacacccctttctgttccgtgggtctgtgtctgccttgatgtcagtcccacagtttcgacgactggagctttgtagtcaggtgtgaaacagtggagtgtgggtcctccagttttgttcatctttttcagattgttttggcaatccaggagtcctttgaatttacatatgcattttattttattttaattattaatattattattattttttagatggagtcttgctctgttgctggagtgcactggtgcaatctcggctcactgcaacctctgcctcccaggttccagagattctcctgcctcagcctctcgagtagctggaattacaggcatgcaccaccatgcccagctaatttttgtattttcagtagagacagggtttcaccatgttggccaggctggtctcaatctcctgaccttaagtgatccaccagcctcggcctcccagagtgctgggattacaggcgtgagccattgcgcccggcctatatatgcatttaagacctgcttgtcaagttctttagaagccatctggatagtgattaatttgtaaaaatgatacttattatctttttgaactgccaaagtaatatatgctgctgaaaacctggaagacagaaaaatccaatagaaggcagggctaattttttttttttttccatgtatgtcccttcaggcttctctgtgtttttcatttttcctacacaaatttggaatcattccagagctagtaagcatctagggccacatttggactagtaccttgggataaattagagctggaattgccgggtcatatagtgtgcacagggctagggactgacttattttcctttctgaatgaagactctgaggtctagagaggttaaatgagtgactcaaggtcacacagctaaaactctggtggagctgggtcttaatgcagaccctacatattcatgccatgctgtatttatacaggcatgtacaccagcgggtcgggattttagggggtgttttaaaattctgcctgcaaaacctttttttttttttttttttttttttttttttttttgagacagggtcttgctctgttgcccaggctggagtgcagtgtcaccatcacagctcactgcagcttcctcccaggctcaagcaatcctcctgcctcagacccctgagtagctgggactacaggtgtgcactgccccacctggctaatttttaattttttttgtagagatggggtctcattttgttgcccagggtagtctcaaactcctgggctcaaacactcatcctgcatcagcctcccaaagtgctaggattgcaggtgtgagccgctgccccaggcaaacccattttaaagccatgagccaaaaattataaaagacatgcaaaatattatgagtagtcacttatctagtatttgcggcatctctcaggcttggggctttgctgggagctctgagggggtggaagaggctctgtcactggccttacctggctgtcaagggctgagtgtttggtggagggaagacgtctgcagcctgggaggctgcgggtcagaaggaggtcagccggggagctgggaggatcgtggggaacccgtggtggaaatcagcatggcgagagagtggaagcaggcagaggagggctttgaagaccaaaaagggtagttaggattgctgctctgtgtgtctgtaaacttggtgttgtctctcgaatttaaatgacatgctttgaaaacaaaaaaacaaacaaaaaccaaacccataaaatctcactaagtggccagagcaagttcccggggggtggcgcatagatgcagcggtctgggttctgtggctgggggagttggcttggggtccgtggctgggtcagtcttcaagagccaccctgggtggcactccaggtctcttggtctggggggaataccctgaccccagcggtttcacggcctcctccccactcagcctgggggagagtccagggtcggccctgtccccctccccccactcctgtcactatcagtcccctgtgctcagcttactggcagggttcctcctggctgtcccctctgcctccagcgctctttcctcaggtgtccacgcagctcgtcctcacccttttctgtctctgctcagatgccgcctgaggctcccaaaacagggtctcactctgtcacccagggtggagtgcagtggtgcaatcacagctcactgcatccttgacctcccaggctcaagcgatcctcctgccagcgagcttgttacaattcctgcaccaacacggatacattgttactaactaaggccctacaccagcaaagatacattgttactaagtaaggccctgcaccaacacagatacattgttactaagtaaggccctgcaccaacacagatacattgttactaactaaggccctgcaccaacacagatacgttgttactaagtaaggccctgcaccaacacagatacgttgttactaaataaggccctgtaccaacacagatacattgttactaactaaggccctgcaccaacacagatacgttgttactaagtaaggccctgcaccaacacagatacattgttactaactaaggccctgcaccagcacagatacattgttactaaggccctacaccagcacagatacattgttactaaggccctgcaccaacacagatacgttgttactaagtaaggccctgcaccaacacagatacattgttactaagtaaggccctgcaccagcacagatacattgttactaaggccctacaccagcacagatacattgttactaactaaggccctgcaccaacacagatacgttgttactaagtaaggccctgcaccaacacagatacattgttactaactaaggccctgcaccaacacagatacattgttactaaggccctgcaccaacacagatacattgttactaactaaggccctgcaccaacacagatacgttgttactaagtaaggccctgcaccaacacagatacattgttactaaataaggccctgtaccaacacagatacattgttactaactaaggccctgcaccaacacagatacgttgttactaagtaaggccctgtaccaacacagatacattgttactaactaaggccctgcaccaacacagatacgttgttactaagtaaggccctgcaccaacacagatacattgttactaactaaggccctgcaccaacacagatacattgttactaaggccctgcaccaacacagatacattgttactaagtaaggccctgcaccaacacagatacattgttactaactaaggccctgcaccaacacaaatacgttcttactaagtaaggccctgcaccaacacagatacattgttactaactaaggccctgtaccaacacagatacgttgttactaagtaaggccctgcaccaacacagatacattgttactaaggccctgcaccaacacagatacattgttactaagtaaggccctgcaccaacacagatacattgttactaactaaggccctgcaccagcacagatatattgttactaaggccctgcaccaacacagatacattgttactaactaaggccctgcaccaacacagatatgttgttactaaggccctgcaccaacacagatacattgttactaagtaaggccctgcaccaacacagatacattgttactaactaaggccctgcaccaacacagatacgttgttactaagtatggccctgcaccaacacagatacattgttactaaggccctgcaccaacacagatacattgttactaagtaaggccctgcaccaacacagatacattgttactaactaaggccctgcaccaacacagatacattgttactaaggccctacaccagaatggatacattgtacattgttactaaagccttgcaccaacatggacacatcattactaactaaggccctgcaccaacacagatacattgttactaaggccctgcaccaacacagatacattgttactaagtaaggccctgcaccaacacagatacattgttactaactaaggccctgcaccagcacagatatattgttactaaggccctgtaccaacacagatacattgttactaactaaggccctgcaccaacacagatatgttgttactaaggccctgcaccaacacagatacattgttactaaggccctgcaccaacacagatacattgttactaagtaaggccctgcaccaacacagatacgttgttactaactaaggccctgcaccaacacagatacgttgttactaagtaaggccctgcaccaacacagatacattgttactaaggccctgcaccaacacagatacattgttactaagtaaggccctgcaccaacacagatgcattgttactaactaaggccctgtaccaacacagatacattgttactagctaaggccctgcaccaacacagatacattgttactaagtaaggccctgtaccaacacagatatattgttactaactaaggccctgcaccaacacagatacgttgttactaagtaaggccctgcaccaacacagatacattgttactaaggccctgcaccaacacagatacattgttactaagtaaggccctgcaccaacacagatacattgttactaactaaggccctgcaccagaacggatacattgttactaagtaaggccctgcaccaacacagatacactgttactaactaaggccctgtaccaacacagatactttgttactaagtaaggccctgcaccaacacagatacattgttactaactaaggccctacaccaacacagatacattgttactaagtaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttactaagtaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttactaactaaggccctgcaccagaacggatacattgttactaagtaaggccctgcaccaacacagatacattgttactaactaaggccctacagcaacacagatacattgttattaactaaggccctgcaccaacacagatacattgttagtaactaaggccctgcaccaacacagatacattgttactaaggccctacaccagaatggatacattgtacattgttactaaagccttgcaccaacatggacacatcattactaactaaggccctgcaccaacacagatacattgttactaagtaaggccctgcaccaacacagatacattgttactaagtaaggccctgcaccaacacggatacatcccattactaactatggaggtgctttattcagatatcctcagtgtcacctgttctcctttggccgtctcagggttcctcccaggacaccacattgcattcagtcctgaggcttctctgggctctgacagtttctcagactttccttgtttctgttgaccttgacagttttgaggattactgctcagagagtttgtagactgtccctctgttggggtttgtctgatgctttcttc

SEQ ID NO: 2782 - DNA, 1587 bp, Homo sapiens
aagtcagggaactagctttggttgggttcggtggtacacaaagcacaaggcctgggttggggttaggaggaaatgagacttgcggcgggtcggggctgaagatgtggcagcgccctgaacctggagaaaggctggtacgtaaacgcctgcgtcgcaatctggagtcagctggagtgtcccggcaggtgaggaagagctggggcgctcagttgagtgctgggagccaaagaagtaataactacctttggttgggtgtggtggtacacaaagcacaaggcctgggtgggggttaggaggaaatgaggcagggttggcctcagacaccaaggcctatcctagggaaatggagatggacaggcgccatggtctgacaactatcttgagtggtgaaattgaggggacttggtgactgagtgaatggggaagagggagcgctgggctagtggtggttccgagtttcctggatgtggtgtcattttctgagagggggagagtaggagaagggtgagcagtgataagtgtagttctaaggaattggggtggccataggcagtgggcagctgatcgtgggggtctgacgcacagggagtggcacatagagaagtcacagggcagtgagattttcaggggaagggtgggggtggaaggagctgtgagtgaaatcctgtggcacaggactgggagtgaggaggggtgagagatagaagaagcctcctaggctttctagtctttccctcaaaccccctcagacctctgagctatgaaggagggtgggttaccctaccacaagggcagaggcctactcagggcctgatgctgagatgcaggatccctcactccaggccaggccttccccaccctgcagagcgcccctacaccaggtgtcgatattgattatgcaatagaaagcaggaggcagctccttgaggggggctgggcataaactcacagcctgtaagtgacggcatatggtgggaaagagtccggacccacccagaaacaggtttgtgaccttaacaagtcacttaactctctcagatcccagcagctcatctgttaagtggagatgataccaacctattagggatgttgagatatgttaggcacttagaacagtgccaggcagaaagtaaatgtagccattcttggagttgagggttggggcacagtgctatgtcttacgttgaggagccagggctgggcacatacctataatcccagcactgtgagaggcgaggtgagaggatcattcaaggtcatgaatttgagaccagtctgggcaacatagcgagaccccgtctctacaaaaaataataataataaataaagacccaagtgttggaactgagctgcactcatcacgctccagtgtttgaaggagggatgagctgtatgacatcatctttcctagcttagtcttctgcgttgtggggcagggatattatctaataacatgaagcaactgcattaaagtgatgagtctgtaggtgtgatacaattgtcactggcctgctagagttccagggggtttggaaatagccctgctttaacattagagtcacctcgcaaaaagcttctaaaaatttt

SEQ ID NO: 2783 - DNA, 6418 bp, Homo sapiens
gcagacagcccggcgaaccgcgcaatgcgcttcttctgcctgcagcagagaaaaggaaagaaaactccgcaggggctccgttggcttctccacgagtgacaaccatgttttcccagatagaagaccggagccctgctcctttgcgatccgccgagggctgcagagagcatcctcatccatttgggcacccctgcccaggaagagcccggccatccctttccggactggatccttaagaggtgaattttcttccgtggattccgatttgctccgtctgaccagcctaggcaatccagcatcgcgtggtaccagtgccgctgggcacactggcttcacgccggctccgcctcaccagcaagcgcattcccaggtggtcaggctcaggatggaccatgagctttcaaaaaggaaaaaggtggaaatcctcaactatgctgccatctgaataagtgtttctttgtagatgcacagagtcaaggaaaattacatccctgcattatgtaatgtaccaacaacgcacttacccactgttttaatctaggttattcttgaaagcagagcctgagacaaaggtagacacattctatttatgagtctaacacccaggagcaggaatgagagataggggagtgaactggggaaaagggaaactaagtccgagcaaaaccagatactgctcttatcaagtggtccacccctattaatggctacataatgcagaactttctcaggattcttcttaaactttatctcagaactgtctgcctcagggagaaaggagaagtatttctccatcagcagccacctcctgtgtgttgagggctgctcctttggggcattaacccactgcctccaccaccccaaccctctgggctgcaaagagctagctgacagtccagctggtaccttagcatcacacattgctgcatcagagaggtcttaagacaggaagctagagtcttggtgcatgctcgaagtgagacggtgtcagcacagagcagggtaaaatcttcccgttaactcttcaccagagctatgactggaatcagaggttgaaaagatgtgagactgtacccaagaagcatcttataagcctacgtaatatactgttagactcatcgaaatctatttcctcccttctttataatcaaaacttcagtgtccagaataaagttggcagaagggttaaattggaaagttaaatgtactagaaggtgtacatttataagttttgaccttgagtcgtgttcaaggagaaagtgacattggaacttggaaaatttaaaaatgattctacttgaaaaatttgaccattgcatagaaatattagctatcgtctaatcttttgtaatcttagaaacaatcgtgaattgtttggtgaaaaatgaaaaaataaccatttcttatgtctccgtgacctttatagaccaatgtcaccaacttttcctaaggtaattgtttcctactgtcaaatagctctagtgatataaatcttaacaatcaatgaagggaaaactggtggaaacataggaggaaaaatactgggataattttcatcacaaagtattggcattaacattggttagaataggggagaaactgcatgacttgacaactggacattcctgtatgttgtatgaggccctgtcttaacagaaatagtgatgtcatcatcatcctctcttatttggtcttgaattgccaccaatcggataaaacctttgaattatttaactcaatatatgttaagtttctactatgtgctgtgtattggtactataaatatgaataagacataagatattacattcaaaaacatcagaatacatgttcttttaaagtataccccaaaacatttaccatgtgttctggggcgcatgttaggctggatcacaaatcaagtctcaagaatttcaaaagattgaaatcatatagagtatgaattaaaccagaaatcaagtacataaaggtaacaaaaaatttccaaaatgcattaatttaaggaacatacacctcatgacccatgagccaaaaaataaatcacggcaaaattgcaaaaatattttgaaatgaattttaaagaaaatacttagcatattaaatacttagcatattaaagctctaagtacatatgttagaaattttaccgaaaggttggctatcagtgtttccagaagccagggaaaaagtttatacaatttgatcgctgaggcagggaaacaaagtgagacctccgatcgccctgcctttctgaggtgagcactctggatcccatcgcaggagatcagagtcttgctgagttgaggagaggaagattggagttgatactgagatagcttgaattttcaggacaaagtatcaacaaggaggaaggtagacaaaaaaatccagaaatctatgtagagaccccattgtgtacattgcggaacactaagcctaacaattctcaaaattagcgtgagattgggaaatatctaatttccatccagccacagtggagagtcctgactgaaaaccaggcattcgctaaagatcccagaaaggttgtgtgttacatacgtagggctaaactatcctgactaaaaactacactacacttgctcctcacccccacaaaaagcttaaaaacaagcctcaatagtataaagctgatctgtaagtaactaaactacctgcagaacaaagtccaaatttattagttccagtactccaaaaaaaacacatgtaaaaaaaaaatagatttacaagacatttatttggggaaaaaaagaatgcctgagggttgaaatggagaggaagccagagagacagagtcctcagaatacataaaatttctggcctccatggaggtgtgatggttaattttatgcatgtcaacttcgctgggccacaggatgccccatatatgatcgaacattatttctggttgtgttcatgaagctttttctggaggaaattcgcatttgaattgatggactgaataaagcagattgcagtccccagtgtggatgggcttgatccagtcttctaaggacccaaataaaataggtggaggaagcttgaattttctgcctgactgtggcgctgggacacccatcttctcctgcccttgaactgggactgacaccatcagtgctcctggttctcagaccttcggacagcagacttggggccttctcggcctccattattgtctgcttttagatatttaacgggagaggaaaagagaaaatatgattaaagcctttgaaagtccatttccaagaaataaaaactgcagtaggaattctacaaaactgaaaaatcttcaggactggaagatctatccagaaaagcccagtggattataataacttattaaaatatttgtttggcaagccactgactaataccactttaagatatgaatgcattaccaaaaaaaattggagtgagtagtttttacaagtctttgaaataatcatatttgtattttgacactaatttgaaacaaggagctggcttgaaatattaaacctaagtgatcagagacaatgagctatcagactgcatgatcaacgtagagcaatctccacataagatgagatgcatgcagcctctacaaatttggcttggggaggagtttgcttcgctcgcttgaataagccactgtctatggctcacaagggtcccgttcttaatgaggtggtgcgtagcagcaacacactgtgaatccaaatagcagatggcaacactgttgagtaggctggcagtctgatgtctagccaccaactggcagcaatcattattaaactgattcatgtgcccagggaaaatcttcataagagtcttagcaaatgtgagcagcaagaagcaaatgatctgctattcctatctgctatgagtactacctatatttcttaaaatatttttccccagtgcaacctacacaaagaaatggcatgttatgtgcactggaggccctattcctttcctatagatgcatgtatacctttaaacatgatagctgtgatttctctatttggtgaatagctttcccttgacggaaatagcttcatagcattcaccctatggatttgttgcacatattcaatgataggcaagcactcatagattctgtaaataaataactgaacatattctatctcacataatgaagcaatggcctacattgctcatagtccatctacatgagacaggtaactcatccttgggtgaaaagtttgttacactcacacttggttaggaaagcagactaagaaaggctctagctttagaaaacttatgtaaggatctttctacaagaaaatcttaaaggtatacatttaaaagttaagtctttatgctgggtgcagtagctcatgcctgcaatctcagcactttgggaggccaaggcgggcagatcacgaagttaggagcttgagactagcccggccaacatggtgaaaccccatctctactaaaaatacaaaaaattagctgggcgtggtggcacatgcctgtaatctcagctactcaggaggctgaggcaggagaattgcttgaacccaggaggcagaggttgcagtgagcagagatcacaccattgcactccagcctgggcaacagagcaagactccgtctcaaaataaataaataaataaaagttctgtctttacaaaccaaaatgctaaacaaatagcatttttttccaaatgttgaaagtatgtgttgtttgtaaccaataaagccaatttccacaactttatatgttaataaacaagccttaaggtaaggcttttattgaaaaacaaaaccctgctttattcacttacaaaatacttacagttaaattaaaaaacaaaaattctagccattctctaaatcttcattacatttttaaaaattaagatactagaattcttttacatgctcataataacaaggggaaagctgcagttaaatgtcagatattccacatgttaaaaaatatattttattttatgttccatttatggtaattttttaatagaagcaaaatttaaaatcttttttaagaagtaataaaatcactctgaatggattatttttggctttatcaatttgataaatcaatccaggctgaaatatcatttataacttctagagtgagtgcccctgctcttgtctcaaatatgagagtgattatcaaccaaagttagataccccagccctggcagtcaaactcaaaagcaagcttgcacgccgtctctcaagtctctcagcattctccccaaacaagaaatcaagtgccagagcttatacacttaatatttgagaccaaaaaagaaaactccaaacaagagatttactcaaatgtgcttgtctcccagttactttataagaagtaaatccatgtcagaagaaaagatgcccatgtcttgttctgcatgggaaataagtgccatgtactaaaagaagcctaaaaatggtggcacaagtttctttaaatggctaaaatccctcaaaatactgaacatctcatcagaccatcaagagttatgttttttgtcacacattatgaaattctagatatcccagcctgggcaatatggaaaacctcgtctctacaaaaaatgaaaaactatccaggtgtggtgccccatgcctatagtcccagctacttggtaggctgaggtgggaggattgtttgagcctgagaggcagaggttgcagtaagtcatgattgtgccactgcacttcagcctggatgatagagcaagactgtgtctcaaaaaaaaataattctagatatttgaaaaataagatagggtgatgaatgtttatcaccggatattagggtgtactcaatggtaagtataaagggaaaccagcaatgggtaggctagttcaaaagatgtattatatttccagatattctgataacagtgataaagacttgatggtgaataggtatgtcgatagcagtactgcagatgctcagtttgagtaagtcacccacactaccaaaagatgaatattctttttgagaacagaagaattctagtaatcatgagctaaggatgctggaaattcattcctgaaaatgtatatgtaccaagtagttgttttctgttctcccattcttcattaaacctgtccttatcaagaacaccaatgatgtccatcttgtccaaatcaacgtttcatactcagactctcacttactctaattctcagaggcatttaatgcagttgatcactaccatcatctggaaacacttccttggcttggtttctagaacaacagtatatgactagttttcctttttccttattggaagttcattgtccatctcctgtttagctccttatcaaaatcctgacctttgacatttgactgttgttcttaaatacactgtgtagattctgatatctgaatgaactagacactctgcta

SEQ ID NO: 2784 - DNA, 11433 bp, Homo sapiens
gtagtcctgtaagcgcgcggagcccgtcgggcgcctatggaactcgacccgcaggccaaaggggctccgttgcaaggaagaagtgcggggtcccgccgcctcctagaccgagatcgcggtgagctggccgcggcgcacaatgggcacggcctgggcggcggcgtccgtactatcgccctgtgcctgcggatcccggtaacattgcgcggcaggccccaggccggcctccctcagcttcgcggactgtctgggccgggggtctcaaccttgacttcagggccgggccgctggggcagacccttagtgatgttcaggtcctctgggcccctgccagtcaagggacgctcgtcgcgcgccaattgttaagtctttcattgtttctgtaaacctgctgacgccctcccagcgcatagggagactgcgcacgtgagtccgcccccgcgcgcactgcggagaggtagaggcacgaatgtagtacaaggtacaaaatgactactccagagagggccagatgactaagtcagcaaacacttagggaacacgactgtgtccgctgcgcgtttcccggagtagacacaagggtgaatgaacaaagaatggatttcggtcactgaaagtggagaggtagccgactccgtccgtggaggcccttagcagagctggatctggtagtcccccggtcatgaggggagattctgctggaggaaagaggtctccattcccaccgtttgaaatgtgtaggatgccctcagattctttggcccattcataggtatagctatgctaaaaacgcgggaccctacaatgtacttagcactagcagagagggagtcgaggatatggacagagactgcactagctcacacattagcaggccagggtgcggtggctcacccctgtaatcccagaactttggaaggtcaaggtgggaggaaaacttgagtccaggagttccagaccagcctgggcaacatagggagaccccttctctattttaaaaataataaaatagggccgggtgcggtggctcacacctgtaatcccagcactttgggagactgaggcgagtggatcaggaggtcaggggttcaagaccacctagccaagatggtgaaaccccgtctctgctgaaaactgcaaaaattagccaggcgcggtggcaggcgcctcaagtcccagctactcgggaggctgaggcaggagaatcgcttgaacccaggcagcagaagttgcagtgagccgagattgcgccaatgcactccagcctgggtgacggagtgagactccgtcttgaaaaaaaaaaaaataataataataataataaaatgaagaagtagttagcggtgtcctttggtcctcagctttgaagggcaagatcttaattcagttcaactacagctaatcagaatttggaagactaattcaagtcagtcaaactcacaatagcccgacacttaaaccctgccaggggacatagctctctaggattgcaatgttcctaatcccttccttctattaaactacctagaaactgatttagtcattagaaatttcttggtatgatggcttttaaacatgcccacagttttttttgacaatcggctcctcaaaagcatagccaggcgcggtggctcacacctgtaatcccagcactttgggaggccaagtcaggcggatcatctgagatcaggagttcaagaccagcctggccaacatggcgaaacccgtctctactaaaaatacaaaaattagctcgtcatgcacctgtaatcccagctacttgggaagctgaggcaggagaatcgcttgaacctgggaggtggaggttgcagtgagctgagagcgtgccactgtactcgagcctgggcaacagagtgagactctatctcaaaaaaaaaaaaaaaagaaagaagaaaaaaaggccggtcacagtggctcatgcctgtaatcccagcactttgggaggccgaggtaggtggatcatctgaggtcaggagttcgtgaccagcctggccaacatggtgaaactctgtctctactaaaaatacaaaaattagccaggcatggtggtgtgtgcctgtaatcccagctacttgggaggctgaggcaggagaatcacttgaacctgggaagcagaggttgcagagagctgagctgagattgagccactgcactccagcctgagcgacagagcggaactatgtctccaaaaaaaaaaaaagctggagttgggtgggtatggtggttcatgcctgtaatcccaacacttgggaagccgaggcaggtggatcacttgagtccaggaatgccagaccagcctgggcaacgtgacaaaaccttgtctccacaaaatatatatataaaaaaaaaattagccaggcatagtgacacacacctgtagtcccagctattctaggaggctaaggtgggaggatcgcttgagctcaggaggcagaggttgcagtgagccaagattgtgccactacagcctgagcaacagagtgagactctgtctcaaaaaaaaaaaaagaaaaaaaaaaaacctggagtctaattctaattcccctcccattgagtgtgggctggacttcactgactttttaataaataacatgggacagaagtgagtgtagttgatttccaaggctaggtcataaaagatactgtgacttccaccttgccctcatttagataactcattctaggaaagctagacgcatagtagagttgtcatgtggtgaggccattcaagcagccctatagaaaggcccacatggtgaggatctgaggcatcctaccagtagtcaggagagagaatcttcttggaggtggagcttccattcctggcggaacccttgaccaaaacctcatgaaccaccctgaggcaaaaccacccagctaagtcactcctgaattcctaaccctcagaaacagggagatactgaaggtttgttgttttaagtcattacactttgggataattcgttatacagcaaaagataactaatattcttggtgatcaggactgtgtcatacttagtgttattaatcttcaggagtttcagcctaagtcagcagtgttccccacatgggcctgccttgctttcattcttcctccattgtggactgaatgccataagaccattccagcccatccaaagcaggaaccagaaatgggctgggttttgctgttgttttagttggtttggtttgtttgtctgtttgtttcggggaaagatgacagaaggtgcactgtgggagattccaacatgattattgaatcaaagactgtgtgtgtacgtgataagtctttattagattctctgggttcataagccagtaaaaggtaagaaccatcctctaaggagaaatctcacagctaaggcttgccatgttaaagagtttgcacttccaggaacaagggcactcacgtctaccctgtgctattctaggtgtcttcccatcctgccggatgcacggagcacatattctgccacccctagctctatcctttgggcagtgctgaataaacactaacaaactcaggctctgtggctgacattgtaagcagaacccctgccctgctgttgcttaacgcatctttattttgattcccagtcatgttacgacacaatcacattaagatgttctttcgtattcaggttcagaatatttgctctgctcacttgattgaatttggagacttcccaaatctttatatgagcacgtcttctgagtttatccagattatgttttgtaccgtctgttgtacaaatggaccgtggatgttaattagaagggcctcgccagtcttcaatcacatgttactcgtggggtttgttaaatcagcttttgtctcagagagggcttcggtgcttggattacactatatttggaatttgtagccttctatgcgctgacttgccccaccttgctacctggcttcagaggtccaggattctctaacttgagcatccatcagaatcacctggaggtctcctaaaaacccagattgatggcgctccctttggagtttggatgtgcatatctgatcagctccccaggatgctcatgctgctgacccactttaggaagctctcctttaggagttagcatgtctctgagcagacgctggaccagtatgttctggagaccatacacttcccatcccagaacagatgctgctccctgttctctatccccagcccccagccacacctatatgaccacagttctgttcaactggtgccccagcactgatatctgtgggccctgctcatctcaagtgagccacatttttctcccaggcctgccttgctttcggtcatcctcagttgtggcccaaaccccataaaacagcagccattcctggcaggaatccgaggtgagccagttcttttcaggaaaggtagcagaacagaagatacactgtgggaagttccggcctcacacgtgtacaagctcgatgccctggactctaagctgcttgagggcagtgtctctctgattcacctgtctccctcacagtcctgtcatgcaggatgccttgcacatgatgggtgctcagtttacattaataggcaggtgaggccaggcacggtggcctgtaatcccagcactttgggaggtggaggcgggcagatcacctgaggtcaggagttcgagaccagcctggccaacaaggtgaaaccacgtctctactaaaaatccgaaaattagctgggcatggtggcacgcatctgtaatcccagctactcggtagtccgaggctggggaatcgcttgaatccgggagatggaggttgcagtgagctgagaccgtgccactgcactccagcctaggcgacagagtgagactccatctcagaaaaaaaaaaaaaaaaaaaaaagcaataggtgaatgactgttcatactcctactttctccacaaacttgcacaaatgtgtctgcatctagatgtctgtaaacctgctaacacccacacacattttctattagttaggattaggtttggctgtaagacacagaaacctccaaagagcagtggcttagataagaaagaaatgtgtttctctcacataaacgaagtagttgggagagaacaacacagccttggtattgtggttccacaaacttgttaggtacccaggctcctattttgctccctcacggccttcactgcacagctgccacttcatggtctaagatagctgctcaggctccagcccttatgttcacattccagccaccaggaaagagacaaaaaggggtatcccatttccctacaggtgcacttccaaggagtctcttataccacttctgcttacacctcattggccaaaacttaaccacatggtcatgcctagcagcaaagaaggctagaaaatatagccttatgactggctaaaagtcatggttgcttttccacatgagaaggaataaaggataaaaggagggaaactggcatatcctacctcacaccagtaggaggcagacgaaagaaaagagaagttggttcccagtacaggaatggcagggaagctgtggctggaagaacaggggtggaggatggccaacaggccacagagagatgggcaggtccccctggctggggtcaggaagggcttgcaggagggtttactgctcactgtctctctctctttctatctctctccatctctctcatcacacacatacacactcagtcttgctgagggagaattctgagaaggtggagttctctgtagggaagggatacatatttcctactagtcatgtttccctgaaaatgggacttctgttaataatactcctggcctctctctacctggggaagaggaaacgtgagttacctgagagaagctgggaagaaagaaccaagcatacatgatttagtcccctctcctctttaggagccagctggtccaccagaagtctgtgttctgcctgtccctgcagcacggagggctgggctttatacctgtgccaaggacaccaacggcagcatcagcaagtccgtgttgtctcccaaataagtggtgttctccaacaagcttttagcagtaataaagctgacatttttattctcatatgtcccttgtctctttttcaatgatttagatttaagcaggaaagcctgggttccttttgtgtgtgtgtgacagggtctctgtcgctcaggatggagtgcagtggcgcgatcaaagttcactgcagccttgacctcaagcaatcctcccacctcagcctccaagtagctgggatcacaggcttgcatcaccatgcccagcgaattttttttttctagacacggtctcactatgtcactcaggctggtctagaactcctggcctcaagtaattcttctgcctccacctcccaaagtgctgggattacaggtatgagccaccataccttgccttttttttgacatggagtctgactctgtcacccaggctggagtgcagtggcacgatctcaactcactgcaacctccacctcctgggttcaagcgattctcctgcctcagcctccagagtagctgggattacagacgtgcgccaccacacctggctaatttttgcatttttagtagagacaagttttcaccatgggctccagttttaccatgttggccaggctggtcttgaacacctgacctcaagtgatccgcccaccttggcctcccaaagtgctgggattacaggcacgagccactgcacctggcctctttttttttttttttttaagagacaagttctcactgtcgcccaggctggagtgcactggtgcaatccttccacattagtttcctgagtagctgggactacaggcacacgccactgtgccaggctaatattttttggaaatggggtctccttatgttgcccaggctggtctcaactcctggccttaaacaatcctcccgccttggcctccgaaagtgatttattcctaaaactccaacagcctctttccccaccagccccatactagagacccctactgcaccttcccatcccccgcagatgagcagaataactggcgcctctgttgtaatgagagttcaggtgcccatgccatctcgggaccgttcctccctgactccccaggtcccttctgaaggcaagaaccacagggagaacagagaatgctaaaaggtgagctcattccctctgtggcatcaatacctgacacttggtcctatcctgaacataaactctgcacgtggcaaggaaggcaaaggcaaggggcactatgagaatgacaaggcgaagcgacaggcagagacaggcccgagggctccagtggcaagcttacacactgcacggattttgggacaagttctttcatgttatcaagcccacctgtctctcctgcttagaaaaagtcaggtgcaggacatggccatgttaattctgggctgagggtaacaagattttgactcccaaactctcaggcccctttatggctgtgcccaggcattgggaaaaagaggtgatgaatgaggtgcttccaaggcttgccagagatatgtgtgctagggctgcagtggactggggctggggtcctggtcagtaagctgggatggtgacccagtctgagatggaatgtgtggccctgattcataggcaggtgacatttatagaaaagattaggcacctcccaggctgaacactctgtcactgagcccatccaccctcaccctcggcctcaacgctccttgccatagctggggggcaggggtggaagggtgaccttccaacatcctgacccatgtatagaagaaagtaactcagggaggccgggcacggtggctcacgcctgtaatcccagcactttgggaggccgaggcgggcagatcacaaggtcaggagatcgagaccatcctggctaacacggtgaaaccccgtctctactaaaaatacaaaaaattagccgggcgtggtggcaggcacctgtagtcccaactactcgggaggctgaggcaggagaatggtgtgaacccgggaggtggagcttgcagtgagccgaggtcgcgccactgcactccagcctgggcaacagagtgagactccgtctcaacagaaaaaaaaaaaggaaaaagtaactcagggagcttcctggccaaacagacaccgctcctcagcccagtgctcctgatggggtgctcccatccccagtcctgcccagcttctgcctttgccatgtccccctgttcccttcctgtgtcagtaccatcctctccccgcccatcgtcacttgctccagggaactctggcccaaaagaggccagctggcccaaagcgcctgaaatgctggcaagggacagagcccttggcacggtccctgtggagggtcaggctgggtcatggctccaagtgcaggcagaggagagagcactagagattcaggctctgagttgcccccagggccagttgcgccaggctggctccttctgcccagtccactgtatccacgttgaagacaggctggtttcttgtgggaaaggggcaataaaaaggagaggagaggagggaataggagaaaggagaagctagaaagaaagaaagaaaaggaaaggcaagagaagcttgatcaaggaaattttaaaacccaacagagatgaagaggagggaggaaggaaacatcagaaacatcagtagacagagttctttttcttttctttttctttctttctttttttttttttttagagactgggtctccttctgttgcccaggctggagtgcagtcactcagtctcgactcactgcagccccgacctcctgggctcaagcaatcctcctacctcagcctccccaccacacccagctaaattttgtattttttggcagatatggggtttcgacgtgttgcccaagctggtctcaaactcctgagcacaagcaatccacccgccttggcttcccaaagtgctgggattacaagagtatgaaccactgcacccagtctgacagagttctttttttgtttgttttgtgttttgttttgttctgttttttttttgagacggagtctcactctgttgcccaggctggagtgcaatggcacaatctcgcctcagagcaacctccgcctcccgggttcaagtgattctcccccttcagcctctggagtagctgggattacagtctcccaccatcatgcctggctaatttttgtagagatggggtttcaccaagttggccaagctggtcttgaactcctaacctcaggtgatccacctgctttggcctcccaaactgctgggattacaggctggagccagcgtgcctggcccctgacagagttctaagcatgtgggaagcatgcgaagtccacgcaagtccctgggctgggctgctagcctccctgcttggtacctggtggctgttccccaggagggcagatagactccctgctctctgccctcttgtcattgtgagctccctggcccatccctaggctgcactgcacttcccagtcagggcagtgcctggaccctccaaatacagctcctgccatggcctcttccgaatcctaggggcaaacggggcattgatgcacttagctcagccctcacactctcctgccaccgaccctgagaaggggcagctggcaccagagagtctctgagctgaacctgggctcattctgcaagatccttcctagggagactggcatgcaggcaaggggatcagctcctgaaggcccccagactcccataggaggggagggaactccagggataggcagagggaaggctcctgggggagtcagttgccctccagagcccaggcttacgggtgggctgagcagatggagccactgcctgatgctgtctccccatgccctgactccaagtgaccccactggctgctgcccctgtggctccagccatggatgggtcccagcctttgactggctgcacttcattgtatttgatggttactttttggagtcaacttgactggattgagggacacctagatagctggtaaagcagtgtcttgtgaggctgcttccagaggagactggcgtatgagttggtaggctgagtggggaagacgccctgtcaatatgggagggtaccatccaatcagctgggagcctcggtaggacaaaaaggcagaggaagggcaaatttgctgtctctctcctggagctgggacagccttcttctcctgcccttggacatcagaagtctaagggtcttgacctttagatgctgggacttgcaccagcagccccccaggttctcaggccttcagtctcagactgagtcacaccttcagctcccctggttcagaggctttcagatttgaactgagccatgctcccagcagccccaggtctccaggcggcctgtcgtaggacttctcaggcctccataatcacgtggagccaattcacctaataaatcccttctcatctatctgtctgtctcctatctctatctatctatctatctatctatctatctatctatctatctatctatctatctacctacctacctacctgcatgctataggttctgtctctctggagaaccctaatacggttgggatgcaaattggaaggcacaccacctgttaagtagtcctgctgaaagaatcaatcctaaatcttatcaagacttgagatccaggcggggcgcagtggctcaggcctgtaatcccggcactttgggaggctgaggcaggcagatcacttgaggtcaggagttcaagaccagcctggacaacatggtgagaccccgtctctactaaaatacaaaaattcgctgggcacgttggctcatgcctataatcccagcactttgggaggtggctggatcacctgaggtcaggagttcgagaccagcctggcctactaaaaatacaaaaattagccgggcgtggtggtgtgcatttgtaatcccagctacttgggaggctgaggcaggagaattgcttgaacctggaaggcagaggttgcagtgagccaagatggtgccattgcactccagcctgggtgacaagagcaaagacttcatctcaaaaaaataaaaaataaaaataaaaaaattagggagggcgtggtggctcacgcctgtaatcccagcactttgggaggccgaggtgggcagatcatgaggtcaggagttcaagaccagcctagtcaacatggtgaaaccccgtccctactaaaaatacaaaaattagccaggtgtggtggcgcacacctgtaatcccagctactcggggggctgaggcaggataattgcttgaacccgggaggcaggggttgcagtgagccgagatcgcaccattgcactccatctgtgggcgacagagcaagactccatctcgaaaaaaataataatacaaaattagccgggcatggtggtgtgcgcctgtggtccagatgaggcaggagaatagcctg

SEQ ID NO: 2785 - DNA, 2357 bp, Homo sapiens
gtcaaacacccggctctcctctccaccaggctcccacgcccaccacacagcctgtagccccggcggagctatgggctctgactccgcctctttccaaatccggagtagttcgtgccacagtcgtcctcggaaccctgtggccccttcctcacccgtttcagggccacttggttcccacctccaccttcttagtctgcctgccctgctttccatcttcttggaattcgccttgctgccgccccgcgcccacccccgcgcccacccctgcccctgcaccgtcccatgcccttatggatttattctttacacgtaaatatgtctttcctctttttgaaaggatttggagttggaacagagaaattcactatggatgatgctatatctttatatgacctttggaatatctgtaatcatcctgagggcaatacttatgtaatgaagatggaagaagagagaatatgaatactccgtgcactttgatcttatcgtttagctgctgatcataccatccctggagtcctacttctgactccaagttatgagatagaaactattcaaaaaagaaatgaagaaaatcatgagagtcgcttccaagacggccgaataggaacagctctggtctacagttcccagtgagatcgacacagaagatgggtgatttctgcatttccaactgagttacctggttcatctcactaggaatggttggagagtgggtgcagcccatggaaggtgagccaaagtggggggtgggggagtgttgcctcacccaggaagtgcaaggggtcaggggatttccctttcctagccaagggaagccatgagtgactgtacctggaggagcggtacactcctttccaaatgctgtgcttttcccatggtcttcacaaccaacagaccaggagattcctggagacctgcagaccaggagacctgcctggcttggtggttcccacacccacagagccttgctcgctgctagtgaatcaatctgagattaacctgggatgctgaagtttggcagggggaggggcgtctgccattgctgaggcttgagaaggcggttctatgctcacagtgtaagcaaagcaacagggaagctctaacagagcagagcccaccgcagctcagcaagacgtactgcctttctagattccacctctggggagagggcatatctgaacaaaaggcaggagacagcttctccagacttaaatgtccctgacagacagctctgaagagagcagtgattctcccagcatggcgtttgagctctgctaacagacagactgcttactcaagtggatccctgacacccgtgtagcctgattggtagacacctcccagtagggactgacagacacctcatacaggacatctctggctggcatctagaggttgcccctctgggacaaagcttccagatgaagaatcaagcagcaatatttgctgttctggagcctctgctggtgatacccaggcaaacagggtctggagtggacctccagtaaaccccaacagacctgcagctgaggggtcagtctgttagaaggaaaactaacagaaaggaatagcatcaacatcaacaaaaggacgtctacaccaaaaccccatctgtaggtcaccaacatcaaataacaaaggtagataaaaccacgaagatgggaagaaaccagagcagaaaggctgaaaattctaaaaaccagaatgcctcctctcctccaaaggaacacaactccttgccagcaagggcacaaacctggatggagaatgagtttgacaagttgacagaagtaggcttcagaaggtcggtaatcacaaacttctccgagctaaaggagcatgatctaatccattgcaaggaagctaaaaaccttgaaaaaaaggtaagacgaatggctaactagaataaccagtgtacagaagagcttaaattacctgatggagcggaaaaccacagtactagacttcgtgaagcatacacaagcttcaatagccaattcgataaagcttaagaaaggatatcagtgattgaagatcaaattaatgaaataaagccagaagacaagcttagagaaaaaagagtgaaaagaaacaaaaaaaaaagcctccaagaaaaatgggactatgtggaaagaccagatctacgtttgattggtgtaactgaaagtaatggggagaatggaaacaagttggaaaacactcttcaggatattatccaggagaacttcccaaacctagcaaggcaggccaacattcaaattcaggaaatacagagaacaccaaaaagatactctttgagaagagcaaccccaagacacataattgtcaaattcaccaaggtaaaaatgaaggaa

SEQ ID NO: 2786 - DNA, 5714 bp, Homo sapiens
ccaatttggtttttgttttttattgagttgagtttcattcggcaaacactagccacatgagtgtcttactgggcctcaatgctcaccaccttccagaaccgcggccagccacccactgatgccattcaggaagtgtccattgtttggactgtttcttccagcacctcaatctccagaggagtgattttctcagtgaggactgcagtagtccctttctcacacctgtaccggccaagcctagtaagagaaaaacaaaagcacagagttaggattctcctcaaggtgccagagggcagaagacagtgaaaataaatattcaggcaacgcagtgagcaggctggactggaatcttggctctcccgatcccagctctgtgatcttgggggattcaacttcctcagttctcaagtgctgcaaaatgggggtgcctgggaggcaaagagtgtcattagtgaacacggcacctggcccttggtggacacgtgactctccccccaccccaccatccccacaagtgctgggaagcacttggtcccttgacatcaatcttcaacctccctacaatactgttcagggacagcaggaagcaaatcccatcattacacaagagaagggcatgattgctcttccgtgcagcaacaagaatgacttaactgttaccttagacactgcacaaacatctggaagcataaacagtgtaaaaaaaatgtgcagccagactctgggcttgtcatttcagaccactctcaagtctcaagaaaagttaactgtccctttcagggacacagtgggtccccactaggacacacccaacaccttcttcctggagtgaatctggcagaggtttctttgagcaccagactgtctagaagatatgtatttgggctgttaatgctcacagtgggtcaggaattaggatactgtcaaatggcagcacacaaccaactgttcctctgctctagccccagctggggtaatatctctgtcaaacttgctgtccttcaggaactgccagaaggctgctggctgtgccatggccttgtgctcccggaacacccatcctctcccctggacacacgggctaaaagagggagcaggaagcagaacaaggagggcaacttccacagttctgcatccaggtcaggagcacggtcagcccagagcggcctgcctttatgctgccaagcctcccccgacccccaccctcttaaagaatccaagcaaaagtacctttgaacaatgtgtccccaccccatcagtttgaggatgcccctcatccctcacacgctggaaccttggtggcagcgtgcagtcttagagccaaagtcccacgtggcctctgtgtgcctgactcctctgaaccacccctcagtgtctccgggaggcttggacacacaagagcctcctcaccactgtggtgacagtgcccgatttttgcggcatgcattcagagcttccgccttacgtgccagtggactgcaagaccgtgtgctggagggctgcgggcagacaggcagcagggacttgccaggcaaggcccactggcgcatggcacgggatgcttcctcaggcctatcgccctgcccgcaccctagcatccaccctgggaagggctcccctaactcaggcagtgcccccatcttcagtcactggcaaagaagacaacagagtccagggagcttggacacttgctgcccttggccccaggacaccgatggggagcaggctccctgcaggttactgcacacccaccacacgcccagcagcttctgggtcgccttgctgattcttcccaagcagccgcaaggcggttttcttttgttcttgggtgtttagagcctctgtttacaagtggagcagcccatgtcccaggaagtaggatgtgccactgctgcactccctgtggatgaggactcctgcgctcagcacaggttccctaggcaaccacttctcactggcccagacgtggctttcagagtcctcgcccaggaccctggccagcctgaatggtgtaaccattccctaccccatcaccgcttcaccatggacttgctcaaatcacgcatcttgcaaaataaccagcgaagcaggctacatggagtacttggctcctgcctacctggagctcggcaaagcccggttccccaacacagctctgggcctgaaaggtggcttgccttcctgctaaaggcccgagggacttcgtgggctcattagaggtcatctggtttagctccatttccaagacagactgatttgctggaagccaccaagccagccaccaacactccccaaccccagtgccagcgttctctggccccgtgctgccccaccccatcaggagcccactgagcttccgcaaggttgagtgcagcccacagtgaatacctgctggttctgaacgttccattccttccttgtgaattactcctgatgtggagttgtgtgtgcagtgggagatggaagcaagcctgcagaaggtggtgctcacttcctcggggctaccgtggagctgagtgggagccgtagtttataaatgccctgtgctgcacccagatgctgcagctggaagcagcactcagggagcccatcctgacctgcccgggctcccagaagaggtcaggagccacaggatggtcaagcagccggacaatcacgagacactgcaaacgagctgctcctctgacacatgctagccaccaggtttggaaacctcccagttctgctcagcaaatcaactagaaccttctcccactgctctgagtctgcgctgcaccactgagccgaggggcccactcggcatgtaggctcaggctcaatggcacaactccctgtagcacagcacacacacactagctcccaaggccacctctgggaggctgttagcattgctgacttacacccagttaggaatctcggggcactctgagggaaagtgctggggctgccctgaaaaatgcaccttctcccagaaatcaggggattctttaagacacttgagaaaggacagcagatgatccaaacctctccggccccacctcccagcctagggctctttcctgggccaccctccacctctcccatcaaattaaatcactttcctacacctgacagcagcccactgtcataaagcaagtaacaagccgaaggtctgtgtgggaggttgatttgggaacactggatgtacttaatgtggaaagaaccaggaaaactccatccagatgccatggagataccaagggtggccacgacgccaggggacccaggaagaacttcgtctccttcactcacctggtccccttcttgttgggcactgtgtatgggcggagaaaatccagcttgttcttgctgatgacgcagaggtcaatgttgcttccggagcccaggtcgttgaagatgccagctgcgatggcttcgctcaccagattcttggcttcctcctcctgagaaacagaacggcggcaataatgtccccggccaaactagggcctgctctgacatccgcaatgtacgtccactagcagtgcgcaagacctcccgcgagacaggtgttgtttttaatgcccatctcacagatgaggaaaagatctcaaagtaccttgattatttacccaaagttcccgacccaggcctttaaaactttttatgcatgcaccgcctcttgaccacatcagacaatcaccacaaaacgatgggctgacagttactagagggttagtaacttatctttaaaagggccaggtagtaaatattttaggctttgtggccaaaagtctctaccacacctactcaactctgtcacgctagcacaaaacagccacacacaaatacattaaaaaatgggtataactgtgttccaataaaactctattagcaacaggcagtgggccagatctggcccactgactgcagtttactaactatcccctgatcaagaatgtccaacaatagctgaaagttacttgagaaagtcagcactgtaggaggaagaaactaacaccaaaacacaagccggtagttctggggaaatgctggcagaccaagggcgggacctcttgcccagaataatctctctctcctactaaggaacctataggttcactgaagtaatccattactttgaatcactctctcctttgccccacctttaaacacaaatccccatccctaatagttactggtgaacagatggactcatccctttcttatccgagaagccccatcacatgctatgtcctatcacatgctataccagaagctagggctgcagaggtggatgacgcccccagatccctgccccctaggggcttaagagtctagcaggggcacctgacccaagtaagtacaatgcagggtaaggctggctaaagagcacgtgaaaaggagctgggaacacagctggtcagcagagcttcagggagggctgaaggacaggctgcacacgaggcactcagaaaacagcagtgaaacagaaggcaggcagcaacggcagtggtactggacctggggaacaccaagttcaagctctatatacaacgaggacaaaaatgaaccaggctccctgaaagcagggaatctaacctgtgctacggcgccttcccagtccacgagggcgtgagagtacatacacatgcaagtgcactccagcgctcacccaagcaacacccttggagaaacacggactccaggcccaaatccagcctgagaccctcaaagggcagatccgctaacctcaagttttcagaagatctgaacccactgggggctcctgctcctctgcctgccccatgccagactaggattccagtgacataagcgccctctacagactcagaaggacagagaaggttctgctggaagtgggctcctcagcaaaccagcagataggggttcctttgatatttataccccaggttttttcactctcacgtgacatctatgtggggccaatgaagccaattcttcttttgtacatatgcagtcctgtaagaatgcattcaaacgggatccgctaattaggaattttctcctggaattctcaacagtctatggggccagaagctttccacaaaccagtgaaggtggcagcaaagaaagcctcttagacgaggagctggcagcagctgctatctagatagacagcaaaaaccaaccactaattcagcaaacacaacctcatacctaaccgcttccctttaaatggccttcggtgtgtgcgcacatgggcacgtgcggggagaaccatacttattcccctgttcccggcctaccacctctgctcccccttctcttctctaccatttaactgtctcctctgctttgtttcttatcactgctgctggtgtctagagccagccagcagtacctggcagacatcgcgaccctgcgggcagcgcttaggactgcacatttacatttcccaaatgatctgggtagatggggacaggtgaagacttggggaaacggaaatatacgaatgacatgagacatgcatatctagtgtcaatccattcgactgggcacaggacagcagactgctgacagtgctatgtaagattatgagtgatcctccctctattttgcaaacagtctgtaagtaactgataaaactttaaaatatgcaaattttaaaattatatagtttgatttactcatcaaattatcatgtatgctgttatttaagtatgaataaaggcttttttaaattgggaaaa

SEQ ID NO: 2787 - DNA, 5712 bp, Homo sapiens
ccaatttggtttttgttttttattgagttgagtttcattcggcaaacactagccacatgagtgtcttactgggcctcaatgctcaccaccttccagaaccgcggccagccacccactgatgccattcaggaagtgtccattgtttggactgtttcttccagcacctcaatctccagaggagtgattttctcagtgaggactgcagtagtccctttctcacacctgtaccggccaagcctagtaagagaaaaacaaaagcacagagttaggattctcctcaaggtgccagagggcagaagacagtgaaaataaatattcaggcaacgcagtgagcaggctggactggaatcttggctctcccgatcccagctctgtgatcttgggggattcaacttcctcagttctcaagtgctgcaaaatgggggtgcctgggaggcaaagagtgtcattagtgaacacggcacctggcccttggtggacacgtgactctccccccaccccaccatccccacaagtgctgggaagcacttggtcccttgacatcaatcttcaacctccctacaatactgttcagggacagcaggaagcaaatcccatcattacacaagagaagggcatgattgctcttccgtgcagcaacaagaatgacttaactgttaccttagacactgcacaaacatctggaagcataaacagtgtaaaaaaaatgtgcagccagactctgggcttgtcatttcagaccactctcaagtctcaagaaaagttaactgtccctttcagggacacagtgggtccccactaggacacacccaacaccttcttcctggagtgaatctggcagaggtttctttgagcaccagactgtctagaagatatgtatttgggctgttaatgctcacagtgggtcaggaattaggatactgtcaaatggcagcacacaaccaactgttcctctgctctagccccagctggggtaatatctctgtcaaacttgctgtccttcaggaactgccagaaggctgctggctgtgccatggccttgtgctcccggaacacccatcctctcccctggacacacgggctaaaagagggagcaggaagcagaacaaggagggcaacttccacagttctgcatccaggtcaggagcacggtcagcccagagcggcctgcctttatgctgccaagcctcccccgacccccaccctcttaaagaatccaagcaaaagtacctttgaacaatgtgtccccaccccatcagtttgaggatgcccctcatccctcacacgctggaaccttggtggcagcgtgcagtcttagagccaaagtcccacgtggcctctgtgtgcctgactcctctgaaccacccctcagtgtctccgggaggcttggacacacaagagcctcctcaccactgtggtgacagtgcccgatttttgcggcatgcattcagagcttccgccttacgtgccagtggactgcaagaccgtgtgctggagggctgcgggcagacaggcagcagggacttgccaggcaaggcccactggcgcatggcacgggatgcttcctcaggcctatcgccctgcccgcaccctagcatccaccctgggaagggctcccctaactcaggcagtgcccccatcttcagtcactggcaaagaagacaacagagtccagggagcttggacacttgctgcccttggccccaggacaccgatggggagcaggctccctgcaggttactgcacacccaccacacgcccagcagcttctgggtcgccttgctgattcttcccaagcagccgcaaggcggttttcttttgttcttgggtgtttagagcctctgtttacaagtggagcagcccatgtcccaggaagtaggatgtgccactgctgcactccctgtggatgaggactcctgcgctcagcacaggttccctaggcaaccacttctcactggcccagacgtggctttcagagtcctcgcccaggaccctggccagcctgaatggtgtaaccattccctaccccatcaccgcttcaccatggacttgctcaaatcacgcatcttgcaaaataaccagcgaagcaggctacatggagtacttggctcctgcctacctggagctcggcaaagcccggttccccaacacagctctgggcctgaaaggtggcttgccttcctgctaaaggcccgagggacttcgtgggctcattagaggtcatctggtttagctccatttccaagacagactgatttgctggaagccaccaagccagccaccaacactccccaaccccagtgccagcgttctctggccccgtgctgccccaccccatcaggagcccactgagcttccgcaaggttgagtgcagcccacagtgaatacctgctggttctgaacgttccattccttccttgtgaattactcctgatgtggagttgtgtgtgcagtgggagatggaagcaagcctgcagaaggtggtgctcacttcctcggggctaccgtggagctgagtgggagccgtagtttataaatgccctgtgctgcacccagatgctgcagctggaagcagcactcagggagcccatcctgacctgcccgggctcccagaagaggtcaggagccacaggatggtcaagcagccggacaatcacgagacactgcaaacgagctgctcctctgacacatgctagccaccaggtttggaaacctcccagttctgctcagcaaatcaactagaaccttctcccactgctctgagtctgcgctgcaccactgagccgaggggcccactcggcatgtaggctcaggctcaatggcacaactccctgtagcacagcacacacacactagctcccaaggccacctctgggaggctgttagcattgctgacttacacccagttaggaatctcggggcactctgagggaaagtgctggggctgccctgaaaaatgcaccttctcccagaaatcaggggattctttaagacacttgagaaaggacagcagatgatccaaacctctccggccccacctcccagcctagggctctttcctgggccaccctccacctctcccatcaaattaaatcactttcctacacctgacagcagcccactgtcataaagcaagtaacaagccgaaggtctgtgtgggaggttgatttgggaacactggatgtacttaatgtggaaagaaccaggaaaactccatccagatgccatggagataccaagggtggccacgacgccaggggacccaggaagaacttcgtctccttcactcacctggtccccttcttgttgggcactgtgtatgggcggagaaaatccagcttgttcttgctgatgacgcagaggtcaatgttgcttccggagcccaggtcgttgaagatgccagctgcgatggcttcgctcaccagattcttggcttcctcctcctgagaaacagaacggcggcaataatgtccccggccaaactagggcctgctctgacatccgcaatgtacgtccactagcagtgcgcaagacctcccgcgagacaggtgttgtttttaatgcccatctcacagatgaggaaaagatctcaaagtaccttgattatttacccaaagttcccgacccaggcctttaaaactttttatgcatgcaccgcctcttgaccacatcagacaatcaccacaaaacgatgggctgacagttactagagggttagtaacttatctttaaaagggccaggtagtaaatattttaggctttgtggccaaaagtctctaccacacctactcaactctgtcacgctagcacaaaacagccacacacaaatacattaaaaaatgggtataactgtgttccaataaaactctattagcaacaggcagtgggccagatctggcccactgactgcagtttactaactatcccctgatcaagaatgtccaacaatagctgaaagttacttgagaaagtcagcactgtaggaggaagaaactaacaccaaaacacaagccggtagttctggggaaatgctggcagaccaagggcgggacctcttgcccagaataatctctctctcctactaaggaacctataggttcactgaagtaatccattactttgaatcactctctcctttgccccacctttaaacacaaatccccatccctaatagttactggtgaacagatggactcatccctttcttatccgagaagccccatcacatgctatgtcctatcacatgctataccagaagctagggctgcagaggtggatgacgcccccagatccctgccccctaggggcttaagagtctagcaggggcacctgacccaagtaagtacaatgcagggtaaggctggctaaagagcacgtgaaaaggagctgggaacacagctggtcagcagagcttcagggagggctgaaggacaggctgcacacgaggcactcagaaaacagcagtgaaacagaaggcaggcagcaacggcagtggtactggacctggggaacaccaagttcaagctctatatacaacgaggacaaaaatgaaccaggctccctgaaagcagggaatctaacctgtgctacggcgccttcccagtccacgagggcgtgagagtacatacacatgcaagtgcactccagcgctcacccaagcaacacccttggagaaacacggactccaggcccaaatccagcctgagaccctcaaagggcagatccgctaacctcaagttttcagaagatctgaacccactgggggctcctgctcctctgcctgccccatgccagactaggattccagtgacataagcgccctctacagactcagaaggacagagaaggttctgctggaagtgggctcctcagcaaaccagcagataggggttcctttgatatttataccccaggttttttcactctcacgtgacatctatgtggggccaatgaagccaattcttcttttgtacatatgcagtcctgtaagaatgcattcaaacgggatccgctaattaggaattttctcctggaattctcaacagtctatggggccagaagctttccacaaaccagtgaaggtggcagcaaagaaagcctcttagacgaggagctggcagcagctgctatctagatagacagcaaaaaccaaccactaattcagcaaacacaacctcatacctaaccgcttccctttaaatggccttcggtgtgtgcgcacatgggcacgtgcggggagaaccatacttattcccctgttcccggcctaccacctctgctcccccttctcttctctaccatttaactgtctcctctgctttgtttcttatcactgctgctggtgtctagagccagccagcagtacctggcagacatcgcgaccctgcgggcagcgcttaggactgcacatttacatttcccaaatgatctgggtagatggggacaggtgaagacttggggaaacggaaatatacgaatgacatgagacatgcatatctagtgtcaatccattcgactgggcacaggacagcagactgctgacagtgctatgtaagattatgagtgatcctccctctattttgcaaacagtctgtaagtaactgataaaactttaaaatatgcaaattttaaaattatatagtttgatttactcatcaaattatcatgtatgctgttatttaagtatgaataaaggcttttttaaattgggaa

SEQ ID NO: 2788 - DNA, 2283 bp, Homo sapiens
gtctcggagaagatgtggtggcttccgtttgttggtggaggaggtggcaggcctcggcgggtaacccagagaacacagccgaagtggaatgtggggacgtctgcgacaccggggacagagcaactgtggatgaagagggctacatctggttcctggggaggagtcatgacactatcaatgcctctgggtggtgaaggcattgattgtcctgaccccacagtttctgtcccatgacaaggaccagctgactaaggagctgcagcagcatgtaaagtcagtgacagccccatgtaagaactgggaaaacttacctgcttccaagactcagctctagcacctcttcctgctgggtgttttccgatgccccccctctcgccacctcatggggaccccacagtcccctgaagagccttctgccccagtgcctcaccccactctttagacctgtttctgtttccatggctgccttgccttcttagaccacgggctcctgcagagcgggaccccatatctcagtcggctttgcattcccagtgcctggccgaaactgaggctggaatggtctcctattccataagctctcaataacccttgaaaaatgactggaatcctggacagcgccaaggcagcaactgggatgggagagtgatctgctgccctctcctggcaatgtgaggaattgtcctaagcacagacaactccctccctgccttgcacaagtgcaggatgggggaaactggaaaaggagctgatggaggattggggaggtggatgctgtctaaggagacaaactgaattgaggggttgctgggactcggccggctcacatgctattcccatgtcatgggcccaggggccaagtcagtgcttccaaaggagggtgcatcctgagagaggctctggctcccccaacaaaaccctaaactcttgaaggacatcttccttctcagtataccctattgctgtgttgttgtaactatcactgtaacttttattcacttcagtgggcgatcactgagtttttcctccattgttgtaaaacatgtgttttgctcttgtgtgtaaaatgactgtgaatttagccactgccttctcctgattttaactcagctttctactgctaggaggttatctctgttctgggtttctcagctttctatcaaaacccaaatactgtcattcctcggtatccgtaggggattggttccaggaacctcccttgaagataccaacattgcaggtgcccaagcccctgatagagaacagcgcagcatttgcagacaacctatgtacacactgcatgcactttcaatcagctctagattacttctgatacctaattcaatgtaaatgctgtgtcagtagttgtctagggaataatgacaagaagaaaattttgtacatgttcagtacgtaggaaaaagaaagagagatcagactgtcactgtgtctatgtagaaagggaagacataagagattccattttgaaaaagacctgtactttaaacagttgctttgctgagatgttgttaatttgtagctttgccccagccactttgccttagccactttgacccaacctggagctcacaaaaatatgtgttgtataaaatcaaggtttaagggatctagggctgtgcaggatatgccttgttaacaaaatgtttacaagcagtatacttggtaaaggtcatcgccattctctagtctcaataaaacaggagcacagtgcactgcggaaagccgcagggacctctgcccttgaaagtggggtattgtccaaggtttctccccatgtgatagtctgaaatatggcctcgtgggatgagaaagacctgactgtgccccagcccgacacccataaagggtctgtgctgaggtggattagtaaaagaggaaagcctcttgcagttgagatagaggaaggccactgtctcctgcctgcccctgggaactgaatgtctcggtataaaacccgattgtacatttgttcaattctgagataggagaaaaaccgccctatggtgggaggcgagacatgtttgcagcaatgctgccttgttattctttactccgctgagatgtttgggtggagagaaacataaatctggcctacatgcacatccgggcatagtaccttcccttgaacttaatcatgacacagattcttttgctcacatgttttttgctgaccttctccttattatcaccctgctgtcctactacattcctttttgctgaaataatgaaaataatagtcaataaaaactgagggaactcaaa

SEQ ID NO: 2789 - DNA, 1790 bp, Homo sapiens
aagcagtctggattcgtgtttattgaagccagtaattagagacatctttttttcccaggactagaaagcaaggttccacatgactgcatactgcacccggacagagccacacccctggactaaggctggtgggggataatctgcagtcttacttttaagttagaaacaccaataaatttagtatacagacgacagtgaactttcacttacagcattaacattgttaaggtcatgatgtacagagcagtcactttcaactttgttaaattaataaaacatgacaatgtcttcagtttaaataccgattttaaaatgccaatcaaaaaaaagtgcaaacaaaataacaatctagcagcattatctgttgcatttttaggaaagaccaattcttggctgttatcttcagccacgtattcaaaggtgggcttttctctgatttttttttttattttaaagacaaaaagcagatgtaaccattataatgtgcataaatagtcataaaattgtctttaacagtctaccatacaagtgtactctgcaaataaaatgaattttactttaaaaactaaaggctgtttattatttggcctttggttccaatgcttgaaaaccccaaaataacaaaactcatctcccttcctcccacctcccaaaaagaaccctgcagctccccaaagttggtagactttggcaaccactgagcacatgacactatgtatcagcttcttctgatactaggagcttccacttctcatgagtaaataaaagtggtctccaagaaaccttccttcacaagacatgtcttagcatttcatcagttttagtatattttatattgacacaaaaagtgcttatcagttcaaatgataaaaaataaagacaaattaaaattttgcattaaaatttaaaattataccatattcctcttcggcatgtgcctttccaggaattcttgtttctgaggtcactcattttactcccggggactaagcgaccccacctttagtgaggccacaagctgtttggcatctattggtcactataccacaattatcattctacagtcagtttactgtcattacctagacaacctggtaactaccaacaggaccaaatgtgcaaacgggcagggcatgattgagatactgccgtgagccatgcagccttcggaagctgagagatgcttcttcattccagaccagccccaaatccaaccggtctccttgctcctagggatgacatgtgatttggataccaagtgattccaaacacacctctcacagggcttgtgcctctggcgcctgcctgactgctctgaacaactatctaaaatcagcccaagcctgtaggtatgccatctatgactagcctgagtgacactctccttgactgtgcaggaggcaacccaaatccctgagagctcctggctttcacatttccagcctctcacagactgcactccccggctccccctattgcaattctttccagtccgcctgggatctaccatttgtcttccagcatcaccctcctgctttccctgccatacttcctccataaccccatcactgcccttcccttcttcagctgtgtatgtcccctctagacagtgccatatgcaaggaacacgtatcattcatttctgtgtcctttgcagagaacctgagcacctagtgggtgctgaataaggtttcctgaatgaataatgtaattgtttgttaagtcaggaggatactgaagcctgaacatcaatctgctaacacaagtcttgtcagagaccacagcttcat

SEQ ID NO: 2790 - DNA, 7003 bp, Homo sapiens
acttcctggcgccgccgtccaagcctcccgctcggcgcccccggctcccgcccgccgccgccgccgccgccgccctacctggtgaagcagtactcgcagtggttgccccgctcgttgaccgtgagcacgtaggcataggccgggcaggagaacagcaagtcccccacctggaagggctgcagagcccgcagcccccggcctttgcccgggctgcagaagcgctccaggccgccgaggccctcggccctcatggtggcggcggggcgcggccgccggctgtgcccgagctgcggctcccggcgagctgttattggagacgcgtcacctagagctgcggggggcggggtgggagccgcccggcggacgcggcggcggctccccgctccccggaagggagggcggccccgcccgggcctcgcgcgcccccgcggggagggggacgggcccggcggccccgcctagcgccgcgaccctcggcggccgccccgcgcgcgctccgggccgtttccggtgtggccgcgacaaagagccgcagcccctgtggcttctgcgaggaggcgtgaggcgtgtgcgcctccgcggcgtctccacggagcgagcgggacgcgccctcctcctcggtgggagggaggggggtcacctgcggggaccaggtatccgagggccacccctagacagtcagcctggcccgaaggatgaccagcccccggtaaatagaagggggcgaagccagctccgaaaccttacgttcgctgtcccttgtaaagaccctagaggcagtgatcggggaacgccaaggagaaagcggcagaggggaaaccacagtagagaagtttggtgtgcagagggttgaagtgtgcttttccaaggttagaggtttttaaaccttgtggctttaatgggaacgtagtttgccctctgctcctctagtggaattacatggacggaagaggaaatgcattggccggcccagctcaccgagtctctgaggcatgctgcgaacgttgcagaggaagccagagagaaccttgccttcaaggaatttaggctgttgggggataatgcgatgctgtggccagtgtccaggacactgcgctagagtttgcagtagttttaatatgcttgaccacccacgaactgtgatcttagaaaagtcacttgggttaggagtcaaaggatttaaagcccacaaagcctgaaacgtaaatcctatacacatgcacgctattacttttcatatgagaaaggaaaatataatccgtgttccacatgattatgtaaagactggaattgatgtacatgcagtaaagactaaaattgtgacgagatcatttagcagaaaccactacttcaaaataggacctcaaacagttacctgtgtaagttcaggactggttgagcaaagggaaaggattaatatgattggagatgtaaaatcagtggaatttttggcatttcagtaaaatgtctttatcagctgggtgtggtggctcagccctgtaatcccaacactgtgggaggccaaggtgggaggatcatttgagcccaggaattggagagttggagaccagcttgggcaacataaagaccccgtctctatgggaaattaaccacctctcaagtggtgctgaggtgggaggatagcttgagcctgggaagtcaaggttgcagtgagctgtggtgactccattatactccagcctgggtgacagagcaggaccttgtctcaaaagaaaacaaaaaagcccttattagtggcaaactaaataagcctctaacccgtcttcaagtaaaggaagttatgatagtattttcatttatgcattttaagaaacttcgactgactatggccagcaactgggatagaaagatggacatcagccggctgtggtggctcacgcctgtaatcccagcactttgggaggccgaggtaggcggatcacctgaggtcgagagttcaagaccagcctgaccaacatggagaaacctcatctctactaaaaatacaaaattagccaggtgtggtggtgcatgcctgtaatcccagctactcgggaggctgaggcaggagaatcgcttgaacctgggaggtggaggttgctgtgagccaaaatcgcaccattgcactccagcctgcgcaagaagagcgaaactctgtctcaaaaaaaaaaaaaaaaaaaaagtggacaaaatgtagtcctaggtccttgcatttggcacattcaagtttgataataccattagttattgagtattgttgaccaggcatcgtgctccatcattaaacacattatctggtttatctttacaacaggctaatgagttaggtattatgcccctcattgccaaaattaggaaggaaactaagacccagaaggaatgattttcaaggccacacaataaattgcagaatttggtttccaagtcagtctgaattcaaggtccatgttcctaaccacagtgttttgctgcaaacaaacacagttcactgggataagtgcagttatggtggcttgtacaaaatgttctgtggtagtacaggcagggagtgacagctttagcctgctaaacagtcaagacaggcatcacattcaagtaacgttagagctgagcctgaaggatggacaggattttgcaagtggaggtggggagaagagttttctgggcagagagaactgcgtacaaagacagaagaccctgaaagcacagagcttgtagttgggggcccctgagcatctggaagagaggacaggaaatgaggcaggaacagctgaagagcatcttctccagaggtgagttctgccccagaggccatgggagagccagttaaagcgtttaagtgaggggtggcacattgagtccagtgttttagactgatctgccagcagcattgtgggttggctggggtgccaacattcagcacttcataactgtttacatgtatataaacagccttggcatgtgagaccactgacagtttgcatttgtctgtgtgatgacctgattagtgtttacatcctccaccagactgtacaagctccatgagggcagggaatgagtctgtttttgttacccttacatcaccagctcttatcactactcctggaacacagagagaatggaaaaaatatttaaaggttgaataaacgtcatggaatctcattctgatttctgggggctctaaccagcaaaaagatgaaaagactgacgtagaagtaaacaattacaatacagtagacagtttactgtttcaatgattaattgtgcaaagtaatctacctgtttactttttttattgcaagtaactttttccactttaattgggaaagatttccacagctgagaaaaaagcaattacatagctaccgaattatctttccagatgagtgctggcttattcttgagggtggaggtgactgtgatttgagaacactggaaaagaaaccgcctcatttcagaaaaatccctgtgatgaacttaaatgactcgagatggggaaatggtcactgaagcagtagccatgaatttaggagcttaaattactaagaaaactgtgtttaaaataaacagccaaagaatggcaataaaccagcccggggagactgatgacagcgctcttcatgaagcccatacttgtcactctgccactctgtaatctcacattccgtgaagtctttgagcagccaggacccatccacttttcctacgccctctgctccataacgtaggaggtatggaatttgaaaggagtgtttttggttactttgcctcactgaaactcaggagaagtggtacaaggacgaaaactcctttgcttaatttctctaacctagaagttgatctaatttatgagtaaaagatccttccaaccacagattagcacatgaaagaaatagctctggcctagggaaatgaagccttagcaaagaaggtatcccagtgaacgtgagcaaagggcctagatgctgtatagttctgcatctatgtctacatgtcacttattgaggacatactatgtacttacactgtgatagatcctagtcataccaaggtgtaaagaccaacatacatgaaaacagttatgaagtgctgaatgttggcactcatagatattaggttccaatccctggaatctataaatggcttcaaagggtcttgcaaatgtgttttaaggatcttgagagagtgagagtatcctggaacatccaggtgggttctctgtgcagttgcaagttttctgatgaaggacagaaggaaatttgacacagacaggagaggaggcagcaatgtgactatggaggcagtgatgagagggatacagtgatgggctaaggaatgctggcagccaccagagctggaagaggcaaggaacacctttcccctagagcctcgggagggagtgtggctttgccaataccctcacttcagcctgttaatctaatttcagacttctggcctctagaactatgagagaataaatttctgttgttttaagacacctgttttgtggtaatttgtcatagcagccacagggagctaataaaataatccaataaaattttaatagggagctgaacaaagtgcagtaggaaggcttcacagagaacctgacattttagcttctagaaggaagaggaaagattgaccaagggaaagcaaagttcccaaaatgggcttaagactaacagtgcagagctgggcatggtggctcatgcctgtaatcccagcagtttaggaggctgaggtaggtggatcactcgagcccaagagtttgagaccaaccttggcaatgtgatgaaaccccatctctacaacaagagcaacacattagctgggcgtggtggcatgcacctgtagtcccagctaatcaggaggctgaggaaggaggatcgcctgagcctgggaggcagaggtttcagtgagctttgatcatgccactgcactccagcctgggcaatggagctaagccttgtctcaaaaataaaaaaaataggctgggaatggtggctcacacgtgtaatctccgcacttggggaggctgaggccggtggatcacaaggtcaggagactgagaccatcctggccaacacggtgaaatcccgtcactactaaaaatgcaaaaaattagccaggtgtggtggtgtgtgcctgtaatcccagccacttgggaggctgaggcaggagaataccttgaaaccgggaggtggaggttgcagtgagcccagattgtgctattgcactccagcctagccacagagtgagactgtctcaataaataaataaataataaagaccacagttgaaattcactggggtaggagagactttgacagtccaatggacaatttttcttggacttaacgaatgtttccatagctctcactatgtaccaggtgtacctttaaaatatattctcatataatccttctaatgacattccacagaggagaataccaaattgagaggtgaagctagctggacttcctgggtcgagtgggggcttggagaacttttctgtctagctagaggattgtaaatgcaccagtcaggactctgtaaaaacacaccaatcagtgctctgtgtctagctagaggattgtaaatgcaccaatcagcactctgtaaaaacgcaccagtcagtgctctgtgtctagctaaaggattgtaaatgcaacaatcagcactctgtgtctagctaaaggattgtaagtataccagtcagcactctgtaaaatggaccaatcagctttctgtaaaatggaccgatcagcaggatgtgggcggggccaaataagggaataaaagctggccacccaggccagcagtggcaacccgctcgggtccccttccacactgtggaagctttgttcttttgcgcttcacaataaatcttgctgctcctgactctggatgtgcactacctttatgagctgtaacactcactgcaagggtctgcggcttcattcctgaagtcagcgagaccatgaacccaccaggaggaacaaacaactccggacgcgccacctttaagagctgtaacactgactgcgaaggtctgtggcttcacccctgaagtcagcgagaccatgcacctaccccaggaagaaactccagacacatctgaacatctgaaggaacaaactccggacacaccatctttaagaactgtaacactcatggcgagggtctgcagcttcattcttgaagtcagcgagaccaagaacccaccggaaggaataaattccagacacagaatcacagaagtgacatgtatgaacaagctgtctagcagtgagtccaggctcagaaccactccaccatgctgcctctctgttcagccagagctacagctttccttagagtacttgggatgaaggtggatgggcaggagtgggccccatcatgaaacccatgagcctaggagctagacggcactgtgtaggcacgtgagtcagaagaattttggctgacatgatccgagttttgctgtagaaagttcattttttagctaaatagagaatacactagaaggggctgaggagacagagggaactgaggcgcctgatgcaataaagggtccagaggagagatgttactggaatgaacaagggcagtgacggtggcaatgggaaggagggacatggatttgaagaacttttaattaacaggacacggtaattggggcgagtgaagagaaaggagagggaatatgaaccataaaaaatatgtccaaggacaactgacatcatcacctccatccagtccttccagttcattcccccccgccccccacttgagccttgtgtttattccccaaacaagattttgttatttcttcattcgccatatctcttgtctaatcttttatttccattcttaatgccactcagcccttaagtctttatgtccggttttgtgcagtagactctcaacagcagagtgagttcaaattttgagatattagcctgggatcatacattccaactctgtgtttcctcttacc

SEQ ID NO: 2791 - DNA, 1276 bp, Homo sapiens
gcgtgtcctcctgagccaggcacctcatagaatcttcttgcctgttcagcaaggccttccaaccctccatccatttctccctcaggtcaggacagcagggtgacagtgcctggagaaggccctggctcccctgaaagccctcccggcctgtctctgacctgcactggaagcgggggtctccggggtgggtcttcagcacctgccacacctctgggggaggctccaagcccatctgcttggcccgacaccagcgctgcagccgtgtgatccctgccagggtgggaagaagactctggagacttgtggggggtggggtagagtctgagctggagaatgtgtgtgttggggggagacagttcctgagggtcagagtcacgcaagcgcttgggtgacttcagagacgtgtgggtgactggctgggagaggcgcctccgtggggctgggtgggttctcaccggtgcagggcccgtactgccaggccaggtcaaactgcctcagcagctccagctccgcttcctcctcgtcgcggggctggggctcctcccctgcaatgacagctgctcttcagtacgaggttggcttcagtctcctgcccctcacctcccagccttcctcaccaccgctttgcctctgccaccccgcagctagacctggtgtcgggaggggaggacaggccacctttccctttccatcggcccctccgcccctctaggggcctcctctaggcccctccgtgtccactcctcctgcctccctcacacctcagagacctagctcgggtgccagctcccccttgctgtgcccagcgggcccctccctcctcttcacaaccgggtaggaatcagtgatgagccgcttccggcccatggcggccacccaggcaggcagagaaggaggcaactgcggggaagaggagagaccggccagtgggcgcgagaaagacagctgctgagagagacagacggggccaggccagcggcgggcagacaagatgacccagacaaaccgagagaggaagtcgccggggtccagggagggacgcctcccccacccccaaaagcacgcaaacaggaaagacttcagccaatggcaggccgcctatgcggggcggggccctggcgctagccaatggcaaatgttcttttcagcttcgctaatccccgtggccagtttgtaactccctagagtccagctggagccttcactcggtcctttggcccgccccgccttgtgggggcaggtctggaggtctgaagagagtttgggctaatccagg

SEQ ID NO: 2792 - DNA, 355 bp, Homo sapiens
ccacacacacacacacacacacacacgcaggggacgccggcccccaccacctccccacccactccatggagaggcagaggaggagcctggaggccagggggacaatggaaaagcccagcacgggaagtcagccactgtcatctcagagtgggtggggctgtgcgtatctcctggattctgaggctcggaaaactcggtgggaactgccttcaactgactacaccactccctgatgatgcttgagggccggctttggctctgggacctgtcacttctccgacacggacccgacccgttcctctccaggcaggtggtgggtgggggcaggaacaggaggccgggcaggccctggcgt

SEQ ID NO: 2793 - DNA, 1784 bp, Homo sapiens
gagacaccccagtgagggccctcatattgcccttgtggacttcactgggactgaacccttcagacctaagagcttctagggctcagttattggaaacattttcagttttattcttctgaatgacttaaagatttttcaattagaaaaactctcttcatgaatgacatgtactaatgtactaaagaactttgcttctagatctatttagaattgtcacacttcttctactactgattactactgtaatctactgggattacaggtgtgagccactgcgcccggccatttttttctttctttctttctcctttttttttttttttttgaggtggagtctcgccctgtcgcccaggctagagtgcaatggcggtatctcagctcactgcaacctccacctcctgggttcaaacgattctcctgcctcagcctcccgagtagctgggattacaggcgcctgccaccatgcccagctaatttttgtatttttagtagagacggggtttcaccatgttggccaggctagtctggaactcctgaccttgtgatccgcccgcctcggcctcccaaagagctgggattacaggtgtgagccactgcgcctggctcaaatgtgcttttcaataaaggattgggaaaaaataagttagagtgcaactgcaaattccaaaatgattaagcccttggaaataaaatgggatacatgatttgaaagatatccaagaggtggcatgtgcagtaagaagaactcagcattgggcaggctggtggctatagcaccagtgctgagagggcaggatgttaagtaggaaagaaaagcctttagagaagggcagagttccaggatccctgtccatatggacaacatgaccctagtctctcatgtctgtcagctcttgtgtcttctggcttttcttagtctcactcagccacattgtttgtagcactcacttcccttgaaggcacttgaaactgggacatctgtccacagacaggcctgtctggacagccttccaaaatgctcatggcaatgagaaagtctctgagtcccagtcatttccctgcacacagagtagttcccatcttagcaaaactgggtgttctctgagtatcactcagcacatggaagctgtccagacttctgtcctgtgcaggcaggcagtaacctgggatctctgctcttgcatgcagataaacttacagtccttcaaagcttcaagctcctagatggtgaaacaatacatctgtgctgagagtgaggagaaggatgcaatagtcttccagttttgtacttttacacttctgggtcatcagaaaccaaagatttgccttggtttcccaaagtgttgggattacaggcatgatccaccacgtccagcttcaataattattattttttatttatttattttgagacagagtcttgctctgtcacccaggctagactgcagtggcgccatctcggctcactgcaagctccacctccaaggttcacaccattctcctgcctcagcctcctgagtagctgggactacaggtgcctgccaccacacccagctaattttttgtatttttagtagagacggggtttcaccgtgttagccaggatggtctcaatctgctgaccttgtgatccacctgcctcggcctcctaaagtactgggattacaggcatgagcctccacacccggccctcaattatttttgatagttttgtgtcaatatttccatgatatataacaattccttattattctagcaatcttttcctcatcattttgtcttag

SEQ ID NO: 2794 - DNA, 422 bp, Homo sapiens
ggccgcgaggtatgggaaccggtccgccgggccaggcagcggtgctaggcagcaggggcagcgacgccgccgcctttcccttctcctgcccccgtccctgctccgccgcgtcctcgtcctcgctgggtccccgccgccgccgcctcagcctcggcgctcctcgggtttcttctctccatcaaggccgggccgacccgcagggaccatcccggaaagtgaggggttgttgccgtttcccgcagctgttggtggccatctttaatcctcctcctcctcctgctttctccacctcccgctggctgtctgactgactgactggatcctcctctttcccctcctgctcctcctactgagccggccgcagaaattgcagccgctcagcttctaccccctcctgcctttccttcctctttccttacttc

SEQ ID NO: 2795 - DNA, 3128 bp, Homo sapiens
ggggcaagatagccaactagaagcagctgcaattcgaggctcccactgagaagaactaaaacagtgtgcaaatcctgcaccagcaactgacatatccaggttctatgatcaggactgactaggtagttggcatggcccatagagaacaaggaaagatgggctggtggattggcccacctgggagccacatggggcaaggggagccctcaccctcagccagccaagggaggcagtgagtgagcatgctacccagcctgggaaactgctttttccatggatctttgcaatccacagatcagaagatcccactcatgagaccacaccaccagggccttgggtgccaactacagagccatgcagattctcaacagccactcagctggagtctgcctaaaaagttggggagggttgtcatcatcactgtggctgcctgctgcctaaaccctctgagttccctgggggagggggagcagtcatcactgtggttgctggctgcctaagacaactgagcttcccaagagaggggcagtcatcatcactgcagctgcctgctgcctgaggaaactgagctccccaagaagggacagcagccatcactgtggctgctagctgcctaagacactgaactcctggggaggaagggcggcagccatttctacagagccaggctgctgtttttcctttgctgatgccagggagactggacggcttggtcccaagaggtattccccacagcgcagcatactggctgtggcagatcatggccagactgcctctttaggctgaccctcacccatccctcctcactgggtggggcatccctgcaggaactccagcaactcaagccagggaattagggagagaactctgatctctctaagtctgagtccctagcaggaggggtggctggctgttgtctccacaaaccagaagacttattctttccccctgctcactctgaggaatccaggcatcccagacgagtgggatttcccccagcacagcatacccccttcacaaagggacaactaaagtgcttcattaagcaagtcctggatcctgtgccccccaactgggtgagacaccccaatgggtcaccagacaccttatacaagagcatttctactggcatcaggtgggtgcccctcaaggacagagatcccagaggaaggagtggggtctcatctttgctgttctccagcactctctggtgacatcttcaggtgtgggagggacccagataagtagggcttgaagtgaatccccagcaaactgcagcagccctacagaagaggtgcctgactgttcaaaggaaaacagaaagcaacaacaacatcaaccaaaaagtccccacgaaaacctcatctaaaggtcagcagcctcaaagatcaaaatgagacaaactcatgaagatgagaaaggaatgaaaaacccctcacaactcaaaaggccagagtggcttgtttactccaaatgatcacaacacctctacagcaagggcacagtgctgggaggaggttgagatggatgaattgacagaagtaggcttcagaaggtgggtagtagcaaacttcactgagctaaaggagcacgttctaacccaacacattggaacgaatcccagaacttaaagattggttctctaaaataagacagacaaaaataaaaaagaataaaacggaaggaacaaaacctccaataagtatggggttatgtatagaggccaattctacaaatcactggcatccctgaaagggaggtggagaaatcaatgcattgggttagaacatgctcctttagctctgtgaaatttgttattacccaccttctgaaccctacttctgtcagcaaagaagctaagaaccatgttaaaaggttacagaagatgctaactagaataaccagtttagagaggaacataaatgaccggagccaactataaagcacataaggggaacttcgtgatgcaaacacaagtatcaacagctgaattgatcaagcagaaaaaagaatatcagagcttgaagactatcttgccaaaataaggcaggcagacaagattagagaaaaaagaatgaaaaggaatgaacaaaacctcaaagaactgtggaactatgtaaaagaccaaacctatgactgcttggactacctgaaagagacaaggagaatggagccacgttgggaaaacacacttcaagatatcatccaggagaacttccccaacctagcaagacaggccaacattcaaattcaggaaatccagagaaccccagtaagatactccacaagaaaatcaaccctcaagacacatagtcatcagattctccaagatcaaaatgaaggaaaaaatgttaaaggcagccagagacaagggcaggtcacctacaaggggaagcccgtcagactaaccgtgggcctctcagcagaaaccctacaagccagaagacagttgggtccaatggtcaacattcttagagaaaagaatttctaacctagaatttcatatctggccaaactaaccttcataagtgaaggagaaatccttctcagacaagcaaatgctgagggaatttatcaccaccaggcctgccttgcaagacctcctgaaggaagcactaaagatggaaaggaatcagaatgatgctggcctcataaaatgagttagggaggatttcctctttttctattgattggaatagtttcagaaggaatggtaccagttcctccttgtacctctggtagaattcggctgtgaatccatctggtcctggactctttttgtttctccacagacactacccaaagcagtccttcactacagtggcagacagacctgaaaattttcatctgaagcagcagagtgaactgcagagtcagagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaagacaaaatttattgaatatactttttcaaacaaagtttcatgttctaatcattgtctgatttcagcattaaatgaaacacagtaaagaaagttgggctga

SEQ ID NO: 2796 - DNA, 4173 bp, Homo sapiens
ggagattttgggctgagatgatagggttttctaaatatacaatcatgtcatctgcaaacagggacaatttgacttcctcatttcctaattgaataccctttattgctttctcttgcctgattgccctggccagaacttccaacactacgttgaaaaggagtggtgagagacggcatccctgtcttgtgccagttttcaaagggaatgcttccagtttttgcccattcagtatgatattggctgtgggtgtgtcataaacagcttttactattttgagatacgtcccatcaatacctaatttattgagagtttttagcatgaagagctgttgaattttgtaaaggccttttctgcatctattgagataatcatgtggtttctgtctttagttctgtttataggatggattatgtttatggatttgcatatgttaaaccagccttgcatcccagggatgaaactgacttgatcgtggtggataagctttttgatgtgctgctggattcagcttgccagtattttattgaggatttttacatcgatgttcatcggggatattggtctaaaattctctttttttgttgtgtctctgccaggctttggtatcaggatgatactggcctcataaaatgaattagggaggatcccctctttttctattgattggaatagtttcagaaggaatggaaccagcccctctttgtacctctggtagaattcagctgtgaatccgtctggtcttggactttttttggttggtaggctattaattattgcctcaatttcagaacccgttattggtctattcagggattcaacttcttcctggtttagtcttgggagggtgtatgtgtcgaggaatttatccatttcttctagattttctagtttatttgcgtagaggtgtttatagtactctctgatggccatatttctgtgggatcagtggtgatatcccctttatcattttttattgtgtctatttgattcttctcgcttttgttctttattagtcttgctagtggtctatcaattttgttgatcttttcaaaaaaccagctcctggcttcattgatatttttgaagggttttttgtgtctatctccttcagttctgctctgatcttagttatttcttgccttctgccagcttttgaatgtgtttggtcttccttctctagttcttttaattgtgatgttagggtgtcaattttagatctctcctgctttctcttgtgggcatttagtgctataaatttccctctacacactgtattaaatgtgtcccagagattctggtatgttgtgtctttgttctcattgatttcaaagaacatctttatttctgccttcatttcgttatgtacccagtagtcattcaggagcaggttgttcagtttccatgtagttgagcggttttgactgagtttcttaattctgagctttagtttgattgcactgtggtctgagagacagtttgttataatttctgttcttttactgagtaaatttgttataatttactgttcttttatttgctgaggagtgctttacttccaactatgtggtcaattttggagtaagtgtgatgtggtgctgacaagaatgtatattctgttgttttggagtggagagttctgcaggtgtctattaggtctgcttggtgcagagctgagttcaattcctggatatccttattaactttctgtctcgttgatctgtctaatgttgacagtggggtgttaaagtctcccattattattgcgtgggagtctaagtctctttgtaggtctttaaggacttgctttatgaatctgggtcctcctgtattgggtgcatatatatttaagatagttagctcctcttgttgaattgatccctttaccattatgtaatggccttttgtctcttttgatctgttggtttaaagtctgttttatcagagactaggactgcaatccctgccttttttttgttttccatttgcttggtagatcttcctccatccctttattttgagcctatgtgtgtctctgcacgtgagatgggtttcctgaatacagcagatgggtcttgactctatccaatttgccagtctgtgtcttttaattggagcatttagcccatttacatttaaggttaatattattatgtgtgaatttgagcctgtcattatgatgttagctggttattttgctcattagttgatgcagtttctccctagtatagatggtctttacaatttggcatgtttttgcagggctggtaccggttgttcctttccgtgttttagtgcttccttcaggagctcttgtaaggcaggcctggttgtgacaaaatctctcagcatttgtttgtctgtaaaggattttatttctccgtcacttatgaagctgagtttggctgaatatgaaattctgggttgaaaattcttttaagaatattgaatattggcccccactctcttctggcttgtagagtttctgccgagagatcagctattagtctgatgggtttccctttgtgggtaatgagacctttctctctggctgcccttaacatttttttcttcatttcaactttggtgaatctgacaattatgtgtcttggaattgctattctcgaggagtatctttgtggtgttctctgtatttcctgaatttgaatgttggcctgcctcactaggttggggaagttctcctggatgatatcctgaagagtgctttccaacttggttgcattctccccatcactttcaggtacaccaatcagatgtagatttggtcttctcacatagtcccatatttcttggaggctttgttcatttctttttactcttttttctctaaacttctcttctcacttcatttcattcatttgatcttcaatcactgataccctttcttccatttaatcaaatcagctactgaagcttgtgcatgcatcacgtagttcttgtgccatggttttcagctccatcaggtcatttatggacttatctatgctgtttattctcgttagccatttgtctactcttttttcaaggtttttaagcttctttgtgatgggttcaaacatcctcctttagctgggagaagtttgttattaccgattgtctgaagccgccttctctcgactcgtcaaagtcattctccatacagctttgttccgctgctggcaaggagctcatgttgctgcctaatccttcctctggaagcttcatctcagaggggcacccagccttatgaagtgccagtcgcccccctactgggagatgcctcccagttaggctactcgggggtcagggacccacttgaggaggcagtctgtctgttctcagatctcaaactcagtgctgggagaaccactactctcttcaaagctgtcacacagggacatttaagtctgcagaagtttctgctgccttctgttcagctatgccctgcccctagaggtggagtctacagaggcagggaggcctccttgagctgaggtgggctccacccagttcgagcttcctggccactttgtttatgtactcgagcctcggcaatggcagatgcccctccctcagccttgctgtcgccttgcagtttgatctcagactgctgtgctagcaatgagcagggctccttgggcatgggaccctctgagccaggcgcgggatataatctcctggtgagccgtttgctaaggccattggaaaagtgcagtattagggtgggagtatcccgattttccaggtgcagtctctcacggcttcccttttgtagtaaagggaattccccgaccccttgcgcttcccaggtgaggcgatgccccgccctgctccatgggctgcacctatttgtctggcaagccccagtgagatgaacctggtacctcagttggaaatgcagaaatcgcccatcttctgcatcgttcatgctgggagctgcagactggagctgttcctattcggccatcttggcgccacctatttcagatttttctaatcagcttaatatacttcgaagagctgaatgcttttgtcttttatgtttattaattttctcaatagcctagtttagagaaattattaatcttttaccaatgtatctatggtcttattctgaagacctgtaatcttataagcttgatttgtttattacaaaatatattcactgtaagtaag

SEQ ID NO: 2797 - DNA, 2035 bp, Homo sapiens
aggctgatgcacttcctgacactcctcctggaggcccactctccccctgccgcggcctccccatccgccactctgctcttaacctcagcaagttctaggccccttcccagcctgggtgagggggactcagcagccttctctggctctgggtccagcttggccttttcttcccagggactctggtcattgctgggggtgaccccagatgagccccccaccagggctctggggctgcccatctccggcttcgaaagcatcttctccttccgttcacggattttcttggccacctccaggaagtccaaatcaggatcatgaagaggagcctccgccttgaccaaacagtccctgtccagcttggacgctgctctgggcctctctagcccagccatatcccctgctgtgggtccacttccttcatcggccaccttcctcagcaaggcctctttgttctcaaaccgggccgtgaggtccatggacaagggcctgggcttcctcacccacgtcttctcgggaggggtgggtggcactttgcccactgtggccgctgcgccggggcctggcttctgaggctgaatggactccgtgaaaatggcagacacgggccttctcttcaggcgaggcctgggctccacaagggggcgtgccgtgtcctccacactgctggcctttgagggaggatggtcttggcctgcctcctcttggggtacaggtggttttgtgtcctgagacaggggagctgaccggggaagggtccccgcaggcttctgggtgggcagggcgggcttggcagccacctcaggccgggagccggacacacctagcttggcctcctccgccccctcactaaccgccttccccagagcggggccgcttttggtggtttcgaagagaatcatggtgctggagctgggccgcaggaacacagccttgttgaagaggggcgagctcgtcctcgggccctccccactgcccacctcctgccccaccaagccgggcatcctgttgtccagatcctttgctgctggctcctcagagagccccccagagggggaaggtccagtcgaactgggccgcagagacgggacaggagatttcacgtcctgctccttcgagaagggtttgggggcgagccttggcagagggagtaaccgggccgggctccgcagggggctcttcgcttccaagatccgggctgggggagccccagaggcttcgccggcctggaggaagtaggtcctcgtcagggtctcctccttgcccatctcacccaggcctggcacggccgtcaagggcgttatggagcccacctcgacccgcgtggccatggttatggttgtggattcatgggggttaggaacttcaagaatggagaagcaattgctaaacaaacaaaacaaacaaacaagtaaatttggaaaacagtcagtgtctgggttgaagcagaatggtttagagaaatgggacagagtcctgagccccagattccatacgacagccctctgctgacctcacccggcaggcttgggcctgcctctccccgtctctgagctctggacgaggggagtggactaaacgcccatccctgaagttcgttccagctccaagggtgtagaaaaggcatcaacactctggaggactttcccctgacagctaatctagaggccagcacttaatggcaaaaagcagtgatctctgctacacagataaggaaaccagctcagagaggccaagtaactggagtcacccaggaagcaagaggcgaagtcaggacttaaaaccagagcctgcccacatcccaggtgatcctaatcacaagtgtgtgctaagcatctagcacagagaaggcaagtaacctgctgcaggtcacacagcaatgcagctcaggagtgcctgggagcacaaagctggttagtgaccttggaacccatgccctaggcaccaaccccacccaatcatccctttgtcccttttctttcccctcccccacccttccagatgccataaaaagaagccattctcatttttctcactc

SEQ ID NO: 2798 - DNA, 344 bp, Homo sapiens
ttgtcctgaagggagaagagcaacctggcccacagcctgcaggtggcccagcagcaggccaaggagctgcggcaggagcggaagaagctgcaggctgcccaggaggagctgcggcgccagcggtactggctgggggaagagcaggaggacgcagtgcaggatggtgtgcgggtgcgccgggagcttgagcacagccatagacaactggagcagctggaagggaagcgctcagtcctggccaaggagctggtggaggtgagggaggcgctgagccgcgccacactgcaacgggacatgctgcaggccgagaaggccgaggtggccgaggcgctgaccaaggtggg

SEQ ID NO: 2799 - DNA, 2874 bp, Homo sapiens
ctgtggtcgtcgttactaatcacgggggaccccatctgtgcagcacttcatgtgtaaaagcatttccctgcccttattcagtgtccgtcatggaaaatgacttttacccttcaagtgtttttttgttttgttttgttttggttttggttttttaattccttaaagcacctagcagaatactgtgaacacagtgcgtttcatttaaactgactttcctgtaggttgaaaaaataagtgagatacttagtgcccgtgaatactcaggaaaaactcaccaagacggtcatcaaaagttgataaaaaagttaagtgaactcaaaataactgtgttcttgtagaatgtttacaaagctgttagggaccctcagaatgggaatttgggggatgaattgtatgactaacttgtcactggaaaaccaaaaaaactcagaagaaagccgggtgtgttcagtattccccatattgcctttaaagcaaacacagcccaactgttgaaaccacggagcaactttggctagtaagagattcccaaagcccagcacttctgtgcacacgcacaggtgcgctcacacgccacacacacagatggaagttaacattttgataacgtggatgatggaggtttccattttttttcttggctaatacttgatatttttaaaagtgcgagttatctttcttcttgttgcctggctgagttgaccttgagtgatggctaggaagtcagcatttcttcatgagtagtttccattttcttcatgttcgtcttaggaaaaaaatcatttttaagcttacccaggagctgcatggttaatttactatggcatctccctgaagctcaaaacctgcaaattgttttagctaaataccataattataggtttagcagtgaaaccaaggacttggtgggaatttttcatttgcttttgtttaaaagaactaaaaccagattgttcagggtaagaagaaacacaacaggaattttatttttactctcataaaaatgccagccatagtttgctgggggtaggagtctcggagacgagagggaaggaggagtcctgctgatttttctcccttttctaccccctttccatcccatctctccccttcctgtcccatctctccccttcctattccttttctccccttcccgttcacgggaatgccactttctcacagggcctcccccaccagaatcctcccatgttagtgagcacaggcggtgtagacggcctgcagcaggtggtgtggacggcctgcaggtacactcgttgcccagggtatctggtgtctctctggcttagctgtcgcgcctgtgctgcccatgactgaccaggcttcaccagttcacagcggatccatgctactttgccttctctgaagggaggaaaaagaacttgaattagaagttttccgtcagcgtacaggaggtcaggtcctcagcagtctccctcccaggaattggagcccggggtgcctgttgcccatgtctcctccgagtctgaacacaagcagtggctcaggccagctgatgctttcctcactgagctccttctctgcacatgaagcggaagatggggcgtgccatcctgaggtcgggctgctttccgccatccacccaagccaggtccctactgccccgcactgtgcaccttgcctggttaggacctctttgctctcccacctccagtctctccagacccttcgtccagcttcaattccacatcccccagcgagcctttctcaaacacctgggtgcacgattcgtagtttacaagtattgtggaatcgtgcctttcaacttgtattccttggagccctagagtttctgcggtgtcccaggagctgtcacagtggggagagagctgggtggaagggattctgaccccccactcaccgtccctgcctcaagagccccagtcaccccgagtatgtcacaggccaccttctctccatttctaggagagaaaagagtctaaactttcattccatggatgacaaaacagaggtcctcagaggtcagcctattctccaaagacacatatcaaactcatggcagcaccggacctagaaccttggtcttctaatcaccgccattgctctccccttcaagccttctctcctcctctgaacttggaggagacacagcaggggaaggaatccttggctgggaggaggactccaggctgtgggccaggctggatgaccctaggcaggtccctcccccgctggaccttgggaaatcttttggagacagacagaagctcccttaggtctcttccttccactctgggatgctatgaagaggagcctttagctgtctcctctaggcccttcagggccgtgctggctcatggagcaatcatgtgtggctctttaattaaaattacattttagaaaagcacttcctcaatcacaccagtccctttaagtgctcagcagccacatgtggctttagtttctgtgtcaacagcactgtggtagaggaacccacctgttaccagtacacctgccccagccccttctcagcacagaggtgtgctttagcgtccagaaggaactggccccagtaagtctgggataattgcctattcgctaaatgaaaatgagacacttcctgtccggggtaggcataaaagaaacagaaataaaagccaattaaataggaatgacaagatgatagtgcagattcaaaagaaataggtatgcacaagtgacttaaagcagagtcctcctctagcccaggacactcttcagtctggctgcagctggctagcttcttttttttttttttttaattctaagaaatagattgaaatgaaacgatggaaaagaagcaggacttctccccgtgggtgtctgtgatgtcct

SEQ ID NO: 2800 - DNA, 1265 bp, Homo sapiens
tgcagtggcgtgatctgggctcacctccctggttcaagcgattgtcccgcctcagcctcccaaggctgggattacagacagggtttcaccatgtgggccaggctggtcttgaactcccaacctcaagtgatccacccaccttgttctcccaaagtgctgagattacaggtgtgagccaccatgcccagcctgttcctaaccctttcaactggggggtctcaagtgggtgaggactccatggccacggcagcagaactgtctcttctgaaaaccagactccggggcccctgggtcagcacctctaggtcattccacagacttacacagtttaaagaaagagccagcgaacatggggtgatcctggggtgccactgggatcccaagccaggcccggaggtctgcctgtttcgtccccagaaacttgagctggcatcctccgctggtttgcactgggcacggggactggagagccaccaggccactgagcgcagcatgctatcacttctcaggaagttgtgagggtgaggagaatagccgggcccactctgcagaggggaggaacaggcacaggctagaggcacgggctgatagagtgagtcctctccctcattcattcattcattcattcattcatccatcagacacctgctgggcatctgctgtgtgcgagacactgtgctgggtgccccagacacaagacagaaactcgggtcgctctgtgtgcctccacactggccttccctgctgcgtggacgcaggctctgtctcctaggctttaagccccatgcatcaggtggaagacaatttccagcagcctctgcccgcttgtttttcctcctctccttttcctgccgccttggtcttttttgtcttttgtgcagggccgtctctcgcagcgcccgtctgtgctccgcagcgtctaggaaaggattagtgtgagcagagcacgcaggctttggtgaacagagccgagcttggtttcaacatctaattcaatttgttctgccgagattgaaatatgaaatggttgccagtcaaacgttcaaaggacggggaagggagagtgagcgcatgctgaaatttaaattttaatgaaaatgactttaaccctttggtacaccttgcaaaatgtaacccatcctcccatcctgtgaaagcggcctctcgggttagagcttttccacccacttctcttccactgagcttcactaataatatgtaatcatttttttcagccgtcttaataataaaagattaatagaatg

SEQ ID NO: 2801 - DNA, 6938 bp, Homo sapiens
tctggggttttcagtcctttacaagtcttgcccatctgcccaagctcaccaagtagccgagggtgtggttggagggagggccttggaggagcagggctgtccacctgaggctccacctctggctgcgtgtgtagctggccccatgctggtatctcctttggtatggtccctaaaggaaggcaagacccaataagtgtccatacgctggtggggacgggggtcacgtcctgtgctcaaggccaaggcctaggttggaagtcaaggtacctaggaggaggagcctgatagggcatggccagctcctagggagcatggcaagctccaagcttgtagaagtggagcctgtaactgcaggggtggaggccaaggggcaggacttaagctaagacagggctgtaggcaaacaagtctgaagtctgggacagcaattgccgtgcctgtgtgggcagggcatgtgccacctgcctgtcttttggaactggttcagctgatagatgctttgggatggggcctctgcccttttctttggctttgtctctcaccagtgctcggagttccccaggcctccgggctccaggtgctccaggtgccagcatctagaaagtcccgggcactgactcgtacagcatggggcagcccagccacagcatctgtgatcacctcctccagtccagctggctccacctgggggtaaacatgactcactgttacccagcttgtaagtgcagggccttcccagccaccatctacaaagagcaccccttgctcccagtctcatcctaaagcctagtggagctgtctaggtctcatgttgggtgtctggtggagctgagtctacacctagtgtttgtaagacggcagtagtgattacttagagaggctgtggcatcaggcagcctgggttcaaatctttggtgaaccacatattgaatgaccctttgggcctctctgtgactcagtttcttcatttgtaaaatagaggtgaatctacctaaacaaaacaatgtatgcaaaaagtgtagccaggtaccccacaggcaggcagcactaagtaaatattagttattatctgatgctgctgctccctagtcctgataccagccaatctttaacatctcctgagacacaaattcactgctatcctcagctgggtatatgagtgtttgtaggagaatgtgcctctaggtgaaaggcactccttttcctaagagttatttttaggccgggcgccgtggctcacacctgtaatcccagcactttgggaggccgaggtgggcagatcgtgaggtcatgagttcgagaccagcctgggcaatatggtgaaaccccatctctactaaaaatacaaaaattagccaggcatggcggcgggcacctgtagtcccagctactcgggaggctgagacagaagaattgcttgaacccaggaggtggaggttgcagttagccgagattgcaccactgcactccagcctaggtgacagagcgagactccctctcaaaaaaaaaaagttatttttttaaaagccattgctatcttcccacagatgtgctttacctcatagttatagccccacaggacagacattcagtctctcagtcaccactgcaacccagcacccagtacaaagcctggcccacagggaagtgttgggtcttcagtgacctgccagcactggaaagctatacagaacacccaggatcgtgaaatcagagacaggacccacagccgtgggttgggacgcactccaggcctcaccgtggaccaggctggatgctgcgccggacggtactgcaaacggaacttgagcaggaagtggggctggcacggccaggaggcagggtatgtccagctggctcgcaggcgtcgggggtaacctggtactgactctacccgcaggccctggggtgggtcagggcgcactaagggcatcaagacacaaagtcagggtaggctatgggtctccatcacttccccaccacttcccaaagtgtgtgtttaaaggagccttagccagacactcctgagaggggaggggaaatcttaaacttgatcatccattagactcagaccggtcatctgtattatgaaatgggctgaggccgcgtgtggtggctcatgcctgtaatctcagcactctggaagactgaggcgggaggatcacttgatgccacgagtttgagaccagcgtgggcaacgtagcaaaaccctgtctctacaaaaaattttaaaaattaaccagacatggtggcacatgcctgtaatcccagctacttgggaggctgaggtgaggggatagcttgagcccaggagttgcaggcttcagtgagccaagatcacaccactgaacttcatccagcctgggcacaaagtgagaccctatctcaacaaaaaaaggaagagaaagaaaaaaagaaaccacctgagatctgcgggtggacttttgaagtgcttcttgagtgaataaaagagcaattcctattttcatccaaggaagatgaattggcccaaattccagctagagttttagtgtcccactcccatgcacaggtcaaggaaggaggggccagcaagggaggacatgacatatggctgcattcggtacagggcctgctctgaggctaggcagccaatcaggcagtgtgggtagcagcagcagcctctagagtgtgtgctgaaataaccatgcctcctgggctctgatccctttgccttctcaggctccacagggccttctctgtgtgaaatggagtctaggttgggaggaaactgggaactctgggagtggagagatctgagtccatttggggtctctgtgatgggggtctgggggaggtctggggtgggtactcacagatgctctgcaagctcacatccagcaggcgtgtgctggcacccagtgggttcacctcagtcacattaatccggtactggctccagaactcagccccgtggacaacacagcgggcagcccctaggggatcctgtgggcatggccagggccctgtggatggactcctcctagaagggaggatgtggtctttggctttgaaaatgcctactgtgggacccagctggagcccccacatgctccctcacgtcctacctctggctatcagctcctaggactgtcttcttcctggtggggagggggccatctgaagtcaggaaggaaaagagggccttctgccctctctgaggctttcctcagaacctacctccctgcctcccacacccacattgcaccagcatacccaaatgtgtaggcatccacacccaatcacacacacacctgtaggaggtgaggtagcgggtgggtaaaccgctgatctggctgggactccaagtgcaagagaagttctcatagtcggctgcttggcaggagacaacagggcgggctggagggtctagaggcagagggtacacctggagactgagcagtcctcaggtcctcctggtcccagagggcttacttaggtcccatactccctcaggatccctatgtgtcatcagtgccaccctccccaactcacagcccagctgcagggtcactgtgcccccaagtgcaccatccagggtctggcagatgtaggtgccctcatcagtgctgtctgcctgggccaggaccagttcatgccctagcccagagtcaggtccctggagcagctttggctccccatcccgaaaccaggacactgggtccctggaagtgagatgaggtgacaatggacaaagacaagatgtcaagcataagtcagaccatgccacagctctccattggcttctaactgcatttgcaatagaacccaaattccttttactggctttcaaagccccttgtgagccagcccttgccttcctttccttcttcagctcctatctctctccccctcacccactgaaaactccagctacattggtcttctttctattcctcgggggtattgagctcattcccacctcaggacattttgcactagctgctccctctgtcacgagcgcttataccttaatgtgtgcatggctgcctccttcctgaccttcagaaatcagcttcaacaccatctcctcagagagacctttcctaactaccaattaaaaggtaaccacgggccaggcacggtggctcacgcctgtaatctagcactttgggaggctgaggtgggtggattacttgaagtcaggagttcaaagcctgaccaacatggtaaaaccccgtctctactaaaaatacaaaaaaaaattagccgggcctggtggcgcatacctgtaatcccagctacttgggaggctgaggcaggagaattgcttgaacccaggaggcagaggttgcagtgagcccagattgcaccactgcactccagcctgggcaacagagtgagactctcggaaaaaaaaaaaaaaaaagtaaccactcagttgtcctcttcgacatccctcactttggtttttctgccctgcaggtgctcaaaacataccagttgaattttctgttgaataaggatagttagacggttaggacagatagagaggtgaggattacggacagagcgggcaaggatgggaggggcgggacatgaggactaggcagagtcaagaaagggtcatgagtgtcagaccaacaggcaggtggggcacttacccggcagtcactccaggacaacacagcttcacggacctgcctggctgcccatactggacccctgtggagggcacttctgaggtaaggctcttcctttacccccctccccactttgtgagaatgacagataagaagcagactgttaaaacctgggtggtggggggctcactggatcaaagcatcatgttataatctggtcacaagttaggcatgggaaggggccacagtgagggtggcaagtcacaagtcagagttgggaggttgtagagcagggttcttctcacctggggggccccaggcctgggggcagggggaggaggcagacaccagggctgtagccacggccaccaggaccctgctcagccctgagcagctgctgctcatctgtggggagaggtagagtcaaaaatccccgacccctgagatgggaggctaaagcctggctcttcctctccaaaactgaggcttcctaggagaaaaattgatgcaccaagtggggtaaggctgttagaaatcactgcgggaactgacctgaggtcccctttcccactgtatacccagtgctttgcatgtgcgtgcgcgcgcacacacacacacacacacacacggacacacacaccccctcacaccctccatctcagtcctgggcttagggcccagaacaaaagccggaggcaacagactgtgccagcaactccccctccactgcccttggcgcccacccctggcaccaagcactggcaccagctcagccactcccattaacccctccagtccagctgttgggaattctggtatttacccccacctggtccagggcttatcactgcctctgattaacctaggcagaccttatcaccctgggggaagggtgtcatcatggatctgagcccatcctgcactcccaccctgaggcccacccctgccctggctgccaggcttctcgcctgaacctggctccttggtctggctacttgggccactcagctgggcctggctcttgacacttcgttggtctccagtttgtgaagctggatggggctagggtgcaggctggggctgtgtagttaagcagatccagatgccctggctgctgccagaggctgggggtgggcgaggagccagcagatggaaatggagacagggtggcggggaggggaggggagggaaggggatgagaggctgagaggaactgggagcctgcagggacaggcatgggggccacagcaccaagagatactcagagatcaggactaggaggtgatggggcagtgtgggaagtgttggaaagactggattggggtcagcggaaactcaaaaagctaacagtgtgtctatatggcaggtgggggatgctaggagagagagattctggacaagggggagcagaaggaggaaggcagtggtgaagtggatggagaacgaaggggcaggcggggaaagggctctgggaacaagaccagaagaggaagagcacggacccttcaggagtaggagtagagcagagcagggcctccacctgtctgtgtgtctgtctgagtgtgtccagttggctcacccctggccacccagccacacttaccctgcttagccccaccctacctcggtgatcccagcagcagagtgtccatagcctctaggacttcctctcaccagctacagcccccgtctcctactccactcagttctgggaccccagagccatcccctccttccccttccctgccccgccccctctaagccctggagctctgccgcccctagccaggccccctccctgctcctgcctcctccctccttccctcccacccaaggccctgggaagggaagaggcctcccccaagtctggaaaggaagccacagacacagccaaggccagcaagagggaaaggagggtggctaatacttatgtccctgtcagtgagagatgccctgtgttttcacacagccagacacagtcacattcacacacagactcaagaggcacagttaacaaaagggcatgcctttgaacacacgtggacacaatcaaatgaaaaatcagatacaaactccccctcttttcactcctcaccaaatgtttccttagggtacagctggctgtgcttccaggggaagggaggccccaggttgggggatataaggagaggccaaagagtccagttccccctcccctggaagttccagccatttctcacctccccctccattctttgggccccagcaccaggaaatgcctttggtcccttggtgccagatacacaagacccacagttaccctcagactcatacact

SEQ ID NO: 2802 - DNA, 6280 bp, Homo sapiens
tgggcagaggaggtgccttgatcaggccctcacctcccaggggaagggttcagggtccctgatgtcaagtgctttgaaggctgagactggcagagtagagaggaggtggatgggaggaagaacgggagaggggagaggggagatgggaagggccagctctggagatgctgcctcctgggctctgcggtggccctctcatcacagcttggcacccttggaaggctctgaggactgccgcacgtctgtccactcctgcatggtgttctgcagggcctgggtcttctccttgtccacctgaacgtagtccaccttctcatcagaggtgacggatgaagtagatggctgaggggacagagtgggaaagagggagtagctgtgagttaccagttaggtggggaggaagaaggtgggcacgggatcttcctgagctgtctgaaggggagaagagcatggcctctgcctgccactgaccagcctcaggagcctggcttctctttctgaatgtgggctttaaagctcagactccaaactcatcatccctcctgcaggatgtagcagcacctgccagcccttcttacttcccggcttctgggaggacccaggcccttccttggccctggtggatgggtccaggccttcatctctgcctccacccatctctgtcaggtcgctcatccaggggaaggaatttgctaggtgcaaacaaacatcagccacaggactttacgtgctgtgctcactgccaccctgtgaaggggaaccatgctgaggcacagctctgcacccttctgtctagactgcttagctataaggatgcctcctggggaggctttcccaggcctggaagtcccttctgaaggctgatgtatcgacggcagggctctggacccactcgagagcccaggaccaggaggcagtatcctcattcctggatctgttgctgattcactttgtaaccttaggacaatcagatctctgtgcactcatttgcccatctctacaacacgggggatgggctgactgatgaggttctctgactgagggtactgtgctctgagagcaggaataggagtctttagacctagatgaaagctctatgactaaagatgcatcataaaagctgggtactggagcaggagggaggctgagtgctgctgttcagtgttgaaggcaccctggcctccatgatctctgcctccgggaccctgagagctcttactgcccccccaactctactccaggcaccttgcggtgggggcttggggagctcggctggaagtccagggccagataatcaacgctgccggtgctcttcttaggggcaggactgttcgtgccactgggaacgggagatgcagacactgggttttgctgtcacgaggaggaaaaaactgtgagtgactgcagaaaacagactaacccaccacccagaaaaacacctctgggagtaagaacactgtttccctgagccctactctgacacatgcaccatgctaaggacttttcatgttttcattttaatcctcatgacaatcctgtaaggtaggtatgattactgttgatactgtttaaagcaaagatgaaactgtggttcactttactttcagagaagtgactttgcctgtggctgcacagctgttgagtgatgggaatcaggtctgttttctgacttccaaacctgtgctaacccctgtaccacactgcctcctttctagcacatcaggccaagtctcatcaacagtggctctcctgagacatccagcctttgcttgctggcgcttaagaaaggagcacatttcctttatgcactggaaagttttcttctgtcgcaccaaatcagcccctgtgaaactcccacctgtggcctagagtggggtagtcaccccaaagcagcttgctcccccgcctagctcctccaagatctgaagagggtggcttcatctccaggctgcacaagcccgcatttcttcagatgacacgctctaggatcctgtccatccaggctcgtgctctagcagagcaccacctcctctagaactttctggaagtcttattctaatgagaaggtgatagtcctgtgttctgtttgttggctgctttactggttggttaattcattctttcactatctatgcagtgactaccaggtgctgggcagttacgcccttaatggaaatctcagggaagaaatatcctcctctgcctgtgttgatagctctattatggcctcaccaaagtgagttatgtgcacgtatgcctctcaccactgaggagatacctccaccactgaggagatacctccagcactgcctatccaagggcacagatcatgccacccatgtcactgtcatgagaggcaggcccctgctcttgaagaccatgacttcgttgggacaggtctcatgtcttccttacatctgatgacaactcctactgcttgataaacaggtgctcaagaagggtttgtagcaggagactaaatcatgaataatacaaggagtccctgggctgaggtgagttagctaagctgggaagtggggaactgaggggtgggtcccaggggacttgaaaggcgtcattccagcgaagcccgaaggactcaccatagggacatagttctcttcgctgtctcctgagtctgtgctggtgatgctctgggtggagatggggcggcagtactgggaggagctggagttgaaggtgtggctgttgtgggaaggaagagttaacactggggaagctgcatggctgctgccatgtttctagcctccagctgggccctgaccctcacacacccagacctcagccattagagctgcacactccatcagattaagatctgatatagggcaggtataattattctcttttacagctgaggaaaccaagccacaagacatcgagacatgatcagctaatgatagcgttagcatcagaatccagctgtcccggcccacaggccagctaccacatcactcattttccctaatggcccgactccaagctcccacccccacacatacgcacttacttggccctagaccaagacttggtgataggtgacttgaaggggagttcatcgatgacggtgttgttcctcaggtcaagtggtgttggctttgctggagcaggaaaagaaagtctggtaatcagccagtaatgataatgctacacatacacaccttatatataacacatgagcatgtttataaaggcctgcaaagtcattccagtttcacacagggaaactgacgctcagcgaggttgtataatctttgcccatattgatgagccttgaagtcatgtcttcagattccaaattatatattctttctgctgtatctatggtaattatattttcagaatcaaaagtggggacacagggtttgacaacagatttttctccctcaatttatgacttcatttaaaaataaaagactatatataaaatatatttatatattaatatattaatatttataaaaatatatactatttatatattaacacacatatatgtattttttaagacggggtctcactctgttgctcaggctggagtgcagcggcgcaatctcagctcactgcaacctctgcctcctgagttcaagtgattctcctgcctcagcctccctagtagctgggactataggcgcctgccaccacgcttagctaatttttatatttttagtagagacggggtttcactattttggccaggctggtctcgaacttctgacctcaggtgatccactcgcctcagcctcccaaagtgttggggttacaggcgtacaggcgtgagccatggcgcccagccaagagaccatatttgaagtatagatggtcaccgtgactactccctgctgctcctggccaggtcggtgcaagccacagtggaggaaggtagatgccataagggcttgagggcttcagttccaaatgctaagatttgaattccctgttggccagacccacagggggctatctctgcctagctatcctactcctccctttgaatccttgccactgatccaatgccaggagagtgagattgtagcagacgaggaccttgcctggtctacatgcagggggcacaaagctgactttactgaacgcctgctatgtaccaaagtactatcctagatgctctcctttgcagcaaacctgggaggtaggaattaccatctgcatttcacagataagaaaactgagactcagattttacatgatttgccccaagtcacacctctcaagtccaggatccacatgacccctaagcaaatggaaagagtccctagccactgtccagagatgggacaggggaaagaatggacttacctttccgatcaggtttgaggttgcggttgacagggggtggctgaatctcacttcctctgctggggcctcggtgcacaggaagggttgttgatgggtagccaagtgagtcaaagtgatgggcccctgggctcattgggatgtagacgctctgggaattatcacctgctcgttccatggccaacagggtggaagaacctggattcatgggcacatagttgtcttcagaattggtgctgtccgatcggcccacaatcattttccctggctagggagaggaacagtgaaagaaatacagctgttactagcaagaagaaacaggaagggggtaagactttgtaaatgaggcaagacaagtcatgactgggttagctatactttgaagctgtaagggagaccttggggagaccaaataagaaagcagagtagtgggaggctgaggcaggtggatcacttgaggtgaggggttcgagaccagcttggccaacatggcaaaacctcctctctactaaaaatccaaagtattagctgggcgtggtggcatatgcttgtagtcccagctactcaggaggctgaggcacgagaatcgcttgaagctgggaggccaaggttgtagtgagccaagatcatgccactgcactccagcctgggtgacagagtgagactctgtttcaaaaaataaaaaataaaaaaaaggaagcagagtgggagacaagaatatatgaggtctgtgggccccttcaagccttcacgatcctttggcatccactaataatttttgataaatctagagtataaaatattcttggtgactgggtccacttggctttctggacgcctgaccaacactgtgggtggcatagtccatagactgtaggtttggttcaggacctgccctccacctcaagtccagactcaccactggcaggtcagcatctcaggccctggatcagaacaaggagcatattaggagtcctggctctggaaggtgaggtctggggccagttgtgtttccccagtccaggtttctaagtacctggggctcactccaggcacctaggggaccaccaagctgcagtcagagcttctacagagttgtgtgatacagcaatcccagccttcctctaactcttgctctatctgccgtgacatacaactaagctgcttctgccttggttacctgatttcactgtcttttcagtgggcctgaagccaggccctggtcttcttgcctgacaccttggagaactgcggttagcatcttccagagggcagcctgggatcctgcactcaagccataattctgccacttagcctgactgtgagtaccacccttgcctggagtctcacactgcagcctccctcctgcatgtgaggccacgtgggtaaggttgctgtcttagaggttcccccaccgtgcagcctgggtctattgcattctagatcctctgcttacctacaaggttggtgaaccttgtaatccagtctaccttagcacatacatttcttccagactagaatacttatatcttacttgtccaaagactcaacgcagggttctgaactgagacaagaacttgggcagggtcctaagatggagacgccatcaatcttttggggttgtgcttttaattccataaggtgtgaccttttacctaaccaggccggcctgaggacccttgggttaacccacactcaccaggaaagagccaactccatcactcatggattcagcagaccggcctgcactctctccaccacgctgtgggtactcgtaggtctcacaggaagaagctgacagaggaaggaggattcataagtactcatggttgattcatgtgttgacacttacccataccctcaccagtgtggttcaaggtcttactgatactccagaagatactactctcaaccccaaatgataaggaatttcttcgaacacatc

SEQ ID NO: 2803 - DNA, 8285 bp, Homo sapiens
actgccaccgccgccgccgccggtggggacgtgaagcaccatctcttgcaggttcaccacagactggccgaagaagcagagggacttcaggtggctcctcgctgcctcctcgtcgctgaagcccgcctggcacttgcggcagaccaacttgtactgcacctttggaacaatgaaggggtcgtagagggagtccgcacttttgctttctgcttctggctcttcagggagtttcggcaggaggggggacacctcacggggggtgtttttctgttcttctggtttgggggattctttggcagggtctttgtctggggaaggagccccgggggggactggggtttggcttgctttgggctgctgctgctgcactttttgctgctgctgctgctgtagttgccgctgctgctgctgctgaattgcctcctgcagactctgctggtattgctggtactgctgcagtagggagcctggggacagccccatcagggcctgcgacagtgcagggctgtaggggaacaggccttccatgccatacataggctgcaggtacccgctctgcagggcgccagggatctggggagcataataaggagaaaagcctggtacaaagtaaggaaggaactggcttgtgagcaatgctgtggggtccgaagtcaacgcggcctgcagggcctgcagctgtgcagggtctaccgcatactccatggtgggcagcggggctgagatcgtggctgcagttgccgtgggggcctctcctttctccttcttggggacaggcaggggttcccctttccctttgtgtgccttttccttctcctttactttctcactgtctttgtccttgcgttgctgctgctgttgcagtgggagctgtggtgtgggtggcggctgggctgctggcggcgggggaggctgctgcacctgtggttgctgctgctgctgctgctgctgggggggttgctgagggcccatcgccatcgtggcttgtgctggggttggggagctcagcgacgctgaggacggtttatttggtaatccagaagtggggaggccaggggaaggaacagttgtgctgggcagacccatcaagttcggcttaggagacgttaaagctgaaaggaatggagacagaaatcaccggtcagtctgggcaggggtagggctgaagctcaagacgttttaccggtgtcactggcacacagtttgagatgtcaaggcttgaaggatcctctcaaaacgaacatttccaacagaagtatcccaccaggctcagggctggacaaccttgtattctaatgaggactcagtcctaggtcagctcccatacttcccctttcagccaaacaacttccagaagtatcccaccaggctcagagctggacaaccttgtattctaatgaggactcagtcctaggtcagctcccatacttcccctttcagccaaacaacttccagaagtatcccaccaggctcagggctggacaaccttgtattctaatgaagattcagtcctggctagctcccatacttccccttccagccaaacaacttccaacaccttcctgcccaatgtgccacacccgctagttcacattttctttgccaagtactcccagctaccattcactctgcccaactgcaattagtctagaggccccaaagctagctgtttctagctggggcccatttgcaccaaaggccttcatcacaaaaatagtatggccacgaggtccccagagaagttatctggaggagagcggcaacaggagaagagagaacgaaggcaagaaagctagcacggccacatgaacaaaaacaaaacaggctctacaggtgttcctcctctctgacctctgttgctgcagctgactggatgctttcggagggtagagagaagatgatgaataggaaagtgtggaggaagggcctgggaagaaataagaacaatccattcagggaaaattgcttccatgccttggcccagctgacctgcttcaacaagtctactcaacagtataaccgcctaggaataggaatctggaatctgcgggagaaacgaccatcttcttttcctgcccctgtttgaatgatacacaggagggccagtgggactgtagatggttgagaaacaaccgcaggaaaagcagaaaagccatgtcagaagtggaatagcccaagatactgacaccaattcccaagacatcacaacctacccgaagcaccactgcctatggatagcaaaggtctgaccatatcaccaggccctcatgggctagaatcccatccttgatcatacccctaatctaccaccactccctgcaacgccttcaccaacccgagagcctaataccctccctgacccatagctatctcctggtttgagtcaccaggtccaaggtaatgcaagagggtgttgctacggatggtactccaagcttcaggtgtgttgagactagcaagatagtaggtaaggacagcatgggggtggggtgcagtgtgtgctggacgatgaaaagctgagaaaacaaagaggaggatcccacaggcaacagctctcagaacacctctatattcaccatatccaagaaacttgatggtatatacatctcttcagaggacaccaaaatgcaaaatcaaaatcttacttcatctggacctcacctgctggaaagctggggaaggagttccataacatgacactgaggaaaaaaaagcaagaaaaagcactctgaagcccagacttgggggaagactgcagatttctggctatcatggtagtgttcaccatcaaaaccctcagatttcagacgaaaagaacaagactgcttcaaattgccaatcccagacaaacagctgttaatactggatagccaaggagaaaggttccttcagcatctcatcatgcagtgtcctcagtgcacataagacaccagagaagatatgtgtgactctactcagaaaagcttagtaaagacttgttggttaaattggcacaaacaagacagagtagattatgagttctaaacttgggacatggctctgtctccactaggcaatgggtctgctctcagtggggcaaggaaggaatatttagagatttccccatccccatggctccagacttctaggagaaagattcaggtcaaaaagccttaaactgtgtgtcttcaactgatggtctatataagaggttcaaattttaagaaacgtttacgaatctctactatttaccaagccttgcactagccatgctagacacagtagctcaacacactcacaactctgtgacatcctttttctgatctgtaagatcagaatcaggcaaggtacttcatcccccctagacttactcctacaaatctggagtcacactgaccctgtgggattatggtcacacacatcagacgtgtgaccctgggactttcggttgaactcttggaacctcagctttccataacagatggttatgaggattaaatgaaagaccacattgatagaaaaagcttagcattgggcctgacatataatagatgtttaataaacacaagtttgttccttccctcccattccagatccggtgtttttgagaactgtgttacggtcaggtgatgataactggggcatgtctgctgccctgaataaataagagcttatctttctatctcgagtccactctaagtggtcagaacttgagtagcactaaacatatacctgttgactgactggctcatattgggtgttgtggaaggagcacatagcacctgggagcccagaggcctgggtggaagctctggctcctaccctagcttgttgaatggtcttgacctctctggccctcagatttctcatctgtaaaacaagcggaataaatcatacattctgattctacttttttttcacattactatgatgtgttaagccttcccaagcccctctgccagggtcctgggctgcaggggtaattaaatgcttctctattttccatagtttgttttcctggcttatgtctagctggctttctgtgacatgacttgtcaacacatataagcaacaacttctatgtcttaatgctttcttttcttattctctttgaataagaaatggggaccaggaatgcagtggccttatgtttggtaaaacaccactcaaagtgtaaaatgtggaactaattcaaccagaaactaagattgctgtgggaagcagcacagctgctttaacccctgggaacagggacacattttgaaggcaaggtagcattaggaggggttctcctttggtgaactggaactaatcaattcaggccattgtggggggaatttgcagacttatgtctaagcctaacaggaccctggaggtgaaggtccaatttagcaaagatggctggatccagagaagatgtgaggacagagaaggagaaacaagagaagtatgtaggaagaactgcaaaactccctattaagtgagactataagagcaacaaatatgtatgattctcagtgatcaggagcaaggaaaaggaaatgggcaaaaggaaaaaaaagaggtgactgaggacctctgaaatgtgcatcagtattttaacagaaccacattgcccaatacaagattcctggtcagtgcactcaagtagaacggccatcttgttaaaaacagccactattgttctggctagaagagaaccccaacattaaggatctaccacataagaccttctggtagttcttttttttttctttttttgagacagtctcgctgtgtcacccaggctggagtgcagtggcacaatctcaaaccactgtctgcctccagggttcaagcgattctcctgcctcagcctcccgaatagctgggactataggtgcataccaccacacttgggtaatttttgtatttttagtagagatggggtttcaccatgttggccaggctggtctcgatttcctgaccttgtgatctgcccgcctcggcctcccaaagtgctgggattacaggcatgaaccactgcacccggccctgatagcagttcttttgccaccgtagctctctcaagaaggcagggaccccaggtgagggcaaagagttgatttaaatgctcttggaccagttttcttagggcataatccagaattagctaggactaactcaggtgtcttatatttacaacaaatatctagacaggatcagcatttccacaaggactgaatgaaagggtctatgataaaaacttgtttcttgaaatattccagaaattagtatgccaggaccctcaagtttttccctattataggggataagagtggtttcaaaggagactgttccgaccaggaggtcccatccctgacacaccagtacttgggagactcaacaggaacgaactgaagtcttgttgcttttaaagaactagaaaggtaagcttcccatctgcccagcactcagagggtttgggtggtatccacataacagaatgctgactgggcagctatttagccctgaaacaatcgcctagagcagaacccacctgtgttggatggagtaaagcctggcaaggaggggctgttgaggcccgggagcaacacaggaggaatgccctggagcgctggatatgctgtaggaaggttaagggcctgaagaggggtgttgtcaaacatcccttgctgctgagctgccagtccaaggacctcgttggcctttttaatccggtccaactcttgttgagccatcaactgacgtacggtggctgggtcaaagtattctttctccttgtccagctggcttccaatggtgtctttaactttggagatatgctgttgggaaaagatatggtcacgtacagacagccgagcgctgtacttgatgccacacaaagtgcactctgttttgggtccctcataactcgtttggtttataccaaaatgcttggccatgcttaacttggacttcttttcttttgcccgggcattctggaaccagacctgaacgactctctttggcagtccaatgtcattgcccaggacctcacattctagcatagtgggtgtcctgtagtcattaaagcatgacttgaggaccttcagctgcagattggtcatttgagtgcgaaaacgtttctgcccaggccgatctccgctgtcaccagatttgcctgcagatccactcgcaccaggactcggggagcagggatctgcaaggcttgaggtttcactgtagtccactgtaccttcattgtcatattccttgctataaaagctcggggccgggctgaccagaccagatgacaaccgatcttcatactcagacattgccatcatggccgctttggtcaacccttcgttgggtgcagaagaggatttggtttcagttgctattcccgttgcactgtcgttatctgcgttgccctcgtctccagttgtggtatctgtgattgctgtgttgacagaggaacagtcatcgttgtccagcttagtttggtcaaagtttagattaactgaggacatggaggggctttcaaagtcttcaatcccttccaccttaatggaggaagggcttagaagagttctgggtgacaattccatggttttactcacaggtgagagggggacaccctgaccatcactactgcttgggggtaggtgggaaaagctagttccgtcaaaaatatctcctttcatctggagtcccccatcacagtctaagagcatcgcagacagagttaggttgtagccagctctcttggcttcatgccagtgacgggaccggatatgagcctcaagagcagtcttggctttgaagagcgctctgcaaaaagggcatctcctgtgggcctgcgctgggcctacagcccggaactgtcctttcctttcccgagctcgggtgttctgaaaccagacttgtaccacacgtttcttcaagcccacctcgtgtgcaatgtgatccaacatctttcgagtcggattggaatccagtagatacttctggtagagaatttctagttgttccggtgtgatggttgttctcaaacgcttgtctctctgaggctcttctcctcctgtcccactgtcgttttcgccagggcttgcactggccttttcctccagcttcctcttgagagtgttcattgtggaggttggagttgaaggagaagtggctgagcttgctggaatctgaggtatggccccagagagcagctggctggccaggagtgggttactgggatcaaagagcatgaaaggcatatccagggacctgtccaaaaactgggggtggatgaactggttctgcgcgctcaggaagtggagctgctgatgctcctgccagtgctcaaatgacggaaatgccaacttacactggtcacactggtaggggattagctgaggaggtaggtttgcgagctgttgaggagttgatgtgtggaggggcttgaggggcaggtgggagagctgggaaggactggggctcgactggggtaaggggcactgtggagggggcgcttgtggaggaggctgtggcaacgaaggcagggacaccagctgggggagcttctgctggggagtgttggtcttctgctcgggctgctcttgctgctgcagctctggctttggttgtccttgcttttcttgggtttggtttggctgtgcactgggagcttccgccagctttggtttctcatcgcctgcctctgtttttgaattgaaggtggccagttcctcagcctccgctgtaagctgcaagaaagcggaggaagctgtattattggctgatggtgctggggcgctgtaagcctgtgagggcatcggggtactgcaggatgagctggtaggcgtcaggatttccatggcatccatggaatcctcattttggctgtcgtcctgcccctcctcatcctcatccttgtaacacagcttcttctggtgcttgatgagatcaaagatgcgctgaaacaccaggctacattttttgcactggtagttcaagttgcttgttcgaatgtatctatcatttgtaagctcacgccgctctccatctttgccctctccctgattctcataattcttcctggccttctgtcgggcattctgaaaccacaccactatcactcgggttggaaggttcagtaaattagagagttgctcaaattcatcatcctttgggtaagcattggcatcgaagaagtcctgtaagaccctcagctggtagtccgtaaaccttgttcttgaagacctcttgcttccccagtactcctgctttggaggttccggcgaagggggccgggagtcaatcttgagctc

SEQ ID NO: 2804 - DNA, 1836 bp, Homo sapiens
ccaggctgtggcacagcccgcacattgttctgggaaggtggtgtccctccaagcccaggggatgctccatagagagagaggtcatcccgggcataaggaaaactcagtgtctggggggcaaagtccaatgggcaccgtggagtgagaggcggctccagcttgaggcctggagagggtgctgggagaggggcagaggggtaggggtaagcgtccagcccccagagtacctttgagaaaaacaaaatgcattaatttgggccctaggtcagaaaaacaaatttaagaaacaaatatgcttcaaattttgttcacaggaatatactttactcaattgttaaaagctgaaaatagctcaaaagaaaagttttcttaactctgagaaacaaaaaggatcagcaatcagctgggactacaagcgtgtgccaccacaaataataaaataaaatatattaatgtttcagataataaattgtagcaactctggatactaaccactacccctctgccacatgcacacagcttcttgtttttgttgtttgcttatttatttagtggcctggctggactattttagggaagtttatttcccggctgtgtgcagtttctgacgtcatgcctaagaagccacagccttgtgcgtgtgtactgtcaccctggaatgacaatggctttaagatggctttctttgtgtctgttcttgagctttctgttaacctgtatattagtatcacacaactgttagcctctactaactgctgactggttcctctattgttttataatcacttgggcataaatttctccacagtctgatcaaattaaattcaagcccctttgctctgttgcgcaggctggagtgtagtggcacgaatatggcttactccagcctcgacctcctgggctcaagcaatcctcctgcctcagcctcccgtgtagctgggaccacaggtatgtgccaccgtctctggccaattttttttttttgagatggggtctcactttgttgtccaggttggtcttaaactgctggactcaccttggcctcccaaattgctgggattacaggtatgagccactgcatctggccaataaatgtttatctgccatatggccttaagaaaaattccagagaatgtgaatggttgtttttaaaattatttttcatcagttatggttgttttgtctgcagagctcctcctgacagcattccaaatgtcctcttcctaaaatcttctctttaatcctagtgttctaagatttcacaatgatgagccttggtgagagattttgctttgttttatatacattcattttgctaggcactcactagactctcaattaagcacttctgtcgtttccgaaaacgtttattgtgtttttaactctttatcacctattatctctgtcctctttttcaggaagttgaatcagtcagatgttgaatctcagattgatctaattttcttattttttgtatcctgttgttcatctctgagtctttctgtgtaactttctgaaagatttccttgattttatctttctaccactctctcacattttaaattcttgttctctgattgctcccccttctatggcatccagttcctgttttgtggatgcaatatatcttccaatctctctgagatgatcaattgcagtttcttcaacattttcttctgctctttgcatcatctttgtttcctctgagttccatttgttctgctgttttggcctctctcttacatgttggaagcttccctcaaatctttagagaagctgagcatgacggttcgtgcttataatcacagctactcaggaggctaaggtgggaggatc

SEQ ID NO: 2805 - DNA, 1552 bp, Homo sapiens
gcaggttggaacgcaaacccagtctggccacgtcccgtgaagttgtggacaaaatgtttcagtttctgttcacctctggtgtgggggaaagtgaaggaagagaatgaaggtgagtccccgccgttgcaaaccttcaccaaaccacgcggcccagttttcgtgagtacccctgtgtcccagagaggaggacccagcgtcctcggctctgccgcaggccttcttggtctggtgggtactcgaggcagttgagaaccttgctgagctgagcgggcacctcgccttgcctgctggttcgacacctgaccccctccccctgggattatgtacacgcatcattgggcttcatggatgtggaaaggggagcaaaggatggtttggggggtacgtccggctttagcgagggcgtacgcttcagccccgaccttgtcagtgagttgtaggcgttgaggctgggctgcctcgagacagtcacggcctggccagatggctgggagctgtgcacctggatggagtccaccctctgcggggcgggcggcgggttgtctcccctgccaaagctctggtttctggagaggtgagaggaattggaggagttagtgttgtttcttttgagagtggtggcctggtggcttctcgtgagcgagttcgtggggtagctcctcttatagtcaaccccgtaggaagaggagtggtgcatttccagccgcttgcttagaccggtctgagacagggaggctcccgggggacccagggaggcctcccgctgtggaactttggggggcaggctgtccaggttctccacaaggttcaccccatggttgggactcttgctgctgagatgttccttgatggtcttatactccagtgtggcggcctggtcctccagcgccatctgggccacctcgctcattttgggctggtccacgtactcatgctggtagccctgctgcgtgatgggcaggaccaccacgctggggatgtggctgggggaggcccgcaggggcaggtccgtgggaatcacaggggagcccatggggggcatgtcctttgtgcaggcattgatgaggttctggttcctctcccactcgcggctgccgcggctgggcttccgcttctgctgcagcgttggggttgactctggggtggggagggccgtcaggtccaggtggtgctggtctgctttaatgagcatcttggccgtgttgccgggagtggcgagcttgccgttgtgcatgagtggcgtgaggatggcctccggctttgggtctttggattgagtgtccccaaagaggccgctgagcttggtgacgctgctcatggagccccggcgcgagtgggtgagctccttctccttgcgctgcaccacagccacgtctttgcgccgatgatcacagacgcagtagacggtgatgcccgagaagacggcccccatgacgaaagccaggatgactgcaatggccaagagggtgacgggaaccagctggtcgtggcctttgagggtcctcctcccttcaattgtgacatcacagttggttgctgtggaaatgattgt

SEQ ID NO: 2806 - DNA, 11144 bp, Homo sapiens
ccaagaaaaactcattccagttcttttgcattaaattctcttataccaaaaaaattgtttcaaaagttgcttagttgttatagaagatgattgcttatatgataaagaaatgttaaggccttgataatattcaaaagcttctgtataaaaacaataccatggaaattaatgacagagtaaactttctgaattaaagttctctttcaaactatgagtaagaggagaattagctggcttcttttttcttttttttgaggcagggtcttgctctgtcacccaggctcaatcacagctcactgcagccttgacctcctgggctcaggtgattttcccaccttagcctcctgagtagctgggaccacaggcatgagccaccacacctggctaatttttgtattattttggtagagatgggatttcgccatgttgcccaagctggtcacaaacttcctgccttggcctcccaaagtgctgggattacaggcatgagccactatgcccaacctcagttggatgggtttgtgtgtatgtgtgtgtgtgttttgtttgttttttagtttttgagacagagtctcactctgtcacccaggctggagtgcagtggcacaatcacggctcactgcagccatgacctcttgtgctcaggcagttctcctgcctcagcctccttagtagctggaaccacaggtatgtgccaccacacccggctaatttttgtatttttttgtagagatgggttttcgctatgttgcccaggctggtctcaaattcctgggctcaaacaatccacccacctctgcctcccaaagtgctgggattacaggtgtgagccaccaagcccagcctagctcctctacctgaacttatttttcattatcctaaagtgataaaatagatcaagaagatcagaacaggcttaaattgatgctataaaaccaattactctgtattatctttgcaactcttttgtaagtctaaaattgtttgaaaataaaagtttattttaaaaattactattctctttcctattcaacacaaaacttatttcataaagatgcttacattttgtttatttccctggaattttagatatttcttctgttagagtgcctatcctgctataaaatcacattttacctaattccattgtttaaactccatgtatttatggtttagaaaaataagggatctggcccagcacggtggctaacacccgtaatcccagcactttgggaggctgatgtgggtggatcacttgaggccaggagtttgaaaccagcctgggcaacaaagtgagaccccttctctgcaaaaaataaaaaaattagctgggtgtggtagcgggcgtctgtagttccagctactcttgggaggctgaggttggaagatggcttgagtgcaggaggcgaaggtttcagtgagtcgagatctcgccactgcactccaccctaagtgacagagtcagatcctgtcccaaaagaaagagagaaaaaaagagatctgtcttgaaagaaaatatgagggtttgtgggcttctgagcaaaagagaaagcaggcatgtgcctcttcaccattgttaataaagtgggctttttttctttccatgaaatgttcaaactaattaccgctttctgtatttctgaaaaatccactctaataggaacttcatattttactctatgctgtaaaaacagaatctagttttacagtggtatataaaagttgcttttgagcaaaagtaaacatttaatctactttcttccaaatattgtcataaatgaggaagctccatttacatgagttttacctatatattttagatccataaattaagagaaaaggaaagtccaaagagaataagggaaaaaaaatgattaaagaggcagggcacagtggctcatgcctgcaatcccagcactttgggaggccgaggcgggcagatcacaagcccaggagttcaagaccagctgggcaacatagggagatcccttcactacaaaatatacaaaagttagctgggcatggtggcgcatgcttctagtcccagctacttaggaggctgaggtgggaggatcgcttgaacctgtaaggtagaggttgcagtgagtcaagtttgcaccactgcactccagcctgggtgacagagcaaaaccctgtctcaaaaaaagaaaagaacaggtaattttaaattttgatggaaaattaattgaatttaacattttaaagtaagaaataggcttaaacaggaacagacactagacatataaagagttggctaacagtggaagtcagtcgtagtaaaatcaaaaatctattttgtggactaaaaattcagatgatctgaaaataaaagaaaggggtgtgacttggagaacatctgaagagcctttccttcaagagaatttcgactagtcactagtggctttctatgtctgataaagagatccttgtcaaccagcttccgtttcctcctgacctgaaaagtctatattgggcattccactatgtgacttgctcactaacgtgggttagcaaacctatagagaattctgttacatcttcattgcattggcataattcctttccatgttaaaaatgcctgaaggttgggcctgtcatacttactggtgccttggaagccccggaaaggagcagtctctctgtgcgggcctctcttcgtggtcccaggggctgggataattcaggataaccttctgcacagggtgcaggcctctcacactggctccaggcaggggctgcccaggcagagccggctggatcacttgctggtaggctgctcgagggtagtcatggccatctgtaggtgaagacaacaaagacaacagggaacatcaactctagctccttcgtgtgaaaggagtcataagctccatgctcatttgtgtcttgatcccagctgaggggtccagatatctgttaccacctctgtgatgtttgccgtatttctctactgttaattacttgagtgttttcacgaaattcacttttttttgtcctaaataaaaacatctgcgaaatcaccagtttggtattccagctggagagctcaaaaaacttttcaaaaaactctacacaggctcctcttttcgtaagatacttaggaaaatccaaccatgaagaacctctttcacaccaccattcctaccacaatttccttcatgtcccgaacccaaggctaggaaaaattatctgtatgatagatatagaatcactgctctgtattttcctcccccaagtggacatacacgtgcatgtgcacacacacgtgcgcgcacacacacaccccactctcctcttaagaagaggtaaatgaatgaaaacttggctcatcctcctgggaactagccaaccaactggcaataccctccaactcccttggtcctctcctgctacagcctacgtgcacttggagccagggctgcttgaagagggctgggctcagagcaaagccagagctggcagtgacttatgtgaatgtgcaacctgggagaaagtgggtcccagccaggaccaggagcaggagggtccccagggaagggcagcctgctgctgccagagttaagcataggagagacctaatgcttaatcacgcaaaagaatagaactaaaagcccagaggagagatgcagggaaccaagtaagggtgagagggaagggctctgagggaatggcccaggcccaaagggggtaaggtgttgggaaatacgagagatgcaagaggactgaagtgagccacatggtagccctgcaagatgagcaatgagcacctcctagtgatccaagcactgcccctcctacccacataagcagtaagacgatccaggaggaggcgtaactagttaggacaagaaggaaggtgttttgttttgttttttaaaaatcctcattgatcttaaaattattttgattcttttaagatcaaccctcattgatcttaaaattattttgctgattataaatgtaataatcaagtttgcctgccatgtagataggatacatatatggatgtacagcaaaataaaactggcaagtaaacaaaaaagtgactgataggttgaaaccaaaatgagaagctgagaatgtggataaaaattgattcttaaggccaggcgtggtggctcacacctgtaatcccagcactttgggtggccgaggcagacagatcacctgagttcaggagttcgagaccagcctggccaacatggtaaaaccccatctctactacaaatacaaaaattagctgggtgtgatggcgcgcacctgtaaccccagctactcaggaagctgaggcaggagaaacccttgaacttgggaggcagaggctgcagtgagctgagattgtgccattgaactccagcctgggcaacagggcaagactccgtctcaaaaacaaaaaaaagaactgtattcttagcttggcaaagcagtcaggagccatctacgttttcaaaggaacattcaggggaatgatggcctcaagtacagaacaagagataaataatgtgcacgttcactagtgtggcctcctccaggttcccagtgcctagactcaggaaactgtttgggtgacctggcgatgtgcccaagctagtctctcaagtgtggtcagattccctggactcaatctattattgtctcctttgacccatgtcaccacctgggtccttccagtcatgcttcttctggcaaaagtgaccatgcccctccatcccagactgtctcctggcaggaccccatgacccttgccctgatattgcttaggcctggtcatgacaagtagtaggggtttaaagagggggaggaggagaaacagatctgcctagatctatccctgcacctggatgacaaaggagactgggacttgaagggactgttctcagaatggaagacaggcccacagagactcctatggtctaggacaaggtctactgcacaggcttcaccttggcagccttctcagggcagggcggatatattccagggggtccagatcaccagttgcagtttcagggcaacagagcaagtcactactgctcctttccctcagtttaaaaaatagcaaaaaatgccactgctatcaggtccccaggtaggggccagccctgcttttcaatgagccttgcatgagcagaccctttacaaacccagctgtagctagaaccgtcttggtggactgcacttacaatccaccctgctagatcaggttcccgcccctgtagatcttgcctcccactacactctcactggcccactaagctctggcttcattttgaatatcccaaacttgtcctctcctttgggatcctgagtttgccaccctctttgtccagaatgtttttgccctagattttcacagactgacttcttgccattcagagctcagcccaaatatcacctgtccaaagagtcctgcctcttcacccagttactttatcccattccctattttgctttcttcgtagttcctatcatgggtttgcataagtaagcatgacttttacctgtcaacttcttgcctgccttccctactagaatataagctctgtgaaagcatggactgtgtcctcttaccaccatgtctccaaggatagtactggcacccaggggatgctcaatagatgaatgaatgaaggctcaatagttacaaagccaacttacagaaaaagagaagccatttaggactgcacaatctattaatactttctagggcacaggtctcctagaccaggggctcccaactcccaggccacaggctggtatcagtccattgcctgttaggaaccaggccacacagtaggaggtaaacagtgggtgagtaagtgaagctctgtctgtatttacaaccactccccatcacttgcattaccgcctgagctctgcctcctgtcagatcagcagcagattctcacaggagtgcaaaccctattgtgaactgcgcacatgagggatctaggctgcacgctccttatgagaatccaaggcctgatgatctgtcactgtcttccatcacccccagatctagctgcaggaaaacaagctcagggctcccactgattctacattataatgagttgtataattatttcattatatattacaatgtaacaataatagaaataaagtgcacaataaatgtaatgcacttgaatcatccccaaaccatccccatccccagtccatggaaaaattgtcttccatgaaactggtccctagtgccaaaaaagttggggaccactgccctagactgtcttaattctcttctgctgtccatttgttttgggggttttttggtttaatcggtgtctccctccagaagtaggaaggagaaacacaaggtaaaagaggagaaactttgccagtggccttaaaagcctttatgaggaaaaagctgaaagtatcttgagaagtttttaatgtttgaagccatttttcttcctatatccattaatgaatggctaatattgttttatttgctttaaaaggactaccaagctctaatcatagggtttatttcttttccagaaagcggatgttggtgctgttaatcaaaagcctttgaatcaaggtcatatgatttctaacagattatttccctcacaacatgtctttgtctcacagcaacaaatcatatcattaaaatcaccaaggcatgtgggctaagtgtttgattagctgtaactttcatttcagaaacggccacctgtggtaaaaagttatgccagtttatgtgagcagatgaaaatgatacacctcatcaatttttaaaattagggtactgacaatatagtcctccatgctgtccttttattgttgaaaacaaaggaaaactgagtatcagtggatcagtaagaaatgagtgttcccttttgtaagtggaatctgaccagctttgtctggaatttgactggttgtatggaaaaggttcctaaataggctggacacgcctgtaatcctagcactttgggaggcctaggtgggtggatctcttgagcccaggagtttaagaccagcctgagcaacaaggtgaaatcccatctctacaaaaaaataccaaaaaaaaaaaagaaacaagaaaagttgctaaataaaaactatgtttatcaagtaaatgaccatcatttcactgctaaagttttaatcatttttttccaattactatgacgaaggcttgccaatttacttgggtactatacatgtaaaataatggctaacatttattgatcacttgctacatgtcaagtactgttctaagttccatattgagaattatagagttcaattttccattttcataaagaagtttaactcagaataaaaatccagattcctcaccatggcccatccagccttcatcttctagcacaccattctctccttgctcactctgctaggccccactgacttgcttttggtatcttaatgacatcaagctccttgcttccttagctccttgcttccttgaccttctcatcctttaggtttcagctcagatgtctacttaaagagattctctggtcaacctgtctattaatgtctgttccaacaaccagttacttcccttatagcacttataatttgtcattctgtttctgacttctacttcttatccatctctccagtagactgtgaattccatgaaaacaaggacggtgtataactatttgctgaataaattgataagtggatggacaggttctgtttccaaatttcattgactcccttctttgcttccctcccaggccaaaaaaaaaaaaatggcttttccaaggcttcacattacaaagactctactcatgattaaggctcactcctttccccaggaagtagagaacagatttctttttattcattcaacaaatatttattgaacctcgatggccaggcacttggtgaacaaagataaataggatacagttcccttgggattagctcaaaataaatggagagagaaagagaaaatctatgtgtctgtgggtgtctgtttttaaacacaaacccacactagttagtgtgtgagaaggggagacatatgagtcgacagccacctacttgagaatccctgttcagaaatagcttccctgcggacttgtccccaatgcctacagttccatcaagagagttaattctgtaggagagggaaggtggatgatgtgatagacaaatgatttgctagcatggtaactcctcagttcagaggcagtgttaatcacaaagcaaaaatgaaaatcttgcacaatcacaaatgggcgcccaggactgtatgttatttgtcaatcctgtgatcttcttggcctgagtacacacgatcttcatgttactgagcttttaccatttggaatatgtaaaccaaatcctaaatgaggttttccatttatcagtcacaacatgcaacatttttcttccttattaagaattaaaagagtttatgagagagaaataaaatctgattttcaagttgtcaaaaaaaatcgtgatataatgcaatcagtttagccaggaaacaaaatggccaatataaactgttgcaggaactcccacagctgtaagcagctgtcgttcctgaaaggcaactccttctttatcatttcttccatctggtttattttttgtgcatgcattctagcatacaaataatccctccccttttttttttttggtccacaggtacaattgtacacatgtacctgtaattttattctattcagtctccttggtagagaaagcaataattttataataaaatgagggctctctagacttaattctctctcttttcccaatatatttgcatcatgagtttcatttgattgcacagccatgaactccatgctggcgaccttcagtggaaggattcggaggcagcaggaggccgacttctccagggggtggggtgaggagaaaacgtagacttattccctttcttatttccacctactttgaaaactttttttttttacatgaaaggggcgaccaataaccatttttgctttaacttgcaaaaagcttagatatgccatttgcatggtgatcattatttatttatatattcattaatgggtaaggaagtaatgctcttctaaagctgagtagagccacgtagccatggtttccaactgcacaagcatcccttaggtgaacagctcttttgaagtggttttgttagcaattaagtgcagttatagccctgacatgaaactaagcatttgtacacctgccatgaatgcttaaaatctgtgccagtgagtgggatctggaagtagaggagcaccctgcagaactgggctacaggatgcttttaaataataacaataataactaaaagctgttagtattgagggcttaccaccagccagccactttcctagtgcctttaatacattatctcatttaatcctcacagcaaccttcgtgggactcattgctgctggaggcctcataaatattctagggctacaatgccctgcaaaaaacccatcagcactggcaaccctgaccctcttctctgtggttagatgggagccagggccaagggacatgcaaggtgaattggggcgagcttgccttctatatgtgctgtttccctttgttcttttcagtttttactcatttcttaattatagaagtaatacctgtttgctatttttatttttatgttttctatgtgtttttgtttttgtttttaagactgagtctcattctgttgaccaggctggagtgcagtggcgcgatctcagctcactgcaacctccaccttccgggttcaagtgattctcatgcctcagcctccccgagtagctgggattacaggtgcccaccaccatggctggctaatttttgtatttttagtagacaacatttcaccatattggccaggctggtcttgaactcctgacctcaagtgatctgccctcctctgcctcccaaggtgttgggattacaggtgtgagccactgcacccggccgtttgctatttttaaaaatcaacaaaagtatatgaaattagaaggaaaatatacctgtctcctcttaattccctgctcccctccccaccaagatcaccactagatccttctagacttaatatgtatatataaacctatatagtttttaaaaaataaacatggatgggatcatcactgcagctcttgcctttcaacttaatctttttgatgtcagaatgtgtattcagtgcaacatgggcctagtagtccatagtatacataaatcacaaatgacttatctggccccttattgataggcattgtaattgtttttgtttttactctaatgcaacaatgctttaataaacattcttgttcttgtatttgtatatgcttgtttaatgtttctataggacagattcctataagtgaaactgctgggccaaagaggaagcacatataaaactgtgatagtgaaattgccttctgggagattgcaccaatttacactcctatcaagagtgattgggaatattcatttctctctaactccactaacactggatgttgtccaaagtttttatttttgcacaactaatcaaggaaaaggtatctttaagaattttgcacttcttaaatctaatgatattgagcttggtttaattttcatattggctatttgtgtatcttctgtgaattattcccctctcctatccccattctctcccctctgcctttcaacacctcttttcgccccaaggatcctagatgtctctccccaaccccctaacagaaggaaataatacagagagcaaggggatggtgaaatgatgaaagaaagcaggtcctggggcaatagggacaaaaagtgttcccagtcaggagtgtttgccttttaaaggagcctgccccaatgggacaacgctcacctccaaagactggattgccaatggcgctgtttcagctccaacaacaggaaaagtattttccgtgggaagtattttccagaaggtcctgggaccttcattataacattgagtcagtgctttttttgtctatcacaatgaggctttcccttgttagtagtcagagtcagctgcttgggactgtatcacaaagccttaagtattcacagttcttcgcattaatctaaggagttaatcggaagtgcagttaaaaaca

SEQ ID NO: 2807 - DNA, 21334 bp, Homo sapiens
gccctcatctgaggtgacgggaaagggccgggaaatttccacttctgaataaaatgactgctgaagtgatgacccgcaagaattggtcaaatttggagtagacttcaccctgcgcttggtgaaacttctacgtcaaggatgcaagaggcgccgaagtaacgcagctcccacctgtcgctctccgctgggcgccgagactatggccggagaatagctgcaccgggattggagaaaggaagccatcagtcttaggaaggctccaccttcctgccattgcctggttggaggagcgtagcgtcagtcactagagcagtcaccacctctgggacaggtgaagatgtgtaacctatttgccgggggctatttgggagggaatagaggacggggagcgatgaggggacagtcgaggggcaaggccgatctcgcttcgcgcctcccgcctttctgagttgagcctagcgcgcgggtctgagggacatccggggagctgcttgggatggccgccttggggagactcgacccgcccgccaggacccggccgcgcgccgcagttcgggcgccttcgggcaggatcgcccagcggggccgcgttctcctgcttgcggacggctgcgggcctgagggctggacagcgccatgcctcagtaccgggaactgtcccacgtaggaaggtgggaatgccgcgaacggcgtgcggaatccgacctcaaggtggaacggggtggtgaagagtgcatgctccgaggcagtttcgagttctggtgctgccacttacttgctgcctgacttcggcgcgtttgctgtttcatttttgtgactttcaactcgctcctctgtgaaatgggagtaatattagtaccttcctcattgggttgttgttatgaataaattagatgataatatagcgcttagcaaagtcccaaacttacaggaaagactcatttttgctagttattgtctcctcttccttcaggaactctctgctcgcccctgggtcctgccagcccaactaattctagttctaatcagatctgtgtggtgcaaaacaaggctagctgtggtggtcttccctcctctaaggagatctcttcctccctatatgcatctctctatctctgtctttatcttgtcagtaaagaggggggttaaaaatattcagattctatagcgggcgccgtggctcacgcctgtaatcccaacactatgggatgttgaggcgggcggatcatttgaacccagtagttcgagcccagcctaggcaacatggtgaaatcccgtctttaccaaaaatacaaaaattgggctcggcgcggtgactcacgcctgttaatcccagcactttgggaggcctaggtgggcggatcatttgaggttaggagttctagaccagcctggccaacatggcgaaaccccgtctatactaaaaatacaaaaattagccagatgtgatggtgcgtgcctgtaatcccagctactcgggaggctgaggcaggagaatcacttgaacccaggaggcgaagtttgcagtgagccaagatcgtgccactgcactccaggttaggcgacagagcaacacatcgtctcaaaaaaaaaaaaaaaattagccgagcatggtggtgcatgcctgtaattccagctactcaggaggctgaggtgggagggatcccctgagcctgggagatggaggttgcagtgagccgagatcgtgccactgaactccagcctgagcaacagagcggtgccctgtctaaaaaaattaaaaaaataaaaaaaaaacggtttctatctaatcctttaatcagacatgaccaaaaaaggagtctggtggtttgtatggaaaatatcctttgacccagagaatgtccatatgataacagaatttggctgaaaaaaaaaaaaatggccgggcgcagtggctcacacctgtaatcccagcaccttgggaggcagaggtgagcggatcacgaggtcaggagatggagaccatcctggccaacatggtgaaaccccgtctctactaaaaatacaaaaattagccaagtgtggcggcgcgtgcctgtaatcccagctactcgggtggctgaggcaagagaatcgcttgaacccaggaggcggaggttgcagtgagccgagatcgcaccactgcactgcagcctggcgacagagcaagactcagtctcaaaaaaaaaaaaaaaaagtcattttctcctctcttacaactttaacaaaggcctttatatatctcaactgtgcaatatttaatatttcgtcatccttaaactgggatcttaaaattttataagaatataatgatttttaaaataactttaaaagttgattctgccaaacatttatttaaaaaacattttgaatatcataaacatttctttggcttagtaattgctcattttgacatttcacatgtaaaggatagtgttttctatgagcagaacatgtttgttaaatgttctttctagataataaataagttgtagaaaatgttaaaaaaaagtcttgtacctattctagagaactattttaatgtaaatgctatgtacactggctttagttagcatttgtggaacttaattagcctatatcctcagtgctgttaagttttcaaggcatgtgtgactaagtcacaacccaaactaataacaccaacaaaagaaacctggcactgcccaacccacttcaaagctggattatccagaattggtatggatacatccttaggcaaaaacaggtattgactggtacagcattacaaaggaactagttgtcatgcttactactgatacaaaaataatttctgatgcaactccctgaacaaactcattaaattctttaaacaaatacaatgactctcaaggacacagggaaaggaaatctggatatatatacatttttctcaatttatttgagagggaagaaaacactctctttactcagtgcctagcaactaaccctgagtatagctaaagaaatgtgattgagcaataatctttgtttcaccaggacctttacttgagatacttgtcagtagtttgacagtcagtatgggaattaggaactcctagtctcctatattttggtgactgctatatagaatctctattaaatgtgatttaatggctgggcatggtggctcacgcctgtaatcccagtactttgggaggccaaggtgggtggatcacccgaggtcaggagttccagaccagcctggccaacatgatgaaaccccgtctctactaaaaatacaaaaaattagccaggcgtggtggtgggcgcctataatcccagctactcaggaggctgaggcgggagaattgcttgcacctgggaggcagaggtttcagtgagccaagatcacaccacggcacttcagcctgggcaacatgagtgaaactttgtctcgaaaaaaaaaaaaaaagaaagaaagaaaatgtgattcaatagttccatatatactacattcctatggttttaaaatttgaaaactcattgataaatcatcacaatatcaagtgatacatttgacaaataaataaaatcacactcaggccaggtatggtggctcatgcctgtaataccagcactttgggaggctgaggtgggtggatcacttgaggtcaggagttcaagaccatcctggccaacatggtgaaatcctgtctctactaaaaatacaaaaattgggctgggtgtggggtctcatgcctgtaatcccagcactttgggaggctgaggcgggtggatcacaaggtcaggagttcgagaccagcctgatcaacatggcgaaaccccatttctactaaaaatacaaaaattagctgggcgtggtggcacgcacctgtaatcccagctactcaggaggctgagtcaggagaatcgcttgaatctgggaggcagaggttgcagtgagctgagaacacgccattgcactccagcctgggtgacagagcgagactctgtctcaagaaaaaaaatggagtggagatttgctcagtggcagtatcatagccaaaggcatcattattgctaattgaaaacttttcccaataacctgccatggccttgaaatatagtaagcattgggaattttgagtctctatggaataaagaagaaaaaaaagccagtgggactatttagaatctacttataatgtgtttcaaagcactgtgttttgaccatctttcagatcaagaaggataaaaaacacatggccgggcacggtggctcacacctgtaatcccagcactttgggaggcccaggcgggcggatcacgaggtcaggagattgaggccatcctggctaacacggtgaaacctcatctctactgaaaatacaaaaaaaattagctgggcatggtggtgggcacctgtagtcccagctactcgggaggctgaggcaggagaatggcgtgaacctgggaggcagagcttgcagtgagccgagatcttgacactgcactccagcctgggcgacagagcaagactccgtctcaaaaaaaaaaaaaaaaaaacataaaaactgtatagccgaaggatttttattttgttattttgtttttttgagacaggttctcaccctgtctctggggctgaagtgcagtggtgcaatcacctgctcactgcagcctcaacctcgcaggctcaagcgattctcccaccttagcttcccaaagctgggaccacaggagtggaccaccatgcccagctatttttttttaattatttgtggagacagcggtctccctaggttgctcaggctgctggcctctaacccctgggctcaagcagtcctcctgcctcggcctcccaaagtgctgagattatgggtgtgagccactgtgcccagctagcccaagggtttctaaaacttctgaaataataagagtcttcaaatcccataatatgagattgacaaactaaattatagatgcagggactttagctacatgaagttctttcacatgcaacctgcattttctccggacattttattcctatatgccaatccatctcagttcagcccatctatataagaagtaaaccaacatatttgttgcacttggaggtcatttaacctttataataatcctattcagattttacccattttatagatgaggaagttgaaacttcaaaattgttaaataacttgcccaaggttataaggccagcatatagaaaagctgggatttgaatttatttctgcttgatcccaaaacccatgctcttcccactatattacatcgattccatggcaacctcaaaagcagaggaaattcatcaatcaggtaaacatgcttcaaccattatatccttcttataaatctgctaatcagcaccctaggtgaagttatccctgactaccatcaaatatatcttcctcccttgtaatagttggaaacatttaaaacttggcttctggtttctccaactatattgttagtttcttagaccatggaatttcacattaaaaaatctaatagtttacacaaattagccaggtgtggtggtgggcccctgtaatcccagctactctggaggctgaggcaggagaattgcttgagcccaggaggcggagattgcagtgagccgagatcgtgccactgcactccagcctgggcaacagagtgagactctgtctcaaaaaaaaaaaaaaaaaaaatctgatagttaatacattcacatggttcaaatttcaaaaagaacaaaacaatttgacacagcaggcatgtggaaaaaaataaaatgggccgggcgcggtggctcatgcctgtaatcccagcattttgggaggccgaggtgggcgggtcatgaggtcaggagatcgagaccatcctggctaacacggtgaaaccccgtctctactaaaaaaaaaaaaaaaaaaaaaaaaaaagaataaaatgaatataaaatgaggaaaagagtatttttactttccccactaaatacctagacctcctctcatacacaaaccatattattaggtttttagatatccttctcaggccagaagcagtgactcacacttgtaatcccagcatattgggaggccaaaataggaggattgcttgagcccggagtttgagaccagcctgggcaaaataacaagacccccatctctacaaaactaaaaataaatacataaatttggttcaataggccacccaccatagttttcaaaaagcacagttatcaagataaaaattgttaaaggaagattacagattttttttgttttagctgaattgagtaaattgggttagaacaaggagatactggagtgtaggaaacaagcaatctggctgcagctttttgcccaggtatgagataatgaacaccggattagggaagtggctttcagaatggagaaaaagaaactgtcaataagtgtaatcagcatgaagtccaggcacagttgctcatgcctgtaatcccagcactttggaaggccaaggcaggaggatcacttgagcccaggagtttgagaccagcctgggcaacaaaacaagactccctatctctacaaaaaaaaaaaaaaaaaaggtagccaagcgtggaggtgtgtacctgtaatcccagctacttgggaggctgaggtgggaggattgcttgagcacaggaggtcaaggctacagtgagctatgatcgcaccactactcaccagcctgggtgacagagtgagaccttgtctcaacaacaacaaaaaaagaatcagtataacctttgcacctgatgaaatgtgggaaacaaaagagtataggaacaaaagttactccagatctatacaaactttctgaaaataaatgtggcattatgcatcaagatccttctttaaaattttatttccacctattagaatggctaaaatccaaataagtggcaataccaattactggcaagaaggcagagcagcaagaattctcattctggtaagaatgcaaaacagtacagccactttggaagagagcttaaaagtttcttcaaggctaaacttgccttaggccaggcgcagtggctcatacctgtaatcccagcacttttcgaggctgaggtaggtggatcacttgaggtcaggagttcaaaaccagcctggccaacatggtgaaaccccgtctctactactactactactactactactactactactactactactactaataataataataataattattattattattattattatacaaagcttagccaggcatggtggtgggtgctataatcccagctacttgggaggctgaggcaggagaatcgcttgaacctgggaggcaagagactgcagtgagccgagatcacaccactgcactgcagcctgggtgacagagcgagactccatctcaaaaaaaaacaaaacaaacaaaaaaaacccaaaacaacaacaaagctaaacatgatggatttactttatgtgtttggtttcagacagcaatgagaagaacttcacctaggtagaacattacttgctgagtcagccagaaacctccaaaccttcaactggacagaaacacagttagatttactgtaactctgtaactgaaaactttttttttttttgacagggtcttgctcctgttacctaggttggagtagtgcagtggtgcagtctcactacagcctcaacctcccaggctcaagccaccctcccacctcaaccttccaagtagctggaactacaggtgcacaccaccatgcccagcttgttttgttttgttttgttgtgtttttttgtattttggtagagacagggtttttgccatgttacccaggctgctctcaaactcctgggctcaagcgatccacctgcctcagtctcccaaagtgctgggattatagatgtgagccaccacacctggcccaaatttttaaaagacatcaagttgtagctttgctttttgcaaaagttaaacatctctctgcagaaaggtcatattggttgacaatgaagattaatccactcttcccccaggtgagtccttggtgaatatttttgtgtattgcttccattggaaggattgtactgaaaatatgagtcccagcagtaattctatgagctttctcacttcagtactaattaaaaggaaaagccgtccagcacagtggcttacacccataatcccaacactttgggaggctgagacaggcggatcacaaggtcaggagttcaagaccagcctggccaacatggagaaaccccgtctctactaaaaatacaaaaattagccgggcgtgatggcaggtgcccatagtcccagctattcaagaggctgaggcagaagaatcgcttgaacctgggaggcagaggttgcagtgagccgagattgcaccagtgcactccagcctgagtggcagagtgagactccatctaaaaaaaaaggaaaaaccaagagtcacattgagaaataagtaccagtaagtgtgtagttcagcccagatgttctggtctacagttatacaagctctttgacaagaagagggttctaagaactgacaatcaataagttactgggagaaatccagaactctaccttgtgcattacagtgaaccctctgcttcttctatcccacacttggtaaacctgaagctagtgaccccaaacatcctttttcacatgtcctcttaccactgcaacttaggcagccacacccaccttttgtagaagctctccttggctggtaccatgtccttctgccacagactttagaacatcccagaattggtgaaaattttgaatcttatggtctgagcactttttctgatgagagaacagctagatagcaaccgcagcagcaagaatcctcttattttacaggttatggtggcctggcatttagtgaatcagcacttttgagtcagaagaacccttgaggggtgttttagtttttcacaatccccccgccccgcctttttttttttttgagatggagtttcgctcttcttgcccaggctggagtccaatgggatgatctcaactcactgcaacctccacctcccaagttcaagcgattctcctgcctcagcctcccaagtagctgggattacaggcgtgtgtcaccatgcccagctaattttgtatttttagtagagatggggtttcaccatgttggccaggctggtcttgaactcctgacctcaggtgatccgcccgcctcggcctcccaaagtgctgggattacaggtgtgagccaccatgcccagccttacaattttttttaaatagaggagtaacaaggagtgagcattaggatcagtatctcccaataaaatctctgaagtgattttacatgacccatccattaccctctgatatttcctgtgagaacctgaagtacataattgcttaccacaatgagaaaggagcagaccaaggactccaactcaaagagcaatttgggcttataagtgaggactgagtcactctgaaggctgatcttggagactcttgtggagtgtttgaactcaactcagtttgccacacccctttttcatcaagacagtcccataaatcaggagacacagcatggcattcacctgcagggcaggtaacagtgccacctaccaagtgttctttcccaaggaagtggctatggccccgaaaggacacttgtagaaagtctaggccagacatgagtctgatataagctcacagaagctattaagaaatatagtggtcaggactctactctgaagcttttcacctagaagcccttcttagaccctggcatttacacctctgatgtcaagggaaaaaaaaagaaaagaaaaacagccaaagttggacttctccagcagagatttagtcaatgcaaaaggttcgtcagttgaaaagaattgcatcaccattcagagttatgcaggacatatgggcaggcctgttgtggcctctggagtttggttaaagccctaaactgtcccaatggctccacccataagctggcaacattttaaatcaagattgagccatactagagagtccaaagaaaacagcaatacttttctgtataccagggatttcaaatgaatattagaattcctggagagtgactgaagggctcagaaatatttaaaaacccttcaaagcactggttgaccactattcagagcctggtaatcctcatgcccaacaattactctcacaagttccctgttgcactctctgtataccattagcagtagtgtaattgatacaatctttagggaaataagtttggaggtgccttcattttatttttttgaaacagagtctctgtcgcccaggctggagtacagtggtgtgatctcaactcactgcaacctccgtcttctgggttcaagcaattcttctgcctcagcctcccaagtagctgggattacagacatatgccaccacactcggctaatttttgtatttttagtagagatggggtttcaccatgtttgccagtctggcctggaaattctgacctcaagtgatccacccacctcagcctcccaaagtgctgggtttacaggcgtgagccatgtgcccggtccttcttttttttttttttttttttttttaagtgcaactaccctttgatttagcaaatccatttccaactctggaggaaaagtggcacagaaaccctcacacattaactaaaaaaaaaaaaaaaaaatgtgtacagggacattaattaaaaccttacttgtcagggctaggcacggtggctcactcctataatcccagcactttgggagactgaggcagacggatcatttgaggtcaggagttcaagaccagcctggccacatggtgaaaccctatctctacttaaaaaaaaaaaaaaaaaagccagacagggtggctcacacctgtaatcccagcactttgggaggccaagatgggtggatcacttgaggtcaggagtttgagaccagcctgaccaacatggcgaaacttcgtctctactaaaaaatacaaaaattagccaggcatggtggcagatgcctgtaatcccagctactcgggaggctgaggcaggagaatcgcttgaaccttggagcaaaggttgcagtgagctgagatcacaccgctgcactccaacctcggtgacagagcgagactgtctcaaaaaaaaagaaaaaacattagccagggggttggtgcacacctgtagtcccagcttctcaggagactgaggcacgagaatcacttgaagctgggaaacggaggttgcagtgtgcaagatcatgccactgcactccagcttggacaaaagagtgagactctgtctcaaaacagacaaaccttacttgtctatcaataagtggctaagtaagctgcggtacagttataacatgacctacaatatacttgttaaaaagaatgaagaggccaggcacagtggctcacgcctgtaaccccagcactttgagaggctgaggtgggcagatcacgaggtcaggagattgagaccatcctgaccaacatggtgaaaccctgtctctactaaaacacaaaaaattagctggccgtggtggctcgcgcctgtagtcccaactacttggaaggctgaggcaggggaatagcctgaacccaggaggcggaggatgcaatgagccaaaatcacgccactgcactccagcctgacgacagagcaagactctatctcaaaaaaaaaaaaaaaagaagaaaatcagaaggctgattgtgcatggtacactgccaagtgagggaaaaagtgaaattatttcagttttttactagaagtatatcattttatttgtgcatatattgtttgaatttgtttacaatgagtatgtaacaccttggtaacaaaactattttccaaaaccaccccagttattaccttaaaaccaaactttagagagttagtagattttttttgtttttgaaaatctttattgttattattagtgtgtttatccaacaaattaagaagaaaaataaaatttaaaaaagttagaatgtacttttttgggcaaaatctagggagttacatttaactcagagaaatgtgaacttagggaagaaatatttcacttatactttgacatacacacacatacacgggtatattaccacaattttgttgttgtttttgagacaaagtcttgctgcgatgcccaggctggagtgtagtggcacaatctcggctcactgcaacctccgattcccaggttcaagcgattctcctgcctcagcctccagagtagctgggattacaggcatgcaccaccacacctggctaattgtgtgtgtgtgtgtgtgtgtgtgtgtgtgtgtgtgtgtgtgtgtgtgtgtagtagagacggagtttcaccatattggccaggctggtcttgaactcgcgacctcaagtaatccacctgccttggcttcccaaagtgctgggattacaggcgtgagccaccacacccggtgaattcttacccccacctggctagacggagtctcactttatcacccaggctggagtgcagtggcacggtctcagctcactgcaacctctgcctcccaggttcaagtgattcttgtgcctcagcttctcaagtagctgggattacaggcatgcactaccacacccagctttttattttattttattttaagatggagtctcgctctgtcacccagcctggagtgcagtggcttgatcttggctcactgcaacctccatctcccaggttcaagcaattcttctgcctcaacctcccaagtagctgggactacaggagcccgccaccacacccagctaattttgtatttttagtagagacagggtttcactatgttggccagtctggtcttgagcttctgacctcagatgatccacccgcctttgcctcccaaagtgctgggattacagggaggagccaccgcgcctggccatattgccacaattctcagagtatgctctatagattcctgcagccctcaagaccttttcaggggaatccatgaagtcaaaactattttcattataattctaatatattatttttcactatattgacttgcactgatggtacaaaagcaatgggggggggggctaaaaatttgctggtactgctgggtgtggtggtgcacgcctgtagtccctgctactcaagaggccaaggcaggaggattgcttgagcccaggagtttaaggctacagtgagctatgatctcaccactgcaatccagcctgggcaacagagtgagctcctgtttctaaaaaacaaacaaagatagctggtacctcagcacagtattaggtaatggtatcaaactgtactagcagtaaatgtattcttccccattgggcactcaaagcaggaaaaggccgattttattaagaatccttgatgaagcagtaaaaattaattttattaaaacttgacccttgagtacaagtgtttttaatattctatgtgaggaaatgagaaggatacacagagcacttctgctatatatcaaagtacatttgttatctcaaggagcatagctattttggttgcaagctgcattggccttttttgttttcatagaacaccatttttacttgaaaatagcactgacaggcaaatgttggtaattcagatgtggatatttggcagacattctctggagcctgtcacttgaaggaaaacacctgacaatatttatttccaatgataaaattcaaaacctttgagcaaaaatgagaattttggaaaattgtatatattcctggttgacagttttctaaaagctttaaaaacttttttgatgagataaatcatggtattaataaatgtgttttttatattatataataaaaatgtgtcaatatttgaaagatctgcacagttcagtgaaccaatgttttccaaatgaccaatcatgatgttacaaaatcatacatgtgtaaaagatccactgaaagtatattaggccaggcgcggtggctcatgcctgtaatcccaacattttgggaggccaaggcaggtggatcacttgaggtcaggagttcgagaccagactggccaacatagtgaaaccccgtctctattaacaatacaaaaattagctgggtatggtggtgagcacctgtagtcccagctactcgggaggctgaggtatgagaatcgcttgaacccaggaggcagaggttacagtgagctgagatggcaccactgcactccagcctgggcaacagagcgagactccatctaaaaaaaaaaaaaagaaagtacataataggcctgtaatcccagcactttgggaggctgaggcaggaggatcgcttgagcccacgagttccagaccagcctgggcaacatagggacaccctgtctctacaaataattttttttgattagggctgggcaccgtggctcatgcctataatcccagcactttgggaggccaaagctggaggatcacttgagctcagaagttcaagatcagcctaggcaacatggcaaaaccctgtctctactaaaaatataaaaaattagctgggtgtggtggcacatgcctgtagtctgaggtgggaggatcgcctgagcccaggaagtcaaggctgaaatgagcagtgattgcagacactgcactccaccctgggtagctgagcaagaccctgtctcaaaacaacaacacagaatgaaagtatgtgatagaccaatggattttaatataacagagtatggacattttatagttatggtctcaacctttaagaaactaacagttgttggattttggtgtattgaagggaatatccagttttctgaaaaatctgttgaagtatttcttccttttccaactacatagctgtgttgagccagattttcttcatattcttcaaccaaaacactcatggatttgactgaatacagaagcagatataagaatcaagcttttataaagccagacattgaagatgccactcttctcattaaatttttttgttttgaaaaaaatttttttggtcagctgtggtggctcatgcttgtaatcccagcactttgggaagccgaggcaggcagattcacctgaggtcaggagttcgagaccagcctggtcaacatggtgaaaccccgtctctactaaaaatacaaaaattagccaggcatggtggcgtgcacctgtaatcccaactacctgggaagctgaggcaggagaattgcttgaaccccagcagctgaggttgcagtgagccaagattgcatcattgccctccagcctgggcaacaagagtggaaacccgtctcaaaaaaaaagaaaaagaaagaaagaaaatggcagaggaagccgggcacagtggctcacacctgtaatcccagcactttgggaggctgaggtgggcagattacttgagctcaggagtttgagaccagcctggccaacatggtgaaactccatctctacaaaagatacaaaacttaaatgagcatggtggcaggcgcctatagtcccagctacttgggaggttaaggtgggaggatcgcttgaacccaagaagcagaggttgcagtgagctgacatcccaccaatgcactccagcctggctgacacagcaagactgtctcaaaaatagatagggaaaatagcagaggatctagtgaaggaacatggtctagtttgcatcactgcacattataatcccctttgtaagtggatatattaatggaaggtgaacaaacatgtctctgaaaacaacctggagaaaccccccaaggccatgattcttcccttgggttcacttagctagtaggttcctggaattggtactgaaaaattccccagttcttgtccagaagtggtaattcctttggtcttggaggccctagaggttttcaacctccccattttgaccttgctgttaggttctggcccttaccattctttttattttttaacagctttattttttttatctatttttttttagagacagagtcttgctctgttgcccaggatggagtgcagtggtgcaaccataactcactgcaacctgaaactcctggactcaagcaatcctcctaccttggcctcccaaagtgctgggatcacagacatgagctactgcaccccaccttaatagctttcttaaaatataactcacatatcacacaattcactcaaagtgttcaagtcaataacttttattatatgcagagctgtgcaatcatcacatcttttttttttttttttaacttttagagatgagatcttgctatgttgctcaggctggagtgcagtggctgttcacatacaagatcatagcacactgtggcctctaactcctggcctcagcctcctgagtagcaggaactacaggtgtgtgccaccatgccgtgcttatcacatctattttagaacattttcttcactcctaaaaagaattcctgcaccccatagccattatccctaggcccccagccctaggcaaccactagttcactttatgactttatagatttgcctattatggatatttcatataaatggaataatatatgatccttgtaactggcttcattcacttagaatgatgtttttcaaggtttattcttcttgtagcatgtgtgggtgctgcattccattttatggccaaataatatttcactgtatggatataacacattttacttatccattcatcagtttgggttggtgactcttttgggttatttctactttttgtctgtcataaataatgcggctatgaacatttgtgtatgtctttatgtggacataagttttaaattatcttgggtcccttatcagttttatatttgcaaatattttatcccattctgtgggttgtcttttcactttctaggcagtgtcatttggtgcacagaagttttttattttgatgatgtccaatttgtttttttttttcttttgttccttgtgcttttggtatcatatctaagaaaccattgccaaatccaaggtcataaagatttatacctatgttttcttctaagaaatattttagctcttacatttaggttattgatccattttgagttaatttttacatacgatgtgaagtaggtgttcagcttcattcttttgcatgtggatatctagttttctcagcaccatgtatcaaaaagatgatcctttcagtcaggcacgttggctcatgcctgtaatcccacactttgggaggctgaggtgggtggatcacctgaggtgaggagttcaagactagcctggccaatatggtgaaaccctgactctactaaaaatataaaaattagcccggtgtggtggtgcacgcctgtagtcccagctacttgggaggctgaggtgggaggattgcttgaacctgggaggcagaggttgcagtgagccgagatcatgctactgcactccagcctgggcaacagaatgagactcccatctcaaaaaaaaaaaaaaaaaaagaaagaaaaagaaaaagaaaaaagactattttttcaccattgaattgtcttggcaaccttatcaaaaattaattgaccataagtgtgagggtttgtttctggactatcaattctacttatctgtatgtctatccttatgacagtaccacacactgtcttgattattatagctttgtagtaagttctgaaatcagaaaatgcgagtcctccaacttggttcttcattttcaagattgttttggctattctaggttggccactactattcttaccccaagtggcaaggctcccttgcccacactacttcttccaaggcattaattatggtgacctataaaccctaatcctcaccctctccaacctcatcctgcaatattctctctctcactcctccactccagcaagatagtccttctttcagtttctcaagcatttcaaagtttttcctgcctgatggcctttgaactcatgtttcctttgccaagaatgtttccctccaccctccacttcctccttccttttatcaaggctgactttttttttttttttttcttgagacagagtctcactctgttgcccaggctggaggacagtacaacaatctaatcatggctcactgcagcctcaaattcctgcgcttgagcaatccttccatctcaccctccctcatagctgggactacaggcatgtaccacggcacccagcttatatgtgtttttctactagaatgtctccattctagtaggggagacagaaaaatacaggagaggagagatcctgtcttagttaacactgaattcctactgcctggcatataatatatttaatatgcatttgttgaatggatgaatgaatgaaagaccaatccctggacagccctttagtaggattcagcaccaggaaaagaggaaagaggcaatgaacttggccctcaaaccagggttgctttccttgtactcaccttctctcattttgtgccagtcagcaattcctccctcctttcattcaaataattatcccaaactctcctcctaatgaatgtcaatgtacatttgagaagtagatacagacacattcctgccttccccaatctctgctctggattgccttcagggaaaaaaaaaagccaaagatgtctctgacaatagtttatatggacaagtacaccctcagatccatttgcagagacaaaaatgtagagtattgggaagcatgagacaccagacaagggtacagaagaatacagaactaagaaggtaagaattcagaacctcagggagaatcagaatctcaggcagagagcctgggaattcacatcacaacctttgattctaatgcctgcaaaagtttgagaaccattgtcccacagctacagactggagaggaaaggcctaggttactgatatgaagggattttccctggggcttggaagggaagagcttccaagcccttggtaattctgtatacagccccgagtctttcatctaaagatcttaaagaatgttacaggcatcaattaacctttccagcaccctagactgaaaatccaggctcttggccctattttactgacaaaaactcaaacctatggtttagagccaagaaaggaatatcttggctcacgtgacctgaactgaacaagctaaggggactacaggtacgcatcaccatgcctagcttatttttttattatttttgtagagatggagtctcaccctcttatgcaggctggtctcaaactcttgggttcaagcaatcctcccaccttagcctcccaaagtgctgagactacaggcatgagtcactgctcctggctgacagtggttcttaatctggggacttaaatttatgtgtatatgtgtcactccttgactgtaggcagatgatactttcacttactccttgtcactcaagtctcagcttaaaggcaatcccctcagagaggtcttccctgaacacccatcttaagtaatgttttctatcatatcctattttaatttcttcagagtacttgtcattatctgagattatcttaccttttctttgcccctccttcactacaaggtaaactccatgaaatcagaaacctatctgacagtacattgttgatgttcaataagtgtttgttgaatgcttaaataagcaagtctaaatgaagatgttttcaacaatatgtagatgctgttgaaatgagtaaaatatacatttatttttaaagtctaaatttagggtgggcacaatggctcatgcctgtaatcccatcagtttgaaaggccaacgtgggaggattgcttgagttcaggagtttgagactagcctgggcaatatagcaagacaccatctctacagataattttaaaaattaaccaggtgtggtggtgtgcacctgtagtcccagctgcactgtagcccctcggtccctgtagtcctgtagcccctcagcctaggcaggcagaggcaagaggattgctagagcctgtgagatcaagactgcagtgagctatgcttgcaccactgcactccagtctgggcaacagagcaagaccctgtctcaaaaataaattaaataaataaaaagaaaaaccctgatatgatagtctaagtagctatcgattgagagaaatacgtgcccagagtatcacttggctgggtgcagtagctcatgccgtaatcccagcactttaggaggccaaggcgggggattgcttgagcccaggagcttgagaccagtctgggcaacatagcgagaacctatctctaaaaaaaaaattattggctgggcacggtggctcacgcctgtaatcccagcactttgggaggctgaggcaggtggatcacctgaggtcaggagttggagaccagcctggctaacatggagaaaccccgtctctactaaaactacaaacaaattagatgggcatggtgacaggtgcctacagtcccagctactcgggaggctgaggcaggttagtcacttgaacccccagaggtggaggctgcagtaagccgagatcatgccactgcactctagcctgggcaacaagagtgaaactccagtactttttttttaagtatagtttaaatttagactttattttgagacaggatctctctgtgtcactcaggctggagtgcagtggtgcaatcacagctcactatagcttcaaactcctgtgctcaagtgatcctcccaccttagagcaccccttgccccatccccacccccaccctgagtagctgggacgacaggatgtgccaccatgtccagctaattttttatgttttttttttttgtagagacagggtctcactatgttgcccaggctggccttgaactcctgaggccgcaagcgatcctccccactcagctacccaaaatcctgggattataaggcatgaggcactgcgtccagccagggtttttctttataatattgaaaaaagggttggtacaatttccatttctgacattgtatggattataatttctgaacaatcttccccaaaaaacaactaaaatgataggttaaatataatttttaactttaaaattcataatgagataacacaaaagtaaagagttagaatgaccccaagacaaattaaccaaaatcaattctccctgaaacattttcttaactcccagttttgattccatatcactggccactcctcagtcttctcctttcctggttgctcctctatctcttaaccttttaacagtgaagagttctaagacttggtccttggatctgttctctgattgtacttccttggcaatcgtatatagtctgtgttttcaatataatttgtactctaataaaattataaattttatctctgactcagatttccttctgtacttcagatttgcatgtccagctgcccatttgacatctttacttgattg

SEQ ID NO: 2808 - DNA, 2277 bp, Homo sapiens
tatgtctttcagagatcttgtgggtatcacatcaatcttgacaaattttctaccctccaagtcatgatcctaagaacagcttgcctcccatttctccggtttgtgctattatgaaggccttattgtttcagccttcttcaatcttgagggttgttgtcactgtatgggtggttcagaaataagtaggtcctgttactatgaagggggtcacagcttttgttggcatagctaaactttgtggctcatggaacagtatgaatgcagaatgtagctttctccacttgtggactgctttgcatagctgccagaggcctccagagaagaccttcagggctttgtggtctttatctgtagcacggatactaaaatttgtgggttcataggtcagctggatacagggcattttttgtgacaatttctggcattttttgaacaagacaaaattcttttacgaggtatattgcattgtacttggtacggctgagggaagtctgttgcccagctcttgcaatgcagacacatgccctgatatccagaattctgtaggataacatcacagattgtaatgctatcaggtgaaattataattttatagaattactttatttataggcagtggaggagacagaataatgtaactgcaactcatgtcttttttttctttttttttctttttttttgaggcagagcctcaccctgttgcccaggctggagtgcagtggcataatcttggctcacggcaacctctgcctcccaggttcaaacgattctcctgcctcagcctcctgagtagctgggactacaggcacatgccaccacacccagctaatttttgtatttttagtagagatggggtttcaccatgttggccaggctggtctcgaactcctgaccttgtgatctgctggcctcagcctcccaaagtcctgggattacaggtgagccaccacgtgcagcgtaatgcatgtcttttaaaagggcatccacaatgatccagtcactacgtatatgatgaatatgcagatacaggaattatcaggacttccataatgatgaatattgtattgttgaggccattgtcagaggaaataatctaaaggttttgtgaattcctgtactcattctgggctgttctcctcaaggtcattcctgcattaacaggaggaagatgatagggagaagggagatctcagttcagtgatgtggcctttgtgaccagccagccacttaatcaggtggaaatggccttagtgccacatcaatatttgctaccgtggaggctagttttcccacttagggcatgagaagaattggtgtagtcagtatagagttgccaaacctgttttccaaaaataatggtaaatctatatttttcttttgaactgcatttttttaattattattattatttattttgagacggagtcttgctctgttgcccaggctggatggagtgcagtggcacgatctcggctcactgcaagctctgcctcctgggttcacaccattcttctgcctcagcctcccaagtagctgggactacaggtgcccgccaccatacccagctaattttttgtatctttactagagatggggtttcaccatgttaactaggatggtctcgatctcctgacctcgtgatccgcctgccttggcctcccaaagtgctgggattataggcatgagccaccgtgcccaaccttttttttttttttttgagacagagtctcactgtcagccaggctggagtgcagtggcatgaccttggctcattgcaacctctacctcctaggttcaagcaattctcctggctcagcctcccatgtaggtgggactggaagcatgtgccaccatgcccggccaagttttgtatttttagtagagacggagttttgccatgttggccaggctgatcttggactcctgacctcaggtgatatgcctgcctcagcctcccagagtggtgggaatacaggtgtgagccactgctgccagtctgaagtatattttaaagctgtgatgagttataaatgacattcagtaagctatgcatatttaagctgtagcatgtgataaatcttgagtttcatataatcccatgaaaccattaacatagtcacaataatgaacttaacacctttatatttacttggaacctttttataaaggctttctttctgttctccagacaaccaatgatttactttgctgtacagtagagtactttccattttctggaatgttagatgagtgatgtaataaagtgtttcctcttat

SEQ ID NO: 2809 - DNA, 3228 bp, Homo sapiens
gctggccctgcgaacgaacgagcactgttcgtggttagaaaagcgaagtgctgtaaaaacccgggccttcacgaaaagcgcctacggttagcgagagagggatcacggggagaggcgaaggggcggagcgagggcggccggaaaaggagcaggacccgcgcctggagaaggtagggaggccgagctccagggcctgagagccggacgcgaagcaagagagagctggctgcccgagggcccggttgcaatgatgggacgcgcactttaatactgagtctttcctctgattataaaaatgctatctgttcgttaagcaacatttgaaagctgtatgaccaaataaagaagcacttttataccgccagttatcacaccactagcctgttggctttcccgtccaaattttaaaatatgcaatttttttctttggaaattctgatcattcggtatatgctgttttatagctctttttcatggaatattattttgtgagcatttcctcgtgttttccaatagccttcaaagtcagtgccttcgctgctcattgtcgcacacctaagcagcaagtcattattgtactttgtggttggatatcgtgtgtgtgcacgcgcgctgcaagcgcactttcaggcacttcttagtccctatctctgactcttttccgagtctttttctagagatgtccatcacagtgtttgcccgttcacgccgctagtcttttgcaagggaaaccgccccattggagcagctatgggtgagctgtccctttttagccttagcctcagctgattggaccagggaggtcatctgatcccagggcagccaatccatagactggccaaaaacctcttacttgcgtcgtttggaaaggtaatttaaccaatcaagagttcaaacaaggaaatgctgagagtcaacaggtggtgttgccagaaggtgactgggctgtagaaacgaaataagacagtcctatggtaaagaaaagctagagcggaaaggaggggaaccaagtcctgtgaatagaggtagcaccctgagaaacccatgtcatcccaagggtgcccaaacccatagctgcccccaggtctgtgcacttaaggctgggatgcttagactttcctgggtttctgtctctgtatagcctcttaatgtttcttgagataatttgaatgattttactttcatctacaataacccaactgattgggcaggttcttatgggtagaattacatggtcaaaaataggaacatatttaagttgttgatatcttaaatttcctttgaaaaatataaatttatatcccaacaattcatgagtaaacgtcatcttgatctatcgtctgtgctaactttgacagagaagcttaaagtgcaacattaggaacacccagctcccactgattgttctgtcaacactcaactccatctcaaatgaggccagctcagacaccagggatccagcctgatcccgtggtgaacccaaattcttggcaggttctgtttcttcagctctgcctccaagaacagactgctgccagctgacactgatcacctgatttcatgctcttttgcagctggttttacactaggacctttgccttgtcttggaacgtgtttctcgtccaatcaagacctcactaagcttaacattgtaatcagtcccaactttagtgtgtttgcaatccaaaattgacaacaaagagtaacatctagaggaagtaattcctttattaccacctcactgttgatctccgagtatgcaaattctatttatgatgttgacagctgctgagctctgcgtcagaaacaaaatgtgtccaactcccgattgtccaccccttttttccttggacatgccttagggcagtaaagattatacataaactagacataggtgactcactttccccttaattcccttacaacaccttccaccttcacataatatgctcaaataaatatataaggagtgcaatgtccatgaaaattatttgctttattcacctttgactatgtcttatcccaccttgcaacacaggcatgacactaagttatcacaagttttgattctttgcatttgccttttttttttgctttattgtgcacacttcacaggtacgtatttgacttttaaccaaataatttgcacaggtgtgattttaaagtaacaacaacttgtaaatagttgcatggataatggcaaaaactttagtacagagttcagagtctcatttgatcattggataacatttggcaatgcagtaaaacatattacaactcatgtgaaatgcaaatcaaaacctcaatgaaattctattttatgccttccacattggcaaaaataaaaaacacattatcaaatattggataggatttggaacaactgccaacaggagtgtaaatcactataacctccttggaaaacaatttggcattgtctcttaaagctaatatgcctatgatctgacagttcctttcccaggtgtatcccctgaagaaagttttgcacaagtgtaccaggaaagaagtaaagtgatgttcacagcagaactatttatgtagcaaaaagatgggactaacccaaatgtccatccatccatacatagatgagttgtgtaatagtatagtcataccatgttgtacaagagaaagctggtggctcaaatgataacactgagtttgttcctgtgttaggacaatatatgaagagcttagtgaagtttgattggaactgaaaaacatcagtatgaaagcatcaagtggataaatctcagaaacataatctctagaggaacaagcaaatcacagagaaatacctacagtgtgattccattgatataaagtcaaaggcagggaaaaccaacagtatcttgtgtaggaatatggacatctctgataaaacaatgaagaacaagtgaataattatcacaaaattcagcataatggtgaccacctctagaggaggacagaagagggtagcattggagccttctcttacgttggatagcacattcatgtatgttaattttactactcttctttagagctaacatatattttataaatatcattttttatctgtcttatatttaataaaaacacatttttaaaacctgtatgcattactgccatctgttagcacatttgatattaacatcctcattgtggtatcactataatctcaagatttttctacaggttcagcttgtttgtgttgtttgtctggtt

SEQ ID NO: 2810 - DNA, 4709 bp, Homo sapiens
gctgcctgctgcccgccgccccgcgaccggggcagccgccggcgccgcgccccctcctccctgcctccccggcggggcgggcgacgggggcaacgggagtgtgacggactgcggcgctcggcgggcctgggcgcaaggactgggtcgccgccgtgcggggcgcccggggcgggtgggtgtgggctgcggggccgacggccgcggggggggcgcggggctttccacggcacggggcgggtggggctgcgggcgcggtcggggctggcgcggcaggcgagaggaattccagcgggacgcgccagcgctgcctccgcctcgcctcccgttactatagttttttcagaacctcttatccaccccgcagaagagaaatttttttttaacgtcctgttgcttcacgggggactttcggggtgggcatcacgtggcccgacacgtagccgtggggctccagagcgcgtgcgcgcgtcgagcccggtcgccacgccccttccgagggtcgctccgcccccgtcgggccccgcgagcgcgcggtgggggaggggagggccccggagcgcgcctgcgtggggcgggggcggcagccgactaggggctgggtctggccgtttagggccgggtcttggcccgtcgcccacggtgcggagggctggtgggctttccttggccgtcgggcccgccacggcgcgggtcttggctgcggggcggaggtggggcgggagagccgaggataagagtttgaggcttttcgaggcgcgtgccgcggcgtccgcctctgcgggactctgcgccgggcgccctcggccggcgcgcccggctcccgctttgtcgccgagggaagcacgcgcgacgcccctcccgtcgccgccgtggcttctttcggtgttcgtgatttgctgagaggctggaaagcagcacggcggagaggagccttgcactcgccaggcgggaagcctgcgcggacacgcgtgcgcacccacggggcggcgggcgggcgtggggggtccgggccacgcgggcgacgcgcctctagggaagcgatcttgttgcaccttcccgttattctgaaagcaaatcgtagccagacccgagcgcagcggcttagcaaataataaggggagcgtcagtcgtgctcgaaatgcttccttcgcgatggcgtcagtgttccgtgagggaatgaagccgcagtaggaaataaagaggctgtgcgcgtagtctgaaaagcagaagtcaacatttttacagatgaagaaagaatacggaggcaagaggtctttctctgcagtttggtggatttccaacatttagacttgtttggaagaatttcctcagctgcaccaatgaagtccttgatctatagaagtcggcagtccctaaatctacgtctgcattttgttgcaaatcctttataacattccattaaaataatgcagagttatttaatatccagttggccatcgtgagagtaattcgcggctgagattttgttaatcattctgtcttctgacttaacagtgaacgtaggtgattttttttgtaaaatgttgcttcacatgaattgtgagaatcacctctaagtttgaattgtactgaaggcactataagaatttcaaatgaacgctgagtagccagtagccttctggccttttcgtttaacaagcacagagttcgtttttaaaattaagttactttgacagaggaaatgtaatagccttggtagacaacattaaaaatgtaactgtcagatgttttaaagtctccaacagccgtatctgttttagagccatagaatatttacttactgaattgcctgtttaaagatgaactttctaaatgcagggaatagtaacttgcaaaaaagctatggtctctaagtaatgaaggctgtttcagtacctagaaaaatcaaaatcaaggttttgatgctgctagtgtaaaagatgcaatccccttcttaatggcctgcttatttattaagctcctaggcactatgctgaatgccctacatgcatatctcgtttaatcatcagtacaacttgggcttaggttagactgttatccccattttacaaataaggggaaacccaagaaagatgaagttaagtaacttgcccaagaatatagctagtgagtcctgtgtctgggattataatccaattatattttattctaaagcttttttttttttttttgctttttttccttgccctatcctttaaatcaggttgaattttatgacaatattccaccatttttgacccatagaaatggcagtgtcataaggctcaaccacttaaaccagattaaagaacaatgataggcaattttcatttcctatgtattaaatcacttacggttacagcatttgataatagctactgtgtgttaattttcttttttttgaaacagaatttcgctcttgtcacccaggctggagtgcaatggcgcgatctcggctcactgcaacctctgcctccccggttcaagtgattctcctgccccagcctcccgagcagctgggattacaggcatgcgccaccacgcctagctaattttgtatttttagtagagacgggggtttctccatgttggtcaggctggtctcgaactcccgacctcaggtgatccgcccccctcaacctcccaaagtgctgggattacaggcgtgagccacgtgcctggcaggttaccttttcaaatctatgtagatcacctcatttcctgacagtccctcaatggtttcttatctcaaaaaaaaaaaaaaaaaaaaggaaagaaagaaaaaatccgaagagcttaccaagtcctgcaagacgacaggtgtgcccctggtgcatcactgaccttatgtccttctcctcccacagcccacttggctgcacccccgtggaatccgtctggatccttaaatattccaagcatgcttaccctccccaggactctgcccttggtgtttgctctcctcggaaagcttttccccatacatcggcgacccctgcccctatttatctttagaaggtgtcccttaacaccctatgtaaaatggcgcctttgtgcacgcaaacacttcctcccttcttccatctgcttaccccaggttcttttcataccatttgtttccacgtaacaatgggtcaactcgtttgccactggcatcaacattgtaagctccatgagaaaaaggagtttcttctattaggaatttccaacacctagatcagcatatggtacacgtaggcacttattaaatatatgtccaaaagaagtattaagtacttgttatggaccagaagctctgcaaaacccttatcttcattgtttattttcatccttacagccaatatttgaggtaggcaggaagagccatatttcagagatgagagggctgatgcttaggaggagtaagtagctgcagagggtcgggtgcggtgtttgtgccagtaatcccagcattttgggaggccaagacaggtggatcacttgagcccgggattttgaaaccagtctaggcaacatagtgagaccctatctctctagaaaatacaaaaattaacagagtctggtgtcacatacctgtagacccagctacttgggagattgaggtgggaggatcagggaggcagaggttgcagtgagctgtgatcacaccattgcactccagcctgggcaacagagcaagatcccgtctcaaaaaaaaaaatgtagaaagactaactttgtaataattacattattacaaaaatgttatcttaatacagtattgaaaataaattacaacatgtagtgagtatatatacagaatgagcctccagttgaagatccctataataggttttttcactgtgaaaaattgtcatctaatatgttgacactaaaaatggttccacattctaacatcagtaattaaccaggcgtggaaacatattttctattctgttaaatttgattggctctatttgcttattgctattcttaacatttaaaatagaaatttgcagtattccaaacctttctttatcaccatagagttctcgaaagaactataatgttccttggatataagatttagggttttatggctttttgtcccagtgttctttttaaaaatcttagtctttagattttcctaaaaggaattggggcattcttggtatcttcgcaaaataattgtttattgtcttaatagatttgagcatccttttaaattacgagatggcgctttttttttttttttttactttttaaaattttttttacttttaaattgtgagatggcttatcaggtactatttaaaagattgaaaatgaaacatttcaaatgtgaatatcttaaatatttccagtacctgttatatgtaaatgcatatcattaaccctaaggcatttacaggctgagctgggagttaatagcatgtgcaggtacatttaaaaagttaactaataactgccacgtaaaggctaaagacaaaaatgctgtgaaaataccggtgagcaccaacattgcctgcccggaagccattgtaagaccacaccggggaggtggatttgatctcgaggcggagcaaagagtgttgggagacagcaatgacagaacttgggaagtggaaaagtacgaggtgttagggtaggagtttccacagagagtatttgatgccagattttggttggccttgaacatcaaactagagtgtttgtaggggaagagcctt

SEQ ID NO: 2811 - DNA, 1079 bp, Homo sapiens
cgtggccgccgcactggatatcgccgtggaagggcttgtagaagatgtcacgggcctcccgggtgcctgtgtaacaggcgttgcggttggcctccatcttggcgtgcaccttgtccagcgggaacaggcagaggcccgcaccgggccccccactgctccggctgtctctgctgaagacagcatatagcaccctgccagagccaggcgcagccacggaggcggccaggcaggtgccaaaggcagcggcgtggatgtcggggtcccggcactgcaggtccatctccaggtaggagtagtagttggggtcttctctgcacatgcgtgccagcagcgtgcggttccgggccgggtgcttgtcctgctggttgaagacaaagaagacgtaggggccgtcctcgaaggccgccacgaactgctgtgtgttggtggacaggtagccggccttgtaggtggcgtggtccgtgtaggcttcaaaggcctccctgctgtcagtccggtccaacagccgagtgctcacgatgatgccgttgtcgtgtggcccattgcctttgcccacaaacagcacgcggtcaccaccaggacccgtggagctcaccagccccactgtggccacgccctcatcattgctggccacgaaagacttctccccgctgccgtcctcgtagaacaggcggagggagatgttgctcagggcgcgcagagcgcagatgcccttgaagaggctgccgcactccaccaggcgcttcctgggagggtcgagcagcagcagctggttgacattgtcagtcatctcagcctcatggcactggctggcctcgatgggcggcgtgcacttcttgttgtccagggccgggcccgtggccacctgctgctccagctgcagcttcgcatccagctggtagagggcattcaccgcccccaggtacaccacgcctgaggcctcatccacagccaggtggttcagctctttctcgctgcggaagaagtccagcttgcggggcctcaggctggcacctgcgcccagcaggcccagcagggtcagggcccagagctgcagtgccattgccccccgcaccctg

SEQ ID NO: 2812 - DNA, 1265 bp, Homo sapiens
gatgctgtgtgaatgtttattgaacaagtgtttattgagcttctactatgtgtcagacattgttctggatactgagacacagagataaacaagatagacaaaaacctcaccttgttgggcttacagtctgatagggaaggcagtcaataagctctttgccaattctcaggcactttacaaaagcaataaattatttttccattgaggatctaatacaaatatgggtcacactatgcactcattcattccatttatttttctcatttattcattcattcattcaattattcaagtaagcacccaatattactggataccaattatgtgtcaagtaccgctaggtgataggaaaagagaaataataagacagattgaagccccacctgaatgaggtttatgatatagaatggagaacagaaattaaattgaggaagtgttataaataacaacagcaatatcaaaacagtaatgcaataataatagcagtgacatcctcttggctggtttgagtaacaatttacagcttatgaaggatgcacagttagggcttgctaagtcaacttgagctgggtggaggttatgaggtccagaagtgaagggcatctgacacaggggcggtcctgtgagctgtgagcacaagatgagctccgacacctgatggcatcttcatcgtacccccaggtggtgctgagatgagggccatggaagatagagccagccaaaggtgtgaggtttttgtgggcagacattaatggcacggcagggggttgtcctagcagtctcactgaacttgtgtcagctttcaggcgctatctgagagtgagtacctgttagtcttggcctgatgtcagtccttcagtttcctcatttgagaaatggagacaacccaggcatctactccaggtcaaggactcagggaaggagcgtgatatggtttggcctgcctgatctttgggctcagcatgttcttgcagccgtccggccagccccgcagggccgttcatgctgtcatccacttgcttttgctcgtcctcgcgcctagtcgcccctcatgtcctgctcgttcggggccccgtggccgctggcgtcacccgtcaggctccctcggctacctctcctggctccggacggacggctcgccttggactacataaacctcgatgcattatttatccatcccagaattaattcccatccaagcggaccattaaagcctcagtaatcactgctgatcaatcactggaccagggcggggcagtccctcc

SEQ ID NO: 2813 - DNA, 2388 bp, Homo sapiens
ggaggaaggcggagggatattcggaccggacctctccgcggaggcgccgcgctccacgacgattggccgttgtcctggccacgcggaatccctaactggccaggcgctcagcgtcgaagggccgtctcgcgcccattcgcctgctggtttcaaggcccgggttggctgggcgggcagcggaatggagcgcgcggattggccgaggggagggagattgggatggggtaggagagagcccgccgttgattgggtgggcttggtaaaggccttgagctcagaccggctgagcgctgggaggagggtggaccggaggcacgactcggatcctgcgcgattggctgggatagtaggcgttgataggatagggtgcccgggagaactaaggagaggagttcggggtcggggcgcgggaaggcgggaggtgcccggcaaccctaggagcccggcgcggggcacgatgggacgcccccgggaagaggcggagctgggttcgagcgctggggctgcggttgggtaagcgccgtcgctccgaggggcgtgttgcgcgaggttttcgcgggcctgagcgggggaggggggactgttgaagtcctgcgccgcgcccacaggaagctgctttaatggctaggtcggcttggtaccctgctttcggctgggagggatccgtaaggccatgtggctccactgccaatgtgtagatgtggaaactgaagcccagagagggtatggaacttgtccaaggtcacacagctggttaatggcttggtaaggaatgggttcaggagcccagagagggtctggaacttgtccaaggtcacacagctggttagtggcttgataagctcaagctctcctgacggcccttgtccctacaagcagcttcctctccaaggagtcccctaagcctgcttatatggggcttgagacctgtgctgtgataaatctgacttgcttaggggtgagctaagggattcctcctcttagaccccccatccatagctaccaggtacttgacaggatggaaatgtttcaccctccaaaagtaccctgtaaaggcccaacctcgaaccagaaagaatgtgtgtacaggaataaaggattgtggttcttaacctgtttcagttctcaaccccggaagaaactcatgaatgccttttcttagcaaaatgcatataaagaaaacgtgggccgggcgctgtggctcgcgcctgtaatcccagcactttgggaggccgaggggggcggatgacgagtcaagagatcgagaccatcctggccaacatggtgaaaccccgtctctactaaaatataaaaaattagcccggtgtggtggcgcgtacctgaagtccaagctattcctgaggctgaggcaggagaatcgcttgaaccctggacgcagaggttgcagtgagccgatatcgcgccactgcagtccagcctggcgacagagcgagactccatctcaaagaaaagaaaaaaaatgtgcatacagtatgtggctcaggcctgcaatcccaggactttgggaggatcgcttgagcccaggggttcaagactaacctggacaacttagcgagatcctgtctcttttaaaaaaaatgaagatttttaaaatgataaaggaaaagtgtaataatagggccgggcgcggtggctcatgcctgtaatcccagcactttgggaggccgaggcgggcggatcacttgaggtcaggagttcaagaccagtctggccaacatggtgaaaccctgtctctactaaaaatacaaaaaaaaaaaaaaaacctagccgagcgtggtggcgcacgcctataatctcagctcctcaggaggctgagacagaatctcttgaacccgggaggcagaggttgcagtgagccaagacttcaccactgcacttcagcctgggcgacagttaagactctcaaaaaaagaaaaaataaatggtaacaaagaatttcttgaattgtttcattttcacagtaatgatgtaggggtaattggatgtagctggttcatagagctttttaccatatgacttgagcttgtgaggtaattgccctgcagtagccacactgggaaaacctaggaggaagtctgactttgttgaaaggtttcacaaagaattaggaaagattggccaactctttgttaaaagaggaagaaatggtctttctctgctagagatatctttgcagttttgaagctagaaatgtagggacaccattcctcacaccatactgtgactagtggatttcccatggcttagcagctaaccccagccttttgcttcatctattaactgtggaagaactgccctgtgtgtgtaactttgttataaatcagtgaagattgggccagggcgtggtgggtcacgcctttaatccca

SEQ ID NO: 2814 - DNA, 1424 bp, Homo sapiens
tcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgagcagggaagtgggagtgtgtgtgagtgtgtgtgtgtgtgtgtgtgtgtgtgtgtgaataagccagaggctgcctggtggggccccgccgtggcccagtgactgagataattgtcttcgtctgtggggtaatgcgaacaagccccgttcccctaagccgtgatgcatgcggggttgacgcggccgggctctgtccccataaactgtgacacaggtgtgtgtagacgtctatgagggccatagcgccgggctgtaagggcatctgtaggggtgacgcagccgggctgtgtctctgcacctccgttctgtgcgaggtcaatgctggtggggtctgcagaggtggcacggccaggacgggtctccgtgtctctgaaatgtgcctttgcacttctgtcaggttgacagggacaggcagtgtccctctggtgtgagcgtctgtgggtgtgaaagggccagcgagtgtgcggctgtgactggtcgggatcgggcctgggtgcatggccttttgagtgagcacaggtgtgtgcgaccatgtcacctgtctttctagtgtctccgttgcttcctgtgccttggccttccagccatgtggtacctgctagggagcagtggtcccaaagtgacgtgagaggctctacgctattgtgaaaatgaccaagaagaaggcttcacaagtcacgagatggcagttttggagccagaagtgctctccgtgcacactacctggacgacaagaggaagtaacctcaagaatagaattccttttggggaagaaagagctggccttcaggaaaagcatcccggaggaggaagaagaagtgttatatgtcctaaagtaaggtttcaggctggagtgcaatggcatgatctcagctcactggaacctctgcgtcctgggttgcagcgattctcctgcctcagcctcccaagtagctggaattataggcacccaccaccatgcctggctaatttttgtatttttagtagagacggggtttcatcatgttggccaggctggtctcaaactcctgatttcaagttatctgcccgcctcagcctcccaaagtcctgggattacaggtgtgagccaccatgccct

SEQ ID NO: 2815 - DNA, 2611 bp, Homo sapiens
tgtcagatgcagcccagcagagaggccctggaactcagaggactcccaaagtccgtgagcacagtgtcctcaacaaaaccccccctcaccacaccttcctcaacaaacccctcacgccaactggctctggaggactgtgtccaattgcgagctgccttggatttaggttatggtcctgaatgctgctgccaccacctccctgaagtggctcacaagtcctcagcctccgccggagccccaagtgccagactcccccttcagccgcacagcctgggcactcggaccaagctgccaccttccctgtgcttgccggggccaggtaggacacgtctcacaacagagccttttccgggggcgcccttctgcagtgattcttgcagtcctgcactctgctgtgttctgctcacaccaggcagggggagagggagcgtggcccctctgggaagctcccaggacggcaggggtgggtgctgccctacagatacagtacctgctgcacagggaatggacgcctcctggacggtggccccagcccaggaatggctgggacacccactccagtcttgcccacagtctgcttccagaggacacttgcccctgcctctccccacccccaccacgccctgcatctcgcagccacctggaaggagatgtagaccccactgtggtaaggagctgttcagagcccccggagccctccacttcctaccacgcagacatcctgctgctgtgcgacacagatggaccagggcttgtcctgaaggtcccaggatgcacattcctcagggatggctactctcctccccctccctgttaacagactggttttccatggactcctttaagcccccaagtctggcctctggtcaaatttcaaagacatgatggggtggtctgttaagactgagtagctcatgtggcaccaggtgagggctgctcaggcctgcattaaggaggggagcccgaacaacgggcctcccccttccccccacccacaacgaagcagctgctgctggctcctctcccagagactggaagagaattgatgagaacaccggggacccagcagttccactcccaggcctaaatctaagagggcaaagtcaagcctccactcaaaaccttgtgtgtgcacacactcccggcagcaggattcacaacagccacggagtggaagcagagccagctgtccagtggaggatgaacacacagcggggaagacatgggccgtgcaaccgcggctgccacagagaaagcgcaggagcagtgcatgctgcgtgagaagctgggcaccaggcagaaagcagagtccgggagctgggggaggaggggacagcaagtgcctgctcaatggccctgaggtttaaggtgatggagctgatctagatagaattgggggtgatggctgtataactgggaatacactaaaatccctgacttgtacactgtggccacctgaagtgaacagtacacgctttctgtctcagtaaagctacgcaaagaacagcagacatcccgcatgaagtcagctctccagggccgcaccatgggagctatgggctggcagtggccggctctgctcttgacacacaggaaggatgcaaactcagagccccagtggggtcacggccttgcccggagaactccctctggggatggcagcctgccgtccccttgcctagcctggatgccacatcccgcggcagcgaagcagcctcctgcttgaccgtctggcccggggacccttttgtctcctgggtcagtttcattctttccccaggctgtgctcctgatgaagcagcatcgtagctgatgttgaagggcctcacgccagcacctaggctggtcttccctgggtgcctgcttgagcacgtggcccaaaacagccgttgcatggggcactcagaacccaccacaccctcgccccttcccagcccgccaccctgtggctgaggccctgtgccttgagcaagctgctgcccctcctcctcctggtccagttctgcccacacctgggtgcccacctcccctccctgtggtctccaggagctgcccccaacatgccctgggcagcagtgctcatcgtagccccgtctgtggcctggacaggctctgaccactcctgcgttggcacagcttcctcgggaggctcctgccaacaccactcggcacggtgggctcaacacggcagcggcaacgggtgggagtacttgcctctgcctggcccgaatggcggttttccatttggatttggggatgagcagccaatgagcctatctcattcccgttaacgtgagagaaacatccagacgctatcctcaggtctcacacacccccgccgtgctctgcaccacacctggcaggggcacccccgactgtatgctgggcatcagctcccaggcccgagcgcctcacctcacactggggattggagccctcaggccctagagacactggcttgagaaacttttgagatggagtctcgctctgttgcccaggctggagtgcagtggcatgatctcagttcacagcagcctctgcctcctgcgggttctggaaattcttgtgcctcagcctcctgagtagctggaattacaggcgtgtgccacca

SEQ ID NO: 2816 - DNA, 883 bp, Homo sapiens
tgaattccagcatttttattgagcgcaccacatcggggaggggcggcagtggtttccacggtaaccaaagtaaggcttgtgcacttgctgagcttccagatgcgaattagtaaaagctaaattcaaaagtagaatgggcatctccaaagagtacgataaaaacattttgtatcaaacttgtgattaaaaaaatacaaaagttaaacccacaggcaaagaggaaaatgacaatcctgagagctgccctgataggtgagcctcgaacctcgtctaaatccgtaagaaggcaaaccctggggaggccagcacccctcgggagagtgggagtgaacgcggagcccacctggcttcatctgggcaaagcttcgtagcgcctctggcaggatgtgtgtccagtcccccgaggggcagaggcactgcggtgtggacacacgagggctggggggcaggggcggagccgaaccctgcagccaggcaaaagcgggaaaggcctggttcctccagcatttcccagcttttgggggctcccaagagatagtggttcccacttgcccagccactgctgtggccaagcagcagggtcggacctgagcctgtggtcacagcagactggctactactcagctccaggcccttatttccaatcctcggtgtccaggagagaaagccggtcccagagtgtggaagtggcgttactgtacagagaggcggcaggcaggagtcgcagatggtggtggctgctaggacagcatggactgctgcacggccttctgcagcgactgccgcgtcaccagcagacgcaccacctcctccgagcgcttggtgagccgcttgcgggcctggtcgtgtgtgaccatggtcatgtcccagccgttcacctggc

SEQ ID NO: 2817 - DNA, 1078 bp, Homo sapiens
ggtcactggttcactgctgaatagccttggtcagttttggctctctcctattttagggggaaaaatatttttgtttcttttttttaaaaaataaaatgttcgcacaatgggagaaaattgctttaagtgttacaccttagccaacagagcccaaactccgtgtttccgttctttctctttcggtttctgctgagggctggtgacacactggcctcttgtcagtggctgccggcagggccaggaacagagtagaacctgcagcacagctcagtccagaaagcgctggcaggccttcttccaccggcaggccgtgcaccactggtcccggtgctcgatgccatacaccttgcggcacttcttagcctcccctcgggctttcctgcagaaagagaggaatgcaaatcgagccccacacaggtggtgggcccaggagagtggccaagtggggctgggagaacaagcagaggccaaaggggcagctcccggcaaaagtcaccaggaccaggggccagaggctctgaggaccaaacagtcatcccatctggtgcatccgccatctgggctcctctctggggactaaccctggtgacttcatctgggtggggtcggagtccacgccactggagacagggcacagaaaccagaaggcaggggacgacagcggacatctcacctggcaccactctgggcccggggtggagaagtgacgatcagatgagatttcatcgcaggtgctggctgctggggctcgctgaagcttagcgaccggctccggacctgggcgtggggagaggggctgtgagcacagggacattcaggaaaggtgagggagctatcctaaaagacaggcagccacccgtccccagctcctggtgcagaaggcctcgcaccttctcagggagaacactccagccgaggggagctcttggcaggagagtgaggaaggagcaggccttcatgccacactcaggacccagccaaggacaaggacaggggagccactggacctggccccctctgaggctctcctgcaggggacttagacggagccgctatgcctggaagcctcacactgcct

SEQ ID NO: 2818 - DNA, 13879 bp, Homo sapiens
gaggagcagccagccaccttccctgcagagagcagccccagcatcccctctgcttgtcctgaagggagaagagcaacctggcccacagcctgcaggtggcccagcagcaggccaaggagctgcggcaggagcggaagaagctgcaggctgcccaggaggagctgcggcgccagcggtactggctgggggaagagcaggaggacgcagtgcaggatggtgtgcgggtgcgccgggagcttgagcacagccatagacaactggagcagctggaagggaagcgctcagtcctggccaaggagctggtggaggtgagggaggcgctgagccgcgccacactgcaacgggacatgctgcaggccgagaaggccgaggtggccgaggcgctgaccaaggctgagggcagaggaggcctccctgcaggactccctgtccaagctgagcgccctcaacgagagccttgctcaggacaagttggatctgaaccgccttgtcacccaggccacagctggaggaagaaaagtgcgccctgcagggccggcagcggcaggcgaagcaggaggccacagtggcacgggaagagcaggagcggctggaggcgctgcggttggaacaggaggtggcgcggcagggcctggagggctccctatgagcggcggagcaggcccaggaggcagtggagcagcagctccccacgctgcatcatgagtgcagccggctgcaggagcagctagcgcaggccctccactcagggtgtcaacagaggtggatcagatgagaaacctggatttctacacacacctggctacaatgagatggcaccactcccctcccctgcagaagcagactcagaaaaaggtagttaaaacagaaggtttcaataaaatcgacagtctgataacataatacccaaaagtccaagtttccattgaaaatcattcatcataccaagaaccaggaaaatctcatactgaatgaaaataggcagcaagcacacactggcaataaaatgagagaagcgctgggattgtctgacaaacattttaaagcaagcaagcctgatgaaaatgatttagcgagtaattatgagcacacttgaaataaatggacaagtagaaagtcttagcaaataaatacaagacttaagggagaaccaaatgaagtattagaagtggaaaaatacaaccaccaaaataaaaagtctggcacataggctcaacagcagaatggatggtgcagagcaaggaaatccatccactgccaatgaaaaagtagaaattacacaatcttagcagggaaaaaatagactcggggagaaagtgaatagaacctcaggcacctgtgaaactacctcaaaaggtctcactttcatgttgtcatctatgtctggaaggggaagaggaagaggacaagcctgaaaacataaagaagtaaatggctaaaagcttcccagagttggcaagagacataaacctatatgcttaagaagctgtgaggaccccaaataggataaaacccaaagaggtctatggcaagacacgtgaaaaaataaaatgttggaaactaaagacaaagaaaatatattgaaagcaacagagaaaggtgacaccttacctagaaaggaaaaacaattccgacgatgatggctttctcatcagaaaccacggaggcagaaagaagttgtgcagtgcttttcaagccgcagaagaaaattgtcagcccagactcctctctccagcagaaacatctttcagggattaaggagaagatcaaaacagtttcagattaagaaaagctaaggacatctctgaccagcagttctaccctaaaagaagggctaaggggagttctctagacggaaaggaaatgattaaagaaggaaccttgggacatcggaaagaaagaaaacagcaaaataggccttccttctcctcttgagttttctaaactatgcttgacggtttcagaaaaaaatcatagcaccattcaatgtggttctaactctccataaagaaaatgtttgaaatggttataaactgggagggtaaagagacctacaagggaggtaactcgtctatcattcactcaaattggtaaaacaatgacaccagtataccgtgtggttaagatatagatgcacagatatacgaatgtctggaaaaaccaagagggctatacaaacagacatactcaaaagcactatggataaggcaaaacaccattctcaaagatgttcaagtcatgacaggaaggtaagaaaaagaaagcatatccagaaaacgaaaccagggagaacaaacagaaaaggaaaaataaaatggcagatttaagccctaccatgtcaatatcattaaatatcaatggcctaagtataccagttgcaagacacaggctggcagagtaggtcaatggacacgaaccaactacatactggctacaaagagactaacttcaaatatgatgatacaggcaagttgaaatgaaaagggtgggaaaagatatatcatgcaaaccttagccaaaggaaagcaagactggctatattaatgccagatatagtatatttcagaacaaataaactaatcagagacagagagggagactatataatgtgcaaaggaccaatccaccaactcctcgcctgacaaattcataaatgtctacgcaagaacaactgaaagtacttaacagagaactagacaaatccacaaatacagctgtatgcttcaatgtccccctttctcaacaatttatacaacaaccagatagaaaatcagcaagaatacagaagaacccaacaacacgatcaaccagcgggacttaaattggcaattttagaacacccaaccacaccagaatacacattgttatgggatgcattgtgcccagcccccccaaattcatatgttgaaatcagaacattattagccactagtgatttactaattaaaacaatgagaaattgctacgtacctatcagaatggccaacataaaagtgtgaccacatcaagtgctgtcaaggattcagagaaagctggatcactcatacattgctggtggggatgtaaaagattacagcccactctggagaatatctgtataatttttacttttaaaactctatgtgcaactaccataccacctcggaattacattccctgcatttatcacagagaaatagaatcttatgttcacacaaaacccatgtacttcaagtttatagcagccttgtttttaatagccaaaactggggaaacaatgtatacacgacttttgtgagatgaatggttaaactgtggtatatatccacagcatcaaatagtcctcagtaattttttttaaaaaaacaacaaatgattgatacccacaataacctggacgaatctccacagaattatggtgagtggacgaagggtaatcccaaaggttacatgtagaattccatttaagtaacattcttgaaatgaataaattataagagtggggaatagattagtagttgccaggggttaaggagggaaggaggagcagcactgaatagaaggggtcataactataaaaaggcaacatgatgaatcccggtgttgacggaaatgttctgtaccttgcttgtataaatgtcaatctcctggtactgtggcatttgcaatatttgcaaattttatttatttattcattcattcatttttctgagacggagtcttcctctgtcgcccagactggagtgcagtggcgcgatcttggctcactgcaacctccgtctcctgggttcgcaccattctcctgcctcagcctcctgagtagctgggactagaggtgcccaccaccatacccagctaattttttatatttttagtagagacggggtttcactgtgttagccaggatggtctcgatctcctgacctcatgatccacccacttcagcttcccaaagtgctgggattacaggtgtgagccaccacgcccggccactatttgcaaatattaccattttggaaatattaccaagatgttaccattggaggaaacggagtaaggcgtacaagggacctctctttttctgagttaagattgtatgtgaattattaaaacgtaaaaattaactttaagaaagctaagtgtatttctccttgagtgatcatgcctttgcttagaaaacattaaggcaacaataattttccaaaaccctttattttcttgaagatagttttaacaaaagctgtgcttaggggttttcctagaagtttaaaacttctactaatccttactgttcttctttgagaaccctccaggattttatttatttattttacacctttcaaaagcatagagacaaaacccggcaactggcatataatactgtattagtctgagttatccagaggacaagatacacacacacacacacacacacacacacacacacacacgcatgcacgcacgcagagaagcccaagttctactctgagtaagctctatacctaggagagtcgaatatagttcaagaccaagtccaaggcttaaggcagaagactgatgtcccagctcaaagacagtggagcagaaacctttcttaacccatcatcttattcaagccgtccatgggttggatgaggcccacccacactcgggagggcaatctgcttcactcagtttactgattcaaatgtcaatctcttccagaaacaccctcaaagacacagtgagaaataatgtctaaccaaatgtctgggcacccccgacccaggcaaattgacacaaaaattaattttcacaaatactatcaatagaagtgactaataaatgtggcatcatgtcctgcctgtttatcccatgacaattagtatagtcgagcgtaacattggcttccgttcccttatagtagcaacatgtaggagtttcatttaaagtgaggataattttgaccttacagagtttctccctacccctatctaccattgccacttgtggattgtcattttgccatgactttcttttaaaaaatatcaataagctctatacttcagtaatgtaagtttgaatttcatcctggctgcataagtcactttccattttgacaaagtctagaaatatttttctccatctccttgaatatgggtaatggatacctattgtggggcccactctcaatctcatggttttattttaatttagttctcaatagatatgcctcagctgcttaaaaaccattgaaaatggcccatggccttgtccatctaacagagtccagtaaaatcctgacaatggaatggggagagagaaagtgagaaccaccaaactcagcacaaaacgactgagtttaaacctctgtgctaagagatgatcagagtctatcatggcttctagtagcatgagaccatgtctcacgaatgaccctaggctcccatgacaatgcctacctaagaaagctcaaggctgccaggggaacttactttagtctagccaatacttgatgatggcagtttcaggatctttctttcttatagcacttactaagaagggaatccttcctccatccctttgatatatgtgtgtatctcctagggacttcaatgtatctttgcccaggatctgaaaggcaatacttttgaggtgtagttctcaggaaggactgagcctctgtcttccagtctctgtgggaggttagaatcctaacttctaatattgccagctggcagacacagctgtcctgatgaggcagacatttaaaatgaccaatcttttgtaatgtttcacttgtgccctgccccctgccctctcccctgcctctctctcccattagaatgccatcacctctgcacaaatgcgaacagaaccagccccttcctctacggtcagtagttactgaataaaattggttttcatcgatttgactaatgtctgatatatctttgacaaaataagtgtgaatgattgtttttagagacacggcagctgcaaagagaggcacagacatggcaggagagggaggggtcacctgacccttctcatttcataggcatctattcctgcctggtgtttatgagcctgagacttggcagggctgtcctggtatataactccatggctctgcagcaagactcgaataggctggtggtgacacttggtgtgaccagtcaccttcaaagatgccattaagggttcacaagaaaatgaagggaaacagaaaaactgattatgaaagttgttgcctctcctgcttcttcatacagagtgtgtatgatattgctgtgtgatgttagactgcaacttagcccaacagctgttctagtaattggcagtttctcatcgagttaagcctacctgataaagaagcacgcttacatttattgattacccccgtaaaatgaacaatacatccaacaaggcttctagcaaaaatgttcttattaacctcctttttatactaaggaaaaactgggtacaacacaaatcttcatcaacagaagaataccaactgttatacagtcataaaacgatcccagaagttcactccataccatcaaaaccaggaacccacactgatgcccctgatggcagaaaatcatgatacaaaaatgagagaaacgagagagagaaaatgtactagagtcatggtagtgggtaaaagccaaagagctcagtttctactcatgatattcattagaagaaccaaaggaacatgagccaacagctgtaagggtccaggtctgcacaaggtgcctgttgggtgcagggttctgttggctccagtgatatatctcaggtgggctaatttttacggacatagccgctgcaaaaatctatcaaacaataataaagggatagctacttgcatgctaatttaccattgtatagaagggagaacaggcatcagattgttttcgtcaaataaaagcaaaaccaagatttatgaagaaaagaggaaagaggaaaaaaaatcgcctgggacctttgtgattttgctccccttggataagagacttgacagaaagctttcaaagaggtcactgtggcctgtcttcttgagacacacgacacttgttcaccacggaaaacaattacagatgttggaggactttaaaatatcctagtttagcagttcatcctatgccacagaatctgtgtgtgatgtccaccatgtccttctgtggtacaccccttcagttaagccaggagggtgcctctcccctcagtggaatatcatacatcaatgtgtagaaagtttgttgtgctggcaagtaaatgacaaaagggacattgatagaattaggaaacaaattggaatatgatctgttaccgttcccatggaagataaatttgcagaatatactcaaattagaagcattaaataaatgctgtaatttaaaatggcacatcccattctctacactacagaaatatctgcaggagtgaccaaagatatgtgtacaactatggtagagattgcagcatcagttataatcctaaaaccatgaaacccaccttatttcaaaaacatcttgaaaagggttaaataaatcacgcacaaactgaggaagaaatgctgttttcacaaacaatggtgaggctcaccatgaggatgactgattccacactgttcacatttgatagagcaatcagttcacctcctgagttcaagcgctcctcctacctcagcctttcaaagagctggaactacaggcgggtgtcaacacgttcggataacttttgcatttttttggtagagatggggtttcgccatgttggccaggctggtcttgaacccctgggctcaagcaatccgcccaccccagcctcccaaagtgctggaatcacaggtgtgagccactatgcccagccagattttatttttctctgaaaagatggtacatttacatggttcaaaattcagatagggccaggcgtgagccctggagttcgagaccagcctgggcaaaagagagccctgtctctactttaaaaaaaaaaaaaaaaaaaaaaattcaaatagtacagaaaattataaagttaaaataggcatctcttatattcctgtctcccaatctcaccctgtaggcaatctgtgggatgctgttcccgtgactccttccagggatattttagatcaagtcttcctcttgtcgcccaggctggagtgcaatggcatgatcttggcttactgcaacctccacctctcaagttcaagtaattctcctgcctcagcctcccagatagctatgattacaggtgcccaccatcatgcctggctaatttttgtatttttagtagagatggggtttcaccatgttggccagactggtctagaactcctgacctcaggtcatctgcctgcctcagcctcccaaagtgctgggattacaggtgtgacctccatactcggcctttttatttatttattttttgagatggaatcttgctctgtcacccttgcgggagtgcagtggcacaatctcagctcactgcaacctcagcctcccaagttcaagcgattctcctgcctcagcctctctagtagctaggactacaggcgtgtgccaccacacccggcctcccttcccatttttttaatgccaaagagaacatattatatatacactttgttctgtaccttgctacctgtccttgatagtttggggaccatcccttatcccttatcaatatataaagagcttctttttcattgttttccccagagatctagtattccaccagatatgcctaaatttatataatccatcccttactgatgggccttgtagcaggtagacatagtgggtgaactgtgtctcccaaaaaagtatgttcaagtcctaacccccgacacctgtgaatgtgatcttatttggaaatagggcatttgcagataatatcctcctggatttagggtggggcctaaatccaatgatgggcatcctaataaggaaaggagaggacacacatggaaacacagggaggaggcagagattggcgtgatgctgccacacaccaaggaatgctcggggccaccagaagcctgaagtggcaaggattctggcctagaccctctggaaggagcatggccctactggcatcttgatttcagatgtccagcctctagaactgggagagaataaatacattcaggtggtttaaagcacccagtgtgtggtcacttgttacagcagccctagcaagctaatacacaggtagacttgttttgagacgaagtcttgctttgttgccaggctggagtgcagtggcacaatctcggctcactgcaacctctgcctcctgggttcaagtgattctcctgcctcagccccccgagtagctgggactacaggcgcattccaccacgcccagctaatttttagaagaggcggggtttcaccttgttggcccggatggtcttcatctgttggcctcgtgatcggcccacctcagcctctcagagtgctgggattacaggcgtgagccactgcaccccggccaggtagacttctaagatggctctcaatgatccttgcctcctggtatccacaccctccacttagtgcggacaggacttgtgacttctactctgaagacccagccaagggatgggatcatttctggaattaaaactatgactgctatcttgccacaatcacgtttgctggcttcaatgaagcaactgcaaagatgtgaactatgcagaggcctacgtggaaagaaaatgagagtgacctctgtccaacagccacgaggaacagaatcatgcccaaaaccacgtgagcgagcttggaagcaaacgctttccctgctgggccttaagatgacagtgcggcctcgactgacaccttgactgcagcctgtgagaggcctgtgacccagctgagctgcaccagattcctgaccacagaagcggagatgacaaatgcaggtcattttgggcgggtgtggtggctcatgcctgtaatcccagcactttgggaggctgaggtaggcggatcacctgaggtcaggagtttgagaccagcctggccaacaggatgaaaccttgtctctactaaaaatacaaaaattagccaggcatggtggcggaagcctgtaatcccagctacttgggaggctgaggcaggagaatcgcttaaacctgggaggtggaggttgcagtgagctaagattgcaccattgcactctagcctgggcaacaagagtgaaaatctgtctcaaaaaaaaataaaaatacaaataaataaagtacctacttacaggctttgtatggttggctaaaaaaaaaaaaaaaaaaaaaagaaaaaaaaaaaaaaacagtatctgtctacattcaagctgcggtgaggaaaaattggtcttttccctactccagtccactcagtccacagagcatggtatctttctcactcccagctcatagaaatcgacaactattaagcacctactgtgtgcccatgatgcatttcagtagctttcaatcaccaatggaataaagccccacccttcgcctgtcattcctacttgccacggctttcgtaagccatgtggagggaatgggacttttcatatattaagggggtcttatgtgccaggctttgcagggagcactgctccaaagaagtagccaccctgactaaaagcatggatgctggagccagactgcctgggttcaaatcccagctctgccacttaccaaccatgtgactttgaacaaattatataatttctctgcatttctcattttcgaaacagggatgagtactgctataaacatttgtgtccacccccacctccaaattcatactgaaacctaacccctagtatgatggtatttggaggtgagttctttggaaggtaattatgtcataagcgtagagccctcacaaacagtattgcccttataaggaagccccagccaggtgtggtggctcacgcctataatcccagcactttgggaggctgaggcaggtggatcatgaggtcaggagtttgagaccagcctggccaataaggcaaaacaccatcttgactaaaaatacaaaaattagctgggcgtggtggcatgtgcctgtagtcccagctacttgggaggctaaggcaggagaattgcttgaacccaacaggcagaggttatagtgagccaagatcacactccagcctgggcaataagagcaaaactatctttaaaaaaaaaaaaggcagtgccattcccatgtggtggctcatgcctttaagcccagcactttgggcggccaaagcaggaggatcacttgaggccaggagtttgagatcagcctggtcaatatagcaagactccatctcttaaaaaaaaaaaaaaaaaaaaaaaaaagtccccagagtactctattgccccttctaccatgtgaggttacagcaaaaagacggcctcaccagacaccgaatctgctggtgccttggacttcccagcctccagaactgtgagcaaaaaatttcttttgtttataaactacccaggctatgttattctgtcatagtcccaaatagactaaaacaagtacttactggccaggtgcggtggctcacacttgtaatcccagcattttaggaggccaaggcaggctgatcacttgaggtcaggaatttgagaccagcctggccaacatgatgaaaccccgtctctactaaaaatcaaaaaaattagccggaagtactggcacacgtctgtaatcacaactactcggaggctgaggcagaagaactgcttgaacgcaggaggcagaggttgcagtgagctgagatcatgccactgcattccagcctgggccacagagcgagactgtctcaaaacacaaaaaaaacaagtccttacctcatggggttgtagagatgatgcaatgagttttataagtgcatagaatagtgcctagcagagagttaagcattactttagcaataaacaataagcattacttaaaggcaacaggaaggcccaaaggagcatcataagggacctcccaaggccctacagctattaagtctatccagattctctcttttccacactgattcccacctcaaacacactttgctaacctttgtgttggttatctattgctgcataaccttaccagaaacttagcgacttaacacaatacatttaccatctgttcctatgggacagtctgggcacagcttagctggtcctctgcaaggctgcagtcagtgttggtcaggcctggggtctcacctgaaggcttacctgggagtgatcagcctccaagcttgtgtggttgctggcagcatttgctttcttgcagactgctggactgagcttcagtttcttgttggctgtcagaggctacctcagttcctagccacctgaccctctcccaagggcagctcacacaacatgacagcttccttcttcaaagccagcaagagaatttctcagcaaggcagatgttgcagtcttacataaggcaaccatgaaaataacatcttgtcacctttgtggcactctactggttagcagtcacaggtctaggccatctcaaggggcagggagtacataaggctgtgaacagcaggtggggatcacagtgaccacctgggagtctatctgccacacctcccagtgcatccaaattctgttgtgcagagggcaagtgaggtctagcataccccccaagaaagcagccatcttctaccatccacccaccagtttgtaaactccagtcaggggtgtaattgaagtgatgcctggtttgggattgagttttcctggagattctggtcctgtaatgagttttttccagctgggattccagttagtgatggacagcatcaagctgtcccttgctcctggccccagaccccacaaggtgcttttcaggctagattcctgagggctgtgtcatcagctgtgccacctcctcctccctaccatgatgaactgttctgggtacttacctgactccagagaaaggtcattaaggtcaaacaatgcaatgtgcatctgctagtgcctcatccgagtgacgctcaggtgaaggaacagcctgtggccacacgtctaaccaggggatagcctagatcctaaggccaggtctgtctccacaatccaagtgctgatcttcaatggtacatactttttttttttttccttttgagacagtcttgctctgttgcccaggctagagtacagtggcatgatctcagctcactgcaacctccacttcctggaggcaattctcatgcctcagcttctcaagtagctgggattacaggcgtgcgccaccatgcctggctaattgttgtatttttagtagacggggtttcaccatgttcgccaggctggtctcgaactcctaacctcaagtaagccacccacttcggcctcccaaagtgctgggattgtgggcatgagccaccacacccagccatggtacacacttctaataaagcttcctctacatctaagctttctgatttccaccctccaagtacttaaaactgactcgatgtgaagtaatgctatgtgaaatcgacataaaaaagttactgctcccgaagatcctttaatgcaatctccttacccttaattcaatgggcaagagaatcttcaattttcattttctttctcctctctacagtttcttaatcagagtggctatttccataacaataaaaactgcttcttacagaatcctcaggcaaaagaagtgttgtggctttttttcatttttaattcttttagagaattctctagggtctcactgctgcctagactggagtgcgaggccgtgatcatagctcactgcagcctcaaactcctgggctcaagcaattctcccacctcagcctcgcaagtagttaggattccaagcatgcaccaccaccacactaatttttttttttt

SEQ ID NO: 2819 - DNA, 2299 bp, Homo sapiens
cctctgcagccatgggcagaaagcagcctttacaaaggttagatgtggctatttcaagtgaggcccctgggccttcctactggaacctgggcttggctcctggctgttgtctctctcccctaggttcccgctgggaaggcttgataacaaaagcaggcttttaccagacaagcaaagatcaaaaaaagatgcaaacctttgtttgtttaatggaaattcctcagggttgctttcctgtgtattccaaagctatgacggaatagtttgaatagtgtgtgctctgactcatccatgacccctaagctcccaagatctcccaaatccgcaggccccgtttggcagagttgtggctcatggggatgacagagcagaatgtttagggtttctgcccaagagggagaccaataaaataggatgacaagtcttacgatgtccctacttctaaagagaaggtaagaaatcccgtgctgaacatccactaggttctgggtatatactttatacacacatggcccctttattcctctcagtgaccctcagggtaggtctcactacccaagtgttagagtgaaggacgctgagaccaagaagaggaacaggtcagggtcagacagagctggaatttggacacagttctgtctgactccagatattccttgtatcacacaatactgtcttctgaagcaagtgattgtccccaacacacacacacacacacacacactctctctctctctctctctctctctctctctctctctctctctcagcagagctgaggataaagaggaatatcctgcacacttcttccttctgtgtcagggaacatttgcttgtctacagctcgagtatttgtaaacactcagtagcacccaaaccctgagccctagcagtttccttttgcttgtttactagcaagagtagcatgtcggaggacgatgagacattgaatcaaactcttagacaagctggtgaaagttttaacgactgctggaggcaacatgcttccacactgacagaaatcatctttcaaaaatcctgcacatatctcaggcttatgaaacaaactaattcctaatagttggaaatgaattaaaagcttgcggtgagataaaagatagattttggctggatgtgatgactcatgcctgtgatccctacactttaggagggcacagcaggaggatcgcctgagcccaggaattcaagaccagcctggtcaacatagcaagactctctctctgcaaaaaaaaagaaaaaaaaaaaaacctcccaaaaaaaaggttttactaggcatgaaaatgagtccatttccattctaggccccaggatatcaccatgaccaataaaaacaatctgtggcactcagcaggtgcatgtcaacatgggcaggttctttctccccgtcagcaggacaagaacatctcccctatccaaaaggcacccactgaggatccgcagttctctggaattatgctgagcacccagatgtgtgcaactaagccctgagcagtcgatgtggagcgcacttgaaggcacttcatttttttttaagatacactcttaggagtttactttaacccacttcccagctcatagcacacgaggagaggcagacattttaaccttggtaagacctgacaaatgacaatagttggaccccacagcaatcattacttttgtagacagcaaagttatgctccttggcttcaggtgaagacccccagatccaggccagtggatttacaagtgagagtcagcagcactgggcatttcaggcaatagctctgaacaagccctttaccatgcgggtaggtaaaccccagaatatacagatgccccttacgatacatgggtggggagggtatgtggccgagagagcataagcttaggagacagagtggatttgaattccactgagcttttggctgtggacccatggggacgtggcatatgtctcgctgagccttagtttcctcctgcatggaatagggagagcaatagtacctgcctcattcagctaacgtgaggatctagagcagcatttgcataaatgacgcgtggggcacagagcagactcaacacagagcagcttacgttatgaggcttggcaggctgggagctcctgtcggcctctctcctcagctctgtgcccactgagctcggcacaagggttggcccatgacaggtgtttattatgtggaaataaatgagagggacaagacatttgctgatttcttcactgtttccaactgggaattcaaatgtatctcacgttcccataccctcacaataaatc

SEQ ID NO: 2820 - DNA, 53411 bp, Homo sapiens
aggccgccctgctagggccggagggaggtgggcacgccgggctcgggaccttcccggggtcctgcgcccgcccggcctcccgccctgggcatggttggcccactcctcccgcagccaccaacctgacagcccccgagggcgactccgccgacagaccgccatgcaccgggccccgccaccagcgccggccccacaacccgcctgcgccatagcccgcccgcccgcgcgcagcttgcctcgcgcgatatccaggttccagggccgccgcactttcctttcctcttggcgcgcctctaccgggccccggaacccgtatagaaaataccgggcacggtccaccccgccccccgcttcgccgcggcagccatccaacttatcctggttccggggctcctggagcccaggcggccgggatctgaaccgagctcttcggagccccgcccccaccaaggccggggtgacgcatggccagcgaggctgagcgcccagggaaggcgtgctgacgtcacgacgcccgggtcagggcctgggcgcggctcggagccgggtcgtcgctatagcaatcgggaaccgctacctgtccattccaaggattcggtccagcagaagcgtgaggaggtggcggaggccccgagggctttgcgtcatcacttctgcggcctgcgggcgagaaggtgcgcttcgggagtagcgcgggaggacaggaggcgcaggttgtgagggacgcaggccctggggcttcggtctctgtcctccgagctcagagcctccaggcttcttcccggccgcgcgctcagcactcactgtcttacggtcccgaagcgctttaaggtgcgcagtccgcaggccttgcctactgatcttccagccaccccttgaaggaagcagttgcaggtattaagagctccttattgaaaaggacgatgtagaggggcggtgagggactcgcctccgcagggagggcgccctggcggtcttctcaggttctctctcattcccgcgtcagctccaccgtcaggctcgaaaccgactactcccttttgtaggcttgctttgggttgaacataaaaaccaagcccctttactatttccctgctgggaggggctgcgattgggaaattttcagaaacctgagggaaaattaaaagggagcgagctttcggtaaaaaatcaaattaaaaaggaggggcgttagagaaggaactggtaaagattgccttttaggagaggaactgggtggctggaagaatgaggtgagaaactttcccctctctatcctttcagactttaactggtttcttttgtatcttccccgccccgaaaacaatttaacttaataagaataatttttaaaggacgtaaactagacacagttacaaagtacggggtttggggcttgtggtagctaaaggtgtctttggggatgcgggcatccttttcctctcctgcctgaagagcttaactagaaagcccccctttcggtcttagacatcccctcttcctgacttgttctggctgggaccagagttcagtttaggtaggccagtgagtgacatttgatggttagaattcctacggttagaattaatcccttctgtatctcctagtatggaaataaactgcctggccactatgctgccctctttccattcctttttggtggaagtttgacaagttatttcccatagaaaataacttataggccgggcgccgtggcttaaacgcctgtaatcccagcactttgggaggctgaggcgggcggatcacgaggtcaggagttcgagaccagcctggtcaacatagtgaaaccccccctctctactaaaaatacaaaaaaattagctgggcgtggtggcgggcgcctgtaatcccagctactccggaggttgaggcaggagaattgcttgaacccgggaggcggaggttgcagtgagccaagatcgcaccattgcagtccagcgcgggcaacagtgtgactccgtctcaaaaaaagaaaaaaaaaaagaaaaagaaaaagtaccttatagatacagagagaagattaagtagctcctcttataatatgaattgagggttagaaataccgcagggaatagaactcaggctgtacctgagtttgtccctctccaaccaccctttttccatagctctctctgtatatatatatctgtcttttctcacattccttacggatcgtaatctgatggccagtcacctctgcaattatacatttaacaagagctctgggaaacagtgtctgaatctgaagtaatgatcctaatggaaggtaatttcaggttctcaggagaattggtgaggatattttggagggcagtattgaagaccattgctagcagtttctctcctatcccttccactcaacatataggctggtgatcttcagacattttttagaatgaacccataaaagaattttgaagagctatgtacctcttgttcatttttaagttgatacctaaattttccttcattaatttaaatacttatagaggatacaatttcaaattttgacatcttaaactaagacttacatcattctttttttctgagacggagtctcgctctgtcaaccaggctggagtgctgcagtggcgaaatctcagctcactgcaacttccccttccaggttcaagcaattctcctgcctcagcctcccgagtagctgggactacaggtatgcgccaccatgcctggctaatttttagtagaaacggggtttcatggtgttagccaggatggtctcgatctcctgacctcgtgatccgcccgccttggcctcccaaagtgctgagattacaggcatgagccaccacacttggtctacatcattcttaatgtatctggcagggcaggcacagtggctcatgcttgtaatcccagcactttgggaggctgagacaggcggatcccgaggccaggagttcgagaccagcctggccaagatggtgaaaccctgtctctactaaaaatacaaaaattagccgggcatggtggtgcgtacctgtagtcctagctactcgggaggctgaggcaggagaatcacttgaactcgggaggcggaggttgcagtgagctgagatcgtgccactgcactctagcctgggctacagagtgagactgtctcacattaaaaaaaagtatccggtggattccaagtaccctaaaaatctaatgcctaccatcatccacttaaaaatatatgaacaagctcttcaacagaaattttatatggttctctttctccttatactttgaattccattcacttcctgtaatcattagtatataacttactaaactttttttttttactaaatattactaaatactaaattttcctaaatatttttaacatttttatgacttgtgaaacctaaaaagtacaatttttattgaaaatgcatctgttaatgagaaatatggtgtttctccccaattagttcaggtattcatggattaatattacctaatggtagaaggagataaggtgcaacatcaatcctttacctgttttttatttttatagacatgagtattgagaaaccttgtttccacaattgggaaaggaagagatttgttacaatgatattctttgagtctttgaacttctaaattatatgccaacaatcacagagtgatctattaatactatcaaatagagtcttcttttaattttgttaaaagcaaaggattagaaaccactgaacttccaaaaggatttagttattagagtctcagttttggttttattaaacatgattattaattatctgtgacctttacactcagagacactttgttaatcagatattgatttccatacttctttgcctacacaatattttttggtaaaattctttaattattacatgtcttcaagaactttttgttaaactgaaatgcagattcagctcattcactgtatagaaaacaactgccatttgtggaattggcaaagccagttttcatttcaaaccaatcagccaaatcagacctactttctgttagaaacatgtctgactttattcttccattcaaataaatatgttaacattcattttgaggaatattataaaaattattaggaaataaatgattaactatagcttataaaatggaccactgataaaccagtcaagattaaaattatttagacctactattaacataataaatggtaaaaataagatagtactgtttttcattatataattaggaataatgctgtataatgtatagttaaatccatcagttttgagaagtcatatagaaggcatatattcccttggtaaatgtgtgtgcctgctttcatcaaactcttgttgttcagcttttgggaacaattaaatgagaatcatgtctaaaaatcagaaataactaataatcttgttacacaaatttttttcttctgtattttttagaaaggaaagctgtatttgctaagaaataatgaattgagcagctagcaatttcactttttactaggaggtagaaaataataaacattttatataagataaaataggaagactgattgcaatgggaatattttgatatgaagtggaaaataattgctccctccaagctcctcaggtttttacaccctggaccatgcatcaagattcagtgtaggggagagacattcctttcttttgtaaagtaggacaaggactatggtgaaagtgggggcagtggtagagtggagaatgtgcatgaatatgtcagctggctcccaaatggattggtttttagaatttttttttttttttttttttgagacggagcctcgctctgtcacccaggctggagtgcaatggcatgatctcagctcactgtaacctctgcctcccgggttcaagcgattctcctgcctcagcctcctgagtagctgggattataggcgcgtgccaccacgcccggctaatttttgtatttttagtagagatggggtttcaccttgttggtcatgctggtctcaaactcctgaccttgtgatctgcctgtcttggcctcccaaagtgcggggattacaagcatgagccactgtgcctggccgttttttttgtttttgtttttgttttttgagatgaagttttgctcctgttgcccaggctggagtgcagtggcacgacctcggctcactgccacctccgcctcctgggttcaagcgattctcatgcctcagcctgccaagtagctgggattacaggtgcctgccaccacgcccggctgtttgtttttttttttttctgagatggagtcttgctctgttacccaggctggagtgcagtggcccaattcagctccctgcaacctccccttcctgggttcaagagattctcctgcctcagcctcccaggtagctataattacaggtgtgcactgccacacccggttaatttttgtatttttagtagaaatggggtttcactatgttggccaggctggtctcaaactcttacctcaggcgatccgcccgctacagcctcccaaagtgctgggattacaggtgtgagccagtgcacccggcctggttttagaaaatattttatagggaagttgaggatctggaaatttattcctttaaaactctcctcagactgatttgaggctatttcctgggtattccttgcagtcttacgtaccctaggaaaaatcttcatttaccccacttggaagacttcttaatataggcatatccaaactccaatgtccctgactatccattattttgagacaccaaagcaaatgtcctacgaagtaaggaggaagacgtgttgttcttagaatagaagtgagttatgagagaagtcaaagaggatggctccaagttggtatagtgtgaaggtcatggatatggtccttggctttgcagttctagaagtgtgattttgggtcagtccacacaaaggtgttcatgttttgtcacattaaatcaaactcataggaagttaatgtacataatagaatgccagtgcattcttttatacttacagccaccaagtgaactggattatcgctcctgttgggtaaatcttatctgggaagatcaattataatcagaaagttacatgaggagtgtggatcttgagcatggctattgtcaataagctgatgagcaggtgctcactacctggcatataataggatctcagtaattatggaatgaatgtacttcatctgtatcttcattatagatgctaaagggtaagtttaagattctgataggccaccccacatgttttttgatcaggtagatttttccttgttgctcaagttatactcttaaatggctatatcatgtagatattaaatccaataaaatttcatgaaagggaattatataattgcaacagcaaagttttatctatatctctgagcctagaaattgggactgttcatttataatagagattggagattgctttctcctgccctgtaggagtagtgatggtggtagtgactaaatgatctgtatttcacaatactatttggtggctaagagtgtactgcatacaaagaatgacactgggtgaccctcagtgctggcgctttcctagaggtgggacatcctgagtagggaggtgctgaaccacctgtgggctggccagctgttgtggactgtactgtggagaggaggaacaataaatttcccccactccttagatccccctcaggagataatacttgatgctgcttttaaggacagagaaaagacaagccttttcaaattttaaaatcattagggatgagttgccaaaaaatttgggttaagttttatctggaagccagaagacattgtctcctcaaggctttttctggctctgggataagctattgagatagaggaaaagatgccgggctgaggagtttcatttagtattttaataataataaaaaagacatacaaaatccaaacatttctttttacaattcagatacatatttttccccaagtgcaaaatactctatgaactgcatcatttgctgtttattgtcgattgtataggagatgcttactaaattggcagcagtggaaggcagatataaatacaatattttgaaatttcttctgcatttaacaaaaagcctcccacatggcgatgattattctgaaacttgagttcagctcacacagaagtataaagttttcagtttgttcaaactgctacaacctgtggtgtctaaaaaagctgatgacaactgggggttctattccttctaatcatatatttccttgtacaaataatggcacaaggatagggtgtgctacttttgagacgggtcaaatgtaaaaatatccttgtgttgttcgctcccacttttattgtgcttaagaaagaaacctggagggttaacattttctgcttatgctcagttatactttgtcttggtaccccttgtttgtggctgtaatattgaggttaagcagcaaatacaaaagttcgagtgctctataacgttttctgacattttgagatatgacctcataatccattccagagtcacctcaaacatgtatatagagaacacttctcatataaaaagtttctctagggccaaagaccaggactgtgttactgaactttcagcaacaaatctgagtctccaccacctcaaactgaccaaatcttgggggctgttaaagcagtcacagctcagtgccagcctttggggatttctaggcctggagcaggcagctcagatccaggatctggtcagttttcttctgactccaagagttgtctcaggttgtaggaataggcatggcctgataatatagaaagagggaggcagagaagtaaagaggaactgccatgttgctgaggatataagtgcctttctggtgtgcattacttggtgcgtgaagccctcccatttccaggctcagagcaggtgaggttttgtactaagatgaatggaagccccacaatactgtcgccccacaccctacacgctgcagagaggcctctgggttgcttcatgaagggatcctatttataccatctttccatttccctccaatggtaaaaacctctcttctgtctgacctgtaaagacctagaatgtccctgagcgttgactcctcattcaatccagttaacccctagtttgatgtcccagggccagcctcctccatagattcagcagcagctttgcctgggttcttaaccctccaacttggaggacctaaattaaacttggtggacaatagcaggtttttacctgctcaccaagatctgccttgacatcaattaagaagcctagtggtctatgccttccgtactgtggaactcatttgcaggtctcataagccatggaataaatggttgaaggatgtgtatttgtatgtatgtatgcatggtgtgacaggaaaggaagggagaaaggagaagccagaccctgaaggcataaattaagaagcatggtcaccgtttggctttccaagagacgcaaaacggctggcagagaggaatcagaaagttatcctaggctgggcgcggtggctcatgcctgtaatcccagcactttgggagactgaggcgggtggatcacctgaggtcaagagttcaagaccagcccgggcaacatggtgaaaccccatctctactaaaaatacaaaaattagctgggcgcggtggcgcatgcctgtaatcccagctacttgggaggccgaggcagaattgcttgagcctgggaggcggaggttgcagtaggccgagatagcaccattacactccagcctgggtgacagagcgagactccatctcaaaaaaaaaaaaaaaaaaaaagaaagaaagaaagaaagttatcctagcttctggtggagaattaggatagtcagagttgattaaagcagttttcatggtgcttcctgggaagtacagagacactcatactaaatgaccatttcccttgtttggaagcagccattttgcatctttacagtggccctccttgacccagaaagacaaaggtagccagacactctacccacaaggaccatgatgttggctaatggttgtcagggaatctagctgtgtcattggctacctactgctatggccgttttggctgatgaatgctactgatgggagggcagggagtcagactcctttatttagtgttgagtctcctgggggagcagtagcctaggacagtcacctagaaatgaacctgagctgttctgtgagttaccaggagagttaaaaagaaaaaaaaaaaaaaaagaaatgaacctgaggactcagttggtagcctttgattgattgggactacagctttgggggaactagagtgagaaaacagaaaataattttataggcaacacttggattaagggcagaatgtgtgcaggctttgggcttgggcatggacttgattcttcttccatttgattctttcttccttctgaaaaacagtagttgaggaagctaagcttgaagtcaacttcaaagggaagtgaccagagccaggcaaatatctgatgccttctgtcttattcttggctcccacagctttgtctctggcctcgggaccctgagtcagcccatccccaggtggtatgtcctggtcctcttccatgtgtacaccaggggataacaggatgaagacagggaaaagatggaggttttccctacttggggtagagaatcactgaccagttccattggcctctataatcatgaggtccacactgactccatggagaggcatagggatagcaagattggtttagcaaacataggtctctctcctttctgctccatcaaatccccagaattactttcctacacatcagatgcctctgcgcaattaccctggattaccacagccaagggctctaggtggccagtggtggcatagagacagatcagatgctccagcactcaaggttcatgagattcaaaaccgattttcttccactccaaacatacactcttttctcttgggcagctataaatagggttttgctaatagaggaagaagaaacaaaaacaaaaaacaaacccagaaaacaaaaacccctccgtctagacaacatagaaagactcaaaatgattgcacttattaggtgtggacagggtgggcaggaggctcgccaagtgcacacacattccttttgctgcccacagcctgaggccagaggtaggtggctccaggctggcttcagagtggggtcctctttggtgaagcccacaagccagctggggctacaagggaaaaacaactgtagggcaaggcctaggctggcttcaggtcaataaccatgtttaaggacaacatgtagcaaggggagtagggctcccccagggagcatcacatggggctgaggaggtggctgggccagggaagacaagaaaagggattagtgtttgaagttgacttccaattgttctgtgtctagtcctttagatgatacattttttctttctgttttcttttttttggcaatgctttaaaaccttgtttctgtcctgcagagttacagtctttctctcagggagctacagcggggcattcaccatgacaatgcctgctgctcttcctcatttagccggtgtccactaactcagtgttgtgggccatttgtaaacccttatggagtagaccccaggcagacgtagggaaagaaagagaggatctgtatagacaagaaagctggccatgtgggaagtccagagctcaaaccatgtgccccagaggactggtgctggcattaagcctgtaaatcaaaggcttctttggcaggaccctgggctgttagaatcaccctagggagcagagccaggggacattttggcccctgactagcaaggcacaaccctataatggcagaagcccttctttcccctccccgtttcccaccagacccacttccttgatgggcctctagcacccttccaagctgatggggtcgggaatgtgagctggtaaaatgggcagtggaaggggctgtactgtttctttacatctcacggggactagagccagtactgaatggcttttctaggtagtgtgttagaaaagggggaacagtagagaggcaggcagagagagacaaggaaaggaaactagaaagacagaaagggagagtgcctggtttgtgtagtgatattttttttttccctccaaaaagagaggagagagttccttgtctgagggtagggggctgccggctctgagggctaaggagtctgggggcttaaaaaattgggtctctgagcctagggttactatttgtagggcctcaggaagctggaaactttggagcggagcagcttgatgaaggattttggcagcatctccttgtgtttctctgtgtacttgaagtagttctgggggtgggctagcacctcaaagaaggccttgatgagcttcttgtcctgcaaaggatggcagggagcaatgtcagcctcaccgtcgggggtgggaaagagaaacaccatgactcagcagcccttcttgatgtctactaggcatcctatactgaatatatccagagggcaactctggattcccattcccaccatctgcccttattctggaattccacaactgaatcagtggcagctccatccttctgttgcttaggccccaatccttggagccatccttgaatcctctttcttgcttacaagtatagcaaatcctattgactctaccttcaaaatatgtctgggtctgaccacttatcatcttcccaagccaccactgtctctgacttggagtactgtagtagcctcctaactggtctccatgctacctttgtccctccgtagactcttctccccacagcagccagagtgactttttgtgtttttaattagttcatctttttcctgtttgaaactcttctctggtttcttttatcactcattggcagaatgtgatctgtatcttgctttccacctccactcttgctccctctgctgagccacactggccttctggaggttcctgaacacactaaattgctcccatgctccttagcttggaatgctcctccctcatcttctaatggggagcccttttacctcatttgggtctcttctccttagaggcctttcctgaccaccctgtctacaacagtagcatggtatgtggagagcctactaggtgccaggcactgtgcattaaaactcaggtcttctggctcctaggctggtgctccttccatggcgtcagtggatttttcaaataagaagtaggggtttcagcctcttaccccactttaatcagaacagctgcactgctttatgtgttggaattccacagtacatttgatttgaaataagggttcagatgctttaaaaatgtttgaaaagtattattaaaagtatattctttgaagtctgcaagttctaggtgatttttgttgtcaaggcttttattttgatgataatataaaaatattttgctaacacttaacttttttgcagtgataatttatgaaggataattctatgactacgactatagtttccttttttttttttttttgagactgagtctaactcttgttgcccaggctggagtgcaatggcatgatatcagctcactgcaacctctgcctccccggtccaagcaattctcctgcctcagggtcccgagtagctgggattgcaggcgcccgccaccacacccagctaattttttgtatttttttagtaaagacggggtttcactatgttggccaggctggtctggaactcctgacctcaggcgatccacccgcctcagccccccaaagtgctgggattacaggcatgatccaccatgcgcagccagactatagtttcttaaggaagattttcttaaattgggattcaccgacccagggcatctagtccattcttccatgttggaagtatttattttccttgaaaagaagtctgtacataaattgattctgagaaagctgtgctagatctgccgctgctttttttgtttttgtttttttgagacagggttcactcttgtcacccaggctggagtgcgatggcgccatctcggctcactgcaacctgcgcctcctgagttcaagcaattctcctgcctcagcctcctgagtagctgggattacaggcgcctgccaccgcacccggataattttgtatttttacaaaattaagacgaggtttcaccatgttggccaggctggtctcaaactcctgacctcatgtgatccacccgcctcggcctcccaaagtgctgggatgacaggcgtgaaccaccacacgcagcctatctgctgctgcttaatgaggcctggggagagaataggggaaggaagggacttatgcaaaagtatctttctatacttcactttccctatgtctcttggaagaggtagggacatttcttctcctcactttccctttctcttccaagttttccccaaggtgtaatatagtgtgggtgacgctgcagtcggataggcttgggctcaaatcccagcttcccatggggcaggttctttaactctctataccccagttttcccatctgtaaagaagcaatggagaaagcacctacctcatagagctattgtgtctatcaagtgagaatattcatgtaagcacttagcctattgcctatatattgttacatgcttattaaatgttagctatcattattgttaatattcattcacctttaaaatctcctggtggttttcagaggcatagagccggccatctcgcacaatgtcttctaccagctgctcatagtcctctgcaaagtcaaccaaggtgaggggctcaggggcgggagctcttcctgctctcctggttccctctcaaaactgacatacctccccttctcacccacctccttggcttaccatcataggtaacatagggaatctggaagccacgggcgctgttggcctcgcttgtcttgaagttgatccagagcttcctggaacgggcagtgaaggcaatgggacgctcgtaggtctggcaggtctcataagtggtaatggaggatggggatgctgggaaggcaagcagcaggtcagtagagcagcagggcaggctacccaagccctcctagaacgtgggctgtacagctggtggtgggggtatagggcaagagaatcattctgacaaaggctcccccttcgcatacacacaccctaccccacaccctctcccattgcccactgggctcattccacaattcctccttgatacctgggcactcacatagtgtaataaatatgacatttaaatgaatggaatggcaaaaatgctaggataggaaagtgatacatgtaacgccattggagttctagccccactgctagctttcttaactctgttttctaccaaacatgtgtcattgctgttttcctttgttagcttctctcttcctaaaggcctctcactatttcaccctcatagatccctaacttcactgccccatttcttcctgtatcagtctctctctttgttctccgccttaaccagatttggactgcccttccctggcccagctctgcaagccacccacagttctttctcatgacgaggacgtccccacactcatcctcagatggcaggaagatctctggtaccacgataaggatcttgcgcttgggtggggggttgatgttccagatgcactccacaccagctgggtagttgcccgggtagttgggggactcaatatagccagtgaactcacccagctccccaccacactgacgatctgcagccaaaccccagtggataaaacaagacagagaagggaagtcagtggggaagtgtgctgggggaattgaagagttctgaagtagaggtcagacatttatgggaagtctgcgttctagttcatcattattttccaagctctgagtccatcttccttcctgcccttttagtaccttctcttctcacttcacctgtctctgcttcctcattaactgtctccagggagagggtgttacagggtccagcctagcaactggccttgagattgagtgagttggggagaggtggaaggtggagttttcctgctcctccaccccccagccctgctccctgttggtttcacacccctcctttagatgtccactgctcccaggcctctctcctcccttttgcacagcctggcttgccacgtactcttgcattgggccacactggtagagccatcaaagtctgtgcttgtgtttcctggacagcggctgcagaagttctgacggaagtcgggctgataggagcccatggcacagcgaatacagcggtggatgctggtgttgtagtagtgccctggggagcactggactgtaggcaagggagaagggcaggaatcaagatggtaggcaggtgggagttacggggcatgggatggacaggatacattcatcctggagaatcaggagatcagatacatcaaagttcttttctagggtctcaatctttcccagtcatgccagaatttaagcccacggaaaaacagagtttacagagtggttggctacagtgccaatccttttctttcagacgctgagcacagtgccaaacctatatagaaactcatttgggatatggaggagaatatgccaccagttctccaaagtggaggggtaagtgggactgttaattatttctcagttcccaagcttgggactagtggaggggcagggtgggtcctggaagcaggatggtatggttggtcaagtagctgggcccattactggtttggagaaaatggtgggtcagtgtcccctctgggaaattggagagttttttgggagtagttggggttggggcatcccccagggaggtgagtagcttactcacctttggtgtcacagtcttggaaggaaatggccccttcatgcttggtggtgaggcccccaccacaagggaagcatagggtccgtcctgcttcaggttggtaggtgccacgtgggcatggctgacagggcttgaacccatctacagagtgttggccaggtgggcactgacctgcaatgaatcaagggcccaactctgatggggatggtcctgagtcatccccatggggtcacccgatctcaggggacaaaggtatacaaacaggatgttgactaagagagtggcctggagcctgggcctgccctttgggaaatcccatgcccatgggcatcccagtgcccaccctaccccactctgtattgtttgttcccctggcacctgcacacgtggtgacgttggtggctccaagaggcccgtgggcatcactcccagggcaaaggtcgcaggagagctgcccttctctctcctggaaggtgcccgctgggcatggcacacactgctccgtctggccgtggtaatacgttccctgcgggcagctgactgagggagagtcggccgcgctagccacccacccccgcatttcccaccacccaggcctgggactccccttcccactccccgccacaacccccgattcagggagaatctctgtcagggaacaaacacaatcctacttggggggataggagggtcaaaaccgtgtgcaggaggattgctggccccacctggcatccttctagatttcagcctggaaccaaggaagggaggacagcgggcaggagcatcctggctgcctcataatttgagaaatgcatctgaggccacaaagggtcctgctctgagtcaggcccaaactgggtctttcctacatccctgctccccagtaagctcccttaccacacttggtcccagcacggtgctgcccgggcctacaggactccatcggctctgctcgctccccggctaccaggcccggcttgtgggccagctcataatcaaggcctgccaggcgcagcaggaagcggtcctggttgatggactttctgagcatcttcagggatcctttcagccgccgttccattcgctgtcggaggcagggcagcccacagctggctggtggtggatggccgtgtgtatcagggaggagaaagagttgctgtgagcaggagggcaggggagcaaagctgggagctaggaggggcatggtaagagggactagcttttaggcttggcaccaggcagggtctgcccctagtacaggctccatcccttccttttgctgctgagacctgtggtttccccacctctgccctccccttccagtcctcttcccaacagtgcccccagtcccacctgtggtttcttcggctctgacctctgcctccagttccagggtgagccttgtgacctctttgcctggaggggtccgggcccgtcggcccttgcccttccgagaggagtcacacttaaggtggatgaaggtgacctggcattcagagcagggggcaccacctgggagagagggcttgtcaaccccagggacatcccctggaaagttctcactcccagcccagacagacctccccagatctctaactgtaactatctctcaatcctgttttagtctagggtcctaattagttggtggaggggaatattctgggacttccttgggtgctatgcctacagctgctttttcctctgctctgcctagagttcagggttctggtgggtttttggaagcagaggagctgaggggtaaggaggatttagtggccagacagccaactggaatggggtccccagtccaaacctggccctgtgattctgccagcctcctctgttttgcctttgtttcgcaggtgcaaacggcatttggcatccttgatcttgaaggaggcccgttgtttaatggacagcactgcagcctctagagggatggtagaaactcagcacagtatgggatgcccatggaggtcgggggtgccgtaggggttgttgagaagctgggtaataagccaggggcttggctgggggagtgagattatgaaagtcaaggggatcagatgttagggcagagggagtgagggagcagggttggagaattacagggcaaaaaagaggatccaggagaaaggaaggccaggggattgatgaagaacaaaaataagggattaatgtaagagagtagggtgggaacagggcttctgggctggtgcttaccatggcagtggttggagttggtgctgttcccattgtggccagctcgggctggagcagccctggggctgggggtcccacagctcaccgtgaagccattctcagactctgagaaaaggagcctgtcacagttctgacctgccttcccaacccccgctggctggaggaatccagggggaatgaaggagctgcctgaacggccagtccttcctcttttctcctccaaagctctccagcaccctcctcccatgtacctggcaaaaatcgggccctggagggacaggtcagggcacaggtgtccttcttgccagaccggttgcagctgagcatggctttcgaggccccaggactgccctgacacttcagtggctctaggaaggggagagaggcctgagcaaatgaatgcattcctttccctcagttgggtaatttggaggaatcagctacttgcataactattgttgtacccatggagactgatgatgggattgtttactacaaatttcatgtctttaactcaaaatggctacattctccaccctttccacctcacacctttccccaatgtgatactctatgctttccagaaccccaactgctccctgaaatggcagtgtcatctttggccagcagagggcactgcccacctgtgcaatctttgccattccagtgcagccgaccctggcctgctgggcaggtacactggtagctgccaggagtgttgatgcagccaaagcggcaacctccccggttgatgctgcattcatccacatctgggggaaggagtagggagacagaaaaacaacgatggagttggaggaggagccggagagtaggcagtgagtgagggcctttggttagagtttcaggtaccctgcattacgcaagatgaataagttcgagagatctactgtacaacagtgtgcctataggcacataaatactgtagtgtacacttaaaaacttaagagggtagatctcttgttaaatattcttacaatttaaaaaagttaaaaaggcattctaggcactgtaagatgactactggcctgagaagagctcaaacctcctccaattatctctgtccccaaaggaatgatcgagaaggggccaagccaacaagctttttaaagccttccactcctcccaaccagtgagactgtcatttgggagctgagagtgggggttcagggacagttataggaatgggagataggaattttggaggcaggatgctgtttccgcagtctcccagttcttcaaaagctgtcttaattcctcctattttgtcacagcggatgcagacatggtgcatgcatccagggattgcccatagccacaagccaacacaaggacctgttcaattggagggtgaagaggtgagggggccagggtggctgggggtgcaagcttactagcttacccccacagtgggtgataccatacaacaggtagccacgatggcagagacactggaagcttcctggtgtgttgacacatatgtggtcacaggttcgatcaaaggaacactcgtctatatctggaagagcaaagattcaagccactgaatctgtcttggagcacttgacccttgctcaggtgaaggacccaagtgaggggccttggctttcccccttgaactgaagagttcctattcatgtcctagctctaggaccagtgatttaacaatgccattccatcttctctgccccctctatttgaagtccttggaattaggaactgcaagatctggtgcctttaggtcagggcccaccatgtgtggttaggtacgtcctactctgccaaggatatgaattggggtgaaatccatccctcagtccttgccaggctgaatgctttgatatggagctagtccgctgaggggaaagagtaccatttgctaatttgcaggatgacactgcctctagagactctgtgtgatatctattgagtttctaagactttagccctctggcctccttgaagctctcccacaagaacctctcctaaggctttcacctttggctgagtctgctcaccctggcagttcctctcattgatgagaagcttatagcctttcttgcaactgcattcgaagctgcccactgtgttgcggcaaatatggtcacagcccccgttgtttaagcggcactcatctatatctgaagaaggaggacaaaacaggataaaagatactatcaaaggctgagaacaaacaaggagaaagatccctccctcactgacagagacatgcaaaaatcaaggagtcctgggcctgcctcttcttgatctctctctgtctctttctctttctctttcctgtctctctctctctttcctgtctctgtttcttccctgttcaggggatctgtggccattagtaacaccctctcttctgggattgagtgttcttataaggggacaaattggaaccaaaactaggaacaggccctcagggaattacctagaggaggggcaggtgggcatttgacctaacaggctagcccttagtctccagctgatggccattccctgaaaggttggtgggtaagggttatctctttcctgtccctcaggacggggggttgggggggtgcggggcaaggagaggtggagggtctaaagggactcactgaaaacgggcagccctttagggaggaggaggagctgggaaagaggccaggcagggaggacctccaggagagccagtgaggctgggtagctgatgggggagggctgggggccaggcaaggggctggactgggagagatctggagagactcaggcctgaggcagctttcagcactagtaagggaaaggggggctggtgaatggcttccttcctgaggtcaagttccccaagctggtggcagacaggacccaggctactcacccctggttgggggaaggggcagggagggcagcctttcacttcactcttagcatacctgtcaacagttcttcccagcaggaaacctctcaactctggctggctgacctgctgccctagcctcccccctcctctcgcagctgttgggccaaaagacacaaagaacgagcccagtcctcctcgtccccactccttgtgaccaggggatatggacctaatgaatcatcattttcagtatggctaccctgcctttttcctccaccctttccccccattctccctcagacctggctaattaaaaggaagggaaacagaatgcataatgtgggtaactatactgtaataacagttaacacaaagtgtttccatttgccaagcactgttctaagtactttttatgtaatcactcttttaatcacaacacagtatgaggcgagcactatggaaaactgaggcacagagacattaagtgacttgtccaggatcacagagctagtaggagacagggctgggatctgaacccagcttcagtcctcctaactagtatcctactctccctttgaccagtacagcctttcgaggggtagacatcatttccccagagcccactgggaaggtctgaggaatgtggggtaagaaggttatggaacacacctgtgacctcatgcacacacacagtcagggctcaaatatccttccagacccaggagcaaatgtgaatcgcatgtccattaactaagagggttagggacccatgggggataggaatgagagtagggaaacaaggtggggtaggggaagggggcactaaggaactggctggacttctctgtcccttgaactgagatgaaacaggcagataggagacaacccttagctatgtcctgggttcttcataagaaggaggttgaggaggtgtcatcccctaataggcaccctatctctggtcccaacctcagccccttaccaaaggtcactctgcttctgtcctctcaaagtccttacctttgcacgtcttcctgtctggctgcagcatgaagcccacagggcaggtgcagtggacaccagtcgctgcatcatggcacttactgtcacagcccccgttgttgacagcacaggtctctgtttaggagggaagtgggggatggtaatgaggttacaagcctggaggagtcccaaactctgagggtagtggagaccacagaggcccgagggaaggcctcagctgcctctctgtgctttagaaggagcattaagccaagggaggctcccagcccctttcctcccatcactcccaacccccatcccctcacaagtacagccaagcagtccacttccctgccccctacttgattgaaacaaggtggacagcagtgaggcaggtacaagccagagctgtcaggcaggaatgtgccgagggggtggaggaggtggggcggggggcagtagggagggatgggagctaagtgagggtggttctggctgccagggaaccagaagggacagataggagtttcttcctctttccactatgtctttggtgggtgggtggggattgtggtgggacaatcttattgtaagtggattggaaagaatgagccgggccattcctaaggcaactgaaggatacccatcaatttatcttccccttccccgctgcctagctgtcttaagaaagatcccacttccaggatcgactgactgctcatcctcagaggaggtagcacatactgggttaatctaccttcaactcctcccaaaccctccttttagttctagatggagataagctggctgttttgttgttttactctgctaatggggagatgttgtataggagaggggagaagcaaaagaaagagaagaatccagaggagaaggaagggtgtaaaaaggttagtgaaagagttagagaacctcagagctagataagacctaaatccttattttagctaagtctcttatgctgctccctcttaactggtaagttttccctttcactaaaaggtcagagtaggaggagtgtcgatgggtcactctccctattttctgaattcacagcaggagaaaaacaggtttaaatggtagcttgggaaagtcagatgtgtccaaggaaaagccattagttcaaacagtgaaggcccctgatacagagactgtggaggtggtgcatactgtcctcttggggtgactagaattctcccattagagagaaagaatcccaagacctccactagggaagatagaagaatggttctcagaatcaagggaattgaataagaccagtactggatgtactgtcatcttcttaagtctctgactccccacactcaggcccaactcttgtcaccaatgagaacaggaaggccagggctccaaaagaagcctaactctatgggtccctggccatgccctggtccctcaaatgcccatgtgtggaacagcccaacctggagtgggatatcgtctgtgccatttccactttagtctctcctgaggctctccaagaccatgggaggaacctagtagggaacattgagttcaggttccaaggctagccacccgctaaagagtgcttttagcataagaagaggtccactaagcccaggagcagggggaggggcacagagatcttatgccaaggccagatagcttctgaaggatgtaggatacggaatagcagagctggcacaatgtccatcccaggctggacagaaagctgggcatagccgcccacctgtgcaggacggcattcttgagagcagggtggggcagcaggaccatatagtctcacccctttgctctctaggtcacaatattaaaaccacaagttactctgtgcttatgctgtgccaggcacttgccaggtagatgctctacatgcactatctcaagcattacaaccctaaggaaggactgttattttatagaaaagtaaactgaggatcagagaggaaagtagcttgcctaaggtcatacagttagaaagtaacagagccaggattcaaactcaggtctgcctgaacacacatgccatgctcttagccattacggtaggagagaatggtgagtgatgctgggactgtgaactaatgtgggtaagaacccaagaaagaagccccaaggaggggatggcatctaatcctatcgcacccctatctcaggtggcacagtgggcatgacagggaagatgaggctggctgggtagaggggggtggggagcagatggctgggagtggggtggggtgttagaaggtgggtgtgggaggagacagcagaagaggaagggcagaaggagagtgacaggaacaaagacgagaccaacatgaaagctcccgggccagctcttagggactcaggtttcttgtcacccaatgggcccagtgccctggctgccaggatagccctgctggcaagttggggcccagtcaggctgggcccagtgggcatgcagttagtgggagccccagcgggttagcccttcccctagcaagccagtgagagcaagcggagagagcagacatatttaccattagaaacggcttgagtggggatgtgctgctctagccgcctttcccctgtttgacattgtaaaaaagctgtttaggtgctgggcagaagccactgtggccctctggccccggacccctccccaccctctcctccccactgccagcccaaaccagtagccccaaatgatgagccctgggacccttatgacagcttcactcctcatccttatcctgtctggtggtatccccaaagatgccaagctccccgcaagtgactgaaaaactgaaacagtctcagaaagggcaaccaaccatgtgcccagtaccacagagcatgctcaagcctaagctgggatgcaccctcaagtcttactaaccacaaaatcccaaatcccaaagggtgccgccctttctgctaaactatactgccttctcagtcttcccaccgaatctgaatgtcctgacggccccaggcaatgatgtttcctcttaccagggatggccagaaaaattagatatatggcaaggtaaaataagttctattggagaagaggaagaggaactaggaaagaatatagctgtaaaccccagaatagcctcatttggtcttttctgcctcatttggccttttctgcctcatttggccacagcccagtggtggaacaggtcttgagttagagaagagcccaagctcagtaagggtgttttcagaagcaaccatgtctggaactttgaacagaaataaatcagagagggatcagaccttcacatccctggcccctgactcatgcatcttttctttgggcactgcaaacaatttcttttgagagactggggatgtgtgaatgtgtccaggaggtggtgagagctttgaaaagcaaaataattagacctatgagtaaaaaatgaaaggagctgaaacacaccagcccaaagaaggcaatgagaagagcctaaaaatgttctggggtctttgaagagttaattcagagggaaacgtggcaggggagattttaattatatagggactttagaaatggatgtgccagtctctggagcaagtgcctgagggagccctgtaagagcatcatctgctctccagttcctattcctgcagtgaaagggacaggtccctggaaagtctagttcctcagttaatgtcatgtctctgatatacataacttcatacacagtgactggattcacacacccccatcctcagcatgccacagcccaccagatggacagtcattcataaacacctatgcccacacagcaagctcatgccctgcctggctaaagacacagcctctctctcagccaaacctcttcctttcatttcccccttctccaaggggaaaccttgttccatcatccttctcagcactaaagacctaaaggctaaaggaattaggaattaactttaaggaattaaactcatctagggtacctgaaaatatgtgagataaggcctaagaattcaggaagagggatccaggtattaagaggacctcaaatcaaggtaagagatggaaggctggagttggtgaggaagaaacagggttgctggtggagctgagagggagtaccactggcatctggaggagagagaaggaaatggggggtaaggtgaggtgagtagaaaggggagttgcaggaggagagtgaggagagaaggaataaagaggaaaaagatacctggagccaggaaaccccatctgtcagtcagttcagggatggttgttccaggaaggagcactctgtcccaccctcagttgcagagtggggacactgggctttgataattcctctgttatcacactagtcaaccaagggcctctggtcaggcctaagcagatgcatttccccagatctcttcccacttctcaactacagccttggtcaataagcaactctgctaattattcccagtttggcaacactttgtcctgggatgaagagggtggtgaggctcctggaacagggtggtaaaaccactgggatggggaggggaagagggctggggagcccttcagtctctctttgagttgtcccttactagacctggcattttctgggtcttaactccctcaccagtccctctgtgcccagcacctgggccccatgcactcctccacttccctggttcccaaagggtcccacccccaccccatctcaggtggactgagttctcccctggcctcacccaccgatgcatgtcttcccgtcggtatggagcacaaacttgatatggcagccgcaccggggaccctgctctgtgtcatcacacgtgtgctggcagccgccgttaccatagttgcatgtcactgtgcacagagaggacagggccctgtcagcttgctcctccctgcatccacagttttccacaatgtgggtactggcccccttgcctagttgcctcccccatactcccttttcctcccagccctgtcctcttgctcctgaagccctatacccttcctctatgttttcacccccgaccccactgccccacctgccatcccaattatctcacatttacagtcccgttggttcttggtaagctcaaagccaggacggcattcacaggcaataccccccttgggtgtctcccggcaaatgtgggcacagccgtggttcttgttcatgcaattcattccttctaaaagagaagaaaggggtgtgaatgctctgtacccctggatgtctagaaaagaaaaactacagggggcaactggggacctagggaactgggagaattctactgaggttgaattcaacacgaggggactgactctccttgtcccaggcctcctgtcttccccacagacctgggtgctcatgagcagagcacagagctgttctgaatgatgtataactagctagctattgatactcatcccaacgaatgatcaccctttcctttaaacaaccaaaacattgtgtataataggtgtccagcactgtgctggagatggggtggatttaggaaggtcctagaaaaatacaaggtgtgatcactcccctcaaagagcttacagtcaaactgggaagaagatcagtagcaatcagatctacaatgagagtggagggtaattggtatagatatttactatgcaattttattcaacaaacatttattaaactctcactacacgcagggcagtatgttaggtgctggggatacaacaatgagttagacatagtccctgccctcagggatgtcacagtctagtgggagtggggggcatgagtcatagaaacagccaatataaacccattattcctgcctgaccctcccatgccaatccaaggaaaaagatatggtgaggccctctcagataggcagcagcttagagaagctcagccatctacaattagggacaacatccacctcaggtctggacacagaggatactccatagtagccttaatcccatattgatcccaacctcaaagtaatttccccagattttgccctaacagggtgtctgttcctagatcctttagggtgtgattgagttgaaggacaagagaagaaggagctagctgagttgagaatggagggtgagacttaggggctgctgagggacagctgggaagagaagcctggggagggcagggatggggccatcccaggtcatgggctgaccttctggccgctggatacaggtatgctggttgtcgctgaggaagaagccttcccggcagtggcactcatagctgcccatcatgttgacacagctctgctgacagccgccgttgccctcggcacactcgtccacatctgtgcaggataggtagtcagtggggtcatggggtacaggcagggtccagggtatatcccaagacttcagcaccaaaggcagtcttaagaactactaccccctaagcccagccttaagccaggaagtcctcacacccttgtcagctaatatttcactaagtgtaaaaaggctgccctgagggcagagctgggaagctaagcaagtgggggaaaaggggacctttgaacctcaaatgtcacctaggtgaagccatgcctccctttccctcacctgtgtaaactgggtatgaagacagaggacaccaggaaagaagccagagaaagaggaacagtgatgaaggtaaggatggagattggtcacattggtcggataggtaactgggggttgcagctggttgcaatgagcagccagggaatgtaggaacctgggaagtggctctgggtgcaggcagagctatggccatggtgctgaggttggaggggcagggtggggaaaggcagctgagcctcacctccttgtggagcagggaccatttctgtggacaggccacagccctgtccttcctcccctcccccctgtgcctgggcttgctgccatattccctagcctttctcctattttggcttaacaaaacaaagtctgacaacttggcggggagggatctggggagagctgccaggccacaccctagatggtgggggtggggggcagggagaacagtaggctctcacccccaaatcaccacccctaggttctagagccaagctcaccctggagcccccaattcaacaccttgattccatctctatgctagctactgccctcccaagtccatggcccttctcagtttgccttggcccaggaggcatcacgtagattggttgtcaaatggagcagctagaatctgggctcctgagggcttcatctgcccctctcttcccatcctctctgctgagatcctgcaaccttctcttccccttctggccagggcagagaggcccagatccagctggctcttgcccaagagatgcacctgttggaagagctaaggtgtactttcctgtgctttgctcctgtctctaccctgtcttttgctgttctcttgacttctccccatccctgtcttcctgctcttgccacattctacatgccatccttctgtctgctcccttactatctaaccttgtggctttgctactctagccaagctctttcctccaattctcagtggggaagctaaggcccagagcatggacaactttctcaaaattcccctaagagccaaaggtagtattgagactttgaaccctaaccctaggtaatctttgtcccttgaccctctctatacctaatcattctcttgtccctctggttggttctccccaaaacacttatagggaaatgagatgtggtgacaatcaggggcctagaaaagtcaaaggcagccaaagaactcagaagcttatgtgcatgtcctgtaggcaactcactgtcctggtctaagtgccacagcttcccttcccaaaggagtttcataagaggccctcaagggtgactgggcagatatgaggcccttccctggaagctaaaatggtaggagaggtgaccagggctgggattaagggcccagcagatatcagggtttggaggccagggttgggtgtagaaacctatagcctgggtccaatgatgggttatgactaggtttggaggcagctctgcagtaaggaggctcttctcagccaataggacttaagagaattcatctatttggtcaattggtgggtgaggaccagcccagcctgcttttctgggcatcattccttttgtttctcttcctttcctggtcctttatgcttctagtgcctgttttctgttgtggctacagggtgaagtaatttgggagaaggccctgggttcaaatttcaaatccttttctgctatgagcttcagattttctgcttggggaagagtctgacttggtcccagtaattttccaaaatgacagagaccaaagttgagttcagttccttagagattctcttatctctgatccagctcctgggacaaaggagatcagtgaggagagggtgagactggagattgcaggaagaactgggagaaaacaagcctgtaagggtcagaggcttcctggggcatagggatgcactgtcgtcatcatcaaaaacattcttcccattactgagctcctaccatgtgctaaggattgtacagggctcttttcatatgttgtcttgtggtgatccgcacagcagccttcaagtgggttattaccaccccattctattttattgttattttttgagataagattgctcgatctggagcgcagtgacacaatcacagctaactgcagcctcgacttcctaggctcaagccaaggaagagctcccaagtagctggggactacaggtatgcaccatcatgactgactaatttttattattattattttttgtagaaacagggtctcactatgttgcccaggcctgtcttgaactcctgggctctagcagtccctctgcctcggcctcccaaagtgctgggattacaggtgtgagctaccacacctggtcccacccccattttagagaggagaaagatgagatttccagagattggctgatttgcccaagacccaaggctagtaagcagcagaaccaagatatctgtgtggagccaaatcagcttcctaccatgcctcaccactggctaaacccactattcccatctcctggcccttgccctaggagcatttcgtagcagcttttcctctaatgtttttcatccagcaggatttttcatcctaagtggccagtctcaaaggggaggctgaccttattctcttgtgaatgtagctcttcttgatcactctctcctccttccctgggaaataggaaatgctgaaaagatctctttctccacaagacatccctccaccaaatcccctctcctttgcttacccagacagttgtgtccgtcatgtgccaggtggaatccatcatagcaggtacaccggtaattgccagggatgttgacacagtcatgcacacaacctgcattatcctctcgctcgcactcatccacgtctgtgggcaaagggaagctgagacagctgaacccacctgcgaacccactgtccacccccagactcagccttatggttgtgtttacatagttatgttcatggcctataagccatttagcatttttctgttttcatttaaacctaagtcatgaacattttcaggtctccatccagtctttctaattaccattgtacatggttgcagaatattatttttctatttttttctctattgttagagatttagatttctttaatttattttaccatcatagataatgcatcaaagaacatcttctcccatgtattattttgttactttgaataagtccccaagagtaaaattcctggatcaaaggaaataccttttaagattcctggtaggtattacaaaattacttttcaatttataatgcaactaggaattaacaagtgtaccctgtccactaaagtctcaccaacactgaagctcataaatttaatatctcaaggctactttaatttgcattgatttaattatgaggggaagatgtgtttacattatgaacttcctctgaagcacactttctgttcccatccattgtggatgtggtgtaagggtctaaagataaaggttccaatgtcagggaacctcaggtcttagtcttatgattttcatgctcccaccccagccaggttgtgggctgtgaactgtccccaccagggcctctgctagcctgcatggtgcctttgtgcaaattagaaaatggcaccctctctgggaagatgcagttgcccccctcaccacccccccaccacttgaccagtggaatttctagccttgatgtgatggagagtggccaactgagggcagtggcactggtttgccttcttccacaggtccctctcctccaggtgcccttccagcctcacctttgcagtgtttgccgtcccctgtgtagccagacttgcagatgcacttgtatgacctcggggtgttctggcagatagcatcgatgtggcagttgtcagtcccctccacacactcatccacatctggcaggggcagagggggcacatgagaacctctgttggcacctcttaaggggtgtcttgaaggtgggcttccaagggcagaatcccctcttctctaaaacagaggcagtgaccccctccagaaacaggtgctgtctcacatctctctgatttcagagtaggcagacactgattttgggaattcagaaggaacccccactgccctcaaaaatactaaattcacagtgacagctaaaactccatcattcgaaacactcctttttttatttgaaaacaaacaaaaaacccttagagtgggtagtacacttaacttgattaggaataatcaacttaaagtgaatgagtttacggagaaggcttagagggaaagttaagggaaaaggcatgggaacagtggtctctgggaaggtggcagggtccagcaatcactagtaaaggaggaagaaagggggatggggcatctgagggatcttcatctgtgtcatgattctgcttgagaccaggcctgcttccacttgcccaccatggagccaagaagctttagaggaaaaatgttccatcctggatgattttcctcggcccctgtgctgccaacaatggagacatccagagctggcagaggttggcaccagctacctgaagcctaataagtgcagcccttcaggccctaatccccagtgtttagccctctgtctcctggccctagctctaacaataggtgctacacacacagctatacttgaaggaagaggccactcaccatctagcaaaaaagaggatggttaggaaaggacatagatgatgccaggcgcggtggctcatgcctgtaatcccagcactttgggaggccaaggcaggtggatcatgaggtcaggagttcgagaccagcctgaccttgatgaaaccccatctctactaaaaatacaaaaattagccaggtgtggtgatgtgtgcctgtaatcccagctactcaggaggctgtggcaggagaatcgcttgaaccagggaggcggaggttgcagtgagctgagatcgcgctaatgcactccagcctgggcgacagtgagactctatctcaaaaaaaaaaaaaaaaaaaaaaggacatagaaaagagtccaacttctgaggcaatattatggtgcccttaaatctgaactgaaatagagaaacatgttattcagttgaaaacgccttattgagtgtgtttgtgaaagacactataatgatagctgtggaggctcaaaggtgactcagcccagccaaaaggagaaacaaaaaacatggagcagaatgtggtacatgccctgaagacatgagagataaggtgagggggtcctccaccctgcacatcagagtcaactctcctaggagatgtccaagccacaaccccagagattctggtcagatagcctggactggtgccgggccatcagtatttttctaaagctcttccagttattctaatgtgtagtcaaggttgagaacctgtgttacggggcagatcagaggagaaagagattacttccagctggaaactgggaaacccaaaatagtgtcttaagtagcagcctgcaagtgagtgatcactgaatgggaggcattactctcctgtgatcccacaactgagcacagaaaggagatgagatttgacaccaagacaatttgatatccaagtgtgatctatgggccatagaattgcctaggttttattaaaatgcagattctcaggactcattatagcctttttgaatccaaatccttaagtgattatttttactgagtgaatggatgcatggaccagtattctctccaatttatagatacccagagtcctagcttgagacagttatctgtcctccgcttttatactctgaaacttcctggggctaagaagagaactgaaatccccaaacaccctgcctcaaatctcacaggtttccgttcagctcttcattctacccttcaactcctatgcagccaaccatcataccagttgattctaagtgctgggagcctctgtctacacttactctccacctcgctcaggctccataggcatggtgtctacctgctggcccatcctgggaagtcatcccaacgtgacagaatggaaaagagagggcatggaagactagttcataggtaagggcaagagggacctcgcagatggtaaggtgctctgtggagaatcagtttgtccaactgataaacagaaaacagtacaaagaaatgtgctatcacagaacgatcttaagcactggaaccagtcagtcccagattcaaatccagctctacccttctctagggatggttttcttattctccatctcctcccccttaaaatggggatgataatacctcctcatgagaggctgtgagtagctgatgggataatttgtgtaaattggctaataaagtatctggtaaacagtagggtcccaatacaggaagcttgagatggtattaaatcactggtcaggcaatagatgctcgagacagtatgacagccactagccacatgtggttatttaatttaaaattcacttcctcagttgcactagccacaggccaaatgcgcaatagccacatgtggctagtggctaccatggcggaaagcatagatatggaacatttccaacaccacagaaatagcactgctattagcacaccacaggatagcactgctctggggttctgaataagagatactccctgggtccagcagcacggatactggtctggaactgctcccctgaccatatcagaggtatgtgcctgtgactgaatcagctggtgcttcactagagactgtgtcagactatatgggctcccaattctttcctttgcctcccattcagtgctcaccagtactagagtggatcttgatgctgatcaccacaaacccaggcctcccagcagattcttttttttttttttttttttttttttgagatgaagtctcggtctgtcacccaggctggagtacagtagtggtgtgatctcggctcactgcaacctctgcctcccaggttcaagctattcttctgcctcagcctcctgagtatctgggattacaggcatgtgccaccacacttggctaatttttgtattattaatagagacatggttttgccacattggccaggctggtctcgaactcctgacctcaagtgatctgcccgccttagcctcccaaagtgctgggattacaggcgcgagccactacacctggccacagattttttagacccctcctacagccagacttctcccaccatctaactaacccctctcccttacctccctgctcacaatgcttatccctctccagcaaagagtctctgctctggaagacattatctcttcctgttccctctacaatacctaaccatcctattcctttctatgcatttgcgtattttcgttattcacattgcagatgcattcctcatttttctcttccagccacactatgctcagctttccattccagctcaaatttttcttcccaaaagctcttccttgtaagccccgttcctggtgagttcctggtccaaggggactgttctcctcagttcatttacagccgtcactgaattgctctgctaatactttaaagcgtgttcagctttcctcacctggctgggtacctgctgaggaagatgtcccttcaatgtttggttggagtcttttgaagcagaacagacctaagacaaagctgtgaaagagggccccaaattatacccagtatctcctccttttaccactcattcttccagagttctctcctaccatatgtgcccacccagaatttgtccttgcaaggacccttcaacgctcacagcacagtctcatcttagcctgttctctcaggatgcaggtgcttactagctggaaaaccagttgatgctactgggtgtggactggtttaaaccagcggttctcaaccctggggctacacactggaattccctgggggttttgaaaaaaatgtgaatgtacagatgtcccctagaccagctgaatcaggatctccagggtgaggctgtggctactatctgtcttcctttcccaaggtaatgccaataaactatttgcccaagctgggaagagaccagggcagccacatgacagagtagttaagagagaggttctggagcaacattgtcagttcaattgctagctctacctgtgtctgtgtggtcctgggccagcctctgaacttacctgttccctcctctgtatgtgggaataatattcatcatagtacctccccatggggcttccaggaacatcagttgaattaatacccatcaagtacttaacaccacagtgtgggcatatagaaagtgctcaacaaaggtttgctatttttttctttctttttgaaacagagacagggtcttgctctgcttatccaggcaggaatgcaatggcatgaacatagctcactgcaacctcgaaatcctgggctcaagtgatcctcccacctcagcctactgagtaactgggactatatgcgcgtggcatcatgctcagccaattttttaaaatttttagaggcagggtcttgctatgttgcccaagctggtctcgaactcctggatttgaacgaccctctcatgtcagcctcccaaagtgctggtattacaggtgtgagtcgccatgcctagccaaggtttgctactattattccttctctccaaccttctccctgtattctttctgaactccctttccctatcaaagccccatttcaggcctggtgtggggaaatgcagcaccaggtgagcatgtgttggtggggaggatttggggagacacatccccactgcttactctacctgtgctgggaactgcacaaagaatgggggtgaagtgggtgagaggccagttgggaacccaaaagctgtcctctacaattctttttgaaggctagggagatcccactcctacttcaggccatgcattggaaccaaagttgaggtgggggagagtggtggctgcacagataccatagacaagccaagacctccctgcctcgccctgtcctggcatgaaggcacaggtctgtaactacagcagcttttcccagtaccatctgacatttcttctgaatttgctttagcgcctagcagagcactccataaactctcctaaagtaggtaggaagggtaggatggggtatgggatatgagggtcagagggtcagaccagaaagggtggattattataaaacaagtagtcctaagattctgaggatgggcaggtgtaccctaaaagggaagcagtgggattcccaagtaaatacttcatctacttcacaagtttgcccaagcccagctcaggaacagtaacaaatggaaatgagcagggatgccggctgtggacaagcagaccccctaggtagagtccaccccaccttcccattaccacaggaattattaccttaccacccataggggagggggtaattgtgggcaaatttgatgggcccagtgggacagtcagaaacagcctgcctagagccctaatgtacccacccacatagctgtgacatcctcagcccagccaggctagcccaggatatatggtgtgtgtagcgcactctgctattttcctctccttgaatgtccttgaggacccagttcaggtgcctctgctgggacactccctgtgacactaccagccttctctgatctactctttctcttgactcctaagacttactgtcaggctctctggtcacctgatcaatcccaggcttgtgatacctcatatgctaccttgtaccattatttaacttttagttcatgtgtataattttcctactgaagcagtaggagcttgaggccatggctcctaaagctttgaaacccatgcagcaactgaaatagagctcagcattcattcattcactcactcactcaatagttattgagcacctccaacatgcgaagcaccgtgctaggtgctggggatttggcagtgaaccagagatgaattctacattgaagccacttagtaaatatttgttaaacagatagacgagtggatggagacatggatgcattagtagtgagtggataatgtctctatctgtggcatcccttctgctctatgttacctcagagaaaaatctcacttctttactctccgtgatcccacaactgttctggatgggggaagtcccaggaagtttagtctcaagtggagagtagggagagaggaaactaaattcagaggggtagtacccacttaaaggcatccatatgatgagtgctggggccagaagagactggaaccaatgagtcatagggtctcagggtcttcagacatcatatggggctgctacagggatcttttcagagcatccccttcaacagatgttcctcagcctccatgctaactctcaatgatggggcacctgacacaggcattccactgcttgcccctggtgatttccctcattctcacctctaagtaacatccaaaataaaaccagcccagccttgggccatgatatcctaacccacagcatgtgcacatgtacccacatctgcatatctgctctacctccagatcaaaatagcaaccagggagattggcagagcctggagtaccaggctgtcttcccagtttgggactggctgaggcactgtgacttcagtgagagtctgggcccatcctcagtctagaaaaagcttatgcaaggatgagggtagcctagagaaagtccagaaaaccacacaaatgaccacctgttgattccaaggcggagacagagcactttctccttttaaaaacagtatcctctcctctcactcaagcttagcctgctcaactgaacagccaggaaaagctgctggtgtttggtgatttgaagggaagggggtctgaacctcagaagcttgtcacttactggggaccctgatgagtttctctctgttgtcctgccttatccctaatctagctccctgatcatttgaatgtaaccctaattggacaagaattttctccctttcagtatggacaaaatcaacaaccatgaatcagagacttttagaggatgggtagtgaagtgggggaagaacagaacattgtagagtgaggggcagagaggcaggcagtgggcatgggtaggttctggttttgtgattagtaatattatctctttaattgaaaaaaataaactcatttcagattcgtataatttcactaagtgtacagttttttcatgcaggttggttcacgtggtcttcaaactgtcctctctcatctggggcccagtgaggatacctcaggaaagagcaagtagctagtgtaaagccaggatccaggtcttcaaactcccagtccagtgctctctaactacccactgtgttctctaagcacttgagggaggaatccatgccttagtcattattgtacctcccccaactccacctcagcacttagttcagcatgaagcatgcatccagtatataaccgtggagcggaaggagctgaaatgtacatgatccagggaggaaatcagcagtgggaatgcagatgctctgaggctttgggcatgggagcagcagaagagagcaaggctgagtagtgggcagggagggtacagacacagttgcaataaggaaagggtgggcaatgcaacagtgggcaggtgttgcctgcccttggattcactatgctggggccaagcagctggttagaaacaaaaacaaacaccagggatacaggttcctgctgttaacagcttcaaaccgccagaggaaaactccaaataaatataattagaaacttgtaaaaacgtcctctctgtaaacctgctccccagggtctacccttcaagcactccccttccccagccctccccccaatgcccacatatcctgatactccccactttcagagggattccttagatgtgtttccttatcctggatcttccctccagccctgcagcccctgcccaggtctttcctcagcttgttaccaccagtgaccagacctgaagagcccctggtgtaggctcagaaatccaaaccccacagctctctagggctatggttataaccacagggaaaaccagaggtaagagcaaggaccactgtgccctatataggggtcatcatcccatttgttcagccaaagcacagcatctaacagcaactacaaagcagtgcttgatctgcagggggacatgtctaggctagggcagaatacagacagctagtctcagagctagaaacacggaatcctggggcccagatccaagaatattcagttcccataacacggatatttcagctccacttcccaactttgttggatacacacatatagaaacacacatgtgttcttcaggggctatttccagggataaatacccacttcatggacacagtaagaactatcagctacttggggttccaggaaactggggtgggggaagaaaggaagagtatccagatgacctagcctcaggcaggcagaagtggaccagcatccaaggaggagagcgcctgagatttgggtgagtaacctgtggaggcccggcgccttctgccttcagcaggaaggatttcagtgagatgtgcagaatctcagggctgcagggaaccctactgatattttacaagtgagaagagggatttcagtgatttcctccgaggctcaaatccttaggctctgcatttgtctaaacccactggcaccatatacctctatatccccggtgccacttgaggctggcattgggtgggcataggaacaggagagtagccagtccaatgttaagtggccagtgggggaggggagtctctgtcccctcttagcccaggtgactagctcctgtaccccctagacatccctgggttggccgttgtttcgcttctatacccaaggcccagcagtccttctgtttccagactccagtcttctgagcctgaagaagctgtccccaggtctgggcctcttgcaggcactgccagcctcagagcagctctgcagtttccagccctgacagggactctttcttataagtggtcatgtgctagggatacgggatgtcaaaggaggcccacaccctgacatttggggaccagagctgggggaaaggactgagtgagttcaggcagcaagctcttccagctccatcttctcaaaaggtctgaagcccttcgttcccttcccctgtcctcagttcaaggcactggaccaagccattccacttctttacttctccaactaaaacaaaatgcatattgccccacttcctttttcctctcaccagagcacttcacacacacacacaccctgagtcatgcacacacattcacacgtgtgtgaatgcacacttcacattcccaaactcacacccagggccggctcctcttacaacaggtcccagctgctcacatctcaaaccggttctcatgctctcagattcctgaaggtttcaaaaaacaatctcatttgagggctgctgatgactgtcttctttctctgcctgcagtaattctggccttagtgtcttctagtcccctttctcttattccaccctgcagagactcaaagagatgagaaggaaggggttgaaaacagggaaaagtctctgtactctcccaccccgaggctttccccacctctgagacatgtcatgagagaagagaggtcaaagggattcctgaggaatttctaagcagtccaccctcttctccaccttctggaaaaatgggggtgggcttagagggaactgactaaagatcaggctctgagtggggactctccctctctccagtgtggcctggacagggcacaggcaatagccggctgcccacggggccacccttacccgctgacatggttatggttttcatttcatattttggagggaggggctagtaggaacagtcccctcactgtaagagctggccacaggagcccagggaagcggggaggaaaggaaacagccacattaaagaggaagagaagggtgggagaaagaaagagacacatacacccagacagagacccggagagacacaccgagacagagagacactgtttgccaccacatgaacgctctcagtcccagggatggggttacttggaaattctaaatgcatgactttatcaaaactctatccctaacaaggagagaaaactaccaggtaaactaaacggccaggctggctctcctggagccagccctggggacaagtttccctggaggccgagagaccttttcattcagctgtaacctgagccctatgcgaggattaggtctttttaaccactgctgcacacacccccccccccgccgcgcctcccccccgccccccccccccccgccaaacacccacccccttaccaaaagcaaagcaaattaatgcttttaagttaacaattatcttggttatccagtctgtctactttaaaatatacagacaagcacttgaaaaacactcaaaaccatgtcccctcatgctccctcccttcccagtcacacaggcttacccacctactcttccatacagttctcacagacactaaaacagcagtttacccttagcaactacgtcacaagaaacacagacatccagctatgttgcctgtgggtaactgtggtgaacctctcatgtgtgcacagtcgcacactcacctttacacttagggctcccttccttgtctccccctttccccccttccacatgactttggttttcccattgtgggaatcactgatgaaaagggacagaaacccagatacccccagaggtatagtaactccgtgcaagatacttgccaagggtatttgattttaaagacctgctagtgctttatataaagcatgtggcattaaaggcacactttctggcactgctgataaccaggagatatgtttgaaggtaaggcctccctgatgctcacagactgtgtctatgggtaaggctgtaaggttgccccgcctggtcagtactagttcttcctgcagcatctgcctgcaagtttgtgtccagagacatccctgtaacccagcaaacctgctattaggcaacctctggcagatggggtttgtagatttcctgaagagaagggtcaatgaaaggcttccattctaggccaagcttagggatcagaagaaaagaaggaggataccaagctaactgcggtccagtcacaggaagggtggcctgtgaatgagataagctggggacaaaaactactctaagttccttgagggcaggggccttcactctggcagcatgttcctcagtacccagcagggagtccaatgaaagtggaagccctggagtaccatgcagggattctgactcccgttcctgaatcatgagctgatctcccatacttgagtgccttggcttgatggcacctgtcccttggaggggtctccatctgcccctgggcccccctcgaatacactgcttctcctttggtccacagcctcactaggccactacagacactggctccaacttgaaagaggcccttatcttgtctctaggttacttcatgatatctgttccttccttcagactaaactccccacctaattccatgttatgagtaagtcagcacacactacaaaagccagctttgtttatgaaaacacaaatccacagtgaggagaggggctgctcccaggttgggggtggcagtggcgatgcgctgtctggaaccaggactggaaaagaggcagtgtggggctggaaggtgtgggggcagggtccagtatttgacagctgaggatctctagtgtttcagttctgtgaaaggacaggttggagggggaagaggttagctgaagaggcagtgtttggggagaggagggcggcattgatacagcaccttcctcttcacagagcaggagcccatccaatacaacagagcagcttaagagccaaacgctcaggctctgggacacagcgacctgtgtcggacactcaggcttccccaactcccaagttcaactttccttctggcccagccatctcctcacccagctggcttcaggagcccctgggacaataggcagaatcatactctcctgggcaaaaccttgccaggaggaattttctttttgtccatataaatctcttgtcggtgaggacacgatgggggaggggtacagcaagaggtcaagggggaggagaaactgtcccgagagaactgtagtacatcagcctagtctctgcctgcacagccttgggacctgccaggcgatgagctgggggtcagggacgggggcgggaggcctccctgtctctctttaattcctagagggatctgtcagagctccccggcctggaattctactttgttattttaatgcaattctgacctggatttaaatggaattggaaacccgaggccttaataaataaatattatgataagaaatgaaagccatgcaagacgaaagagatttcaccccaaagaggcagaaacgcaacattcctgtcgggagccagtcacagaaattttcttctcttcttcagccccctaccatccggtgagagatgagttgatttttccataaaagatcctatttttcttcaacatttttccactgataaggcatcaacttagaaatgtctaactttgcatgcgggttgggggtaagggaaagaaatatacggcacggctgaaaagttttcattattccctcagtctctccaggccacagcgtaagtttctggcaatgtttgagagaagagaaaattctctctcagattttggaagacaagaagtctttcgaagatgctgggagtggatgaagtcgagcggaattctgaggcgcgtggtctcttctgcccaccgcccccaagagtttctcactcctctctgccgcccccagcttgtccggcttttcgctcggggcgcagcgcccagcggtcgggcccctggccggggagtccgggtgcacagagccgggttctgacagcagcacgctccccagcacctgccctgcccctcgggaatcgctcctaggccctgaggcccagcagccaggacagcccccaggccgcgcgcccctccttccttaccttgcgcggctttgctgtactgggcggcgcgggcgtggaccagcaggacaagcaggcagagcccgggtacgcgccccgagcccatggctggagctactggcggcccagccgccggggccggtctcgcggccaggggagggcggaagccggccggatcccagctcgcaggagggggaggggagggggcgccccgccggggccaggccgggggctgcagtcgcggggcgcggaccgcggcgccctcggcgcgaggctcccgatgctaccggctcctcctggccggacgtcggggagagcgaggcggagagtgcgacgaggcgaggggcgccaggggcgactgacggaggggaacccccgccctctccaagccggcctctgccagcggcggcggcggggctgctccgtgtaatcccacccaattcccagcttcgccgggagagagctgcagccggagagcgcgcagagcccgagcgaaggacctgagaaaggggaggggaaacgcagcgccagaaacacgccctttctgcctctctttcttcctctctcgctctttctccgtctctcaggctctttttcttcgcctttctcctcctcctcctctttctcctcctctcctcgctccttttcgttttcttcctcctccccctcctcctcctcctcctcctcctccttctccaccacctcctttttcgtgcccttttttctttcaaatggggcctcggcgcggtggccgctccccctgcgcgcccgggcgcggtggccccctccccaggctgccgggccgctgcctgcaggaatttacaatccggcgatgggggagcgggcctggtctccatggagacggcttccccgggagcagggaggtcaggcgcagaccgcgcgcaatcaatggatcaatgcaagctccgctcggctccagaccaaacagcaccgggctccgactcgtcctcgctcccctaggaaagagtcggggagcgagggtgcgtccccgcgctcgctcgcgaggacggccgtgcggcgccaggtttgaacgcacacctccacccgagacaaagagggtgcgaggtgttggggaggctggggcagacgtggacacacggacacacgggcactcgggcgtgtccaccgacacagcctgacaggggacataggacctcggaacacaccgcctccgacaccaggccgagtaacaacctctcaacttttacacctaccacacccccaacctcaagactcagtccccattcctagatgcgagtccactttgaggaccaaaaagaaagtagcctccgcctgctaaaactgccagctccagggcagactcccttgcagttaaggccttggaggtaagcctaatgaaccaccctacccgcagagacatggactcacatacagacactctcatgtggtcagcacaggggcgaaagctaccccacagaatcatgtctatgtgtataaacacagagacatagagacaggtacaagaggctcctccaaacctgcaccccgcttcaagaggtggtcctgactggtccattctgaacccttcatccttccaactgaggggaagcagaggaaagagaaaggatatttttaaaacaggggcaaaccgcagaaggagcagggtcttccaaccatggatgctgcctcttgactgttcacccactctgtatcttctttccttccattgtaagggaaagaggaaagacctcttgaaaggctatgaagactttcttggagtgtgaggctgtgttcagaatgagaccaggccaggtccagttttctacagggaagatgctgctaggacccagactagcctcacagagccctcagcgtacccaggaggaagaggcaatgaccaagatctcctcaaaggtgccgccatctaacataccatccttcagcccttggtgaagtcctgaagccagacctctgggagtctactcagggaacccactgcctcaaacaaatttgcaaataaaattattgtatttgaaataggcccacattggtgaagttaagatgtggaactaattgtatgtgtatttctatataaccacagactcaatgtttgatgtttgacatttattgtgcacttactatgtaccagggacttaaaggatgtggggattcaaagatgacatggtttctccttttaagtttatgatttggcaagagaaattcacatctaaataattggaatataaggcagaatgtggtaaatgtccaaacatggaggtgccaacataaaattctaatgagggcataaagagcacagattaattccagctggaagcaggaggacaactcagtggaggaggaaagggtttaaagctgacctcaaagaatatatagaattctcatacatggagttgggtgaagagagtgagggctttccaggtggcaggaacaacatgagcaaagacttggagaggagaatgtcttcagggaattaataattggttcaatcagagacaagtatttcagagagtgtggaggaagatctgaaaggtgggatggggctagacaatgaagagcctgtttccatcagatgctaagcgactgacagtgttgcataggctccgggaacccggcaactttacagcaaagtagcagcatggcgggctcacttcatgaattagctttatgtgtgctccaggatttcttcaatgtgttgatttttagtgaatttatttcatcatgaatgcaggaagagaacagaaagaaaaacggggaaaagaggacataaaaagaagtgggctgggcatggtggctcacacctgtaatcccagcactctgggagcctgaggcaggcggatgacgaggtcaggagatcaagaccatcctgactaacacagtgaaaccccatctctactaaaaatacaaaaaattagctgggtgtggtggcggatgcctggagtcccagctactcgggaggctgaggcaggagaatggtgtgaaccccaggaggcggagcttgcagtgagccgagatttggccactgtactccagcctgggtgacagagcaagactccgtttcaaacaaacaaacaaacaaaaaagaagtgacagggagggaaataatggacagaaggaaaagagagatggagaaggaagagagagaaagagaaggaggcagccctggaggagacaaggcaaaccctgaactgttcaggggccaagcttaaggagctacttgggcttttccaggcaaacgacctctggcttcttgccctggccaaccacagaggacaatgtgaggcgagtttgtttggtgatgtgttttctgctggccctgtttgtttgtttttcatttttctggtattggacagatctggggtgaaggaagagggagacagggttgtggctggcattgatagtggtccttgggctgggctctgggctgcccagagcccccctttagtgggggcttatgggcattggagctgaacttttgatgtccctggaagggggcctttttgtaggtgcccagagccaggtggccttcccaagcctggagatggtttgccctaagctctttgtctctgtctttccccaccctggcaagaaagaattagtccttgaggcctgggctccttgcctgtgtagccaggatgtcgtgctgggctggggagcccatgggggtagcaagagcagctgcttccagattggtgctggggaacgcaggggcagtccacgagagccagccttctccccagccccgatgatgagtctggctttctctcccgtcccacagcccttggaagccaacctaacaagttctattaaagttaatgaaacacaatgattcctctgtttgcttggttacaactcattacgagttgctcttgcttgctcggcttttgcagaggagattcatttgagtagccagtgcttggcctttgtccccctaatttttactggcccattaacaagatcagacactttggctgaccaggaatatctagtacccaagtcccaacaaaacccattgggtggagtttcagatgaccttttgagtctaaattagcctaaaaacatgctgccgcccttcctccctctgttgcttccctatatccaaactcagttttatatgtaggtacaataggagtatgcagagatttcagaagttaggagatgcttttccagcctctttagaatgtatctcaacccactgatttagagaagttccctagtaagagctccagctcgatttaagggctttcctcccccatttaaatggaaataaactgaacattgttagtcacttatactttggtgtgaattagttcatattgtcactttaaggggatttgggagtctcctaaattgtatacaaacttttgtccacattatccattcttccagagagaggttttctatagctttcttcaaaatttccataaccgtccccccaccccctaccccaacacgtacacacacacacacacaaactctctctctctcaaaaggttaacaacctctgtgttagtagaagagtgggccgtaactggggcacagaagacaaactctccttccttcaccatctgcttggccagtcctgcctctaaggagggaccttcccctcctccttgagttccttatccacagacctcccattgtcaccacagctcaatcatgtgcttcccaaatcttaaaaccaacctcaagttggtggggaggagtcaaaaggagagcccttgaactctatgttgatttacatgccgaggctgtaaatgataggtttacatgctggtgtaaatactcataaactcgcagtaagtgcagggcatcacatgctttcagtgtccagatcctctgcagcccgtacaggcctggcattctcagggtcagggaggagagcgccgagttggcagcagctagcatgacaggggctgactatgactatggaggaaaagggcgtgcttggagttggtctctaaaccctcatcctctcccatacagcaggtggcttctgcacagtgataccttggcatgactccccctgctgctcagccagcctgactgttcttttgggttaaagcattgtctccagaaggtccctgttaaaatgcaaaggggcttcttgcagggtgacttgggctggttggctgactggctgtcactcaacagaaaacagagaccccagatcagggaggttaaggtttgggagaaaggttcaggtgggtcaatactatagctatatgaagttgatttaaatggctttccaggtgttctccctaattccactcttgggggctgagaatctatccttcatatggcagccagagtcgttttaaagctgggccatacaacctcaacgtgattgacgtttgttggggggccatcctatgcattgtagcacatttagcagcatccctggcctctacccactaggtgccagcagcagcactccctccccacgttgcgacagccaaaaatgtctacagacattgacacatgtcccctgggggaggggagtgaaatcataccccctatcttcacttccccctgccccactgagaatctccatcataaagtgtaagtcagcccatgttactccctggtcaaaaatcctaccatgtcttctcattgttctgagcatgaaatccgccgtttggcccagccttcaaggccttgtgtagtccagccttgcctccctctcctgccccaccttgtacccctctgctgtcatctaccatcaccctttagccacatataaccctttttgacatacctcgataaaccaagctctttcttggacagggtggaagatggagagatatgggcagatttagagtaagtttcagaggccctaatttctttggattttactgggaggccttttcttttcgcttttttgagatggagtttaactcttgtcgcccaggctggagtacaatggcgtgatctcggctcactgcaacctctgcctcctggtttcaagcaattctcctgattcagcctcctgagtagctgggattacaagcgcttgccaccatgcccggctaatttttgtattttttagtagagacagggtttcaccatgttggccgggctggtcttgaactcctgatctcagaacgtaagctccatcagagcagggaccatgtctggcttgttcactatcgtgtcctcatcatctcctgtactgcctgccacatgaacaatggccattaacaggcatggaactggagcagaaatggaatgaaccctaggggcctgggagcctggaggggtgtaggagtggggaggggattggggagacaggcggcagaggaaagcgcctgccctcgcctcctcccatcaccccctatacccctgtccctaatgaggtgcttctggcggcacctgacttttccattgcaaacaccacttgactctcggcccttcacactctcatgaggttctaaggggctgcacaggcgccgcccaccccagccatgccctgggactcaccacacaccaggaaggccgggagctgcagcaaggggacagcttaaaacagccccaccaacaccccaaagtgggtctcccagttccccgagaaggcctggatgccctgctgaagggtgagcagggccatgtgggtgacttggaggacccaattccccggccatgggaacccccagcctgggctttctttgggggtagctgagacaacgagcccccacccagagcaggagatgacgcattttttctgtggccacaagccactttgacgggtccgccccactggggagcaaccgaaacctcatcccacccaaagcggcctttgtctgcactacatatttgtcttatttggaagatttttgtgggttttcctgtctttctccagcgctcactgccctaagggggacgaaggccatggcggagctgagggaagggggtgagaggcattcttggggcgctgtgcctggtggtctgcagcacatttgggggtgggagagaaatccaccccacacaccctcggcgccccagtgatgccttggccccaggccacactctgggccttgcctgtcctctgtggactcgtgcccctcctggtcctcccagagctgtttcctctccatcttctctcagcctcctcagctcactctccaatacttctgtttattccctcatgttccatccttccagccagcttggcacctcatcatttcctacctcccccgtcatgggaccctctgctttctttctacctgtctgaattctgaagactctcccagggcttgttcccccatcttgcctcctcctgggagcctccctggactactgtagcgcttggcaggatctcctccttctgaaatgtaaaagtatgtgttttctatcctttctgtgattctaaacacaccctgcccctataccacctgcccagctaaatagaggccagaggccatggcttttgtgccttggcgtccaagccccatcctgccttgtacaaagcaattgctcaactaatatttgttggtttggggcttcttaagggctacccatgagattaccaacaaattagagaatttcagtgatggaagggacctaagagcttgaattcttgctaaggggtgtctgggttcagcttacatacctttaatgacagggatcttaccacttcctggggcaacccattcccttgcctgtaactctgaccataagaaagttcttccccacgttgagctaaaacctgctgccttctggctttccccaccctactcccaactaggtcacatcaaactattccagtcctctttcctcacgaccacccttcagatatttgagggcagcaatctcctacctctgcagtcttttcttttccagggggaaacacctgtagtcctaaccttcagtgccccaatgcccctgatgaccatggactttgggtattcccccccacccctgtgctgggcctctcccacatccctgctgaactcattcttctcacaaaatcccc

SEQ ID NO: 2821 - DNA, 793 bp, Homo sapiens
attttattacagggcatgttggggacaggggagggaagtgttagaggagtgacagggcagcccggggccctctcccaccctgagcctcgaggcctggtgggggacatgaactgcagaggcatcagataaggcctcagaaagcccaggccatcattttccatgggaccaggctggctcaatgtggaactggccctcccagagcagcaggagaagggctcgcatgggctgcccccgtcacctgtgcctgacaggatggggggggaggcagagagagagcatcagacgccctccctccccataaggggcatgggggatggggacacttcctcccaggacacagggagcctggctgagctggctggctcatgccccatctggtctggaggtcagaggggagtgagacactctggtttgaaaggccttcctttccactttggggaaaacaggcagggagagaggtgagggtgccatgccaaaaaacacccccaaatccagatgcagactttggagccacatgtgggtttgaatctcaactctacctgagtgaccctgggcaagtcacttcacttccctgagactcaagtttcatcaagatgggaacaatgagcatctgcctcacaggcttgtcgtgaggattaagtgagaaggtgcagctgcaaagacatcaagctggacccatcgaggatttcggattcagccatcatggggctgctgccggggaagccactgcccctcctttctcctcagcactggggttataaaaaaatacctacaaaccatgagaaagtttgtg

SEQ ID NO: 2822 - DNA, 4897 bp, Homo sapiens
gtgtgagccaccgcgccggcctgttttctatttttgtcccacagaatcagccggaatctctcttgcctagatcaccatggggacataagcccagggtcactgaggaccctgtcgcaggtacctgggagtctttaaacattagtgcagactcaggtcaggctgacaggaaggtctaaatctgcttccagtctatggccataccactccgaacatgcgctatctcatctcatctcggaagctaagcagggtcagtcctgggaatactggatgctgtaggcttttttcctttaaaaataaacaaataaacaaagctgcttccatctcagaggaagagaaatgagtcatgcatgtttcttctttccccctcacaaaaggaatctctttgattgatatccagatgggactggctcccgtttcctggtattgggtaaaaaacaaggaggagatctcgagactcaaactgataaaccagttgcttccatttcatatggccattacaaaaacagatggcacagtcttgggtccttaccaaccaggaactttcagtctagagccagtggataaacggttgaattcggcatcctgtggtcagcacaaagaagggaggtatacagaggattgtggcttcattggggccacttctcttttcttgttcttttgtgagttctggtgttgccacctgaagggctatttatggacaaaagagttgttattatctttatttctagtgcattttccttgccaagaataaatatttagtttctaatatatttgtcctagaaagctctaagggtgttggttaaattgcccgtgactggatcttataaaatagacgaggaagtagctaaaattggttaaaattacacaaactctgggagtcaagcgtctgttgggcaggcctaggacaaagagaaccggtagtacccagaggcctaaaggtgagaagctgagggtctgcttcgtggcccagctctgccagatcagcctgcttcccaggccttatcccaccctgaaatctccgtcgcagaattcattagaggacatcagagttgttgcgtggtggttcctgtgatctctccagagcaggtgctgacaattttcccaaacccaaaagcaggtaaatgagaacaaagcactgtgtaattgtggccctttgtttttcattgaaaccagtgctgccagagacatcccacccagcagcctgctgttcatcctgcagacccaggtgttcttcattcctgcagatgcagtagttcctccatgagttaccagaaagtaaatacaaacacgacaacaacgaaaaatccctctcaactacatttaaccccttctttctgtatctctcccatctgtctgtatttagctttcattctatatattttctttctaaaactcagtgatggagaaacagaaaaagaaaagctgggcccttcatgtaaaccctggggattatggaacacttagtacccacctcccggagtgttagaattacctcacctattactaggttttcagcgctgtcctctgtaacacacttctgagcacgtagtatgtgttccgtaaacattcattaatgcccgtgtccacgttctcccagtgcagacttactcagacattgctgccttctctagactttagtaaactttaaacgctcagcagagaatgccatttttcaggatggcgattggtggtcttcacttgcaatcagaagcattgctgggttttttttgtttgtttgtgttttgagaccaagttccctcttgctgccccggctagagtgcaatggtgcgatctcagctcactgcaacctctgcctcccaggttcaagcgattcgcctgcctctgccttccccagtagctggaattacaggcatgcgccaccacacccggctaattttgtatttttagtagagacacggtttctccatgttggtcaggctggtcttgaactcctgacctcaggtgatccacccgcctcggcctcccaaagtgctgggattacaggcgtgagccactgcgcccggccaaagcatttctgttgtgataccggtgttgagtacaagggactctgtgctgtatttgccttctctagctgagtgctgctgatgaggagtccgggggaacagtatcagaagacttgttatagaagcccatttgcagacccctttcacacctgcggaaacacattacttagaatggggcctggaataccaaattagaataccaaattatttatatgtacattgaagccagagagacagtactcaggtatgtggttctcagcccaggctttcaattagaaacaaatagccagtttggagaactaccatcacacatgctgtctccaaagatcctgtctgtggtctggatggaagcataattgttgttttaagtaagtgccccccagcgattctaaggtgagatcagagtcaaccttgagggctcccagatacagtcacgagacttgggttccaaaaggaggtcagagggcctgctcttcggtttgataagggtaggtcaccaagatccatatttcctttgctgtaccagaaattgctggagttcatggcaggggagatcacctgaaggcaggaaatttttggtctttatgtggtagctcatttttcctctcctgtgataaagaataggggagtattcccttttctgcactgcagggccttctgcctctaggtgtgctggttgcaggtgaaagggttgtgttgacacctttaaagacatattctcaaatgcaggtgtgatttgtccagataatctcacctgagaaggaatcccagagaagaaggaagaagaggaagaaatggctggttctcaggtgaatgtgtctgggttcaggggatgtgtctcctcttttcttctgggatgttatgtgtttagaacttgcaaacctttatttctgtacttctgatgtacctgcctaatgtgtttcttcccaactaccttccccccttcccccctcctttcttatgattgataaggaactctgtaaaatccttcctcctgtgtaccagaaccttctctccattccctccttccaggcttcttatatgtcatgaccaaatcttaccattaatgtatgatgggcagtattcagatgttctgtgacatatcaacatgggaaagtgtggatccccaggattatccgtggggatggggctgggtcttgggatgtcagtgaagaaggggatcatgtaccgtttagatttcatccacatgctccatcatctctatgcagaacagaattaagaaaagagacatttaaagaggatggcattcattgcctggaataacttaaagttctgaaaagagaataattagaagacatttgctgtctaggatgctaaagaaacactattgaaataccctattgcagattaaagaaccagggaaacagctatagcttgaactttgcataaaactgatgtttctggccaggcactgtggctcacacctgtaatcccagcactttgggaggctgaggcgggcagatcacttgaggtcaggagttcaagaccagcctggctaacatgatgaaaccccatctctactaaaaatacaaaaattaactgggcatggtggtgcacgcctgtaatcccagctatttgggaggctgaggtgggagaatcactggaacctgggaagcagaggctgcagtgagccaagattgcaccattgcactccagcctgagcgacagagcaagactgtctccaaaaaacaaaacaaaaaaaggatgtttctacatgattaggttcagattgtaatttactatttttgtggtcaataatattagagcagtgatactttgtccttgatgtcatgtgatccttgatgtcattttatccttgacatctttgatgttgatttatcctattatagttgatcttaattttatttacttggttaaggtgctctctgccagatttttgcacgatagagatatttttttcattattgtttagtaccttggggagatttactgactgatacatataagccatcacatttaattaggaagctcttctttctttttagattctcctcgcttatagcttgctttggaaaatgaaggctctcgtgtttgtttattggttagataaactgaaataaacacaggctctgccacttcctgcatgtttgaaaaaatattttccttggcccagacacagtggcatcactgtatggctcacttagaaattcagagactcaggcttcaccctaggtcctctgaatcacaacctgcattttaagaggatctctagtttattgtgtacgcattaaaatttcaggggtaccttctgatgaatcatgacctctacatatgagaaatatttacagtttatcctgtgtgaggtaaatagagcaggaaaaaatgtatatgcctgcgttgatgcccttaattttatactgtattattcacaagagtagaatatgtacactggttatgtggagcttatgccatcctctttcttcaggattaaagaatatgttagagaatatttctgtgtttacaattatttgatcatttcagtctcttctataagtaagaaccagttctctctgtctctctttgtgcctggaatcagattaagaactctgcccatgaccacttgatacgtatgtgttttttctttgccagggactgttgatattcagggatgtggccatagaattctctccggaggagtggagctatctggaccctgctcagcagaatctgtatagggacgtgatgttagaaaactacagaaacctggtctccctgggtattgctgtctctaagccagacctgatcacctgtctagagcaaaggaatgagccctggaatgtgaagaaacatgagacagtagccagacacccaggtaggtgggagtaaatgaa

SEQ ID NO: 2823 - DNA, 14374 bp, Homo sapiens
agtgcgcgtatcccgggagcggatcttgatgctagctctgtgtgcagtgtaattttattaagagtcccgccccctccatacgggaggaaacgtgtgtccctggggccctcagccaagcctccactatctttttggcccagacggatttcccaggtcacaagtggctggagacttcctcttgaaaaacatttgccgtcgtttttccctggcagagcccctttgaccctggctaacaaggacagcctgacttggatcccactatgcaggaaggaaggcgactcttccccgcacctcttgctacgattaggacttgcgacttggtgaaaacaggaatcaaaacttgggcctatttctcctgaggtctgcttgcctagaacaattcgtaacgatgaatcttattaaaaagagaaagtcctccccgactttatctttttccgcccagaatccgataaggaagacttgttctggccccctcagctctctgacctcacctaccagaggagagagtgggatcctctaacactcgagccgtcatcccagcactaggggacagtgaccagtgtggctcccgtggccagaacccttctgaagtttgggttgccctgtggtcttcgccttcaaagcaggccgccacttgaatccttctggaacggacagtgttgctgtaaacgccgcggaatagtatcttctaagtattcgtagcttctttcttgagggatctcgggaacgttccgtgtattaaccactaacgtattccaaagttaacttcgtggtaaagtcgctggggaaaaaaataactgctccagttccacaggtgattgaaacaaaagtgatctgtttcccaaacttccttgatggtaaagaatgacttggggtactaattaaaaataaaaataattgcgtcatttccaacctactaaatcggagtctttaagggcaggtcctgggaagccatccatgtaatgggggtcctaagtgggctcttatcggcgagggcggggactcagcgagagggctggcagcgacgggacaaaccccagacggctgcgcggatgcgtttgttcctggagcttgcgagcacttgcaatgcatggacacctccacagggtggtggcctgccaccacgagagcaccagctccgccagcgtcctctccagaggacactttagagcagaaagaaacggacagttcagtcttcccctcagcttgaaggcagcattcttttgcttctctttgagtcaggtaattgttttgtcttccttccactcagtcagcaggtattaaacagcaaccgcattgccaagcactgtggtgggggctgtggcttatgctttccggagcagaacatagttgttgctaccttggggatgggggcgggaggaatagaaaaaatgcggagttagcggagtatcagggaacaagggtggaacagatataataattgcagtacagttagttagggcctattgaaggagcacaaacgaagcgtaaacttgtctgggaactagtggaaggtgtcccccaggggatgttaaagagctaattctagaattaattcagtggggaaagaaaaggagagggagatgccaggcagagggagcagcatgcctgattgtctggaggtgatcagagggcctggctgattgaagatgaacaggaattgtgtagtctgtgttcattcattcatttattcattccacaactatggatttaaaaacggttagtcaaccaatgtggaaaaatagcatctcgataaaatgttcttcaaatgtccacctagtattttgatactcagttttcatgactggacccaccatcaaaggcctctgactctgatatttctatcctttggaccctatgggagatctttgcctccatgtgataatctccttctcacgtttttactaaaagtttggagacttgaattctgctccaaatagagtgaaacagggtcttgctctattgcccaggctggagtgctgtgttctatcacagctcactgcagcctccatctcccaggctcaagccatcctccctcaatcttttgaccaatactcatagtaagaaatttatttcactaagaaatacttgactacctataatgtttttcaaggatttctattctgttcttttcaattctgttattagtctgctttagctgccatacaaaatactacacactgggcggcttaaacaacagaaatttatttcttatacttctggaggccgggaagtccaagatcaaagtgctggccaattcgattgaaggccctcatcctgacttgcagatagtcagtcgccttctccctgtgttctcatgtggcagagagatctcactctcttcctcttttttttttttcctttttaaatttttttttttgtatttttatttttttacttttatttacttatttttttgagatggagtctcactctgtcgcccaggctggagtgcagtggcacgatctcagctcactgcaacctctgcctcctaggttcaggtgattcttgtgcctcagcctcccaagtagctgggattacaggcatgtgccaccacgcctggctaattttttttttttttttgtattttagtagagacggtttcaccatgttggccaggctggttgccaactcctgacctcaggtgatccacccgcctcagcctcccaaagtgcttggattacaggcatgagacgccacacctggcctctttttttgtacttttagtagagacagagtttcaccatgttggccaggctggtctcaaactcctgacatcaagtgatctgcccgtctgtgcctcccaaatggctgggatctcttcctcttatgagccttcagtgttaatggaattagggccgaccgttatgacttcatttaaccttaattatattttaattatatctccagatacagtcacactgggggttaggccttcaacatatgaatttggcagggaggggacacacaattcagtccatagcaaattctatgtcatttaatttttagaatacctctcaaggcccactaaatgtgagcttatgatccactattgcagtggttctcaatagtggaggagtggtggttgggttttgccctgaaggaacatttggcgatgtctggagagacagttttgcttttcacaaacgggacagatactgcatctagtggggagaagccagggacgctgcgaaacatcctactatgcacaggacggccctcgacaacagaacgttattcagcccaaaaagtcagtagtgcttaggttgagaaaacccagcactaatcatttggaaactcaatatttatagcaatcaattatttcgggagtactataatttctacaaggtcactatccattgctcctgcctcagagtaaggtggtggtgttttttttccccaagtgagatctaaagggagaaaaaaatggaatggacagttattattatctgtgcctattatgtgctaggtattctatataaacatttctaatatataattcttacaacaaccctgtgagatagacattattacctccgtttcattgattgggacacaagctcaaatacttgaatgatctgcacaggtttcccaaaaggtaatgaaagaacctgggttataaatcctgtctctgattgtccgggggtagaatagaaaggaaaacagtaaatatgtggatatttatccacatatctctaactcctaatacaatgcctaatatccacaggtgccggtaaatacatggtaactggtcaattgttcaagtgcacatagctagtaagtggcccagcccgaagcccatattttattttactgtactgtgctttctcctttggtccaaagtaggaaaatttcgttacccaaacaacagcaaggaagcatagcagaatggatccttggtatttacaacctaagtcaatgattttatatggatcacttgcaatttttattgcatgtaagaaactattgaatgttaagggacatggcttacattctggttttgcctacatacatggaattctaattcttcatacatgaaatatttatgatgtaacaattagcattaatcctttaattcaggaaaacagtaggaggagctcctttcttttaaatgaataagcgtttacataaatctgtataataattaattttagagcaccaaaactacaaataatatattacaaagatatagaagattctacatatataaagaattgctttttaaaaaactttagtcagaattatcattaaagtcagggatgataaatgagataaaaaattatgtgaaattgaattaagggtatttggggatacttattacttccatactagaaaatttgaaaaaataagttaaatagatacatgcttagaaaaattaaaatactaaatgagatgtaagaacagagaatatgaataaagcaaacaaaaaaaggaataaggattatatagataataaattatctggcagtattagtctgttttcattctgctgataaagacatacccgaggtcaggcgcagaggctcatgcctgtaatcccagcactttgggaggccaaagtgactggatcgcttgaggtcaggagttcgagactagcctggccaacatggtgaaaccccatctctactaaaaatacaaaaattaactgggcgtggtggtgcgtgcctgtaattccagctactcgggaggctgaggttggagaatcacttgaacctgagagacggaggttgcagtgagccgagatcatgccgctgccctcaagcctgggctacagagcaagactccatctcagaaaagaaaaaaagacatacctgagactgggtaatttacaaaagaaagaggtttaatggacttacagttccatgtggctggggaggcttcacaatcattgcggaagatgaaagtcacatctcacatggtggcagagaagagcttatgcagggaaactctcctttttaaagccatcagatctcatgagacttattaactatcatgagaatagcacaggaaagaactgcccccatgattcaattacctcccactgggtccgtcccacaacacgtgggaatttaagatgagatttgggtggggacacagagccaagccgtatccttccaccctggcccctcctaaatctcatgtcctcacttttcaaaaccaatcatgccttcccagcagccccccaaagtgttatttcagcattaactcagaagtccacagtccaaaatctcatctgagtcaaggcaagtcccttgcacctgtgagcctgtaaaattaaaagcaagttagttacttcctagatacaaggggggtacaggcattgggtaaatatagccattccaaataggagaaattggccaaaacaaagggactacaggctccaagcaagtccaaaatccagcagggcagtcaaatcttaaagctccaaaatgatctcctttgactccatgtctcacatccaggtcacgctgatgtaagaggtgggttcccacggtcttgggaagctctgctcctgtggctttgcagggtacagcctccctcctggctgctttcccaggctgacgctgagtgtctgttgctttccaggcacacagtgcaagttgtcggtgtatccatcactctgtggtctggaggacagtggtcctcttctcacagctccactgagtggggccccagtagggagtctgtgttgggtctcccaccccacatttcctttctgcactgccctagcagaggttctccatgagggccccgcccctgcagcaaacttctgcttgggcatccaggtgtttccatacaacctctgaaatctaggtggagtttcccaaaccccaatttttgacttctgtgcactgcaggcccaacaccatgtggaagctgccaaggcttgggtcttgcaccctttgaggccacggcccgagctgtaccttggcccctttcagccatggctggagcagctgggatgcagggcaccaagtccctaggctgcctgcagcatagggaccctggacctggcccatgaaatcactttttcctccttggcctccagtcctgtgatgggaggggctgccatgaagacctctgagatgccctggaaatattttccccattgtcttgggattaacattcacctcctcgttacttattcaaatttctgcaaccggcttaaatttctcctcagaaaatggaattttcttttctattgcattttcaggctgcaaattttccagactttcatgctctgcttcccttacaaaactgaatgcctttaacagcaccaagtcatctcctaaattctttgctgcttagaaatttcttctgccagataccctaaatcatctctctcaagttcggagttccacaaatctctatggcaggggcgaaatgtcaccagtctctttgctaaaacatagcaagagtcacctttactccagttcccaacaagttcctcatctccatctgagaccacctcaacctggatttcattgtcactatcagtatcagcattttgggcaaagccattcaactagtctctaggaagttccaaacttttccacattttcctctcttcttctgagccctccaaactgttccagcctctgtgtgttacctagttacaaagtcacttccacatttttgggtatcttttcagcagcgcccactctactggtaccaatttgctatattaatccatttttatgctactgataaagacatacctgatactgggcaatttaaaaaagaatgaggtttagtggacttacatttccatgtggctgaggaggcctcacaattatggcagaagatgaaaggcatgtctacatggtggcagacaagagaagaaaaacttgtgcagggaaactctcctttttaaaaccatcagatctcgtcagagttattcactatcatgagaacagcacgggaaagacctgcccccatgattcagttacctcccaccggatccctcccacaacatgtgggaattcaggatgagatttgggtggggacacagccaaaccatatcactggctctgatagttaactggagaaatgctgttttaactgttaaaagacaaagattcctgatatctaagctgttttgaagtatatagcctaacatagtgatactataatagttcgttaatgaataaacgtagtgattaaattacatttactaaattaatcttatgacacaaatattatttttgaatccccgaaataaaactaatacctaaaacaaaaattatagtcgatgcttactttagccaatcttttagtttcctcatctgtaaaagggcataataatagtgcccactttattcagtggttgtgaggataaagcacaataatccatgtaaatttcttagggagaaatttactactctgactaataaatatatgaattctttgtccacttgagtgtaggaaacaagctaagtggttgcactttaagttaatgaccacagacttcaagtgggccctcgatgcccacaacatttctctagtcttttcatgctccgctctctcaatttctttttttttttttttttttttttttttgagacaaggtgttgctgtgtcacccaggccagactgcagtggtaccatcatggctcactgcagccttggcctcctaagggtcaatcagtcctcccacctcagcttcctgagtagctaggactacaggtgtacaccactacacctggctaatttttgtattatttgtagagacaggatttctccacgttgctcaggcttggtcttgaactcctgagctctagctctctgcctgcgttggcctcaaaagtgttgagattacaggcatgaggcaccatcccctggcccatgctcttgtctatttgatgtcagttttataacttttgtctcttcacacctctaacacattctattctatcctcactctcagttgacaaccttgctgctaagtcactgagaagataatggctctcacgagcccccaccacatttacccaccagccaacatctgtcttcatgcattgtcctccccctcctctcctgctaactagagaggaactctccttgctcctatagaaagccagctcctctgttttcttgctcatgccacaccagcaattctgccctctcctgcatcatcaagttctctctgttggagtatccccatcaacatgaatgctgtaatgtaccccgtatgtataagcagactaaggacccccaaaagatatccctgtcctaattcccagaacctgtgattgtgttaggttacacagcagaggagaatcaagggagaagatggaatgaggttaataatgagctgatcttaaaatacagagattatcctgtactatctgggtatacccagcgttgccacaagaggtcttggaagaagagggaggcagaagaagactgttagagaaagatgtgactgtggaagaagggtcaaagagatacaatgttgctggccttaaagatggaagaaggggtcaggagccagggaatgcaggaagcctctagaagctgaaacaggctaggaaactgattctcccctagagcctcaggaaaggaacacagtctccctgacagcttaattttagcctggtgagatccacattggacttccaacctacaagattgtaagatgactaagttgtgttgttttaagccactaaatttgtggtaatttgttacagcagcaataaaaaactaatgtaccgtatcacaaacaaacaacaaaaactcgcttcagctgttgtcctattttcttgctcccttatagaaaaccctttaaataagtcaccaagtcacctgtactcactggttctcgatgcccccacccccccaccaatttagtaaaatgtacataacatgaaatttcccatcttcaccatgtttattgtatagctcagtgcaggggtccccaacaccccctgcctcccccctcccccaggtcggagggagtgatgctttgtctgtacttacaactgctccccatcgctcacattactgcgtgagctctgtctgctgtcagatcggcagtggctttagattctcttaggagcatgagccctattgtgaactgtgcattgcgaggaatctaggtcatgttctccttttgagaatctaatgcctgatgatctgtcactgtctcccatcacccctgagatgggaccgtccagttgtaggagaacaagcccagggctcccactgattctacattatggtgagttgtatatgtatttcattatatattacaatgtaataataacagaaataagatgcactataaatgtaatgagttgaatcattctgaaatcattgccccccgaccgccacccctgccccagtccctggaaatatcgtcttcctcgaaactgatccctggtgccaaaaaggttgggaactaaaagcttagtggattaaatatatttgtagtgttatgcatcaccaccatccagctccataactctttgcatcttgtaaaactgaaattctatgaccattaaacaataactccccattcctcccttcccccagtaaccaccattctactttctgtctagaattctggccactctaagtatttcatgtaagttatggaatcataagagtatttgtctttttgtgactggcttatttcacttagcataatgttcttgaggttcaccgatgttgtaacatgtcagaatgtatttccttttttttttttttttttttttttgagacggagtcttgcactgttgcccaggctggagtgcagtggtgtgatctcggctcactgcaagctccacctcccgggttcacgccattctcctgcctcagcctcccaagtagctgggattccaggtgcccgccaccacgcccggctaatttttgtatttttagtagagactgggtttcaccttgttagccaggatggtcttgatctcctgacctcgtgatccacctgcctcagcctcccaccgtgctgggattacaggcgtgagccaccacacccggccatgtctttcctttttaaggctgaatgatattccacgatatgtatacaccacattttccttatctgttcatttgttgatggacacttgggttgcttctacattttagctattgtgagtagtgctgctatgaacatgggtatacaaacccaattctctctttattttagtttttacttttttctttctcagtgatccttttctgaccaattatctcttgaatctgctataataaatcttttttttctgaccactccatcaaatgtgtgctcgtcaaggtcaccagtgacctctacatcctcatagccaattcacagttctcaaatagtattagaaaaggtgctcactccctcacctttgaaataccttcttctctggcttccaggatgccacactgtcctggtttctgccttcatttgtggttactcttcagtctcctttgccaattcctcctaatttcgctaatcacatggagtagcctaggattcagtgcttggatctcttctcttttctgtcagccgtccttttgagctgacctcatccactctcatagctttaaataccacttatacaccgatcaccaagtgtgtatctctagccaagacctgtgacctttactccagactcacatatctaacctctcacttgacagctccatgaggatgtctgttgggcatgtaaaccttcacactccacaaatgatctaatcttacctccaaaacctgctcatcctgtttgtcttctccatcctttaagttgctcaggccgaaaactttgactcacctttgccacctctttttctttcctgcccctcactcaacttttcagtcaattctggtaggattttctgtcttctttgttcatagatgtatctccatggcctaaaaccataattagcacaagcctattagcaaagtccttcaaaatatatccagaattttattaagtctcaccacttctactgccactatcccagtgcaagtcattttcatctcaagcctggacttttgttaaagcctcctaaagaggtctaagtagttttcttacttccttttcttcctatagtctgttctccacatagcagatagagtaatcctttaactataaactagagcacatcattgttctgcctgacaccctccatggtgaagtgaagtgtcctaccacctctacttacgtgactatgctgagtgaagtgtcctacttcactcagagtaaaagcccagtgctttaccatggcctgcaaggcccaataactcaggttctgggaacttccccaccctcttctcctacttcctgccctccccagtctgctcagccatattgacatcctaaatgtttcttgaacaagtcacataactttccacctcaagacctttgcatttgatgttcctgatttcaatgctctttcttcagattcttcactactcatgccctcaactctttcgcatcttcaagaagatactaccatctcagtaaagccttctctggtcattccattttaagtctccatcacccagcttccacccacagcgttcccctctctcggtttattttttccattgcacttattacttccaacacaccaggcactttactcattttgtttaccatctgtctcccctactaagttccatgaagaggatcttttggctgctttgtttactaaagtatcccaaggtccagaagagtagttggcacattataggcattcaatgtataaagatgcatatttgaatgaatgaattgctagaaggcagaatataaagggaaaatttagaaacatgaggccaacaagggaagcagggactgtgtcctcagtgacttctaagccatgtttcaaaggtcagtgggatgccatgcatacattttaagtatgggattagtatgttcagaatcgtattatttaaaaagcactctagtaatagtatggaggattagcagagggtaagtctgggagaagctcaagatttctgacagatggtaaggccactcactgaagtaaggaggagaaatagtttggagggcagagtgtggtaatggtaggaaatgacagttatcatttgggacattttgaggtaatggattagaagtactgaggccttaacccaaacacagtacaaagagacaaaaagaaaaaaatgtagaagtgctgtcaagaatcatggaggatgtattgagatgacatggtataaatttgtgtataggaaagccagaacaagataaagtgagaatgatggaaaaaacaatatcaaaagtatgtcgggccaggcgcagtggcttacacctgtaatcccagtactttgggaggctgaggagggagaactgcttgaggccaggagttcgagaccagcctgggcaatccagcgtgaacccccatctctaaaaaaaaaaaaaatttaaagagataatgacagagttttctgaaactgaaagagagaccaaatttttcattcaaatggagagtgtactctgactatcaagcaggaaaaataaaatatataaaatctgtagtaagttctatcacaatgaagctgcagaacatgcagggtaaaagggaaatggtaaaagctgccagaaaaaaagggagtgtcttcaatggaacaataattaggctggcagcctgctttcctgtagcaaccgtgcaagctgaaggtggcacagcaatagcttcaaaatgctgtgagaatcgccgcccactcctcactgtgtgtgggctgggtgtggcacgctggcaactctccccaaacgactctggatgctggtgtccctagaatctcttgggtctaaagattgatcttcttacctcctataattcctgaggtggataattaactagggggtcacaaaattaattccacaatcttgtaacatgtcctgtatagatgttttgacaatgaacgtttccagcttttgggacagctcccacaattctaaaataatgggaatgtcatgcttaacatcctagtacggtgaacaatgttacataatttgggattttcctctactgtttcctgtatgtttgacttgcttcccaaactggcttgtaaacatatattacttttacattagctaagtagaagtttttcaatgtatacttttaacaataataataaacattatattcttcttcttcttctttattgagcacgtcctatgagccaagctctctgcaaagtgttttattcacattatctctcattaacattagctgcaaggtaatgactgtcacctccattttacagatgagtgagctgaagcttagcaaggttagtgacctgcccagggtcatattctgggtaagaggaaaaggtaggaatgtgacgcatgtctgtataacttcaaagcctgacctttcagcctctgtgctatattgatctgtgaaacatactaactattgataagaatgactgtgttaataatttggagtgggaatatttacttgaaatgttgacttttttgttgttattcttcccggaaaaagagtctgtatggtctcttgcagaatttccagcaaggcctaattccactgaaatcagtgcctctaccagccacctgtagatgtattatggactttgattgagttcttctttcctctggagaaggaatggtagatgaatccgtggacagtttccattcatatgacttgtcagcattgaacacataacacctctttttgcattacctcacagagtgttgattcagtaaagcattaaagctgtgggctggcagtgctacccagtaatccctgaagggccagagagccataggttaagtttggaggggctttaccagggtctattattcagtgtcctgccatgtgctacacagttcattatttgcttgaggaaaaagagcaagccctgatagtaagcgggtaaggggacatgcttcccaagagtaacttactctgtttgtactctcaataccttgcagagtgctagccatgtcatgtgtgcttagtaaaacctcagttaaatctataaactttaagaactttggaacaaaagtagtagaaaaagtaagggagttttagcaagtgggtaaatgatgaaagtaatcctgtgttgaaactcaaccagatgaatgttgttaccaaacttctgtacggtccactaggtccaaaaataaatttttgtggtacataggtagtagaagtggccagattagccatagacagatcttgtttacatataaaggcacaataaaaactattgtccaaggcaggggagaacaatgcataaaatctttaatatatctatactagttcttacagtaattatttctattatatgctctttccattataaaatgctcattagggtgcatgccttagcatgactttaaaacactacaaaggaacaaaatttcaaacctcc

SEQ ID NO: 2824 - DNA, 3069 bp, Homo sapiens
cggtgcggcccctcggcctcggcggcagcggctgcggagaaggcgagcgaaggtaggaggctgggggtgcgcgcgtgcgcgggggctggaccgacgcgctccgggcgaaggaggccgctcgcctgggggcgggctggagccatgtcccggggctaggggcgctgtgggcgccgcgcccgccgctgcccggcaccggaagccaagagggcgttcccgacgggctccgcagatgcccctccgcgtcctgccgcccatcctgcccggattgtcgcgggccgggggcgcgacaggaggccgaggcctgcccgggcgcagaggcctgcctgggcgcagcggcctgcagggcgcagccgtccctccgccggtcggggtcccctcgctccgcgggcggccgtgggaggccctcgcgacggccgctacccctcgcagatgccctctgcagctcctgcgtgcgggccccgccctgcactgccctcctagtgtgggacgcggtttcgtcttcattgcaaccctgccgagtcggaagcatctccattgtgcggatgggtaaactgaggcccagagcgcgcggttgggctggccacggaggcagggccgccggatgctgtgcggggatggggccctgcaccccttgcgcctctcaccatggggcctcaggcccctgtgcccggcagcgtctctggagtgggcattttgaacgagctccctcctgattttcacacagacttaagcctgacgaccgtgctggggcggatgtctgcccctctggtgaccaggtcacagctcccttgggaagacgattgactggggaatggggaccctggggagggggccttcagggtgccatctgtctgtttacgccagaaaacagagatttctgttttctttcgctgggctcacagcaggtgcttaataaacagatcttgtggcgggagcagaggacagcgaggttcaggcacgactccaggagtcaacccctggatctcggaggctccccacccgcgcacatttccctgacttaaccctcccctccccagtctttcagccctaggaggggaggccccctttccacccaggtggcccctgtgggggtcactccctggttttcaccctgaacttctgggatgcggcagatgctggatatgtgttcgctggtgtccttggctcttagcattcattaattcattcagcagctcttcatggagctttggccttagcccatgcactgtggaagtggcagtgaactaagccaacctggcactttgggaggctgaggtgggagaacggcttgagcccaggagttggagactagcctgggcaacatctcatctctacaacaagtaaaaaattagccaggcatggtggcatgcacctgtggtcccagctactcaggaggctgaggtggcctcccaaaggccccccctcctgggcctcccttaagcccaggaggtcaaggctgcagtgagccatgattttgccactgcactccagcctggacaacagagcaagaccctgtctcaaagaaaaaaaaaaggaggagacagacaacatacatgttggagaaaacggaacagccactggagggacctctttagctgagagtcaggggtaggtccctcagaaggtgatacttttgagcaaaaatctggccgacaagcgggggagtcagctgtgcaaaggaagagggaagagcgtcccaggcagagaaagtggcagtgcaaaggcccagaggtgggtgcatgcctggtgtttgaggaatcaagaaggccatgagcagccgggtgtggtggctcacacctgtaatcccagcactttgggaggccaaggtgggtggatcacttgaggtcaggagtttaagaccagcctggccaatacagtgaaacctcatctctactaaaaatgcaaaaattagctgggcatggtggttcatgcctataatcccagctactcgggaggctgaggtaggagaattgcttgaacccaggaggcagaggttgcagtgagcagagatcgtgcattactgcactctagctccagcgtgggcaacagagcaagactctgcctcaaaaaaaaaaaaaaaagaaaaaaaaaaaggagatgaggtgggagaagtggagtgggaccagatctggtgggccctgtgggccatggaaggactttgaacttcattttaggtgcggtaagggctagtagagggccttgggtaggggagggatatgacctttactgtgtgaaacttgagtgggtgaggggatgagcaggaagcatagagaccctcggggagccatctcagcagtccaggcagtggcttatataatacacatcggcgtcctggggtggtgccaggtacacagcaggcgctgcaggatggaagtcattgccgttactggttttgtttatttgagacagggtcttgctctatcacccaggctagagtgcagtgacacaaccatggctcattgcagcctcaaccttccaggctcaagcaatcctcctgcctcagcctctcaaggaactgggactacaggaggtgcatgccaccatgccaggccaattttttgtattttttttttggtagagatggattctcactatgttgccagggctggtctcaaactcctgggctcaagcaatcctcctacctcagcctcccaaagtgttgggaccacaggtgtgagtcactgcacccggcttgctgttattatttaaaactctgggctgggcgcagtggctcatgcctataatcccagcactttgagaggccgaggcgggtagatcacttgaggtcaggagtttgagaccagcctggccaacatggtgaaaccctgtctctactaaaaatacaaaaattagctgggcgcggtggcgcatacctgtaatcccagctactcaggaggctgaggtaggagaattgcttgagcccaggaggcggaggttgcagtgagccgagattgtgccattgcactccagactgggtgacagagtgagactccatctcaaaaacaaaacaaaacaaaacaaacaaacaaaaaacaaaaaccctttggaatcaggcacacctaggtcgcg

SEQ ID NO: 2825 - DNA, 487 bp, Homo sapiens
gaaggaaagccatgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaat

SEQ ID NO: 2826 - DNA, 2364 bp, Homo sapiens
cctttcctgttgttgggtgatctcggtcacttcctttacccacccgggcctcagtctctctgctgtcaaatgggccaccctgaagagtacacccatttcccagggtgaaacctcagaggggccgtaagaggtttctgttccagtgaagaatgttaaaatgcttcacaaagatgccctgtgtgctaggaggcggcactgccagttgtgcgggggtgacagatcagagacggtgtctctagaggacctcttagggcaggaaggagtgtctgacgaagctcaaggaaggctgggcaggagcgtgggctttggggctgggatttctgagttctggcctgtccccctgccacctcctgtccaagtggcccaggcacagtctcccacctctgccagggcccctcagggaagctgggcacaccctaacagttctgtgtgccctctctggccgccccccccaccagcaggcagcccaggtcccctgcctctcccagcccgcctgccttgtgcggcttgggaccatttcacaaaatcatttgtatttggcccctatggcaacctcctgaggcaggaatgagggttttgtttgacagagaaggaaactgaggctcttacctggagcccagagcaaggacctggccagggctgccacctccaggtgggggcttttccactgcccctcgctgctgggttcttctggctccttctccaggagatttcctgccatggattcaaaagacaaattttattgttctttccttttaaaatcagggtgtccccatcccagggtttctttctgcctcccaggtgtgtggtggggccttggtccaacagggtgcgacacttgggaatcccatggagcgtggtaaggagagcagtggacaggtatcaaaggcccggattctagtcctccaccagggacactttccctttggtccgttggtgtcctgctggggatggatgctcagtggatggtcagacatttgcaataggtgccgtggggttcattggtatgtgctaagctcagagtaagagcctggcccaaggtcacacgaggcctccacattctttctgttgtccacgtgacctctgtactgggggctgcagagagtgtggatggaaagaactgaagtgggaggcaggatgaaatgactgaatctcctcattacttttggcagttgtttggagtctctggttgtgttgtcttatgtgtcatgtgtagcttcgtggcattgtcaagttgtgcttttttttgttttttgagacagggtctcaccctgtctcccaggctggagtgcagtggtgcgatcttggctcactacaacctctgcctcccaggctcaagcaattctcctgcctcagcctcctgaatagttgggactacaggtgtatgccaccgtgcctggctaatttttgtatttttggtaaatggggttttttgtttgtttttttttctttttctttctttctttttttttttttttttttgagatggagtctcgctctgttgcccaggctggagtgcagtggcgcgatctcggctcactgcaagctccgcctcccaggttcacaccattctgtaatcccagctactcagggggctgagacaggacagtcacttgagcccgggaggtggaggttgcagggagccaagatcataccattgcactccagcctgggtgataagagtgaaactccgtcccctgccgccccgcccccccaccccaacaagaaaaacaagatctgaaatgctccagaatccaaaacattttgagcaccaaaatgatgttcaaaggaagtgttcattggagcagtctaaatttcagatttttggattggggatgctcagctagtatatataatgcaaatattccaaaatcctaaaaaaattcgaagtctgaaacacttctggttccaagcatttcggataaggaatgctctgcctgtgtgtggttgtaggtaagcctcttcacctgtaaaatgggtatgaagagaatacccgctctccttaatgtaataagacccaccaggcaggatattggaagccagaaagtcaggattcttggtccacttgtatgtggtccatgtcaagcgtccttggccactcctgattaaaacccatggaggctttcgccagagggggtgggcctcccttcatgcagtgggcatgttccattgggtttggcatgaattgagcctaggaagggaagtaacatctcctggacgtctgtgtgccaggctgtctgcccagtgtgcctcacagatgaatatactccatccacatactaagcctacagggcaggtgtgttcgttatctcttcccctctaacatggcaactcaaagcaataaacattgattatttcacatgg

SEQ ID NO: 2827 - DNA, 302 bp, Homo sapiens
gaaaaactgtgctgtccaaaccgactgactcttcccctgaggttataaattatttaggaaataaagcatgtgagtgctacatctcaattgccgattgggctgctgtgcaggaatggcagaacgctatccatgacttgaaaaagagtaccagtagcacttccttcaacctgaaagctgacttcaactatataaaatcattaagcagctttgagtctggaaaatttgtcaaatgtaccgagcaattagaattgttaccaggagaaaatatcaatctacttgctggagggtcaaaagaaaaaata

SEQ ID NO: 2828 - DNA, 20516 bp, Homo sapiens
gttagaaaccctggacccgggaggcggcgggaagggccgaggggacccggggccacccggtgcgcagaggcagaggggcccccaaaacccgcaacgcgggcccctcagtctgcgggccaagcccggggtttccctccattaagaagtcagttgggcgtttctgctggcgtggagagcgctaccaggtgcccccggattttgatcgggagtcgcttttgcctttccgtggacaagccttcctccgccagcagatgccccgggcaggaagagaagcggtgggtgagtggaaagggccttggtatggaaacgcagagaccgaattccttctcatctgccagctccgtggccgtgggcacattatctgttttcttagtccggctcatcgtttctttcaaaaaccattttggacccttctgggaaggcaaagaagagaagcagagtggactgtgagcggacataaaccaccctgatgggtatgatttccatttttggcacgggagtccggagattttgtgaccctctccaaggacacacagcaatcccttgagagccccaagaccagagtccagttgccatgacattgctgccctataaccacactctgggtgagcttttacttctgtgacatggaatgtgcatctccctcttctatagcaaccctcatgagatttcagctcagaaaatgcaaaatgtctgacactgaaaatccatcttcgaatgtcgttatatcagaccagacacagtagtattcagaatcgcgtagtaggatgggggtgtgagaagaggtgtgaactagtctatatggattgcagtcaattttttaatttttttttttttgagacagagtctcgctctgtcaccaggctggagtgcagtggcgctatctcggctcaccacaacctccgcctcccaggttcaagctattctcccgcctcagcctcctgggtagctgggactacaggcacgtgccaccatgcccggctaatttttgtatttttagtagagacggggtttcagcatgttggccaggatggtcttgatctcttgacctcatcatccgtctgcctcggcctcccaaagtgggattacaggcgtgagccaccgcgcctggccttgcagtctatttttaagggaattattttgttatgtgcaagtgtatctgatattttaaaggttttacaacaaaggtattaccaagcctgtttaactatttctgctgaatggtcattctctaccatttgctacagatcccttccgtgcccctctgctctgctctgtattgcagtgggctgagtcttgcggggggcagtttctcaggctcccagagcatctggcttcaggcctcggtttagccaatgggaggcagtggcaggagaagagaaggcaggaggaaagaaagagccatggtatttcttctctttctctctcttgctcaggctcaggtgacatctccagcagcagatgaggcctctctgtggctccagctcatggataggtagctgtggtcccaacatctgtaggatgatccatgcccctgggctctactcagtccacctcctctttttgtccctgcaggttaggagttgtaggcagcttcttgcttttgccagtctctgtactgcctctctctgtcccctgctgggctttccagacctccctgttaacccctgttaatcgtgtcaccaaaaccctgcattacattctctctgttttcaatacttaaagtggttccctcctggcggggcgcagtggctcccaactgtaatcccagcagtttgggaggccaaggcaggtggatcacttgaggtcaggagttcgagaccagcctggccaacatggtgaaaccctgtctctaccataagaaaaaagaaaaaagaaattagcccggcatggtggtgtgtgcctgtaatcccagctacttacgaggttgagtcaggaagattgcttgagcccaggaggcggaggttgcagtgagccaagatcatgccgctgcacttgactccagcctgggcgacagagctagattgtctcaaaaaaaaagtggttcctattttcctggttgaaccttgagtgatacacccagtattgtaccacccaattagtagacattatttcttttaggtcatattattctcagcttatagagcaagaagttgaagcttaaagggttagattacttgcccaaggtaatacagcaagaatcttatttcatccaacctagagtgaatatttcccccacattttaatatccctcaaatggtgatgctttctataatcaacatcaacgtgaagtttaggactgaagtttaggactatcaagaaagtgaaagatggcttttctggcattcagactgtgctgttaccagcagaaagtaagctatgtttagaatgagacatagatgaagccacttcatgaccacaaagtgacttcgcctttttttttttttttttttttgaaatggagtctcactctgtcacccaacctggagcgcagtggtgcaatctcggctcactgcaacctccgcctcccgggctcaagcaattctctgcctcagcctcccaagcagctgggattacaggcgcctgccaccacacttggctaatttttgtatttttagtagagtcagggtttcaccatcttgtccaggctggtcttgaactctgaccttgtgatcctcctgcctcggcctctcaaagtgctgggattacaggcgcgagctactgcttccggcctttttttttttttttaaaacggagttttgttcttgttgcccaggctggaatgcaatggcgcaatctcagctcactacaacctccgcctcccaggttcaagattctcctgcctcagcctgccgagtagctgggattacaggcatgcgccatcacacctggctaattttgtatttttagtagagacggggtttctccatgttggtcaggctggtctcgaactccgacctcaggtgatccgcttgtctcggcctcccaaagtgctgggattataggtgtgagccgctgctcctggccgactttgcctttttttaaaaaaagaatttttttttttttagagatggggtttcaccatgttgtccaggctggactcaagcaatccacctgcctcagcctcccaaagtgctggaaagtaggtgtgcgctactgtgcccggcctgacttcaccttttttggagcaattgctatttctctttagcaaaaattactgtagtccaggctgggcgtggtggcttacacctgtaatctcagcactttgggaggccaaggcgggctgatcacttgaacccgggaggcagaggttgtagtgagtcgagattgcgccaccgcaatccagcctgggtgacagagcgagactccatctccaaaaaaaaaaaaaaaaaagatacccagtttctgaactgcccctgtttcttgacagcattcaatcctgaaccagttccatttccctaattcttccatagaactatgggaacgaggccaaatttaaggagtttcctgagggtgccttgagggtttccctgggatgtattctccttcactgcagcaaattaaacctaattttggttacaagtgtgttcctggtggtccttggtcacagggctttgacaaccccaaccaatttattttgcctacattttcatgtatatgaagagtgatatatcatgaaaacctatgttaaaatatcaacaaatctagggccaggtgcagtggctcacacctataatcccagcactttgggaggtcaaggcgggaggccaggagttcgcaaccagcctggctaacatgtccaaacccagttgctacaaaaaatacaaaaattagctggatggctgggcgtggtggcgcacgcctgtaatcccagcactttgggaagtcaaggcggttggatcacctgagattcggagttcgagaccagcgtggccaacatggtgaaaccctgtctctactaaaaatgcaaataattagtcgggtgtgatggcgggcacctgtaatcccagctactcaggaggcagaggcaggagaatcgcctgaacccaggaggcgcaggttgcagtgagctgagattgtgccattgtactgcagcctgggcaacaagagggaaactccatctcaaaaaaaaaaaaaaaaaaaaaattgccaggcacagtggctcatgtctctaatcccagcactttgagaggccgaggcaggggaatcacctgaggtcagcagttcgagaccgtcctggctaacatggtgaaaccccatctctattaaaagtacaaaaaatcagtcgggtctggtggtgggcccctgtaatcccagctactcaggaggctgaggcaggagaatcacttgaacccaggaggtggagcttgcagtgagctgagattgggccattgcactccaggctgagcaacaagagcaaaactctgtctcaaaaaaaaaaaaggccgggcgtggtggctcatgcttgtaatcccagcactttgggaggccgaggtgggtggatcatgagatcaggagatcgagaccatcctggctaacatggtgaaaccccatctctactaaaaatacaaaaaattagctgggcgtggtgtcaggcgcctgtagtcccagctacttgggaggctgaggcaggagaatggcatgaacctgggaggtggagcttgcagtgagccgatctcacgccactgcactccagcctgggcgacagagtgagactccgtctcaaaaaaaaaaaaaaaaaaattagcttggtgtggtggagtgcccctgtaatcccagctaccttgatgtctgaggcatgagaatcgcttgaatctgggagttggaggttgcagtgatctgtgattgtgctactgcactcctgcctcggcactcctgcctcggtgacagggcaagactctgtctcaaaaaaaaaaaagaaaaaaaatctgcaagtctaaaagagctcttttttttgttgttgttgggacagagtctcactctgtctcccaggctggagtacagtggcacgatctcggctcactgcaacctccatctcccaggtttcagtgactctcccatctcagcctcctgagtacctgtgattacaggcgtccgccatcacacccggctaattttttgtatttttagtagagatggggtttcaccatgttggccaagctaatctcgaactcctgatctcaagtgatccgactgccttggtctcccaaagtgctgggattacaggcatgagccactgcaccggcctaaaagagctcttttaatttttttttttttttttttgagacagagtcttgctctgttgcccaggctggagtgcagtggcgctatcttggctcactgcaacttccacctcccgggttcaagcgattctcctgtctcagcctcctgagtagctgggattacaggcatgtgccaccatgctcagctaatttttgtatttttagtacagacgaggtttcatcatgttggccaggctggtcttgaactcctgacttcaagtgatctacccacctcggcctcccacagtgatgggattacaggcatgagccaccgagtctggccaaaagagctcttttaataaacgtaaaataaaattccaagtgataagagatcattgtcatagtttggcagtatttttttctttggggatacataaaataatggttcatcttgcaaaccatgatgtcctagatttaatgaaatgtggctagttgctaaggcaggacccaaccctagctctatcccctgtccttgctcttaaacactgcaatgcttagatgaagaaaccaaatcaaacaacatgaaagtcacagaagcgaattggtcggcctgcaaagccaggccttctgccttgcatacctgctctgctgagcaaaccttctctgcgctgagctctgagggaagactccagaccatcttcagtggagttattaggaattccaggaattctcctccaccagctacacagctacatagaaagtgccatatacaggaatcaaatttttgtttgtttgtttgttgtagaggcagagtctggctctgtcacccagcctggagtacagtggcgaaatcatagctcaccacagcctcgaactcctgggctcaagcgatcctcccgcctcagcctcccaaagtgctgggattacaagtgtgagtcactgtgcctggccaagaattggaatttatttatttaatttattgttattattacatatatatttttgaggtggagtcttgctctgtcgcccaggctagagtgcagtggcacgatctctgctcaccgcagcctctgcctcctgggttcaagcagttctcctgccccaacctcctgagtagctaggattacaggtgcgcgctaccatgcccagctaattgtttgtattttttttttttttttttgagacagagtcttgctctgtagcccaggctggagtgcagtgacgtgatcttggctcacagcaagctccacctcccgggttcacaccattctcctgcctcagcctcccgagtagctgggactacaggcgcccgccaccacgcctagctaatttttttgtatttttagtagagatggggtttcaccgtgttagccaggatggtcttgatctcctgaccttgtgatccacccacctcagcctcccaaagtgctgggattacaggcgtgagccactgcgcctggctaattgtttgtatttttcgtagagatgaggtttcaccatattggccaggctggtctggaactcctgacctggtgatccacctgcctcggcctcccaaagtactgggattacaagtgtgagccaatgcgcctggccccattttgtatttttatagagtcagggtttccctatgttgcccaggctggtctcaaactcctgggcttaaacgatcctcccacctcagcctcacaaagtgctggaattacaggcatgagctactgtgcccagccaggaatcttaattgttgagacagcttcctgtggaggagagagggtagacccttactaatctaagttatgtctgtaactcgtcttttgacttagcgaatttggccttgagacatgagattcctaggacggggcaggacagactgaaaacaggaagagtggagaaccaatggcttctgtcccagcaaatagttgctccaggccactccccatggtgtcccctaggctggaggcccaagctggaggaagcatttccttttggcacagcttttattgttggtagcattttaggacaccagtgacaagctgagacagcgagtggactgcctcaagtgggaatagctgtggggatattgaaatatgggggccgggcgtggtggctcatgcctataatcccagcactttgggagtctgaggcaggcggatcacgaggtcaggagttcgagagcagcctggccaatatggtgaaacctcatctctactaaaaatacaaaaattagccaggctgctaatttttgtaaaaatacaaaaattacaggtggtggcacgcacctgtagttccggctactcaggaggctgaggcaggagaatcactggaacccgggaggcggaggttgcagtgagccgagattgcaccgttgcactccagcctgggtgacagagcaagactccgtctcaaaagaaaaagaaaaagaaatatgggtgggctgctgtagcaagtggactagacccagctccaagtgaggagagggctgtctgaagcctaggtaagggcaggggggcttcactcttaactggcttggcatttagtagtggtctttagcaaaagccataataaatatatagccatgctcttcagctcagtaatcctattgccagcttatcctaaagtcatccaaaagaagaaaagtaatgacctaacagcaatgttggtatcagttcagcccctaaaacttagcactccttggtgaaattttattcagttgttgtgtgtggtcagaagtccatctcttggtcccacatccgttggaaccccactgttatgaaacttggcacgttgtgctgtaattatttgtttgcaggaccagtttttgtccatctttatagttgcagcatcagcccagaatctgtggtgttagcaccagctgggtggccacattttagggttcttgttgcagaactctcaatctaaactagctcaaggtcaggtgtgatggctcacgcctgtaatcccagtagtttgggaggctgacgtgggtggatcacctgaagtcaggagttccagaccagcctggacaacaagacaaaacctcatctctattaaaaatataaaaattggctgggcgtagtggctgacacctgtaaccccagcactttgggacaccgaggtgggcagatcacaaggtcaggagtttgggaccatcctggctaacacggtgaaaccccgtctctactaaaaatacaaaaattagctgggtgtggcggcaggcgcctgtagtcccaactactcgggaggctgaggcaggagaatcgcttgaacccgggaagtggaggttgcagtgagccgagatcgtgccactgcactccagcctaggcgactgtctcaagaaataaataaataaatatactagcttgaacaaaatgggggatttattggctcatggaactgaaggaagggctgaatgcccaattgtgggaagggcagggatacaggccgactttaggaataaccggacccaggacataaatgctaccaggacgttcttttcacccccagtctctgcctctgtttgtgtacatcagccatactccctttcctgcagcctgtctttttccacatggcaggagatgggccactaattcccacagactagcttctagctctgtacatgtcaaacctgtttctcctcctctgtccacgtgtgtgttcaatgctaggcactgtttacatcctcgtatcaccaaatgactttctgccctgcacgttggtgtaataaaatgaggtgagtcagattggcgggcatagaattattcctggaagctgttcctacttttttgttaaagtatcctgtattgtctgatatttttgcttttataatcagaatttaaaatgccatttctattttttaagaaaagacctggccaggcatgatccagcactttgggaagtcaagatgggcggatcacttgaggtcaggagttcgagagcagcctggccaacatggtgaaaccctgtctctactaaaaatacaaaaattaacctggtgtggtggtgggtgcctgtaatcccagctacttgggaggctgaggcagaagaatcgctcgaacctgggaggcagaggttgcagttagccaagattgtgccactgcactccagcctgggcgacaaagcgagactccgtctcggaaaaaagaaaaaaagaccctatcacgcctgtaatccctgcacttcgggaggcccgaggcgggtggatcacctgaggtcaggagtttgagaccagcccagccaacatgatgaaaccccgtctctactaaaaatacaaagaattagctgggcatggtggcgcgtgcctataatcccaggtactcagaaggctgaggcaggagaattgcttgaacccaggaggtggaggttgcggtgagccgagatcgtgccactgcactccagcctgggcaacaagagcaaaactccatctcaaaaataccccccaaaaccaaaaaaacacaagatgctaatgcagcagaattagacaaaatagatcgattcttatctttttatgtgtgtttatctcactctgtcactcaggctggagtacagtggcacgaacatggctcactgcagcctcaacctcctgggctcaagcagttctcccaccttagcccccttagtagctgggactacaggcacatcccaccacgtccagctaatttttatatttttttggtagaggcagggttctgccatgttctgccacttgaactgctgagctcaagtgatcctcccacctcggcttcccaaagtgctaggattacaagcgtgagtcaccatgcctggcctgatgaatccttcttgacctgctccctaaaggtctcgtagagcaagaatggcaagcatttgttctgagttggttggcttattgtttccagctatcccaccccctcctataattagattatatgtccagccccattaccttgcttttcagtgcctcaaatgagacagtgaatgtttccccacccttgtgactgtggacgtgaccatgtgacttgccttggccaatggggcgtgaacagacatgaagtaagcagtaatcttagctgaggcgttgtagtaattgtatggtgtgtgcttggtttctattgcgtgtgccatccatctgagaagagcatgccctagggatatgctgcttcttcagcttgggtcctggaatgagagacacctggagtagactggaacctaactcacagtacagctgggccaagtacagttgagcccagctagcctagtgcagccacagttgacctacagacctataagaaagaaatgtttgctgccgtaaatgactaagttccagggttgttggttacacaacattgccacaacaaaaagctgactaatactccagacactgcattctctccccaaatcccccccgcccccttttttttttttaattttatgggcctggcaggccgggtgcagtggctcacacctggaatcccagcactttgggaggcctaggtgggtggatcacctgaggtcaggagtttaagaccagcctggccaacatggtgaaaccctgtctttactaaaaatacaaaaattagccgggcgtggtggtgagcacctgtaatcccagctactcgggtggctgaggcagagagaaatgcttaaaaccctgaaggcagaggttgcagtgagctgagatcacaccactgcactccagcttgggtgatagagtgagactccgtctcaaaaaaaaaaaaaaaaaaaaaggtatgggcctggcgtggtggctcatgcccgtaatcccagcactttgggagaccgaggtgggcggatcacctgaggtcaggaggtcgagaccagcgtgttgaacatggtgaaaccctgtctttactaaaagtaaaaaaaatcagctgggcatggtggcgggcacctgtaatcccagctactcaggaggctgaggtaggagagtcactgcttgaacccaggaggcggaagttgcagtaagccgagatcgagacactgcattccagcctgagcgacagagagagccatctcaaaaattaattaaataaatagataaatacataaataaattttatggagataagagtggtgccagggagacctcccggtttgcccagcattgagaggtttcccagaatttgagattttcaggttttattttttattttattgtattgtattttatttttttgaggtggagtcttgctctgtcgcccaggctggagtgcagtggcgccatctcagctcactgcaagctccacctcctggattcacaccattctcctgcctcagcctcccgagtggctgggattacaggcgcccgccaccacgcctggctaattttttgtatttttagtagacatggggtttcaccgagttagtcagaatggtctcgctctcctgacctcgtgatccgcccgcctcagcctcccaaagtgctaggattacaggcgtgagccaccgtgcccagcctgagactttcaggttttaaaaaacagctttattgagatagaatttatattcccatatacctcgttcacttaatgagcatatcaatgttttttagtatattcacagggttgtgaaattatcacggcaatcttattttagaatattttcctccctcttaaaacgaacctcatacccattagcggtcactcctcactcttctccctcgaccccaatccctaagcaaccactaacctactttctgtccctacaaatttgtgtattctggaccttctgtatacatgggatcatataatatgtgggcattttgtgactggcatttttaaattagcaatatattttctaggtctatccacgttgtaacatgtatcagttcttcatttccttccttccttcccaacctccctccctccctccttccctccttcatttccttccttccttcactccttcccaacatcccccctcctttctctctctctctttctttctttcccttccttccttccctccttccttcattccttccttccctccttcccaacatccctccctcctttctttctctccctctctttcttttctttctcttctcttctttctctctctctctctttttctttcctgtctttctttttttgatggagtttcgctcttgtcccccaggctggagtgcaatggcgcaatcgtggctcactgcaacctccacatcccgggttcaagcaattctcccgcctcagcctcccgagtagctgggattacaggcccccaccaccacacccagctaatttttgtatttttagtagagacggggtttcaccatattggccaagctggtctcaaactgctgacctcagatgatctgctcacctcgccctcccaaagtgttgggattacaggcgtgagccaccctgcccggcccctttctttctttttctttttctccttttcttttttctttcccttcccttcctccctccctccctcctttccttccttccttctttttccttttctttctccttctttttctgagacagagactcactctgttgctcagcctggaggtacagtggtgtgatcacagatcactgcagcctggacttccttggctcaggtgatcctcctacctcagcctcctgggtagctaggactgcaagtgcacgccaccatgcccggctaatttaaaataattttttgtagcatgggatctcactgtgttgctcaggctagtcttgacttcctgtgctcaagtgatcctcccgcctcagccaccctaagtgttgggattataggcgtgagccactgtgcctggcttcatttctttttatttctggataatatttgatagtatgtatatataatcttttacttccattcatcagtgatgggcatcaggttgtttccactttttggctgttgtgaatagagctgctatgaacatttatgtacaagtttttgtttgaacatgtgttttttcagttattctgggtatatgcttgcgagtgggattgccgagtgatatggtaattctgtttaatttattggagaactgccaaactcttttccacagctgccgcatcatacgttcccaccagtagtgtaagagaaatccgatttctccacatccttgtcaatacttgttattgtccattgtttatattacagccatcctggtgggggcacagagatacctcaccgtggttttgatttgcatttccctgttgactaatgacatcagacacctttcatgtgctttttttttttggtcatttgtatatctttagagaaacgtctgttgaaatcctttgcccctttaaaaaattagattattagtctttatattatcaagttgtaagagttctttatatattctggatattagacccttatcagatatatgatatggaaatgttttctcccattctgtgggttgtcttttcactgtctatgatttgcagcacaaaagtttctaattttgatgtccaatttccagtgtatctagttttttgttttttttttttttttttgagatggagtttcgctcttttgcccaggctggagttaagtggtgtgatcttggctcactgcaacttccacctcccgggttcaagtgattctcctgcctcagcctcccgagtagctaggattacaggcgcctgccaccacacccagctaatttttgtatttttagtagagacagggtttcaccatgttggctgggctggtctcaaactcctgacctcaggtgatcttcccgccttggccttccaaaatgctgggattacagtcgtgagccaccgtgcccagtctggtttttcttttgttacttgttctcttggtgttgtatctaccaattcctttggtagacactctaatcagttatggtattctttctcactgaacccagatgccacttaccttgaaatttttctcagcactgcgtggttaaaagccccaattctctccaggcgcggtggctcacacctgtaatcccagcactttgggaggccgaggtgggtggatcatgaggtcaggagttccagaccagcctggccaagatggtgaaaccccgtctctactaaaaatacaaaaaattagtcgggtgtggtggcacgcgcctgtaatcccagctactcctgaggctgaggcagagaattgcttaaacctggaggggaggaggttgcagtaagccgagattgcgccactgcactccagcctgggcgacagagtgagactccatctcaaaaaaaaaaaaagccccaattctaggccaggtgtggtagcttatgcctgtaatctcagcactttgggaggccgaggtgggcagattgcctgaggttgggagtttgagaccagcctggctagtatggtgaaaccctgtctctactaaaaatataaaaattagccaggtatggtggcaggcgcctgtaatccctgctactcgggaggctgaggccagagaatcgcttgaacccaggaggcggaggttgcagtgagccaagatcccgctattgcactccagcctgggcaactgagcaagactccatatcaaaaacaaacaaaaaaacacccaaacaaattctagagaagaactgagcgggtgcaaatccccactagtgccatcacttaatggtggtgggttttttttggttttgtttcttacctctgggtcactttacccattaaacaaaatgttgggtgtaggtgagagagactgagaaggggaatagcggaggaaggtaatgaacatagctggtcctacacatcttcttgtgatggattggtcttaatggagggcccatgcagggctgagagctggaagaagtggagcatatgggaaatctcttgtgcattacttcaaatcctcttggccatacctctgtgtgtgtgtgtgtgtgtgtgtgtgtgtgtgtgtatgagatatgagacagtgccaggtgtgagccacagcgcccagcccatgcctctttttcaagccacagctgctaccgccagttctatgcaggctctgctgccttggcatgggtgcagtgtgattgcacctggcccacacctggtgcctcttgctttttgccctggagcttctctgatacttcagtgtgggactcttgcctgctcagcgctagcacacgtgcatcctagaagtggcagaatcgatgccttggggccatcactgactgatggggatgggagctaatgaataagtccttatggattttgtcctccagtttgtttcccagaagtattccaaaagagagggtgaaggatgctgaacaggataaaccacagctgtctgccttttctactaattcagactctatagaaggattctaggaattatatttacaacaaatagaggtcagggatccctgaacccagagctgcagaccagtatgggtctgtcacctgttaggcactgggtacacagcaggtgatgggggtggtgagccattaccacctaagctttgcctcctttcagatcagcagtagcagtagattctcacaggagcgtgaaccctattgtaactgtgcatttgagggatctaggttgcatgttctttatgagaatctaatgcctgatgatctgaggtggaagagtttcatctcaaagccatcggtcccccgatcctacgtccccccaaccctgtctgtggaaaaattgtcttccatgaagccagaccctggtgccaaaaaggttggggaccactgctataggtgattcccatgaatactaatgcttggaaaacatggaattatggcattttcagaaggaatttacattataaaagagacagaaattacaattcaggctcacttagccattcattcccttgtagcatgcagtaaagcagtacatctcttgatcttctcaaggatggcatcttcatggattcttctcctcttctggtcctcaggttcaccctgcatgtgtccatgaacttccttcctagtctctaaggaaggcgacttctctcttcctaaggaagactccacccctttccacaggaggaggttttgcttctgggttccttcctatatcctgttgtctagagctgtatcctgggcttcagccaacagggcactgatgttcacttcttgccagcccagcaagctccaggtgatgacaggcatcaagaacccagagcaatggccaggcgcggtggctcactcctgtaatcccagcactttgggaggccgaggcaggcagatcacttgaggtcaggagtttgagaccagcctggccaacatggcgaaaccccgtgtctactaaaaatataaaaattatctgggcgtggtggtgtgcgcttgtaatcccagctactggagaggctgaggcaggaaaatcgcttgaacccgggaggtggaggttgcagtgaggggagatggtgccacactgcacaccagactgggtgacagagtgacactctgtctaaaaaaaaaaaaaaaggctgggcacggtggctcacgcctgtaatcccagcactttgggaggctgaggtggatggatcacctgaggtcaggagttcaagaccagcctggccaacatggtgaaaccccatctctactaaaaatacaaaaaacattacctgggcgtggtggtgggtgcctgtaatcccagctactcaagaggctgagtcaggagaatcacttgaacccagtaggcggaggttgcagtgagccgagattgcactattgcactccagcctgagcaacaagagcaaaacactgtctcaaaaaaaaaaaaaaaaaaaaagcaggtatggattcatgatacctccaaggccccaggaagtacaggaagaaataataactattggaaaagataagtccaggccgggcacagtggctcacacctgtaatcccagcactttgggaggtcgaggcaggtggatcacgaggtcaggagttcgagaccagcctggccaagatggtgaaaccccgtctccactaaaaatacaaaaaattagccaggcgtggtggcaggcgcctgtaatcccagccactcaggaggctgaggtaaagaattgcttgaacccgggaggcggaggttgcagtgagccgagattgcgccactgcactccagcctggacgacagagcaagactccatctcaaaaaaataaataaataaaaggacacacattttagacacacgtttatacttactgctctcagaaacttttttcccccaagatacgcttaagaaatcaccaaatttaccagcctggccaacatggtgtaaaaatacaaaaattagtcaggcgtggtggcgtgcgactgtaatcccagctacttgtggagcgaggcatgagaatcacttgaacctgggaggcggaggttgcagtgagccaagttcacaccactgcactccaacacgggcgacagagtgagactctgacaaagaaaaaaaaaaaaggaaggaaggaaggaaccacctgattggcttggcgtggtggctcacgcctgtaacctcaacattttgggaagcagaggttggcagatcacttgaggtcaggagttcgagaccagcctggccaacatggtaaaaccgtgtccctactaaaagtacaaaaattagccgggtgtggtggcacacacctgtaatcccagctacttggaaggctaggcaggagaatcgcttgaacctgggagggtttcaactgtggttttaatttgcatttgcctaatgtctaatgatgttgagcatcttttcatgtacttatttgccatttgtgtatcttctttagagaaatgtctattcaagtcctttgctaattttttttttgtgggaggtgagtagagacagggtctctctatattgcccaggctggtcttgatctcagcctcaagcaatcctcccaccttggcctcccaaagcactggtattacaatggtgagccactgtgcctggcccttttgcgtgatcttttttgtggggggggttgttttttgtttttttgagatggtgtttcactttgttgcccacgctggagtgcagtggctggatctccgcttactgcaacctccgcctcctgggttcaaacgattcttgtgcctcagcctcctgagtagctgggactacaggcacccaccaccaagcctggctaatttttgtattttagtagaggtggggtttcaccctattggccaggctggtctcaaactcctgacctcaagtgatccacccgccttggccttccaaagtgctaggattacaggtgtgagccaccgcgccaggctctcccttgcctattcttaattgtctttttcttgagttgtacaaaattttttcttttttttgacagagtctcactttgttgcccaggctggagtgcagtggtgcggtcttggctcactgcaacctccacctcctgggttcaagccattttcctgcttcagcctcccgagtagctgggattacaggcatacaccactatgcccggctaatttttgtattttcagtagagacgaggtttcacactgttggccaggctggtctcgaactcccgacatcaggtgatctgcctgcctctgcctcccaaagtgctgggattacaggcatgagccacctcgcccggccatttattattattattgttattattattattattttttagaggcaggtcttgcttctttgcccaggctggagtgcagtgtggcaatcatagctcactgcagacctgaactgcagggctcaagggatcctcttacctcagccttctgagttggtgggattataggcacacaccaccatgcctggctaatttttacttttgtagagatggggtctccctatgttgcccaggctggtctcaaactcctggcctcaagtgttcttcctgcttcagcctcccaaagagttgggattacacacgtgagccatgatgcccaatcgatatattttaatgttcaattttttctagattaggccaatgaaaaccccttcaagctggtttctgtattcttttgacattccacaattcttctatgcacacatccttactttttggtacaagtaatagacatctatgtctatgtatattaaaaaaacacaatcacagccaatactccaatttctagtccaaccctgcagggtttattccagccttccctctttccatgtgtaacatattacagtggcaagtctgactcccttcatccttaatgtgcttactcacttccccaatcccactccttccctctgtcctagtcacacaggttgactggaacatactgggccccctccttctgctttatgggccagtggaaagctcagccctaacaaaggggaaggagagaagaaggagaaaaaaggaaggaggaaatgacatctttttctattttttctagggaaattttctctactccaatgttttaaaaatattcatctctcctttttattaaattttaaagttttgttttaatatttacaccctggccaagtgtggtagctcatgcctgtaatcccagcactttgggaggccaaggtgggtggatcacttgaggtcaggagttcgagaccagcctggccaacatggtgaaaccctgtctctactaaaaaatacaaaaattacccaggtgtggtgactcatgcctgtagtctcagcttctcaggaggctgagtctggaggactgcttgaacctgggaggcagaggttgcagtgagccaagattgggccactgcactccagcctgggagacagagtgagaagactctgtctcaaaatacatatatatatacatatatatgtttacacccttatccatgtgtagttgctggtgtaatatggtataagggagtgatccattttaacttttgtttataaggatagctaagttttccatctccatttttgaacaatacctcctttctccagtgacctaacaaaacatgtctgtcatacatcaacgtttcatacaaagcatgggtctgtgtctgggttacttaatctgtcttctcctgcctcagcacctcatgttattaagtaccatggcttcctagtaagttctgatccctagttggacaagtcttcctttctgctttttttattcagaagagtcttgactatcattggtgattacacttccttataagttttggaataatcataaaaggttccatgaaaagttctattggtcagcaccataagacaaagtgaaggccgggcatgattgcttatgcctgtaatcccagcactttgggaggctgaggtgggtggatcatctgaggtcaggagtttgagactagcctggccaacatagtgaaaacccgtttctactaaaaatacaaaaattagcccagagtagtggcacatgcttgtagtcccagttactgggga

SEQ ID NO: 2829 - DNA, 36959 bp, Homo sapiens
ctttttcaaaatgtggcggtggcagggaaggttgtctgctccagaggcttccctagagtgaagagctctactatgtatgctttatgcggcagaaggagtgctttggaggagtttttaaatttgttttttttttaaatcttatcggttttaattgtagcaatgattcaagaaacgttagtaggtgcccataacttcggtggtggagatccaaaagtgaacaagacagtgttctggctgctaaattcttcttaactggttatgcctggagaccttcacttggttctgtgccagcactgcccatgaacttcatagactgtgatctttgctaaggcctaaatgaatgaaggtgcaggaccggaagcagaagacagaaagtggagaccagatgtttgaagctgggtaaaggcagggatggagcaggaaccgaggaacaaaccttggaactaggtaagtttcctgaggccttcccagaagtagaagcctgcacagtccacagaactgtgagtcaattaaaccttttttctttataaattacccagtcttaggtagttctttataacagtatgagaaccaactaatacaggcaggatgcaaagtttcaggagccagtgggacatctgttagagatgtgtataaggagtttagaaatttcaaccatgcttcagagttaacatttgaaatagaaaagtagcagccaaaggtgtaaatgtactaactaaaagctagtaaatattaataaaagagagccaaaaactaagctgtgagatgtgccctcatttagaaacctgaagaggtgaaaagaagggaataaaacaagtaagaaagggacaaaaaaggaagtgggaacttacagtaaaaacttgtcgtagaatcaagggaatgcttctgaaggaagacgtgtctagcagaggcaagccccgctgaattgagagaggaaaagtattgaaacgaagcttttgagtttggtgaccaaggtttcactggtgacctttgacaaaacctcagttacttgagtagacttaaatgaagtgaaaagtcatgagcttgagggagaacttaaaactcaaaattactgtaagaacttgagtcttccaggtcgacttgtcatcaggttccttgtttttgttgtggatttccgcttgcaggataaattttcccctgcagtcttcccttggtgacctcttcaatgtaatcagttcagtatttctgctatacctccattacccacatctgaggctctgaattaggtggagttaattggttcaattggagattcacacccatggcaacttgtcatctcctaacctcttgatggagtataccagcaaatgagagatgacttgaactaatctgaccctttcatttcacatccacagcacaattactctcccttttgctcgcctaacacgatctcaaatactaaaatgacccaatccagcttattagatccccaaataacttaatataataacataatacaaaatttagacatttggaaaaggcacacggtagggtccgtatgtacctgctcccatttttttctatggttcaaagcacagttttaagaaaccagttaactttcttcagtgaggcctatttgccagcttctctactgggaattatttatagtatggcaataaggtcattaacttgtacttggttctgaaaagctaaaaactttcgaagttgcaaacttgaatttttgccctgatctctctgactccattgacaataatattttccaccatgccatggtaccttgacagatcatctttctcttcaaattttttttgtgagaatggctaattgacatgttttctttctgctgccttccatgatatataaatacaattaagcaataaaaccaaggaaacacaatatcaaattgattatatatgacccacatgttgaggaataaaacatttagccttataccttttcatactccatgtgcagctaagaacaagtcctagttttctaaagcacctcttgatgagctaaaaaaaaaaaggaccttaatgagtctatcttctataccacatctctgatgtttataaatatttcatataaagtcaattcatgaagttaaacttctgaaacaaaattatgggatccgacagaccccatctgtttaaggcaaaagttgaaaatgtctaattcaaaggcatcataaattatttatatgtaaatttaaaaatttaaagtttcattttggctttttttattttcagagaaggaaagggtcatgttagatctgataacaagtaagtatagttatatatcaacatattccagatattcgggtgtgaaatacccccataaagcatccttgtggagcagcgtaacttatttctgaatttgagtgctctgaggcattgggctagtgtgaggttgaggatgtcaagtctaaaaaagatgtgggtttggttctggaccatggttgtggccagaggaatgtagtctggctgcagggtcagagtgttagacactagaaggacagactttgtggtggtagatgatgagtcccttagagaaggaccccaggcagtagttatgggattatgggaaatgacacccaccactcagggacaaagttggcaagaggtgtcaatggctaggacaatgccagccaagtgtggatcacagaagagctccaggcagtcccagtggagaattcaaaggataaggatgattgccacaatggtaattatgggaattgtaatggccaacaattgagtagcacttttggtaagacttggtggtaccacttgatactgtatggccactttgtctcagaaatttggtagcattgtgtctatagtaactccagctacaaaggtctgagaaagagggaagctgacaacctctagacttttggtcattgatcctacagttcaatgattttatatattttatttttgttcttctcgacatgctgatttaattttatatagtttatttttatgtatgtgtgattaagtctcttaaaagtcaaccaaatacagactctggagccacattgcctgggttcagctgcgggcccttggacaagttacttgacctctctgtggtttagctttgtcatctgtagactgggaacaatatccctacattattagttagttatgaggatttaatgagttaatacttgctttacatagagtaagagttttctattaaattgctaaaaactaaaaataaaattttatgtaggttagtaggtccagttgtatccgtttcacatgggggcattgtttaaaatgcagattctggagtgtcaccccagacttactcaaattcttaaaggtagccctgggaatctatatttctaacaagtctctcaggaaattccatttttcaaagtaagatctgggaattaattgagccatgcttcttgttcacaatatatttaaagttattagcaaattattttctgactcatttcttaagaaaaatccttagtagattgtacaaagcttgcttacttagtttaaatgttatttggaacaagaaaggatataactaaatcaagctttctctaaactattcttcatgcaagatttgctcttacatcttcctctaccaactccagatgcaaatatatcacctatgaattttagaaactagccatttgttgggcatgtcttttactaagactaacctggaatttggtttgaattatcaagtatttgtaacacaatataaaggaaatgcagttctgtgtgtcagaaatccccagttcccaaaggaaaagttcactgtgataggcaattgctaaccgttcacgagcacatttttaaaaagtatagcaatgatagaaaaccaaacaatagagcctccataaagatttatccaaatgtagttgccaagacaaataatgttgcattttaacagtaacatggtttgttcctcattaaacaaaaacaaaacaaaacaaaacaaaaacgcgatcttgttttctataaatgagttcaatagagtggtaatgtgcaaatgatttatttgaaaagaaaaaagaaaataatttccttctcctatcactgtaaatgtttatgggctgcccatttttaggcacagaagatgtctctttagtagatcatttgccagtagtaaaggatttacaccgagacattctatttggcggggtgtgagggatgtctggttgtccttgttcgcagtatcatttgttttcaaggtgactgactcgatgtagggacctaatccatgaccttgaagcaaagcagagttaattgatgtaccaaaggattcattagcatttgtctctcaaccatgaaaccagatgggcagggtagcctaattgagaaattaactgtatattttcttgcctatgggcttttaatgcacaaaaacaaaggaaacattttttcttcctcttctgtttttccagcttttattttagtttcatggggtacatgtacagttttgttacctgggtatactgcataatgctgagggttggagtacaaatgatcccgtcacccaggtagtgagcacagtacccaatagttagtttttcaacccttgatccctcccttcctccccacctagtagtccccagtttctattgttaccatctttatgttcatgagtacccaatgtttagctcccactgataagtgagaacatgcagtatatggttttctgttcctgcattaattcgcttaagataatggcctcagcttcatccacgttgctgcaaaggagataattttgttctttttatggctgtatagtattctgtgacatatatgtgttggggaaccagccccacaccacccagggggtaccccgagtcctgcggagacaaaggagttagaaagagacagaataagcgtttaaaaggcaggtccaggggaccggaccctcggaggcttgctcatggcccagagctctcgggctccgcccaatttattggtttacaagctctttgttcttagggcagatgggagggggaggaagggatgaggaaaaggattaatcagtgaaggagaactcgtgagtcattcaataagatgtatagcagtggcggtttctttgaatttccttgagcaaaggcgtgtgtctaaactacttaagatctttaacttatggggactgaaatgggtgggagcgggtttcaggaggagccaagatgtttgattgtactccactgcttcaagggagtgttatctccccgagcaacctgtggaatgccactgagcggttatgctcttggggcataaagacatgaaggcagtaaggagacttttctcctcagaggccacccatggcttcccatgggtgtctcacacaggagagaccaactcaactggcaccccagaaactctttcccacaatatgtaccacattctctttatccagtccaccattaatggacacctagattgattccatatctttgatgttgtgaatagtactgtgataaacatgcgagtgcaagtgtctttttggtagaacaatttgtcttcttttggatatatgtccaataatgggattcctgggttgaaaggcagttctgtcataagttatttgagaaatctccaaactgctttccacagtggctgaactaacttacattcccatcaacagtctataagtgttcccttttctctgcagccttgccagcattggttgtttttttgactttttagtaatagccattgtgacttgtgtgagatggtatctcattgtggttttgacttgcatttctctaatgatcagtgatatgcagcctttctttatatgtatgttggcagctggtatgtcttataagtgtttgttcatgtgttgcacccatttttgatgggttatttgttttttgcatgttcaattgcttaagttccttatagattctggatattagacttttgtcagatgcatactttgcaaatattttctcccattctgtaggttgtctgtttactctgttggtagtttatcttcatgtgctgaagctctttagtttaattaggtcccacttgtcaattcttgtttttgttgtaattgtttttgaggacctagtcataaattctttcccaacgcccatgtccagaatggtgtttcctaggttttcttctaggattcttatagtttgaggtcttatatttaaatctttaacccgtcttgagttagtttttgtatatagtgaaaagtacagatccagtttcattcatctgcacgtggctagccagctatcccagcactatttattaagtagggagtccttttcccattccttatttttcttgactttgtcaaagattggatggctctaggtgtgttataactggattcactattctgttccattggtctgtgtccatttttgtagagtactatgctgtttgggttactgtagccttatagtacagtttgaagtcgcgtaatctgatgctggtcattttgcttaggattgctttggctgttcaggctttttgtggttccatatgaattttagaatagtttttttctagttctgtgaaaaatgacattgctagcttcataggaatagtgttgaatctacagtatgctttgggcagtatggccatttaagtgatattgattcttccaatccatgagtgtgaaatgtttttccatttgtttctgtcatctgtgatttcttttagcagtgttttgtagttctccttgtagagatctttcacttccttggttagatgtattcctaggtattttatttttgtgtggctattgtaagtaagattgcattcttgatctggcttttagcttgaacattattggtatatagaaatgttactgatttttgtacattaattttatatcttgaagctttactgaagttgtttatcagttccaggagccttttgacagagtcattcgagttttctaggtatcgaatcatatcatctgtgaagagagatagcttgcttcttttcctgtttagatgccttttatttctttctcttgcctaattgctctgcatagcattttcagtattatgttgaatagatgtggtgggaatgggcattctcatcttgctccagttctcaaggggaatatttccatttctgcccattcagtatgatgttagctgtgcacttgtcatagatagctcttattattttgagttatgttgcttctatgcctagtttcttgaagatttttatcatgaaggtgtgttggattttataaaaagcttttaccacatttattgagatgatcatatgggttttgtttttaaatctgttatgtggtgactcacatttgttaatttgcatatgttgaaccaaccttgcatcccagggattttgcctacttgatcatggtgaattaattttttcatgcactgttggattcagtttgctagtattttgttgaggatttttgcacctatgttcatcagggatattggccgtttgttttctttttttgttgtgtccttgccaggtttcggtatcagtgtgatgctggctttgtagaatgagttagtgatcggtaactatttttggaatagtttcagtagaattagtaccagctcttctttgtacatctgatagaattcagctttgaatccatctggtctggggctttttttggttaatatgcttttttatgattgattcaattttggaacttgatatagatatatttagggtttcactttcttcctgattcaaatttgggaggttgtgtttttccaggaatttatcagtttcctctagcttttctagtttgtgtgcatagaagtcttcataatagtctctgaggatcttttgtatttctgtggggtcagttataatgttacctttgtcatttctgatgtgcttatttggattttcttttcttctttgttaatcatctagctagtagtctatcaatcttgtttatcctttcaaaaaacaaacttttggtttcgttgattctttctatagattttttttctcaattttgttcagtttcttcctcttctttttaatatagtgagccaggtgtggcagatgatattttctaaaaatggctgcagcaatctatccagtcctacatgttcctccagaaccatgccaccctcccatcaagaggtggaatctatttgttctcccttgaacctgagtggaactttgagactggtcaacaaatagattagagtggaagtgatgctgcatgacttccaaagctaggtcctataaagcaatatggctctacctggctctccctctttggcatgctcacccttgagacccaggctccatgctataagtaagcctcaactgcatgaggagaccatgtgtgctctgactaacagcactagctgagacccccagctggcaaccagcgttagccaccagaaatgttagtgaactagcctctagatgattttatatcctagtcctcggcctttgagcagccccaaattgcaaattcttgagcaaaaaaaaaaaaatgtcattgcttaaggtggaaagtttgggcgtgatttgttaatcaggatgagataactgtaacaccagggcttcctcttctggaggtgtggatagttttttgcttcaaggacagatatgaggcccttgtttccagacagggtgaataatatcaaggctcagagggttcaagcagtgaggtggcagtctagtccaccaggaataggatttctaatcccagtagataagggtagggagttgtgagagcagtggaaatgttgccctgctctcaatctggctttggggaagaggcgggacctctgataaggctggcaaccaaatactaagctcagtgagcttggaaactgcagttaaggctgtcatgatctgctgggggaggaggaggtgtacatgcacatgtgtatatgcatgtacatgtgtgtgtagtggagggattgaatcagaaaagccagctgccttcaggaggaccacaagagccagagcaaagaaaaatggcatagttacaaccacacactgaaagacactcttggagtttttgtcatcccctgggactcttgttagaccctaggaaggagaccagatccccaaactttgttctgatgttatatgtatatattgaaaaattgttagtcatttgttctaatatcatttatcagctgattagttacctggttaattcttttcttactaatttgaaatattgtgtgatcatataagaatgtctttggtctgctgtgtttttgttccattaatctgtctgtaatcaccaatatgattccattttagtgactatatatttaaaatacattttgatatcttgtagggggaaatcccattatatattctcccagaaatttcttggctttctcacaagtgtattccttcaggcaggctttcaaatcatctggtgatgttcctttcaaaaaactcattggggctttggtgagtattgtcttgcatatgaatagttaaaaatggtagattgaacatacacttagctcttctccctcccagaatcccactaaatgagaataaaggaatgtttacagaagatataaatacatgagaacaaagtatgagataggagacatcagtgacacgattttggaagttggtggacagatggtaggggttaaatgatttaacagacatgagaaagctgaatcctaatctggaagttggaaaaggggagaaataacctaatgtacattgcagactcctacaaagaagcaggatttggcaggtggaataatcagttgaaagactgtttaaaaatttagtccctcatatctccaatccaaatttatacatctgaacaaatatccatcccccattctggcaggagacttgaagtttattctctaaggatgataaacagatgatctttgaattaggcaataccaggtacaactaaaacagagataccaaacagaaaacatggggactaagataaaccttatgtataggacctaagatctctagccatcttccctcatatagctcagtaatgttggcagccagatatatatgttcttcttaaattctagaaattttatattgaaatcttttactactgatttccttctattttctctatcctctattcatagaatttcaactattctaaaacattctcccccttctatggagggggtcaaaggcatcttctttgagaacctatcttccaagagaaataagcacaagacactcaaatcaaaagttttccaaatattatcctagagagaagagcaccattgagaagcactccccctgccatgagctcccagccttctttttagcgcctgcctcactcttaaatatgagcagacagccaaggactgccagacgtttatgaaaaaaaccccacctcactttaaatgccaatacaaatagaaagaaaaacttaataataactagtattaatatccctagagaatatgaatcaatgaagaagtagatactataaaacaaatatccagtgaacatgaaaccttagaaatagacaatatgatcgcataaactattggaagataccctgggcacagtggcccacacctgtaatcccagcactttgggaggctgaggcaggtagatcactgaggtcaggagttcgagaccagcctggccaacatggtgaaatcccatctctactaaaaatataaaaattagctgggcgtgtggcaggtgcctgtaatcccaactacttgggaggcggaggcacgatagtcactttaacccaggaggcagaggtcgcagtgagccgagatggtgccactgcactccagcctggacaacagagcaagactccatctcaaacaacataaaaaatcaaaaaatatatattggaagataaaatcaagagaatctcccagaaagactagaagaaagagaagaaaatagataatattttttaaaatagagacttatctagaatgttctagaataattgaagttctggccgggcacggtggctcacgcctgtaatcccagcactttgggaggctgaggcgggtggatcacgaggtcaggagatggagaccatcctggctaacatggtgaaaccccgtctctaacaaaaatacaaaaaaattagccgggcatggtggtgggcacctgtagtcccagctactcaggaggctgaggcaggagaatggcatgaacccagaaggcagaagttgcaatgagccacgatagcgccactgcactccagcctgggcgacacagcgagactccgtcaaaaaaaaaagaataattgaagttctatgaatagaggatagtgaaaatagataaaaggaaatcactaataaaataattcaaaataaaatttccagaatctatgaggaacatgaatgtcctgatagaaagggatgtcactgagcacccagaacaatggataaagtagaccaaatccaaggcacattatcgaggaatttcacaaagctggggacagataatggacaatataaagtctcagggagaaaaaaaaacaggtttcatacaaagtatcaagtataagaagacatcaaacttatcaataacaatagtggaagctagaaggcaatgaagcaacaacacactaaaaattctgaggaaaaataacttcaagaactccattttcagtgtctaaaaaacaaaactcatgtagccccttttcaggaagctgtttgaagatgtgcttctagaaatttatggaataaaccaagagaaaaaaaaaagacacaaagtccaggaaacagagaattcaattcaagagaaaggctgagggaatctctgtgatgataatgaatggagagttctgggtggcttccagttattaggtataatggtaagcagaattctacgatgacccgcaagattttcaccccttgatatatgtgccctgtagaatcccctcacatgagtgtgtgcaggatctgtgaatacgatgggatattactcctgtgattatgttatatggtgaaaatgaagaggttttcagatgttattaaagtccctaatcagttgactttaagctaatcaatagggagattgtccgggatgaagtcttacctaactagatgagccttttaaaaatagtctagaaatcatagagggaaggagtcaaagagatttgaaacatcagagattctcccctgctcaccttaaagaagcagacagccatttatgtggcgaggaccacatgtcagggaatggtgggtggtctatagaagccaacggcctcagtcccatatctacaaggaactgaatcctgccaagagtgacatgagcttggaagaggatcctgagcctcagatgagaattcagccctaacaaataccttgatttcaatccagtgagatcccaaacagggaaatcagctatgctgtgcctggactcctaacccatggaaagtctgaaataataaatgtgtgctattttaacccaccaagtttgtggcagtaaataattaatgcaggtgtagatggcaaacaatccagactgaagcagctcagactctggaaggatttatccagagatataaaattgtcctaatgtcctgagagatacatacaacttgaggataattgggaaatgtattagtagtaagtacacacaaagctaagcaatcaaacaccacatcattgctaactttaagaaaaacagaatgctgcaaaaaaaaatagtcatagtatataaggcaacttagttataaataggatttacagagtcagtatgatgtaaaaaccaaatgatggtctaagcaaaatcacatgataaatacagtgggaggatgaagatgagaaatatatgtaggagtacgagtggggtgagattttgcaaaagcaaaatcttcatctttcataccaggagtgatagacaatgactagaacaaaaaattcagaaattgcagtgtatgtctatcatggtgcctctgggaagggaaacatttgagtggatgaagcaggtaacttttgttttttattgaaaccttgtgaaagtacttgactctttaaaatatgtgaatgcataacttggacaaaaatgaaaataaatttaaagtaaagaattgaaagttcagtagattaaagacacataatattagttcttgagatgatgttttcatttaattgtattttcaaatacctcccacttattggctgtttataagtgaacaagattataaactgtaaaattcaattcacttattccatgtgtgaataaatgccacaaaagaaaataagaatttccttttcccaatcacaaacatttcccttacaaaatcaccttcaggaagtaacctgaccaaataaacgagagcttccatttctcaatttttagcacatcatagggtgaagggattatttctgttttcccttttgttccttagagtaacattaaaatatttgtaatatattgacacccctgatgaaagatcaaacatttcagtgtttgtttcttcaacaatcaacttctcatttggaatagctggaatctaaattcatttttctcacacttttcactctccagatgctggaattgcgctagatcatgaagaagatatgttgtggttgttttcatattttctattgagtggtattcaccagcaatgtgacagaattcagtgtacatcagcaaggtgtaccttttaccatttctcgcacttactatgtgagttcctaaaccctgttaagcagctatctccatttcagtaaaatggatagtaataacatctccaatatgggatttttgagtagcttacatgagataaataagcaaagggcttagcacaatgtaagaagtcaataagcattagctgctgatatcattgctattcaggaaaaagaactgtgattaataataagcattaatattaatgtttaataaatttaagaataaaattctaactttaaccaagtagaagttttgttgctgggcaagatggctgaataggaacagctccggtctgcagctcccagcgagatcaacacagaaggcgggtgatttctgcatttcccacagaggtacccagctcatctcattgggaatggttagacagtgggtgcagcccatggaaggtgagcagaagcagagtggggcattgcctcagctgggaagtgcaagaggttggggaattccctcccctagccaagggaagctgtgagggactgtgctgtgagggactgtgcattccggcccagatactacacttttcctacaatctttgcaacccacagaccaggagattccctcaggtgcctataccaccagggccctgggttttaagcacaaaactgggcagccatttgggcagacaccaagctagctgcaagagttatttttcataccccagtggcacctggaacgccagggagatagaaccattcactcccctggaaagggggctgaagccagggatccaagtggtctagctcagtggatcccattcttatggagcccacagcaagctaagatccactggcttgaaattctcactgccagcacagcagtctgaagttgacctgggacactcaaacttggtggggggaggggcgtccaccattactgaggcttgagtaggcggttttccccacacagtgtaaacaaagccaccaggaagttcaaatcgggcagaccccactgcagatcagcaaagccactgtagccagactgcctctctaggctcctcctctctggtcagggcatctctgaaaaaaaggcagcagccccagtcaggggcttatagataaaactctcatctccctgggacagagcacctgggggagggggcggctgtgggtgcagcttcagcagacttaaacgttcctgcctgccagctctgaagacagcagtggatctcccagcacagcgctcaagctctgctaagagacaggctgcctcctcaagtgggtgtctgacccccttgcctcctgactgggagacatctcccagcaggggtcaacctcataaaggagagctccagctggcatctggtgggtgcccttctgggacgaagcttccagaggaaggaacagacagcaatctttgctgttctgcagcctctgctggtgatacccaggcaaacagggtgtggagtggacctccagcaaactccagcagacctgcagcagaggggcctgactattagaaggaaaactaacaaacagaaaggaatagcatcaacatcaacaaaaaggatgtccacacagaaaccccatccgaaggtcaccaacatcaaagaccaaaggtagataaatccatgaagatgaggaaaagccagcgccaaaaggctgaaaattccaaaaaccagaatgcctcttctcctccaaaggatcacaactcctcaccagcaagggaacaaaactggatggagaatgagtttgataaattgacagaagtatgcttcagaaggtgcataataacaaactcctcccagctaaaggagcatgttctaacccaatgcaaggaagctaagaaccttgagaaaaggttagaggaattgctaactagagtaaccagtttagagaagaacataaatgacctgatggagctgaaaaacatagcacgagaactttgtgaagcatacacaaatatcaatagtcgaaccaatcaagtggaagaaaggatatcagagattgaagatcaacttaatgaaataaaggatgaagacaagattaaaaagaatgaaaaggaaaaacaaagcctccaagaaatatgggactatgtgaaaagaccaaatctacatctgattggtgtacctgaaattgatggggagaatggaaccaagttgggaaacactcttcaggatattctccaggagaacttcctcaacctagcaagacaggccaacattcaaattcaggaaatacagagaataccacaaagatactccttgaggagagcaaccccaaggtacataattgtcagatttgccaaggttgaaatgaaggaaaaaaatgttaagggcagccagagagaaaggtcaggttacccacaaagggaagcccatcagactaacagtggatctcttggcataaaccctacaagccagaagagagtgggggccaatattcaacattcttaaagaaaagaattttcaacccagaatttcatatccagccaaactaagcttcataagcaaaggagaaataaaatcctttccagacaagcaaatgctgagagattttgtcaccaccaggcctgccttagaagagttcctgaaggaagcactaaatatagaaaggaaaaatcagtactagccactgcaaaaacataccaaattgtaaagactgttgacactatgaagaaactgcatcaactaatgggcaaaataaccagctagcatcataatgacaggatcaaattcacacataaaaatattaaccttaaatgtaaatgggctaaatgccccaattaaaagacacagactgcaaattgggtaaagagtcaagacccatcagtgtgctgtattcaggagacccatctcacatgcagagacatacataggctcaaaataaaggaatggaaataaaggctcaaaataaggcaaatggaaagccaaaaacagcaggggttgcaatcctagtctctgataaaacagtctttaaaccaacgaagatcaaaaaagtcaaagaaaggtgttacataatggtaaagggatcaatgcaacaagaagagctaactatcctaaatatatatgcacccaatggaggagcacccagattcataaagcaagtccttagagacctacaaagagacttagactcccacactgtcaatattagacacatcaacaatgaaggaaaacatgttaagggcagccagagagaaaggttgggttacccacaaagggaagcctatcagactaacagctgatctcttggcagaaactctacaagccagaagagagtgggggccaatattcaacattcttaaaagaatttgcaacccagaatttcataagtgaagaagaaagaaaatcctttacagacaagcaaatgctgagagattttgtcaccaccaggcctgccccaaaagagctcctgaaagaagcactaaacatggaaaggaacaactggtaccagccactgcaaaacatgccaaattgtaaagaccatcgaggctaggaagaaactgcatcaactaatgaacaaaataaccagcaaacatcataatgacaggatcaaattcacacataacaatattaaccttaaatgtaaatgggctaaatgctccaattaaaagacacagactggcaaattggataaagagtcaagacccatcagtgtgctgtattccggagacccatctcacatgcagagacacacataggctcaaaataaagggatggagcaagatctaccaagcaaatggaaaacaaaaaaaggcaggggttgcaatcctagtctctgataaaacagactttaaaccaccaaagatcaaaagagacaaagaaggccattacataatggtaaagggatcaattcaacaagaagagctaactatcctaaatatatatgcatccaatacagaagcacccagattcataaagcaagtccttagagatctacaaagagacttagactcccacacaataataatgggagactttaacaccccactgttaacattagacagatcaacaagacagaaagttaacaaggatatccaggaattgaactcagctctgcaccaagtggacctaatagacatctacagaactctccaccccaaatcaacagaatatactttcttctcatcagtaccacaccacacttattccaaaattgaccacatagttggaagtaaagcactcctcagcaaatgtaaaagaacagaaattataacaaactgtctctcagaccacagtgcaatcaaactagaactcaggattaagaaactcactcaaaactgatcaactacatggaaactgaacaacctgctcctgaatgactactgggtatgtaacgaaatgaaggcagaaataaagatgttctttgaaaccaatgagaacaaagacacaacataccagaatctctgggacacattcagagcagtgtgtagagggaaatttatagcactaaatgcccacaagagaaagcaagaaagatctaaaattgacaccctaacatcacaattaaatgaactagaggagcaagagcaaacaaattgaaaagctagcagaaggcaagaaataactaagatcagagcagaactgaaggagatagagacacaaaaactcttcaaaaaatcagtgaatccaggagctggttttttgaaaagatcaacaaaattgatagactgctagcaagactaataaagaagacaagtgagaagaatcaaatagatgcaataaaaaatgataaaggggatatcaccaccgatcccacagaaatacaaactaccatcagagaatactataaacacctctatgcaaataagctagaaaatctagaagaaatggataaattcctggacacatacatcctcccaagactaaaccaggaagaagttgaatccctgaatagaccaataacagtttctgaaatggaggcaataattaatagcctaccaaccaaaaaaagtccaggaccagacacattcacagccaaattctaccagaggtacaaggaggagctggtaccattccttctgaaactattctaatcaatagaaaaagagggaatcctccataactcattttatgaggccagcatcatcctgataccaaagcctggcagagacacaacaaaaaaagagaattttagaccaatatccctgataaacatcgatgcaaaaatcctcaataaaatactggcaaaccgaatccagcagcacatcaaaaagcttatccaccatgatcaagtgggcttcatccctgagatgcaaggctggttcaacatgcgcaaatcaataaacgtaatccagcatataaacagaaccaaagaaaaaaccacatgattatctcaatagatgcagaaaaggcctttgacaaaattcaacaacacttcatgctaaaaactctcaataaattaggtattgatgggacgtatctcaaaataataagagctatctatgacaaacccacagccaatatcatactgaatgggcaaaaactggaagcattccctttgaaaactggcacaagacagggattccctctctcaccactcctattcaacatagtgttggaagttctggccaaggcaatcaggcaggagaaagaaataaagggtattcagttaggaaaagaggaagtcaaattgtccctgtttgcagatgacatgattctatatttagaaaaccccatcgtctcagcccaaagtctccttaatgacttcagcaaagtctcaggatacaaaatcaatgtgcgaaaatcacaagcattttttacaccaataacagacaaacagatccaaatcatgagtgaactcctattcacaattgcttcaaagagaataaaatacctaggaatccaacttgcaagggatgtgaaggacctcttcaaggagaactacaaaccactgctcaatgaaataaaagaggacacaaacaaatggaagaacattccatgctcatggataggaagaatcaacattgtgaaaatgaccatactgcccaaggtaatttatagattcagtgccatccttggatgcaagctaccaatgactttcttcacagaattggaaaaaattactttaaagttcatatggaaccaaaaaagagctcacattcccaagacaatcctaagccaaaagaacaaagctggaggcatcacgctacctgacttcaagctatactacaaggctacagtaaccaaaacagcatggtactggtaccaaaacagagctatagaccaatagaacagaacagagccctcagaaataataccacacatctacaaccatctgatctttgacaaacctgacaaaaacatgaaatggggaaaggattccctatttaataaatggtgctgggaaaactggctagccatatgtagaaagctgaagctgcatcccttccttacaccttatactaaaattaattcaagatggattaaagatttaaatgttagacctaaaaccataaaaaccctagaagaaaacctaggcaataccattcaggacataggcatgggcaaggacttcatgtctaaaacaccaaaagcaatggcaacaaaagccaaaattgacaaatggcatctaattaaactaaagaacttctgcacagcaaaagaaactaccatcagagtgaacaggcaacctacagaatgggagaaaatttttgcgatctactcatctgacaaagggctaatatccagaatctacaaagaactcaaacaaatttacaagaaaaaaacaaacagccccatcagaaagtgggcgatggatatgaacagacatttctcaaaggaagacatttatgcagccaacagacacatgaaaaaatactcatcatcaccggccatcagagtaatgcaagtcaaaaccacaatgagacaccatctcacaccagttagaatggtgatcattaaaaagtcaggaaacaacaggtgctggagaggatgtggagaaataggaacacttttacactgttggtgggactgtaaactagttcaaccattgtggaagacagtgtggcgattcctcaaggatctagaactagaaataccatttgatccatccatcccattactgggtatatacccaaaggattataaatcatgctgttataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaaccatcattctgagcaaactatcacaaggacaaaaaaccaaacactgcatgttctcactcataggtgggaattaaacaatgagaacacttggacacaggaaggggaacaacacatacaggggcctgttgtggggtggggagagtggggagggaaagcattaggagatatacctaatgtaaatgatgagttaatggttgcagcacaccaacatggcacatgtatacatatgtaacaaacctgtatgttgtgcacgtgtaccctagaacttaaagtataattaaaaagaaaatacaaactttaagttaaaaatgtaataaaaataataataattgtaataagttttacaattctgtatatggaattttctcaccctgcttaagaaataaatgcctaattaattaatttctaccctttttatgaaactagattaaacgtagtaatctgcataatcttttttatacatttgaatctgcaattcagaaaatgttttaatgatggagtagttgcatccatacacctacataaaattaaaaatacattatttttcacactcagaatttcacaaataattttgttggaaatctacaagttctttggaaagttggtaggaaaattgtgtttaaatagccactgacttttaattctcagaagatacaaatgaattcatctgaccttatctaggaaaccacattactacatgtgattattatttgcacatatagagcgagaaagcgtactaaagagttatccttgtgtaaacttaattcttcaaccattaagactttggctgggaaagaaaatgagaatgaatgagggttcctcagttcagattcttcttcactcgcctttaaccatttattttttgctcaaaaaaatttttttaaagcacaaatgcctatgctttcacatttccaaatgacaaacttaaaacttcactttagcagtatgttcatcatagctcaggaaaaaatctcaatacaatgtaaagaatgaaagcctataaagacatattaatcttttgctttgattggttttgttccattgcagttctataaagatacatgaattaagaacattgagcttaggaactgctaaattgaggatttctctagaatgctttcttctcttgtaaactcgtggaaattaaatgaaaaaactatgttaccacaatatttctgtgcaaagaccaaactttagaaaagttgtcaggaaattccaaaacttctacaccctaattacgtgggtgttgtggcctgaatgtaatttttctattcctcttttccttgttaaatttataccttcaatacagttctgttcatgtggtaaaaactgtgtcataatttgcccagggtatgcagtgtggccaagttctcactgttcttaagatccttaactgggcatttcctgacttttgatttttcaccctttaaacaattttgcattaatgcacaccatacaggatattagcttgagagaaaagaaagaaatttaggataaggatatttgtaaacatgtggcacccacagagaacagttcaataagaccagatttgctgtttgaataaatatgctttttagggcactcagcttattcttctaagcatgagaggaagagaaagacaaatctttattttgcattttttataaaagctatcctagtttcacctcatttatcattcagctacaaaatgaaaacttggcctttgttcactcacaactctaatttttcagaaaatcatgcacagatttgaacaactctcacttctgagtggttaacatgaaaccttaagtttttagaatgtggataagttttaacaaggaaggaaaacaatttcaatcaggtaagaaaacagtttaatttggagattcaagcccttaaataatggggatctagagtaggattagaaatcaagagagatcgagatccccacagaccatagttaaaatgaaactagttccagtgtggtgcaaattgaaattgatattaatagttaatattgtagtggatttcaggagtaaattttctgtacaagtgtagaaaactatgattgatatgtaatataatgaagtttgccctgtttcttaactaagttgtggtctaccaccatccccccactcttcctgtcctctccccatctctccctccctctccccatctctctctctctttccacacacactcttttctctctctctctccccactctctctcctgttttccaagtggaacagagttggctagagatgatggtcttagctgtatatcccggtcttagctgtatgtcccttccaccctctttctcttgttgcctaattcctcctacctcagaaccctgactctgtggattcacattcttttggcacttggtgccaacttgccttctgccacttggccatccagctattgtgtgctctctgatggggcagctggcagaagaggggccatcactcccttgattcacagatgtgatcatttaatcaattgttcaacaatcatttattgcatatcaccatgtgcctggcacttggattggagtccctgggaggaataatgtttttccaacttaccttgactcttcctctgcaactcctcaaggtcccactccacagccttgcatggtgagtaggctctcactttctttggtgatcctggactcccaattttgttctcctagacttaggaaactgtcagacattttgctcaacttctcagcttcttcgttccctcatttgggcttgacaaatgtcttaaaggagaaggaatacccaaatggcaggcttacctctctgcagttctgtctgctcccagttccttgaagttaaagttgtttaatcccttgttagcagttcaatgccttaaagcagctgttttaaacaacttttccagcttttctcaacaagttgttttaaacagcttgtccagtttgtccctcattggaggggtgtttccaatgatctagtcttccctcaccttttaagattcttttccacatcttagcttcctgagatcgtatctctcatacccctttcttttaagcagaattcatcatgtcattctctgtgtcagcaaactcctgagtgcatgcctgtattaaagagtgtattcctgttataaaacttacttaaacatttgtctctcgtcttagacagttcatgtgtaaaggacactaattatatctaacatatatttgtgcccctagtgcctaatgttggtgcatataatagatcttcaataatgcttattgatggaataggtggcatttcatataaatgttattgttcattagattcagtgtctcaaatgaaaagtgtgagctttcttcccaccacaagaagaaaaggagaacgaaacttgtatatctcatatagaatgcttcagatagggaaattagaaaaccaagtatcatctttggttttgtcaaagggagagtggggaaataagaaaagataagtacagtaatcatcaaggttagaaaggaaaaaagaaagagaagaaatctttaaatccttatacacaaattttttgggatgattttccaagatgttagcctatttacattgttcagcctctgcatgtgtgtcattatctcccaaaggagaatcacatgatacccaaatatctgcctttaatcctcatgcctggtgggatgggtgttcaaaaggaaaggaattctgacaattgttttcagagatatccacctcaatatttagggtttctgggtggatatttgataaattgtgtagaaatatttaaaagtacagaataataataataaaaagtgcactttcggcacaatatgtggatgggaagtaaaggaaatggcactttttcctcacagtgaaaatttatttataaaatacaaaaaattgtcctatttacagtacattaattactgcaaatggcataagcagaaggaatttatgtgaaattgcagttttgccttttcattcttgtcctattctcagcctttttttttctccatatcttcccctataaaataaaagaaaatagtcacatggacaatttccttctgttgtttaaggatgtctcaattctcagagtagcaacagtatgctatgataatatttctaatttcaaattttgcagttaaaaaaatacaaaacctgtcactcatgatcaataatgcacagaaatcatggagtgacagtctctaaaattgccattaaaataatgtgagcaacacgcttcaccatgatctatttattcagcacaattttactgttaaaaaaacaaagtcaagggaacctgtaactattaagcaccttaccacaccgatcttgtattctccccaataagcataagaggtaggtgatcttaccctcagagagccaaggaagcaagggttctgagagatgtagtgccttgtccaaagcaaggaagtggaaaaagagaatccaaacacaaactccagttctcttgcttgcagaatctctgctgtttccacttgaccacaccattttcagtcttcaggcagggtatggatggatcatggctctgacacctaaaaaaatgaactcctccaatgtaatgcaaaataaaataatgccaaaccctaaaagaagtacaaaaacatgccacattgtcttacttttttccccatggtaaatattttatttatttatagaagtatcaataaccaatttttttcaaagagccctctctctccctcctctaccctctctcccacccgcttggtagtgttctaagcacatagcttgtttttcatttgtgtaatctggtactagtcagggtaggaaaactttttctctatcgagcagagtttcttaagtaaggtttatgggcaactaaggagtcaatagagggatgaaagatatcgatgagagctctgatgtaatgtgcaaaatgttgtgtatataggcagttttctggggtgtagggtagagcttttgttgctgtcctcaatagatgaaaaaccattgtttacacattctcttctaaattaataacaaggattataaaatgttattcaataactaccaaaaatcaagataattcttgctaacttatccttacatagcttttcatctctccttggcattgttctaagcattttatgtatattatttaatcctcacaagaacccaacgtagttagtattatcatggtttccactttatttaaggtgcaagatatttcataaataaaaacatctcagttctatattatgataatagctaatggagaaaggtagaagaacagaagagagggaaagagaaaaaggaagaaaaatagagcaaggaaggatgcagatgaaagggtgaggaagagaaatctagtgctgaagtattgtaggaaaacagaagtgacaactatgtataggctggggcaaccatagctgtaaaaacacaattctgctatttgccaaagctacaagcattaacagattaattattttagaagaaaaaagaatacataaatgattagattaaaaacatgtataaacactgtcagaatttattaggagaactgtctgaatttcagcctaatgtttagaagcacagacatttctgaaaagttctcttttcttcatttgatggaaaatccttattcacacagtgtggaaacaggctgagaaaatagtcatttcattgaataaacatccatcttccacatggtcttttggacattaattaatggttcctcatagctcaccctgtatattggtgaaattaagccaagaactgtatcaagactatggatgaatgcctgtctatccttcctcactcgccaagtctaccatgaaattaaactgagctgttataattggaaagcggattatctatattgtaactgaaatgctctcagtacgtttaaactagccctgtatagtgcctgtgatgataaatattgtaggaatttgaactagattctttcttctctttaatgaaaagctcatgaatacagtaagtgcctttaggatagggaagttagtatggttttcctttcatattaaagaagttttgttacttgagagagaatgaatgatcttggctcagtgttgagtttctcattttcttttgttttcatctttaaaaatgtggggagaagagtgggtttgaatataaaaattgactttgttttttcctttattctcaatgatcaaggtggatctgagatgcacatttttcaagcaagtgttttctaatatatttggtatttgttgtgttatgtctcccctacaccacccctcatccctcacatacattgtctactctacaagactgtagagccatggaattagggccacaacttagggaacaggggcagggagggaccattcaggctctatgtgaattgtttttctcacagaactaatggattcacaatttagactaaatggctatcaaagatggacgttaaataccttgaattggctctgaatgaccaaattttctttcaaaaagctaagcatatatatttcaaaggtagaaagggaacttgcatattcattgttctctttatgttcacttataaaaatacgtactccctacttgcccatttcttttcattggacatagactgttgtcacaatcagctcatgaagctgtcagcagatccatggagactgctttaaagtaaaggcaatgtaacatcaatgcaaatcccatgattattaacgaaacaaatagaattcatttaaaatgacttttacagttgaagtctcctctcagaaatcttccccactattctgtttccgtttcaaagtcacatctttgttaatgacatcatggaatcctgaattcaaattgcttgtgttttgttaagctttgggaacactcatgctagagttccagctttgctagggcatattagaaaaccacatactatttaaaagggttttagtattggttaaacactttgtgtattaaaatgctatattattgcagcagagttgaaaatcttcccttgaattgggaatattaagtaaaagaattcagctaaaggtatatcactaaaatatttgcagataaagaacatttgaattatgactccaatttttactcactttttccaaaaagaaaatttattaagtgcttgccatctgccagacattggctatatgttaaataaggagaagagaataatgtaaagaaagatcaggcatacccatgatgctcaaggatttttttggaatttataagtgagggaaatgcaaatgcataattccagtacagcatgctgagggccatggcaggggtatgcctcatgagattgagagccaattgcctgaaggaatctggtgattagttttggaagggaaatataaatctggccatcaaagaggaaggatgttgtgggtagttgccagattctctagctgcctagaccgtttaaacactcttgtaatggttgggaaacttcttgcatccccaatatagaaggcaaaaacctttcttcaccagactcacttggagctaaacacttgcctattacctagattccagcagtcagaggggtaaacaggagacattgatatataggtgagcaatggaagtggtaggtgtgtgggtttgccttttggagacagaagtagagctttagtgtgagcaatgcaggggtggggaaatctgtgatgttgagtcagaaagaggaggctagggtatttgggtattgttcttggcatctgagtacacaaaagtccctgactcttctgggaactttgtaagcttcttcataccgctcaatatgttttgtgaactaccagtatcctataataaatgtccttttgctagaatgagtatagtttggacttgaggacctcgactgatagaaatatgtaggtatttatggtttggccaaggcagaaagaagagggtgtgcaaagaaaagaagaaattaaggaagtaggctaagttagagtgtgatagggatggttttgacgtgaccattggtagttaggtagggagtaatataaggagatgagattaagaaaagttaatatcagatttggggacaaactaggatatagttctaaattatctagactttactccataagcaatggggaacctttgggaaagttttaattgaaagactgacagacattttgatgtctctattttcaagcaagaaccctggtggtattgggaggaggcatgaatgaagaattgctcatagtgggaagaccagtttgaaagctgataccatagtccatgtgaaaaataatgaggccctaatgagatggtcacagtgaagatgtggtgggggagtgatgggggggttggcaggtgtatctgtgagatctctagagaggacaatcagtaggactttatgacatggaaattaatggggctggcgcagtggctcacacctgtaatcctaacattttgggaggccaaagcaggtggattgcctgagctcaggagttcaagaccaccctcggcaacattgcaaaaccccatctctactaaaaatacaaaaattagctgggtgtggtggcagatgcctgtaatcccagctactcaggaggctgaggcatgagaattacttgaacctgggaggcagaggttgcaaagagtcgagatcatgccactgcactccagcctgggcgatagagcaagactctgtctccaaaaacaaacaaaaaaagtaatgggtcatgaggaagaaaaatagggataactcaagttttccaatttacattattaggtgaatagtaatgaaagttattgagatgggaattatagtggaaaaagcaagtcctgaagtgaatgtgagaggataagttaattttagacatcaaattttaagtacttgaaggaaatagttgggaatacacatctggaattttatagagcagtcaatgttgtagataaaattcaaaatcattagtaattaagtggtagttggagtcatgggcatagatataataaacaagggagagtatgtagggaaaaaaggagcagagatctggataggggctggggaggtgtaattttaaggggatggaaagaaatcagtataaaagacggaaaactgggaaaggatcatcaaagatgtagaaggaaaactagaagcgacactcaagcagacttgagtcttctactgttggaaattaatgtcttcttttacttcatcttaacatgaaggtcctgctattacctttaaaaatatttttctttcactggaatattccacatagcatacatcggaacgttaactgtgttcagtgggtactgccactaattcatcttgaaacccctatgttcaaggttttagaagagtgtataatgtacataaaataaatacaatagagtaagcattaagtacatgggttaggttttctgcagaaagtgaacagtcttcatttcctttatagatttctaagtggtaaaaccaccaaacaattccttgtgataaatcactgcagacagcatgaaaaatttccttaggtaattattacactcaaggatttctggtaaggcaaccaaacgagcataatactgacagtccagacaccttagtttgagctttcaacaggtgatccacagaacaacattcaaatttatatgttcacatgaatggaaacatttggcacatgtacagaaacctttcttttcagaagttaacaattatgatttctaactaggaaattttattcacaatccttcaatgactttcagcattggcaacagcttaaaaaactagagttggcttagtccctacttctagatatttagctcttgagttcttcagttcctcatctgtgatttttgaatattggattccccagattcttctacagacacacaacagttctccaccttgtgaaagatttctccaggagtaagaattattctcagttcctttaatgtgctattaccattttgtcccatcctgcctggaatcatctctatactcttctcctgcccacttctagatccaaaggggaaagagccctgcactctaattgctgatataagaattcaccatcaatatcaaatcccatgccttttcatcttatatttacctggcatttttcatggtgacatatccaatgaattgcaaacagaaataccctggatcacaaatacgtttataatggtaaccaacaacattcatgtaatttttttagcagccttcagtacaaacttaggaatggtgaaagcaaatgactactatgggttggaggttgacagaattgggcataataggcaaattgaaggttttcaggagagccagtgaaataactaaccctagagtccaaactggggaaggaaatttatgaatttatttattcttttagctgattattgtgtgcttgttccactagggccagattactcttatgtccccaggtttttgctgtttaaaggaaatatttaagaagggaaatatttaagaaaggaaatgataatatatttcacagatgaggaaacagaggttcagagaaagtaagtaacatgtgtaagaactagtaagtggtgaactacaaagtcagacctggtctgtctgcctcaaaggtccatgctcctttcactacaccatgctggaatccttgaatccttcacaaacttatcaggggaacccgcccctgataattcaacgtggatccttttctattttccctaagtgtcggccggtctgagaaataaagggaaagagtacaaaagagagaaattttaaagctgggtgtctgagggagatatcacatgccggcaggttccgtgatgccccctgagccataaaaccagcaagtttttgttagcaattttcaaaagggagggagtgcatgaatagggtgtgggtcacagagatcacatgcttcaagggcaacaaaagatcacaaggcagaaggtcagggcgaaactagaatcactaatgaacttccatgtcccgctgtgcacgcattgtcagggttcaagagcagagaactggtctgactagaattcgccaggctggaatttcctaatcctagcaagcctgggggcgctgcacgagactagggcgtgtttcatccctatctacagctgcataaggcagacactcccaggacggccattttagaggccccctctgggaatgcattcttttcccagggctgttaattattaatattccttactggggaaagaattcagtgatatttctcttacctgttttcggtaataagagaaatatggctctgtcctgcccagcccacaggcagccagactttaagattatctcccttgttcctgaaaatcgctgttatcctgttcttaaggtgcccagatttcatattgtttaaacaatttgtgcagttaacacaatcatcacagggtcctgaggcaacatacctcctcagtttatgaagatgacaggattaagagattaaagtaaagacaggcataggaaatcacaagaatattgattggggaagtgataaatgtccatgaaatcttcacaatttatgttcagagattgcagtaaagacaggtgtaagaaattataaaagtattaatttggggaactaataaatgtccatgaaatcttcccaatttatgttcttctgctgtggcttcagctggtccctctgttcggggtccctgacttcccatgacacaaaatcatgttgcccttaacacttccctctgttattcaaggggtcatgcaaccctgagagcaggtcaggtgcctcaatataaaggtccaggggccatggaccctgacacagtcagaacctgtgtctctacatctgggaagatataaccatcagactaaggtttgctgtccttcaagcattatcccctgatgtaggaatgtagtcaggaagtttgacagctttcacatctgtctccttgagtgctctgccctcccagactccctctccctaagacagtcttcaatatctggtctctgacactccagtttggttttgaaatgcttttggtttctctggccatgctatgttccagggaagagctgttttgttttggtttttctcatgccttaagttctgttttggtcaaagcaacagcttccttcccaatttatattacagtggaggttttccactcaataaggaagaaaaacatcaattatagtagaaaccagtgggagaggtaaggggacctggtggatgagaggagggaagaaggaagagaaaatgaggaatgaaagggaccaaaaaaggaaaagttgttaaaagcttgacacacacacacacaaaaatggaggaggtaattatggctgaaaggttgtggggagaggtcattaggaagtctttaagattaaaaaaataatatatccaactctggggaggtgacaaggtcattaagcgttgctggaagcagtgtaaattagtatggcttttttggcaagaatctagagtttggcaagagccttaaaactgtttatacctggccaggcactgtggctcatgcctgtaatcccagcacttttggaggccgaggcgggtggatcatgagatcacgagatccagaccaatctgatcaacatggtgaaaccccatctctactaaaaatagaaaaattagctgggcatggtggcacacgcctgtaatcccagctactcgggaggctgaggcaggagaattgcttgaacctgggaagcggaggttgcagtgagccaagatcgcaccactacactccatcctggtgacggagcaagactctgtctcaaaaaaaaaaaaaaaaatgtttataccctttggctcaatattgtacttctggaaatatatcctaaaaatacttctgaattttgaagcctatagaaaaaaagaacttcgtgcacaaaatttttttctcagtaatagttatgtaactaaataattggtgacaaccaatgtggctatcaatagacaagtggttaaatagttttgaccattcagtaattcctattacttgattgaatattaggtagccattgaaaatgattgttttccaagaccatgtaatgtaacaagtgcttacaataaaaacaagctacaaaaaactatatcatccaaattatgtttacaaatgaagaaataagtgtctgtgagaaatggtgttggaaaacacaccaatgtattaatactgatagtgttttagtagtgagactacagggttggtatttttttaacaaagcaattcttaaaattaagatattatttacacacaataaaattcacccatttttagtgtacaatgtgatacattgtggtattgtgtacaattggttaccagcacctcaatcaagaagttccatgtgagggatgaaaaattacctattgggtacaatgtacactcttcaggtgatgggtatacagtaaagcccagacttcaccattgtgcaatttatccatgtaaccaaaaagcgcttgtactactaaaactactgaatttttttttttttaagaagttcccttatggcctttcacagtgaatctcctcttctcacccctgaccccagacaactgctactgatcttttctctgtcaacgaaagtttttccttatctagaatggcacatacatggtttcatatggtatacaagactattgtttttagcgataatctactttaaaatgtttcttcaatgagtacattaaaaaataatttgaacctaaaacatagacttcaactgtttctttttccactaaatgcaaagtgggaaagaaataaagagctttgattacttaagagaagatagttcaagcagacctaagttatcagcgagctcagaaaatctccctgcttagaggctataaatagtatggtgtaatactgatcctcattcaaagctgtgatagagtagaagataacttttcaaagtttgtttctaacccgataagaggataataggagaagagagagataagaagagatgtttgtaagcagaaaactataaaggggggatatttttcattgttttgtattctgaacatatgctattataaatttaccattccggaacattctctttaaataatgcaaagcttgtctgaccacccagctatatttctgtttttcatttttaatgtctgcacattagtcatttattttaagctatgtaattataagacaaaagatgctaggttaagtataaccacccatgaacataaagccatttttagtaaaattacagtctgagttactatatgtagtcatgtgattatctgcataaacacctatgaatttggagtcagtatgaaataacaaagttaaatattgagtgaaaaatgctatacacacattatgtttttatgtgtgtgcacatcaatatatatgcagttgagaatgttaaatagaagtgttctttcattctttccttattttacaaaagaaaaaattttgaatgttttgcttcccaataactcccaaataccttatttaatgctttttaattgtggtaaaatatgtgtaacaaaatttactattttaatccttttaagtgtacagtgtagtcgcattaaatacattcgcatcgttgtgcaaccaccatccccatccatttccagaacttttctcatctggcaaaactgaaactctgtacccattaaacacaacttgtccttctttcctcccagcaaggttttggcagccaccattccactttctatctctatgattttgaataccataagtacctcatatgagtgaaatcatatggtatttgtcctttttttattatatggcagaacatttctatgagtatttcctcatggtgacatagggaagttgatcctataatgatacaaagatgctctgggatgctttcctcatgtatcttgatggtccttgacaggaatatctctatctgtatttcttgctggtatatagttaactattaatggtacaccatgttgtagccatataataaaacagagtagtacttaacctcactgaaggactctgttgtgttgggtacttgacaggaatttttaatctggaaatttcttaaattttaggaaatttatttttgtattatttcttatatacttttctccctacactattctctgctctctttctgaaatttctaataatttggattttagacctcttaaacttattttctaatgtttttctcttcctctctagttttcccaattgtttgttttaatttctggtcaagattgtcaacttctaatccttcttctaaatttctaatccttctcctacattttaattactgttatcatgattttaatttctatgatctgatttttatttctttctttttaaaaataaaaccctgttctactttcctgaatgccatatcttttttatctcttggatgatattatagttttttgaagtatcttctcactgatttacttctattttcttcaattcctctttggtattcacctatcactcacattagaggctttctcgaaggtctgaggatcctttgcttccaccatgtaaaaaagagctaattgatagctctggattcctgtgtggatgttgggggaggagggccttatagagtgtggactttaatgtaggatcactgggatgagttatctgggtcaggtggggggtacaaatctcagtagctttgagcctcttctttgagctcagtttcccagggagaagttttccatctccctcctgggatatttaatgctggcttctcagtgggatctcactcatcaggcagtagatttttactttattgttctgtctacagtgcagcatccttttctctgaccagccgcaagtccagggttcctttgattcatcactgccagagaataggtctgcagacttttactgaaatgggagtagtttccagattgtttgagttagggaagagatacatgtccctaactgctttttaaaatgcagctaatttgtgtgctattttcaattttacctgtaacccaatttaatttattttatttttttattttaatttttattttattttattattattatactttaagttttagggcacaggtgcacaatgtgcaggttagttacatatgtatacatgtgccatgctggtgtgctgcacccattaactcctcatttagcattaggtatatctcctaatgctatccctcccccctccccccaccccacagcagtccccagagtgtgatgttccccttcctgtgtccatgtgttctcattgttcaattcccac

SEQ ID NO: 2830 - DNA, 6098 bp, Homo sapiens
cttttcttttttttttttttttttttgagacgggatctagccctgcagcctctgcctcccaggctcaagctattctcgtgtcttggcctcccgagtagctgggattacaggtgcatgccacatgcctggctaatttctgtatttttagtagagacagagtttcaccatgttggccaggctggtctcgaattcctggcctcaggtgatcctcccacctcagcctcccaaaatgctgggttacaggcctgagccacagggcctggcctagccctatctttaccattagctccattttacaagttgtcatgggggggtcctcctctctccttcggctccctagtcgccttggggagttcccaccaatggggcccaaacctgctgacctgaagtgaagatctgaaattgacatggaatgagccaggcaaagcagagagggattccaagtggcttcatgagttctcagatgagggactgggaggaagccggtgtgcggtgctcaggagtggcggggtgtaaactgtggtgaggttaaggaagcaggagttaacaataagcacctgggccgggcgcggtgtctcacgcctgtaatcccagcactttgggaggccaaggcaggtaggtcacttgagtttaggagctggagaccagcctgggcaacatggcaaaaccccgtctctacaaacagtacaaaaattagccgagtatggtggtgtcacctgtagtcccacctacttgggaggctgaggtgggaggattgcttgagactgggaggcagaggctagagtgagccatgattgggccactgcactccagcctgagtatcgctcagagtgagatcctgtcatggcggggaaaaaaaaggaagaaaaagatttaaacccaggcaatccacatcagcagccattctcatacctatccactcctcactgccttctaggcattgctgaatttgagctttattttaagtacaatgagatatttgtaagcttttaagtgggactctgcatgatcttttatgttttaacaagatggccaggctagaaatggaaatttttttttttaagcattatgagtgctatttaagtcacttacggatgatgctatctagggagaacacataaacacagaagagttccaagaatcaaaccctaaggaactccaacatttggagggtggatccagaaagagaaggcaggagagaggagagaaagccagtgcctgaggggagccaggaaggactcacaagacaaacacagcctagaactgtgcttacattgtgcttggaaaaagaaatagacaccagatccctgcttcctgtttccttatgtgaacccaaagtatccgagacaggtctcaaccaatttagaaagtttattttgccaaggttgaggacacacgcccgtgacacagcctcaggaagtcctgaccacatgtgtccaaggtggggaggtacaattctatgcagaatggtctccagtgtctagcctgacaggccagaaatacaggtagctgactcattggggaagttctaccatttaaaagaaactatccttttcctaattataaatgtatattttgtagtagaattggattcctgaaactttaatgaacttgtggatccctggggggcctcgtgaggtggcagtatctgacttgggagggctgtggtggggttgggatgccgcatttctaacaagctctctggtggtgctgagatcactggcagacaaaccacactggggactatcaaagacttagcaaacaaacaaaaaatagctaggattacaaaagccagctgtaaatttgccttctcaaaagggacactgctttccattcctctctccacgccggactaggtcagggctccgggcttccctctccaacgtcacccacagcatcgagagagggaacagatggagatgaggatgtagagttgctggggaggccagaggtttggaatgagtgaatatggggtggggagaggtggccagggaaggagaaaatcagaaaggagtctcgtcctgctgctgcctgagataactgatgatttgcctcctcgcctgagatgagtcaggcgcagggatctgcaggatgaaagggagaattggggcaagagctctgagtgggtgagaagctgagaaaacaggtgaggtggaccagacccagaaatccacttctccaccctcccctccaagcctaagtctggagaatgataatccaagggatgccccctgccaaccccccatcatctctcagtgctctccctggaaggatgaagagaaagccctgagcttgcttctagggtgggaagccttggtgcctgggactttccactctagcgtgtgtacgaggccattcttccattgctatacaaaaaaaaaaaaaaaaaccaaagaagagcagcaaatctccagaacacggcttctgtcttgcatgtaagacctgtaccaactcagtgatgtccaccttacctcctgagctgcgtcctcctgagtgacagtgagtatttgtgtgcagatttcacctcttgagatttaacatcagtggaaatgccaagacagcaaacaggacaaagagcactttggttcattctaagaactgaatcttggctgggcacagtgtctcatgcctgtaatcccagcactttgggaggccgaggcaggtggatcacctgaggtcaggagtttgagaccagcctggcccacatgttgaaaccccgtctctactaaaaaaaaaaattagctgggcgtggtggcgggcgcctgtagtcccagctactcactcctcacaactactgtgaaagtcacaccccattctacaggtgaggaaacagaggcttgcaggcttagtagtcatgtagctagtaagtggtggttctttccaccagaccacactgtcttccccaagaggcatttgttaaccctgtgcggagccagccaaaccacaggctccatgactaccgggaaggtaagggccaggttctagttgaccagaactggtgaagaaactaatctttgcttacagggagaaaccacaggacatctgcttcctttgagcaagtgaaggagacacaggaaaagaggtcctggtgaaaacacgactttcagaagttatatctgagccttccaggaagaagtggcaatcagagccataagcttgaagtgtggcgaggaatcggaagggctggactggaagctggcttccttatccggccatggcctcaggaacaaggcagctgtaggctgtcttgaccccagtcagcaacgtggccttggcagactgcacatggaaggtgatttggggagggcctgaatctcccagcatgcctcactccaccctgatagctttaaggggaaagagcaggtgccctgaaatttccattagccaaacctgtagctataccttacatccattaggatgagaaagttgtaaaatctgttttgaaattcatgcaaaatccatacgtttgttttcatgctacagtgttttctctgtacttgattttcttttgttctctggtcatgttatttttgaaaattttcagcttttgctttacagaaagaaaaggaaagggatttctgcagatctaggccaaggtagctggggagatgagaatacatcaggggccagataaagctttatcaagggtggcccccagttcttgagctgggaagagtctttgaggttgaggcaagaggaggatgaaaacccagaactggaagctgagaccttcattgctttccattagtctgtccccacctctctccattcaataggtgatggtcttctagcaacttgttagccacacagcattcatctgcagtaggccacattctgctgtacaatgctacagacatctcaaagaccacaccatgagaaccactgtggtagacatatggcatgttaaaatgctaactaggctgggcacggtggctcacgcctgtaatcccagcactttgggaggccgaggcgggtggatcaccaggtcaggagttcaagaccagcctgaccaacatggtgaaaccccatctctactaaaaatacaaaaattagccaggtgtggtggcgcacgcctgtaatcccagctactcaggagactgaggcagaaaaatcgcttgaacccaacatgcatctcagaattggtaatatgctgatgttttcaattagtcttcaagccattttccaattacagtgttttctactgaagtttgaaaccccccataaaggcagaaatgagcctctcttcccctgaaacctcccattaaggcaggaatgagcctctctttccctgaattcctagagttctacaaaagaaacgctaaatcaacccttcctatggactttgcttgtactacctttgtgatctatcatattctgttgtttctggtaaccatttacacgtatgacaatagatttttaagttcatcaaaggcaggaatggtattttatacattcccaagttttaagagtgcctgacatggggtttgtattacggtaggccagtaattctccaacttttcatcttggaagtcttttacactttttaaaaactttttttttaggaagtcacttgctcacagagtctctgacctctgccaggtgcagtggctcacacatcgcacccagccgagaaacttttaacactctgtagaggaaggaactgatattgtgattgacttttgtcagggttagttgctatcggcagctctctgaggaagaggctgtaatttgcatgcttaatctcatgtctattccacttttccttcagggaaaggccttgttcatgtacatctagtaggagtgaacctgatacatcgtgattgcgtcatatgtatttgctgaatgaattaataaaaagctaatactactcaatttcttttttttttttttttttgggaaagaactgctttcaggaaaatattttaataagttacctgtaataaaagtgagaggcctttaaggaaggaaaaaaagaatatttatgctgcctctttatgggaaaacaagagggatttgtcacttattttttcctactgatggggagtggggctaaggaggaaagagagacaagagccagtgagctggtctgagttggggactgcgggaagtcatggtgggtgagtgataatattttaagcacagggacactcagagtttaatctgaagttccattgctgtgatgtaatccactctcttccttcccacatgtcatcagtgattatgacaatataaacatcagcagaaatcttggggacggtttgggattccctagagggtatgtgccaatgttctctgcccttcaagtctttgttctgaagcaatacttgtggcagattgctggaagaatattctgtccattacagatcatgaaaaaattttacctgtggatcaatccagacctcagaaagctgttaagttatgacttcattagagaagaacaggacttgatgacacatcctttgatatcatccttacccctggcttcaccttactgtcttatttgtattttcggtttgcaccaatggcctccttaatgtttgagggagctgtgctacatagaactctaaaagctgctagcaataatttttcaagcaaggcaaagcataatgaaaaaaattaatatgcttttcaaattctattatctctaattcccacctcactatgctcttcacttgaaaacgtggaaagtaaaaagataatttatcttcctcctgcggcatgttggcaagcattcacccagcccctcttcactactcccaaataaggacttgctgatatttttagcaaaacaatttatgggtccatttttcaaaaatcaagctagttcactcctgtgcgtgctcatgcgcgcacacacacactcacactcattagccactgttaccagtttgatgcataaccttctagattctcatgtttgcttttgtaaatatatacacataggtagagcagtctattggtttttgtcatgtgtatctgggtgttaaatgaaggagtgatgttctacaacttgcttttatgatttaactatgtcttaggccacttttcctcctcccagggaagagctcttctctatggttttgttttgtttttttgtt

SEQ ID NO: 2831 - DNA, 2023 bp, Homo sapiens
cagcactttgggaggctgaggcggggggatcacgaggtcaggaaatcgagaccattgtggctaacacggtgaaaacctatctctactaaaaatacaaaaaattagctgggcgtggtggcacgcacctgtagtcccagttactcaggaggctgagacaggagaatcacttgaacctgggaggcggagcttgcagtgagccgagatcgtgccactgcattctaacctgggcgacagagcaagactccatctcaaaaaaaaaaaaaaaaaaaaaaaagatacctcagttaggttatcagtaaaaggggattgcaaatatcttttaaataaaaatttgcattctatatgttatagaatacagaggatattaaaaataaattttatccatgttttgacaatttctttctttcaactgtttacatattgaagcacaaatgctaaacataagtcagaatggaagaatatttaaaataatgactgtgtttatatctgatttatttcagattgcccaaagtgcatcttgccaggttatcttccatttgaagactgacattttatttcttttttgatctttattgttcctctcttccacctctcagtgggtatagctctctggtctgtagaatgggacagtggtctggtttccagattgataagtgaggtatacctcctagttttcagtaattacctgtagaaggtggagaagttactggatatgtttaataatatctcattacattcttttttttttttttttaacgagagtcttaactctgtcacccaagctggagtgcagtggtgcaatctcggctcactgcaatctccacctccgggttcaagcgattttcccgagtcatctttccaagtaactgggattacagctatgtgctaccatgcccagctgagttttgtatttttctttcttttctttcttttttttttttttttttgagacagagcctcactctgttgcccagcctgggtgacagagtgagactctgtcccaaaaaataaaaataaaaataaatgaatatataaaataaaaaatatatgtatacatatcatatatatatataaaataaaacttataaatagtttttatggctgggtgaagtgactcatgtctgtaattctagccctttgggaggctgagcgaggaggatcacttgagcctaggcattcgagcccagcctgggcaacattgcaagactctgtctcatttttttatataaaatgtttttttaaaaaaccctatgtataattatttattttttttccccaaggattattcccaaactatgtacaattaatgggttgccttgcagagttggatcaataatacctgacacacttgtatagcaagcatacactttacatagttcctcgcatctattctttgaaacccagacacattctagtattgggcactagaaactggtgataaataataacaattacatatatttcctgaagaattatgtggcattccttgttttaagcacctttgatgccttagctcaatctccattacaatactatgatataagtaccatttaatatttctttttgacagatgggaataatcgaggcctagggagattaaattacttggccaggttcatgtaagtggcagatctaggattcaaattcagccggtctgaatctagagcctattcttttagctatgatgctatactttaatacagtaatacactgttcaaatgaaactgtaacatgtcattaaatttgaacttgtcaataaacataccaagcaataaaataattacagcttgtggaaagtgcttatgaaaacagtaaataagctacttgagaatggtcaaggaaaggtttctttgatgtgctatatgtacattcaacagacacatggaggatgaaaaggaaacagccatgcaaagagttcaggggaaagactggcccaggtgaagagaacgccaagcacaaaaaccctgaaacaggaaaaagtttggtttgacaatggaattgccgaaaggctggtgtgactgaa

SEQ ID NO: 2832 - DNA, 5156 bp, Homo sapiens
ggctggttaccaaggttaccgccgagaggccgcgtcctcagctggtcctagacatgcgtggcgtcggggctgtggcacggtcgggtccgggcttgaatgcaccaaggaaaggccatttgtggggacatagcaagaaggcagctgtctgcaagccaggaggagaaccctcaccagaaacctcacagaaatcggccaacaccctcatctcgggcttccagcttcagaacaacgagaaaacaaatttctgttgtgtcctggttcccatttgtaattggcaccctaatgaaaccgttttctgtagccctggaaatggctgaaaatgaggggagggaaataaagtgctataattcagagcatggagcacaccttcctggttcacctgagctggattcggagaggtaaaatggccattacctcgtctaagctgccacttacagacacagtacaggatgaggcccagacccacagagacaacgatgatggccacagctaagatgatccagaaattattcctccaccagctcattgcagtggaatcctgagaagaatggagagagaagaatgaggcttctgaaaagcttccaagagatgttgcatgcaaaagagctctgtgtgcagaagatcaccaagcatgaggcattattaagggcaaaccaaccaagttctatttacaatagcaagtgtcttctaagaagggcagctaccgaccaggagagtcccctattctccctgcagaggatctgcagatctgcaaagctggctgggttaggaatgaagtttgctggtaggaactggggaatgttgaattcctctgggttatagaaggggagaatttggagttctgggagggaaggtgatgagaagaagggatggaaagatgaaaagggaagccagcaggatggtgcaaaggtgggagtgaacccgagggctagattaggcctgcagaacttaacctaccttacttgattttagtcacttgcttctagttgatcttaaaacctatatagctactgggggcagtggctcacacttgtaatcccagcactttgggaggccgaggctggaggatcacttgagcccaggagttcaagaccagcctaggcaacacagcgagactttctctctactgaaaataaaaacaaaacaaaacaaaacaaaacaaaaccagatgtggcggcatgtgcctgtagtcccagatactcaggaggctgaggtgggaggatggcttgactctaggagattgaggctgcagtgagctgtgattaccatcagtgcactctagcctgggttatagagtgagaccctgtctttaaaaaagaaaaaagcctatagagctaaaagtcatgtagctaagcaatatttaactggacttccactagcttcctgctggataacatctctgacatataggtcatcatagtaatggttgtttaagttgtttttcaagggctgggcacggtggctcacgcctgtaatcccagcactttgggaggccaaggtaggcagatcacctgaagtcaggagttcgagaccagcctggccaagatggtgaaaccccgtctctactaaaaatacagaaattagcctggtgtggtggcaggcgcctgtaatcccagccactcggaaggctgagggagaatcatttgaacccaggaggtagaggttgcagtgagcctccaggatcacgccattgcactccagcctgagtgacgagagtgaaactccatctcaaaaaaaaaaaaagaaaagaaaaaaagttgtttttcaggaacttggggtcagctcttatccagttcaagccacttatgaccatcaatccttcaacttggtctgtgtgagtgtccagtaggtgacgtttgatgtcagagcgccaaaaactccatcttccatcatgctaatgccaccattttgtgaacctgcatcctatgaagaacgatgaagcttgactaggcttgcacagattgccgatgtcctacttttccctccaatcaccttccccacaccttaggccacctgcttctttgtcccataaacgtctctaaaccccatcttcgaggaagtgggtttgagacctgttttcccatctcctcacttggctgcctcatgaataaatgcattctgtgctgcaaaactggtcatcttggcgtgagccactgagcctcgctccacttgtccttctcactgatgtcagcaccagaaatggccatgtggatagtcactggcaacttaaaacccaagtgtgcatggggaagtgcacggcagggtcattaaaaggagtccagcctctcttcttcccttctctatactttcacttctggaaaagaccggaaaccttgcctcattcctctttctcccatggccccatccccaccccgcttcagcccatcagcctccaaatgtagtccaagtcctcatctctgtacctggaccattgcattttcgctggcccctagcccccactgggctccccactggctgccaaataccagtgtgaccctgtcccttccttgctttaagcctctcagtagtttgtttgtttgtttttgagatggagtcttgctctgtcaccaggctggagtgcagtgacataatcttggctcactgcaacctccacctcccgggctcaaacgattctcctgcctcagcttcccgagtagctggggctataggcgcccaccaccatgcccagctaatttttgtatttgtagtagagacagggtttcaccatgttggccaggctggtcttgatctcttgaccttgtgatctgcccaccttggcctcccaaagtgctgggattagaggcgtgagccaccatgccccgcctgcctctcagtagttatttaccactgaagcagagtgaagcctgtgctccacattgcttcatggccaagacctcagggacaagtggacacaccaggcagtgggagtggatatggcaaagccaaacccagatctcttctcaaaataattttccagagggcaaaagcagatggctacaccgagaactcacgccagcccaacacactttgatctcgaggcctctggaagggaaggtgcctaatgaactactgaaagccagagatgcaatgacaaaggtaccaagactggaggtgatccaggtctttcatccaagagccccaagacgtagcctaaattcatgctacggtaatcccagcactttgggaggccgaggcgggcggatcacctgaggtcaggagttcgagagcagcctggccaacatggtgaaactccgtctctactaaaaatacagaaattagccaggtgtggtggcgggtgcctgtaatcccagctactcaggaggctgaggcaggagaatcgcttgaacccgggaggcggtggttgcagtgagccgagatcacgtcactgcactccagcctgggcgacaagagcgaaactccatctcaaaataaaataaaaataaataaattgacacagtcagtgcctcgctcccacccccacctccagcatagcaccatgacagtcttctcacataacaagtcccaaaacacaccatcggcatccagaaagtgagagtaactcgttacagttgagacctctcactcccggtcattatctcatttcaatccaagaggtagacttcttcatcgcccctgacatacacatgaggaaaaggcccagagaggtgaagtgatgcctcaggtcactcagccagttaccagtagagcagatccttcaatgcaagtttttctccaaccctacacagcagtcgtaccagggccccaggctgcaatcccctggcccagtgctgatcggtggctcccagggacacgccctgatgccagcgctggcagatgtctgctgtgaagagagcaggaaactgtcccttggaaagctgagatgcttacctgaactgtgaaagtatccatatgtgagcagctaaggagacagcagtggctggagtgctgcagctcaggcacagctggtgagaggcattcctcactcacaggccttcacccactgctagagacagtgagccccatcctgaccacttcccctttctagtcagcccacggggcagagaccctggcgtcatctctaggcaaccatcccttttccagggaagctcatgacccacggctgtccagaagccagaatcttctcactgccccgtgtcgctcccgcaaggcctaccagaggaccctcatggtgtggtagggggtcctggcaggggccaggggccagggtggagacttggcagtgggggtgggtttggtgtccccacagacgagtttgccgtgagcattcctggatgtggcaacctcagtctcaagaagagcgacaggacgccagctcccatgcagagacagatccaggtaagaaaccagctcatgtgtgacaaactcaccatctcaccatgaaggtgactcttgaaagctcctgtgcaccttggaactgctgagacatcttctgcttggaggaggcaagggacaggcttcctgtttctaaaggcgtgtgagtggcgaccttgagaaatgtggccagtggagcattttgactgagttgggtcccctcgtgcaatactgtgagacagaactcccagcgaggcccacggcctctgaccatgggggttggagtggggaaaccaattagccattttgttgaattggctggttctgactcaaatgagcagtcacattagtaaaaataggcaaacggatgtgcattgtatttgcccagagcgaatgagttgttatccatttcagtaataatgataaccagatatgtctgataaatatctgataatgtctgatatatgtctggtaaatttaacaaacaccgggctctggctgggtgcggtggctcacacctgtaatcccagcactttgggaggccaaggcgggtggatcacctgaagtcagtagttcgagaccagcctggccaacatggtgaaaccccatctctactaaaaatacaaaaattagctgggcattttggtgtgaaccggtagtcccagctactcaggaggctgaggcgggagaattgcttggacccgcgaggtggaggttgcagtgagccaagatcacaccattgcgctccagcctgggcaacagagcaagactctatctcaaacaaacaaaacaaaacatctggctcagaagattcctgatttgca

SEQ ID NO: 2833 - DNA, 18394 bp, Homo sapiens
gggaatgtgtgggttggagctcaatggccatatgtcggcacgtccagggtccccaaggcagcaggcaccattctcgccctgcgcagggcctgccacttggggcaggccaggaggctggccaggccttcagcaaagctgttgcagctcaatcagctcctcttgtgggacccggaggctttctgccggtagatctcagcggtgaagggcctgccgggcagcggggagaggcttcggtcagcaggtcctgggggtgacccactgcccgcaccagagctctgcgtccatcagcttgagggtgtccagatgggaccgggatccccttcatcccccagagccactggggcaacactgacttggagccttcagagcgcaggcgggagaggggaggggagaggggccggctgcctgctgggtcctgcaggccgcattgtaagctaccatggccgctctgacctgggagccctggagtgggcctggctgacggcagcctgtcctgagcctgccctggccacaaggaaaggttctagagggagagacagggccagtcgggcagccacgcccccacccgccgcagcccctactcactcttcgtataggagagccactatgtaggtgagggccaccagcaccgtcaggagcaggcccgtggggctggcgtgcctgaaaggacagaggcaggtcaggcctggctggagccagggtctctcagggccacggcccacctgcccaggctggcccttcctgccgtgaccctggccctccggccgacgctgggccacttgggccgaccgagcccaggcagcactgccccttcctgagtctggcttttgtgccaggaccagggtccccatgttctcggtcctgatccatttatcatcattgtctgcctgtctggcctggctgggttccctcagggtggggcctgctcactctttccgggtctccagccgccagcccagagctgggaacgcagccccaggcggaagagtcccagtggctagggctgttcattcccgcacaggaggagattctggggcaaagtgctcccgtctcccagaaaccatgctctgaggaacaaaggctgttttctagaaatgagtccagggtcccccaaagccagtttggtccaccctgagtccccagcccctggccacaggtgcaaccccatggccacgccctgggaggatctggctgtggggaagggggcttaggagctgccgccccgcccagccctcaacacctagcccagcttgggctctcccaggtggtgggacagcagccccacgcccaggagcccccggtcaccccagcccagaggacgggaggccccaggcagagcatacagcaggcccaaggccggatggagcatcgccaggggctctttgctggtgaccagctcctgaccccgccacaccagtaagcagcggcagctcgtcagtgacggcaccaaggagcccgggcgcagctgctttgggtttccagaaatagctgccgtcaagctgtcccccaatctatttctatagttacctctgatcccacagctcccgcaggtgctgggctgctgccagggaggagggagggagggaggaagagaggaaggagagggaggaaaggagctgtctggcgggcacagagggcgcatgggcaggcctgggccaggggctgtgccctccttggctgcccctgtgccaagctgccccctccccagccaaaccatcacaagaacctcaggcagggctggatcgaggtgagggctggaggacacctgtggaccccgtggggaccctctgccctgcccactgccttccacccctggacctcacactggtctgcctgtctgggagctgcaggaggcagggcagacgtaagcaaagatccaagcccaggctccaaccccaggcctggcaaccagcagcgaccccactgtgggcgccgagggggacaggagtccctgattgcacaacacgaagcaggaggcccacctgtccctcacagccaggccaccacctctgccatctgtcccctggcatcgggctcactgccacacagcctgctggggtcctacatgccggggagctcagacacctggaagcccatctccggggccctggcaggtgagagacagatgggccgtgggaggcctgtgggggtccccgctgtgtcagcgtctggccagataatggctcatctctaatgagctcctggaccattgatgccatctctcagcacgctgcatggctgatgtcctctggaggcggcttatgcgtcccccagagccctggcctggctgccccgagcccaagggtgactctcactccagggcacaagacactgctggggacactaagccactggggaggcaccgaaggttggggggttagggagggattcgtgcaggagggaacacttgacgttgggtttggaaggactgacaaggggcataagtgggagggttctaggcgagggaacagtgtgtgagtgcatacatgcatgtgtttgtgcacacagaggagaggggggagccaggtgtgttgggaaccctaagcctgcagggacgacctgggtgggggggattgttttgagtttgggctcatcctgtggccccagtgggggtgctccatggccggtgagcctgggggcacatagtctgggccttagcaggcagagggaccaggctagaaggcaggtaggacgtgtccctggggactgcctggcctggacgtggggtgggggtagggtgggtcccagccagacccacagccccccttctagcttctgctgtctccaacccccgctgctacggtcccaactgctgaaggtgggagccaggaggcaacatcttgcgcttgacattcactgtttacgattcactcctttgggatcctcaggtcttgtggagaacctgtaaattctaggccagtggttttcaagtgttaaacaaaagcagtggaacactgtctgccaaaaaaccttctatggaagaaaatggctaaactagaactgctggggtgggggctgggtatgaagccgagggcagcgcccgctgtgccatccttgaccgcaggtcctctgacccgccgggggagcacatctccataccttgtcagtacccgtacctggctgaggccgacagcagttctaggcttccctcatggcacggggccccctctgtgggaaggggtatctgccacatgggcagaggctattggggcacagggagttctgtcagctgcgggtgagctgggccctggcggctctggccaacccctcctgcggggaagatgggtcgggtggtcccagccctgatgtccccgcacaagggtccgcaaactacggcctaggggccaagaacgcctgttacatttttaaacggttaaaagcaaaaggatcaaaaagaatgtttcatgacacgtgaaaagaatctgaaatttaggcttcagtgtctgtaagtggagctgtgctggcgccaaagacgcgcatccattttcctgcgtctgcagctgttttgtgtggcaggaccagggctgagcagctgtgacctgcctgcagcctttgagcctccacactccagccctctttggagaagctgaccaccctgttctgggatgttgtttctgttaccatagataagacgcttctgagaaagggagaaccagggcgcctaggcccccacaaatgacacgttcttcctttctctctctccaggggccctggcccccgcgtcctgagctgcaccagctcctctccgggaggtggccagcagggcagaggggtggcaagcctggtactcacatgatggcccagcccaggtagttggctgtgcttccccagtacatggggttgtccaggatgttgaaggggaacacggtcactctcgcctccttgaggatcccgaagtaatcacctgtggatgaggcaaggcagggtccctcggctattcatcagccctggccacaccatcactgagggaggccccagagcgggctgtggcgagacctgcaggtgagacagggccctgccctccaggagacttcagagagttcaacaatgggcagagtcagagggacccaacaggcacgcagacagcagagggcgtggggcctaaggactaaggtgctgagcaccgcccctgccccactgctcctcttctcgagcactctgacccagccatgctggccttcctcttcttcctggctctgcacacgctgttccctcccctgcgatgcctttccctgctctctgtacagagagcgcctttcctcctcaggcccttcgccctctgctcatggcgcctctttatgcagacccttcctcttcctgtcctacctcccactcttcctcgctctggtgagttcctctccctctaggggcctcagctggttgctaagggctgctctgctccacaccccaggctgtgtggctctggcaccagggcctggccacagcacgcctcccgttgctctgggaggtcagctctggtattgttttctcactcagctgcccagaggagctagacccagtggagagagggtgactattgaacagcctgttccagacaggccagccatgcacccgtcagccgcacagccacaaggcgtcccccggcagagctgctctgagccataagggagtggccggggtcacagtcacagtgtctgtcccaggcccacagaggacagtcccactggacacagagtaaccgctccataaagggtgtggcttcgttcctcccagccttctgtccccagaaacccctcatttgtctctcctcccagaggacaatggagcttcatccaaggcggaaagtagggcagctgcccgacaatgggcagcatgggcaggaggggtccaggagcttcatcaccatctggggacacggggcagggcccaggaccactggaaagttctttcttcccaggaagcaggaagtggggcacagggtgtgcgtagatggcacagaaacccaattcgagctgagtcacagcaggaagtgaccacctttgcctacataccgcgctgctggtcctcggtgtttctaggccatgtctgctggcagggccgccaggaggctgtggccactggtgtttgcaggctccttccctccctctgactgtccaggacccccagcttgttcttccactgctgaggggctccacccaccatcctggctctccttacgctgcctctgcagccctccctgtccagatccacccgagcactggccactggagggcccccgccgctggtctcccacaggacctgattgcacagcccggagtcccccttcccatggggccctcaccgccctcacatcctggaagggcccctccacagctcctcctgagccccacctctgatcctggctccatcggtccaacctcttccttgctgggaccccccctatggctcccacctctctggggatggagcctcagccccttggatggccttcaaggcctcggctcatcctcctgccctgtcccaaccgacagcacctgtgcggccagtccagctgccccccacctccagctgccagctactctgccctcaacctccctctccttgcaccaaggcttttttctctttcctacctgcccgcacctgcccccacctggcagatccagacgctcctggctgctgtcccccttcctggaccaaactccctacagcgtctgcctgagcaggaagcactgaactgcctgtgggtgccccccacagtcccagagaggcctggccatgggcgatccagaatgctgcacccacagatgccacttcctccctcggggggacccctactggcaggcacaagctccttgagaacttggagtgccctgtgacagcccacggtgccctgggggctgggcccaaggagctgtagccggcatctgaggatggggatggcaggcaggcccgggagctcctcaggacaccgttggtcccaggaggctactgaggccactgaagccgagtgacttccaagctcctgcactggccagggctgatggggaggaagacgtgggccttcccacccatgacggagagcgggcaatgcggccagctggaccaactccctgctcactgggaggggctccccttggacagggactgcctccttctctccttccaggttccgaaggccccctcttgtcccccacccctgcccccatctcccctcccaccccgacccctactgcctttcccatggctgcttttctttcccagattccaaggagctggaagttgctgccatcatcagggtcattggtgggcgtctagccaggccagcactgggctcacagcctgaaagcacctcagccacaggcagagggaaatggagaagggataaggtgcctccacccctcacccctccccagacctacaccagccctgcctgcggccaaacacggcacaaaccacaatcctgcctggcctgagagccacgcgtgccgggagctgccagagaggtggctgactcaccaccacctcaggcttctgtgcaacaaggcctgagagtcttctgcaagggggagctggtgctggagctggactcaaggagtcctgcacccagcccgggccgcagaacgggcattgagtgcatcttcattagctggagagaagcagcaggagctgccttcactccccaggaggcagccgctcagcacgctggggtaagaggagctgttggagcccagcctcctgttctaaccacagacaagccaggcctggaggagcaaagacgccccgatggagggggcccctagcactcccaccgatgtcacggatagcagggcagcagccacctggccctgcacctccctggggctccagcggtcctgctcagggtcaccccagccctcagggtcttacctaggaaagttccagcgaaccccagtgcaaagaagctggagagcacgagcacgacgcccagtcccaggagcgcgaggcccaggctgtaggccgcgggggtgtccaggctctccatcctgggctggctcagcatggcctgcgtgaagctgtgggcaggggatggagagggaggacgtcatggccagggaggatgtcacagcccgggaggaggccgacctcatcttctcgccctctccccagggacccttagagagtagccagcccagggctgccaggccaggcaggcagcaggtggggtccagtccacctgggaggtgggtgacagtaacagggaggggcccaggcctgtcagatttttaaattttttcaagagaagccagaaatcctgactcgtatgtgaaatatcctaatttttagaaatagacaattcatgaaagccactttagaccctgcatgtgagcaggctggattcagcccgaaggccaccagcttgcaaactctcatcctgtccaatgagcaactcatactatggaggaaagtgaggctcaggaaagacgcaggtgccaggttgcagggcaggcccaggtgtcccattccccaacagactcagtgccccgaggcctggggcatgctctgtgctagggattgcgcttccacagcccctgtgggtctggccacatcctgggtggcttgacttgcatttaaaggcactttgggggcccttaatgtcctcctccacacctgaattcccccactaggctccctttggggccaaaccactgaaggccttgtaaaaaggtagtggggtccaggtgtggtggctcacgcctgcaatcccagcactttgggaggccgaggtgggcgggtcacctgaggtcaggagttcaagaccagcctggccaacatggtgaaaccctgtctctacccaaaatacaaaaattagctgggtgtggtggtgggcacctggaatcccagctacttgagaggctggggcacaagaatcgcttgaacccaggaggcggagtttgcacaccactgcactccagcctgggcaatagagcgagacttagtatcaaaagaaaaaagaaaaaaagaaaaggcagtggcgtgaccaaaagggggtgactatgacagcagtgggtctagaggctcaggttctccagttggctccggagaactgaggggctggtgcagggagggcacaggggctaggcatgtgctgatgtacccaggcctcatcacaggggagcgggcgctggtgggaagggggccctgggtgctagatgagaggcacactcacaggaaaggctgtgtgtgggagcacggacatgtgtgaccaaatgtgctcttcccatgctcacaataatcacaacacagaagagacatggagatctgctacctcacgcagggcagcgcctttcacacccagtctgtagacggcatctcccagcagggccagcttaccatccaccccaccacccatccttcctccatccatctatcctctatgcacccacacatccatccatctgtccagctatccatccttccatccatcaatgtatcctctatctgcccacacaaccatccatccatccaccatgaagtatctttgtttgctaggctctttcaagcagattgaagcccccatcttcatccactcgttccattcattggtgaattcagattgttgtgaaactccttatgctgagctaaggacatacagacatgtctttatgcctccctggaactccttcctccagcttgactgggagctcttggggaacagaagttgctcctccttccctgcgtatccccccagcacttggcccaggccacagaatggatgtttagtgcatattcatcgactggagagaagcagtagccgctccttccttctcctcccatccccaagagcagagaaggagccagggagaaagggagaagggcctgtggacaaagccaccaggacccggtggcagaggcgggcacaccgacctgttaaacagcggcattcgggtgtcagggcaaacccactgccggtcatgctgcccatacccccagctctccacccaccagtgccctgccctgatcctgctgctgcccgggctcagggtcaccccgcagctccaggccgagcctctgggattggctcagggtcacgggctgccatggaatcaggtggccacatgcacacccagtgtggtgccacgatccaggcacaccttctcccctgcctggcaccctccactctcctgcctgcagatggtggagtgggagggaaaggaagggtgccggccctgctcaggagcatggctcccctgcaagcatctggctccttggctgccactgcagtggggaccagaaaacagacaggggttgggaggggcgaacaggggagagcattccagaaagaggaaatagcagggaggtgtgccttagagtctggggcagggcatggagcagggaaggtgcaggcctcggcccggcagggtttggaatgcactctgcctgctgtggaaaatgcagaaccagggagacccatccaggtgctgcaatagggggtgggcgcagaggccaggcccgagacgctggagggtcactctggacggagactctgtcgctcttaccccctcctgcggagacccgagccaggcctgggtccataccccatgctcagggttcctctgccagaattcatctgcatcacacaagcaggcagcagatgaaagggaacttcctccctctggtgtggcccaaaagcccagctcattcagggcccagcttccctgggggcatggctcagtaggcaaatcagatctgcttggaagcagattcctgatgaagggcagatccggggccagggagcgggtgggagaggccccagatttgccccagacctgaccctcagtcccccagctgctcctccgcctacggccccagtcctggggcctttcctttcctttctctgagatgacagcctgggctggctcctggcacaatgctctgtgggtcatttgctcagagtcggcagaggaactgggctgagctcctccctggcgttctcaccaagtggccccttacccagtcaaatacactctgattctagattccaggtttactggaatctcatggcccgaattaggcaatcgacagtgttctagctcctccattaagccaggaaagcacagtccgtccattccacagggaaaattagtggatggatgagtagctctgtgaccacaagctccctaacagaatgaggtaatataggacgcaatttcccttggaagtattccgcactaggggtggggaacggagactcattcatttgccttgggttctatttttaagacctggattgaaccttcagtcattaatgtgatttgaggctgtctgcactctgctcccataaaatcccggaaaccctggggtggaggtggggagggggcatcactgccctcagtgtccccgccctgtccccagccagcagtcctgggccacacaccaggccagaggcacacggccccacctgggacaggcctgtcccgtttctatctgcagccgaccagaaacacttccctgactttgatcatcctggggtgtctccgcaacgtcgtccacatccatgtgtggcctgagtgccatgtactccacatccttcaccccaggcttggagtgactcgctctttccactccatctcagctacacgacgctagccatgaaatgagtcgtctgatgggctcatttcttttccaagacatattaaaataagcatgtaactactaaaacaaaaaatgttcatctatgcaacccccgagaccatcaaagggcttgaatttcgggctttgacgctgcactaattctgagcatttgaataacacgtcacctttccaaagtgtttccagaacccatcaatagctgagagagagtctgtcttgttttacaaacagggaagcagatggtagaaagcaggaggggcaggatggctctcctgcctcctcacgacctgtaaacagtgggataggctcaagcctcacgggcaggccaaggacaacaggcagcagtatcccagcacccctagcacctgggaatcccaggctgacacccactctccttccagacttcctggccgtgtgtgctttggggatggggagggtgcctcttccctccttcccagccacagcccctcaggtgccagaccagcctggtctaccagggcctggacccactcttgccgaactgcagcccctctccctccttccttcccagcagctgggggcccttgtgcccaggaaagcctatgccagcttccctgtcctaagtgtccccccaccccttactctccagctgccctcatggaccccgcccagtggctaccccaggcacctgcctcgaggaaatcactctggtgaagggatttcacaaatagaattcaggtcctaatcagctggccttgagttaatcaaaagggaggtgaccctgggtaggcctttccaaaagggtctagaagccagagagaccaaaagccaaagccacagagctgcctgctgtgctgcggggaggccaccaggagctgggcctcaaggacccgcgtcctgccagcaacccgaaagagtggaggaccacgccttgggtgagctcacacccagcaggcaccttgattccagcctggggagtccctaagcaaagaccccgcccccgcatccagcctcctggacacagaaactgtcacatagtaagtttgtgtggtttaagccctaagtgtgtgggaatttgttacacagcagaaggaaactaatacacttggcttcccagtccacagactctttaaaaattctggcctgttctgccaagacagcaggagtcgcttttttctgccatggaacgctgcacacgcccagccctccattgctccatcggaagcaaactgtcccatcagctccatgccctccctccttcatgcagccgctcaacccccggcctgtcctgaccacatccttgagcaggtccggccaggcactgggtgggatgcagcagtgaccaggacatgtagtcaccaggacagagggccacctgtgccagcctcctccagggccacagtccccaaaggcctggcctcagaatcatcagggagtttttgaaaacagacttccctaggggagaggggctctggggtgagtctggtgtcccacagggttgcacctgccccacggcctctagtatacagagcgctgaggtgagtccccacctgccctgcccctgctgcccagcctgtgagtgggggccgccctctcctgggactcatgggccctgcccagccatctgaagagccggctcactcctccaggccttggtcgtaaggcttcttcagccagggctccgcctgcaccccacccacccagaccaccttccagagaccaccctgcccctccaggtgcctcctagcccagcctgggaatacctccaggttgaggaagattcctgatcgacagccacactccgaggccaggatgcagcttcttagcctggctgtgcccgccacaccagagcacacaggagcctctcccctcagaagacccagagggagccctgggagactccaggcaattccgatgtgcgctggagcacagttccatcccgtgactggtgaacgacaccaggagctcgctgatgccctaacaagctcggctgtctcctcccacagccaggagggaggaagggctgcagcccagtcctgtgaagcccgttcgagccctgcctggccatccacgcctcgcccacccccgtgggctttctcgagaccagccttgtggctcatcagagggtagcggtccagccaaagctggccaagttcagctgtgcagggggcagctcaggcaagggacttcaacaagtgccccggagcccatcagccttcctccccattcacactccacagccagagcaaacaggtctgtgctaatggccccttcgggactggatggagcacacctgcttccagataacagtggctcatcctgccccgggcctcccctgaccacctctggatgcactgctggtgcagacctgctaacatagtgacctactctcccctgggacccgctggcaggtcagctgctggtggcctctcggacatcccatccatgacccaggcttggctcaagcacgtgcctgtgttctctgcccaccaaccgactcctgctgggtgcagaggcttttgagcacagcctggaccccacaaagcttgccatctcccatggagaacgatgccacaccccaaaggtccagaacaggcacactcatggggacagaaagcagacgagtgctgccagggactggggggcgggagatgactgctccaggcctatagggtgaggaaaaagctccgaaactagtcaggaggaagggctgcacaacatcgggaagctgctaaatgtcactgaattgtaaagcttaaaatggttcataacagtttatgttatgtctattttactgcacaaaaaagaatacccacctctagacagccactgaagcgaggcatgcatgggaaagggtgtgggggtgtggggtatgcaggagctggtcccgagggtcctgtcagagcctggcccaacagcccggtccggctccagcacctgccacctgtgtgcctcacactggcaggtgtgggcgggaaggatgggtcaccagggacatggcaggatagggtgcaggcaggggcctggaggggaagaacagtgggggagagagtgaggaccagggcacacctctgcctctgaacacaaaaggtgagaggagaaaagcagcccaggacatcctttctctcctccccaaaatccaggggtggccagttcaaccaaaagtcatggccctgctggctgggcagatgccaggtgaggccaacgctgatatgagaggagggaaagctgggagccaccatctgtaagaagctgacttcctccagctaccccaggaggactcccaggccccgggatccaagaacaaaccagacagtgctttgctgctgtctacggctggaactgggctgtgggtgggcctgtccccctggtctcctaggtacacacagcactcggctggggcctggaggaggaaggatgaccccttccagggccctctactctctgccttgaaaaggggtggatgacgggggcagacctccagggtcaggcagatcacaggctgtgctgctggaccagcagggaggtgatggggaggactcaaggaagcctctggggtttctagtgcaagatgagattgcgcaggaaatcagaactcagcagagactcagagcagctcccggggcagggctggcaggaggggctccatcaaggcagctgccttgtggcgctggccggtgtttctgggcagtcacctggcctggtctagctgctcctggatctgtgtgcgctgtgggctgcagcccacttctcctgctttgtgccggccctgatggtggtcccggcatgctctagggagcaggagtggtggaacagctcagcgtgccagccctgggctgagtctcaaccctctgcagccctccacctgtcttcagcctcgctgttcctgtggggggactccaagctctgagcgttcagtcggccagcaccagccccctccctcctggccgctggggagtgtggatgcctgggggctggagggcacagacccctgactgtcctgccaatgcagccagggccccatcctgggtaaggagggacactctgccggtggcccaagaggcagcatgggtaggaaagaggcccatctcccgtcccctgatgctcccataacccagcctgggtggtgccggtgcctgccaggttcctctggcctaaatggatggaatcttttctccctaagccactgctgagctggaagctgcctgttctccaatgctggtcagcgcttcatgagctgtaaaacctcgggcaaccattgcttctttccaagcctcacttcctccatctgcacagtcagagtcttctctacccagagactataaatgtgaaaatgctccctggggccggagagcctagaagattgtaagcatgcaggctgtgcagacgcacaggccccgaggcggtgccatgggccaaaccccttgccctccgaggggtgaaaagccctctctggggaagcctcttcacatcattcaacccagggcaggtgccaggggacccacccctctgaggaccaagaccgtgggatagccacccaggcctagagaaagcaggcagccctggcccaaagggccaagaagcaaaggccaggagccaggggtccagtgcggaaggctgacctcagtaggaccctgaccacgctgctcacccacattcctgtggccaaggccatgacaatgacgagaaggcagcaagggtgcctggccacggagggggaaggcctaggccaccctcggtgagtgtgtgaggggcctgaccaccagcaaggcctgccccggctccgcacgtgctggcatggagcattcgcaggccccttcctgtgtgcacccagtgcctgcaagccaggctggtccgacggagatggggccacgggcaatggggagagccaggctacacgcgccccatccaaagggggcagctgtgcctcggccccagtgagcgctccacgtggggtgtggccaggcacacacagaacttctggtctgtctcgacaagtcaaaaatggggattctctggtgcagctagtttctcattttttggagaaccacgtggtccatgtttagtccatgagctgccgtgcgcaatgattctcagggtactgtgggaggtgagaccggggcccagagatggggcagctgccctgcacagcctgcatccccaggtcgcctgcagccatcacattccacgcaggtgggccttgtctagcctggtgtctgggcagagaaattcgctcccaagtgcagtgggctgtgcctcatcatctagttccagttcttcttctctgaccttttcatttgacagcaggaaggtgcctgtcccaagtccagagatgggcaaagaagctttcttttaaaaaaaaaaaaaatgtgagacggagtctcgctctgttgccccaggctggagtgcactggtgcaacctcggctcactgcaacctccgcctcctgggttcaagcaattctcctgcctcagcctctcgagtagctgggattacaggcgcatgcaccaccatgcccggctaatttttgtatttttagtagagacggagtttcatcatgttggccagggtggtctcgaactcctaacctcaggtgatccacccgcctcggcctcccaaagtgctaggattacaggtgtgagccaccacgcccggcctcaaagaagctttctgacgctgattcaaacctaacctggagagatggtcaggcctgacccctgagggctcccgagccagcatccaccttctgactggacgcttcctggaggagactcctaaaacagccttggctacgtggcagaggctgggatgtgacctggggaccacccaggcattgtcccttgccccccattcacatacccccattcctgaggtcactggggctcctctgctggccagagtctaaacggctgggaggggtagggtggcttgctgtggcaggtggctttgagagctaacccctgagtgctcagacacaaggctcccgcgtggtgagggatgaggtaccaccagtagcggccctcccgctagcccaggggttgtggctccccagtgagagagctgtgcttaccagtgcgagcgcaggaagttcaggagcaggatggtgacgcttagagagtagcaggccaggtagggggatccgaaggccctgctcagcttgcgggtcttgtgttcccatcgtgcaacctaaaccgtgagcagagaacaagaacgagatatttcctggggagactccagggtgggggtggggagcacatgcctctctctgcttcccaggctccaaagcccccatttccaaagaagaagaattacacgggagcaacaaccacatgcaccccagctgcacattatctgccctagagcaagttccacagggattttcacacttgctcagttcatctggacggacaacaaggtccttctggaaacaactcttcaaccagacacagccatgaacccaccaagaggcagaaagagacgtctggtggagaagatctgtccctggggagacacatggggtctgacctcaggccctacctgggagctgctgagtgcatcccacagactctaaaagggccccagcagaactgccagaggagcccatggctgcaggagcacgcggccttcagagcacaggcccaaatttccgctgggggcctcacaaagtgtccatcacaggcgcaaagcaaagcaaagaaaacccctcaccctcctccctctgcccaagtgctcttctcaaggcacagactttcaaacagtgacttttagcctcagaatccttttactttgttttttttcaaactaatcacatctggaatctcaacatctggccaccaacggtggagagaagggagctcttcctgcctgcctgctgtttccacagtcctgagctggttatcgcccgggcctggcccagcacactgaggaaggaacggagaggaggggagggggcaaggaggatgcaaaaagacaagcatgcagcctggggtcaggggctgggctctaggtatgtgagcaagttgtctgtgggcccagagtaggcgcctgtgtgtgcacaggaagagcctcagaggcctgctcccagccacctacctccaccccagccccagcgatgactgctgcctgctccacttcccaagtggacctgcctttcccagcagttgcggcaggagagtgattagcgatgatttcctcaaggccactgactcccagaaggtggctccctagtgagtcctctggcccctgtcctcagagctccttggcagtggcaggctagggggcagcagatggcggggggcagggtatgccaaagtttacaggaaggagaagtgaaggaggtagctcccgggccttcccctcaaccagctgttggcactgcagccaattctcccagaaggtaagcaggccctagtccaggtctcagcaggtggccgctgctgactctgtgggaagctcaaaaggcggaaggaataagcgctgcaggggtgaggagggggctgcggtgaccttgctgggaatgtgtggggtggggtgggggcagaagaggagcagtctgcagagagcaccgcgggggcccaggaccacagcctgctttgttttgttttgttccaattctgagataaaattcaaagtagtttttagctatgcaaccatcaccacggtctaagtccagaacatttcatcaccccaagtagaaaccccgtcctccccatcccccatctgccggcccctggcaaccactcatcgctttccgttgctatggattcacctattctggacgtttcatataaactgaatcacacactacatggtcttttgtgtctggc

SEQ ID NO: 2834 - DNA, 1889 bp, Homo sapiens
taatggcctcttttgtatgtgggagaccatggtgttgaggggaggcagttacacaaaaaacccagataccgagtgttagttccatgggtgtggctggtcatggtgcgcactcacgaaggatgtaggtgatgccctccactccgcagagccagtcccacaggggtacccattctgactcctaccaccgcagctccctacctcccgcctgccatgggttccacgtgcatggctctgggcagtctgtgtctttgcgtgcgtctgtgtatgtctgcgtgtatctgcttacattcgctcagcatctgagattcacccaggcttttgcgtggatcagcggcagactcctgattgccgcgtggcggcctgttgtgtgggtgtgtgccgcgtgtgtatccagtccctactcaggagtgtacgtttccagtgtgggttgcagtcaggatccatttctcccttaactttcagattatttgctgcataggcttttttctcctaatttggcgcctttgtcagaaatcaactgacctacctgtgtgggtctgtttctgtttgtccttacgctcttgccattgccacactttagacaaggtcttgctctgtccctcaggctggagtgcagtagcgtgatctcagctcactgcacccttgacctcccatactccagcaatcccctcgcctcagtctcctgagtagtagctgcgaccacaggcgtgtgtcaccacacccggctgattttattttttttatttttattttttttgtagagacggggttttactatgttgcccaggcaggtcttgatctgggctcaagtgatgctcctgtctcagcctcccaaactactgggattacaggttgtaggtgtgagccatggtgcccggccgccacactgtcttggctacagttgggtttataataaaccctgaatcgaggtgatgtgcattttccaactcttctttttaaagattcttgtggctgtttatgtccttggtgtttccatatatgttttacaatcagtgtctcaatttctaccaaaaaaacatgccttctggaatttcaatagcaattcccttgaacgcatttttgaataccttttctgaatgtcttgaatacatgttgggaagaatcggtgtcttaacagtctccagtgtccacgcgttgactgccgtgtgtgactccagtcggcgtctcaacagtctccagtgtccacgcgttgactgccgtgtgtgactccagtcggcgtctcagcagtctccagtgtccacgcgttgactgccgtgtgtgactccagtcggcgtctcagcagtctccagtgtccacgcgttgactgccgtgtgtgactccagtcggcgtctcagcagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccatgcgttgactgccatgtatgactccaggtattgagttcatcttcaacttctcccaacaatgaactggagttttctgtg

SEQ ID NO: 2835 - DNA, 8030 bp, Homo sapiens
ggccgaggcgggtggatcacctgaggtcaggggttcgggaccagcctgaccaacatagtgaaaccccgtctctactaaaaatacaaaatttagcagggcgtggtggcacgtgcctgtaatcccagctactcaggaggctgaggcaggagaatctcttgaacccgggaggcggaggttgcagtgagccgagatcatgccattgcactctagcctgggtgatagagcgagactccgtcgcaaaaaaaataaaaaggatatagcagctgcccagctgcaggccacagtccattccacagggagctgtgcatcccacaggacatgctgctgtcccactattttgatgagttcacacagaaaggacctggagaagaggaagcagcaagtgcactagaagtcttggtaaggcacagtgtgacaaagagtagaagattaataacgagatagggggctgccactccaacgaagttcctgaggtctagaggactaagaggtggcagcgtattttctccaaagtgcatgacaaattgctgcaccttggtccccttcctctaagaaggagggacaaacctctgagagcttctttccattttggaggcagcagaataccacatcaggtgtcgtgacctggcacatttatcaggtgacttgaaaacctggtagctttgagtggtgctaagcaagagaagtatattctctagtgggtcgaagccaaattcacatcgcagagtactagcaactatacatgatcgtggccccaagccaagttcaaagagctctgccactcaaccctttagctttaggagagcctgtggtgctcaaagtggcagttaaaataccctaaaaggggatcacaatgcaaaaccaaagctttttaagttgagctactctccttcagcaaattactatccatatacatatatatatatatattcagagatagggtctcactatgtcacctaggcttgagtgcagtggtgctataacagctcactgcagcctcgacctcccaggctcaagtgatcctcccacctcagactctttagtagctgggaccataggtgtgtgccacgatgcccagctaattttttctattttttgtttttttgtagagatggggttctgctatgttgcccaggctagtctcaaactcctgggctcaagagatcctcttgccttggcctcctaaagtgctggaattataagcatgagccaccatgcccagcctgctaacctcttaaggagaaagagctcctggccttgtcactaggccctagtggggaataaacaccaggctgcgggatgccacagggccatgtactcatcataactgggtgctgtatgacaccctcctactaaggttgagtgtcccctgcagcactccatcactgaatagaagtggtataaaccaaacttgcccaatgtggaccccaaagtttcccatgaataggtcactcacatcagcttggacccaaaaggtaatgaaggacttaaacttatcctatagacagattttttagcatgggcttttttttttttgagacagagtcttgctctgtcacccaggctggagtgcggtggcatgatctcggctcaccgcaagctccgcctcccaggttcacgccattctcctgcctcagtctgccgagtagctgggactacaggcacccgccaccatgcccggctaattattttgtatttttttagtagagatggggtttcaccatgttagccaggatggtctcgatctcctgacctcctgatccgcccgcctcggtctcccaaagtgctgggattacaggcgtgagccaccgttcctggtctagcatggacttcttttgcctcttttcctttccttttttttttttttttgagatggagtctcactcttgtctaccaggctggagtgcagtggcacaatcttggctcactgcaacctctgcctcctgggttcaggtgattctcctgcctcagcctgccgagtagctgggattacaggcgtctccaccaccatgcccgtctaatttttgtagttttagtagagatggggtttcaccatgttggccaggctggtcttgaactcctgacctcaggtgatccccccgcctcagtctaccaaagtgctgggattacaggcaggagccactgcacccggcctgtccctttttcaaaagatttggttggacaaaaagtcttagatgaagcagaatttgaagactggtttcaaggaggtacggggaaacactaagtgggtgaatcttttaaaattagcccagaacctgaaaatatagctgggcgcggtggctcacgcctgtaatcccggcactttgggaggctgaggtgggtgaatcacctgaggtcaggagttcgagaccagcctgaccaacatggagaaaccccatctctactaaaaatacaaaattagccaggcgtgctggtgggcgcctgtaattccaactactcgggaggctgaggcaggaaaatcactggaacccgggaggcggaggttgcggtgagccgagatcacgccattgcactccagcctgggcaacaagagcgaaactccgtctcaaaaaaaataaaaaataaaaaataaaaaataaaataaaattagcccagaacgtgaaaatatacataaatatatttctgcttatcagaagccccctcccactacaaagaggctcttcataagcagatggacaatatgaccctctatctgtagatggcattcaactgccttccttgaccatcccggtgcttactcagttgggtgataaacaaagcaaatagggtagcaaggacagaaaatgcacatgggctgaacaataggggcttcctgtcaccaagatggttgtgttcccctacacaaccaaccctgagcacccaacaatggcaacacatttcagagctccagtcagctgctgaatggaagaactacatccccctgtcctggggaggggaacagacatttgctttaattacaataggcatacatgctaaacttgaatttttaatttcttcctttcatgcttatgccaactgtaccaggtatcatgagatagccgcgcaatagttattacctccgtcttcttcgtgggaagagccccacttttgtttgcgactgttcccctactccccacggtgcagatatgagcccagtggtctaatccagtcttgctgatccagtgctggtgctatggtttgaaggtttgtgtctcttccaaaattcaggttgaaatttaatttccaatgcaacggtatttagaggtgggcctttgggagattgattaggccatgagaactccaccttcattgatgggactagtgctttataaaagggctggagggaactaggcaggctctttttgccttttgcccttttgtctttcaccatatgaggacacagcattcgccctttctgccatgtgaggacacagggacaaggcaccatcttggaagcagaaagagtagccctcacggtacactgcatctgctgggtgccttgatcttggacttcacagcctccagaactgtgagaaagtaaatttctgttctttatacattatccagtctcagttattttgttatggcaacaaaaatagactaagattgctagtaagcgagctgttttgagacaggggctcactgtgtcatccaggctggagtacagtggcacaatcaaggctcactgcagcctcgatctcctgggctcaggtgatcttcctgccgcaacctcccgagtagctgagtctacaggcatgcaccaccataactggttaatttttttttttttgagatggagtcttgttctgttgcccaggctggagtgcagtggtatgatcttggctcactgcaacctctgccttgcggggtcaagcgattctcctgcctcagcctcccgagtagccaggactacaggcgtgtgccaccacgccctgctaatttttgtatgtttagtagagataggttttcaccatgttggtcaggctggtctcaagctcctgaccttaggtgatccacccgcctcagcctctcaaagtgctgggattacgggcatgagccactgcacccagcccattcctagctaattttttgtagagatggggtctcaccatattgcccagactgttctcaaactcctggacccatgcaatctgccccgctcagcctcccaaaatgctgggattatgtgggtgagccaccatgcctcaccaggcctggcttctaagaacttctttcatgctatgagctgccccactatccttccagctattacatttttgattctgttatcagagtcagtttgtattctttgaaatccaagaactgcattagatatgcaggaggagagtgaggcccaggaagaaaataacttgtttaaggtcagttagcacttgttggcagacatgaaattagaaaccaggagtcctccctctcttgtagcacaggactgtttgctctaccaaacccttgaagacgtgtcttgcaaggtgaaactccaggcagagtaagaggctggatgaggagctgatctgggcctggagcttgccgggcctcttccttcttccacattcctcagcctgcaggctgcagcgctcctcattaaagggcattcagggggtatgcaggaagcacttaccttcccagcgtgatggccaagggacctgcaagcagtgctccaaagaggcctcccaggggatacagagacacgatgagggaccacataagcaggactaggtgatcgggcagtggctctccagtacgcgcctgccatgtctcattggtgaattcctgaatgtgctgtggacagaaatgccagtcagccttctggggatggtggcgtgggggtgctagatgaaacaagccttctccccaacagggctccatgcctctgcagaacaggcaatgacaacaggcaccgtgtcttctgagctccccctggagcaggaaccaactcgcctgagcacctcccttgtgcagggcaccatgctggttctttcatgggcaatatctctcagagcctagcactggactcgctccatttgcccctctctgcgaaaacactatttctctctactcacacaatactcctgacagcaaatgtgtggatattttcccacatcaagcaattctctaactctccggacacaagctgggtgtactacaatgtaatcccattctgacactatccacctggagttagcatcaaatcccacaagtcaaagggctccattccacaagactgtcccctcttcagatgccaagtgcaactcctgcacttctgaccaactggccatcaattggggattcctaggatcctttctgtgggtttgataatttgcaacaatggctcacgaaactcaggaaggccctttacttacatttactggtttgttatgaaggatacaactcatgaatagccagatgggaaagatgcactgggcctgatcctgggagagtaggttgctagaggcttccatgtcccctccaggagcaccaccttcccagcacctcaatgtgttcatgaacctggaagctcatcaaatcttgtcattcaagagtttttatagaccttaatcttcagctcctctccctttcctagagctccgtgagtggggctgaacattcggaccctctaatctcttggtctttttggtgaccagctccatcctgaggcaatctagtggccctaccctgtcatctcattaccataagcgcaggtatgatgaaatggggctcattgcaaataacaaaagatgctcctatcactcaagaaattccgtggccaggcacggtggctcacacctgtaatcacagcactttgggaggccgagatgggcgtatcacctcaggtcaggaattcaagaccagcctggccaacatggtgaaacctcatctctactaaaaatacaaaaaaaaaaaaattagccaggtgtgatggcaggcacctgtaatcccagctacttgggaggctgaggcagaagaattgcttgaacccgggaggtggaggttgcagtgagccaagattgcaccattgcactccagtgacaagagcaaaactacgtctgaaaaaaaaaaaattccaagagttttaggagctctgtgcctggaaccaaggacaaagatctattatatttcttattataccatacccgaggaatccactgcagtcccctcccaccctgcttttgccccagggagccacctgtgcagcccacatcagtaggctcccttactgaccaacttggccaatggtgagcaccagcaggacatcaggaggcaggagagagaagtaggagtgtctgttccctggctccctccctgggaggttgcctcagcctggctgcgatcctctcaaggggacctatgtctctttccttccaatttcagtaatctctccatccactggtcatagctcagagcagcctccagctcctgggctcaagcgaccctcctgcctcagcctcctgagtagctgaaactaacaggcacataccagcatgccaggctaatttttaaatttttttgtagagacagggtctcactatgttgcccaggctgttctccaattcctggcctcaagcaatcctcctgcttcagcctcccaaagcaccgggattacagacatgagcaaccatgcccagccttggtcactgtcaagactggggattaggctcagggagaggtgaaatgacttgctcacagcgttagccacaggtcagagttgtaccaggtagtttggactccccagactccaaacctcaggtgagtgaagggaagccacatggttaggaaagacatgaggaagacatggacacccttctcttggttagagatgaaatgtcatttgcaggtctcctgacagaacagaacacaagggagagcagcgggttcaggtgctgggccagctctcccctgcccagctcagggcaatgactgtcagcctagtgcccaccagctgcctctcgggggaggaactgtccacaggagctgggaccagggccagcctcccctgacattgggtggaactcctcaagagtgaccattgacaaagattctcctcagagttttctaagctcttttttccttttttctttctttttttttttttaaagatagtgtctccctctgttgtccaggctagagtgcagtggcatgatcatagctcactgtagcctcgaactcctgggctcgagccatcctccaacctcagcctcacagatccctacaactacaggcccatgccattgtgccctgttgcattttttttacttttttgtagatactgggtctcactgtgttgcttaggctggtctcaaactccggggctcaagcaatcctcccacctcggcctctcaaagtgttcggattagaagcatggaccactgcacccggccttctgagctctttttcaactaggtctcaacttttggacttctgtgttcatctctgccttgttcaattttagcaagtatcgtgctaagttggtttagctagaatcctcatcctccacatctgatcactctcaaaatctaatcggcctccttatcctctgccatcctccatgatgtctagttaccctggcctgccctcaacaagaatcctgttaggacaatttaaccagaatcccccacaaatgcctgatgatcctcttagtcattgtgcacccgctgaccccactctgctccttggctatcagttctcacttgcccattgctgtatttgaagttgagtccaacctttctgcctcagggcaggaccccattgccacggtccctacaactagtgcttgccacctcttgaataaagtcttcattactgtgctttgacaagtgtcattgaatagttttttgtttttgtttttgagatggagttttgctcttgttgcccaggctggagtgcaatgatgcaatcttggctcactgcaacctctgcttcccaggttcaagcaattctcctgcctcagcctcccaagtagctgcgattataggcatgcgccaccatgcttggttaattttgtatttttagtagag

SEQ ID NO: 2836 - DNA, 384 bp, Homo sapiens
gagcctgagagcaggtccccggacaacaggacccagctggtccccgcgtgcatgccagggggacgctggtgccctggagccaacatctgcttgccgctggacgcctcctgccacccccaggcctgcgccaatggctgcacgtcagggccagggctactcggggccccctatgcgctatggagagagttcctcttctccgttcccgcggggccccccgcgcagtactcggtcaccctccacagccaggatgtcctcatgctccctggtgacctcgttggcttgcagcacgacgctggccctggcgccctcctgcactgctcgccggctcccggccaccctggtccccaggccccgtacctctccgccaacgcctcgtcatggctg

SEQ ID NO: 2837 - DNA, 6758 bp, Homo sapiens
aagaatcaagaacaaagccctgacctgttcaggacagcaaagacaaggctgggtttccagcagaagccagagtgcggccggtgctgaggagtctcttctgagcaccacgtcccttggcaatgccgccgaaaaagagagctcctggccgagaatcacatgaaaatggacggggacgtttataccaacacaacgccctctcagccccatcgtgcacaaacgcagcgcagagccccagtcttgagagtggagcagccaagccaggggggactctgggcccctctgccacccacagccccagtggccgaggcccagggcagcgcaaggttgcccatcagtggaggtgggaggtcattcccacctccacttgcctgcccggagcagaaagggatgcaggaggaagcaagacggcttacctggccatggctgaagaagagcagggctcccgagtacatgagctcccgggcctccgtgtgcttgctctgggacatgtacctgccacagagaggagaccgtgagccacgcccacgtgccctcgccaccgcgctcccccgctcatcttcaggtcagaagctaaaaacaaggcgcccaggaacaggtggcatcctaaaagcagccgctcccagggcccaggtgctgcgtggagggggtctatcctgggtgtcctgctgaccatgagggctgcatggggcgcctctggacactaagggcctatctgtgtccaaatacaccaggagccagaaagcagcctcaccctggagcagctcaccggtttcagtagctgggaccagaaaggccactgggcagggcaggtgcgcagggaaggagcaggggatgtgcatgtggccacctgagagctgagtggccacaggcaggagccaaaggatggggggctccaggctggggtcccacgggggacagtaacggctgtgacagcaccttcttcccccacggggccagtgtccccgccctctgcccctctgcgtgccacacccctccccccacgggagggaagggtctggggtgccccgttgcatcatgctcgccctgcatcacgtccccactcccagagcaccgctggcagggaaagctggagctcctcaggccgcacggggacagaggcacggggtggcgagaggtatggtggggaccagcgcgtgacagacgatgtggagagaagccgagatggccgcactgctgtaagcagcagagcccctgcctgcgagagcagcaggcgtggagggcaggaggcagcctctgcttggatgcgctgcacctcccagtccagtggtggggcccagaacatgttatttcattggctacacgtttttcttaatgatcgctgccttattatcaaaagatacataacgagttaatcagctctgtgcctgcgagccaaatgtccttggacaaagccttgtttaaaaataaatctagttaaagaaaaatactaagtaaacagcagtgcacaccggattcgggggctcacacctgtaatctcagccctttgggaggctgaggtgggaggatcgcttgagctcatgagtttgagactggcctgagcaacatagtgagaccctgtctctacaaaaaacacagaaattagctgggcatggtggtgtgcacctgtggtcccagctactcgggaggctgaggtgggaggactgcttgagtccgggtagtcaaggccgcagtaagccatgattgcaccactgcctagacggatgacagagcgaggcgccatccccccaaaacaaacaaacaaaaaccaattgcagtggaggtgataaagagccacagcaacgccactgaggaccagaatgaccttggtgttgccaggacgggaaggccagccgagaacgcaaagggttggatgctcagttaaccacagaaaagggctcctcttcagaaggcaccacagccagggaccccaaacacagacagccccgccacatccgggcatctcattagcctggcacacaggccctccccccacaggagaccgcttcgtgctgcacagaggcagggcaccaggagggaaaagcccgcacccaagagagaaagtgcccccgcacccccgtcagcctgcaggccgttggcaggcctccggttttgctgtgctccccgcacagtgaaggttctggagggagacccaccccaacaccacagcaggagcctcgacaggaccactgactctgtgaccggccgtcctagttccagtcctgcagggacatgactgactcagaggaggccgggagccgtctggcacagggcactctggaaaaacaagctcccagacacgcctggcctcacgatgccgccagtggggccacgggcagaaccgcatgcaccgaccctgagcaagcaccacaccagcttctgctttgccgatactacagcgttctggatgcttctatctgaggtaaagcaagaggtggcgacttagaaaccagaagaaaaaaaggactccctggaaggcagtgacccatattcctgcacgaggagcctgctctggggggcactgccgatggtcacggcccccggcctggtttggactgcgccttgcagccggctcccttcttccctgggcagctgggagccgggcaaggggaaaaaggacgggaggagaattctgggcacacagtggtccccggcctggctgggggcacccgtttccaggtccaggaatgccggtgacaggcaaaccgtctaaggcggctctgaacgtggacggcttctcctcctgtactggagaattctggaagctgcgaaggattttggtttccaggtgactaagccaggacaggtaccctctcaagcccgaggccggggagagtggggggcagctgggcatggccgggccttctcccggcccggctctgcatgctgcgcactattggccgtgccatgtggacacccagacgtgccttccagatagggaaatggcttctgcctgctgacaggcgctgagagccagtgagcgctggtgctctctgccggccaaaacatctgtatccacagagcaaagtgtctgggcaaacaatctagctgattttgctcttctcttacaaaaacattaaaaagcagaacacagaaacgcaagcattagaactagtggccgagactgtcggtgtcaaatgaagaaagaccgagctcatggggcgaatcccgcccttctctcttggcagacggaagctggcttgcgcgttcagctgtcagggacacgtgaaggatgaagaggaaatactcaagacacacacaggtgcctcgggacagggggccagaggagatttcacaaggacccctccgccgactgccgcgagctaaagcgcactcacgcccggacgcagggctggctggacgcgcctgtaaggagggctgaggcctgctctgctctgccaggagtcactccgagaagggacctgagccggcaggtacagctccttcacaagacgctcctcttaggccctgggctaggggtgcaccgcacacactagaccgttttccttttaaaaatctctttagatgactgaagagacaaaagaaggtcagaggccgcaataaaaaaaatcacgcaaacacactgcaggaggagccaagtggcaggaagagccagacccacgaccgtgtgggcagacagggggacagctgctgcaggtcacagcctcctgggctgtggtctcagccacaccaagtttctaaatgccaatgtacaaatactacagccaaggctgaggctcctcaagacctggatggtggctccgaagtgccccaataatccagttggcctgggagatgactccccgtcccagcagggagaagtctggagaaagcaggtgatgaccacaacccgcgccatccccggggcaaggtcggccgcccacaacccgcgccatccccggggcaaggtcggccgcccacaacccgcgccatccccggggcaaggtcggccgcccacaacccgcgccatccctggagcaaggtcggccgcccacaacccgcgccatccccggggcaaggtcggccgcccataactcgcgccatccatggggcaaggtcagctgctctctagcgtaaccagatgaaccaggtcagtttctctctagcgtaaccacacgaaccaggaactgctgcccgacttctgcggggcacatatccaaggacaccaacctgctgggttcccaattccttccctctccttcaccttcaactgctgtggctgtgagttaaaatggcatctcttgggaacgcttgtacctgctggtgggagtgtaaattagttgaaccatcctggaaagcagtctggcaattcttaaaagaactaaaaacagaactaccgttcgacccagcaaccccactactgggttatgtccagaggactctaaatggttctaccatgaagacacacgcactcaaatgcccactgcagcaccactcacaacagcaccgacatggaatcaagctggggcctgtcagcggcagacggataaagaggatgtggtccatatacaccgcggaatactatgcagccataaaaaggaacaagatcatgccctttgcaggaacttggatggagctggaggccattatccttcgcaaactaatgcggggacagaatcccgggcactacacttccccacttacaagtggaagctgaatgatgagaacacagggacagaaaggggccaacaacacacactggggccggcctgagggaagagggagaggctcagaaaaccattttaacaaaactgtcaggtacccatgcttggtacccggtgctgaaatgatctgtaggacaaaccctagtcactagtttacctatataccaagcctgcacacagacctgaggctaaaataaacattagcatatttaaaaataaatcaacaaagcctgcacacctgcccgaggctaaaataaacataagaatatttaaaaataagtcaacaaacagtatcttttggtaaatttacccgacagctgaagggataaacaattgtgctggagacacacagggaaaaccactcagcgataaaaggaactgcggacgctccaggaggagtctcccagcctccgtggtgaatgaattcaagcggttagacagaaagtgcgcactgtgattccacatacgtaaaactccaggaaacaccacctcacctaagtgcagcccgcagatgcacgggtgccggggatggggtggggtggggtgggagtgggggcgaggaggcctggttgcagagccccacagtgccgtggtatcttctgtgtcttgactggtcatagttcattcatgtcagacctcaccaaattatacattttacataaatatttaaatgtaaatgtgcaattacatatatttattgacataaaagcattttaaaaaatggctgggtgctatggctcccacctataatccccgcactttgggaggctggggcgggcgtatcacctgaggtcaggagttcgagaccagcctggccaacaaggtgaaactccgtctctacaaaaaatacaaaaattggccaggcgtggtggcgggcacctgtagtcccagctactcatgaggctgaggcacgagaattgcctgaacccaagaggcagaggctgcagtgagctgagatcgcgccactgctctccagtctgagcgacagagcaagactctgtctcaaaaaacaaaaagcgtaacttggggaatgtgacttctctggcggcgatacacccatggaatactctgaagcagagctgggaatccacacggaattctaccctggaaagacaacgacagtgtctcagtgggtgacagcgaggtgacagctgccgctgctgactcagtcttcattcctggcttgaaaggctccaagccaaggtttgagaggttcagtaacgtgtcccgggccccgtaagaggtggcgtgtgaccccaaagcccaggctttccgagctaagccacaccgtgcccctgccaggtgacctcacgatgtcacatgcggccagcagggcctgctgtctagagggcttaagggagcagaatgctcatcaccccccgtttcactgtgaaaattcacccttgaccagggactcatcactgaaaaccaaaactgacaaatccctcgtcaccgtagaagtggctcaaaacaaggaacactgtgtttatttcgggggagatccatttttgctggttaatcactgggcaaatatttatttatttatcgagacagagtttctctcatcgcccaggctggagcgcagtggcgtgacctcggctcaccacaacctccgcctcctgggttcaagcgattctcctgcctcagcctctggagcagctgggattataggcatgcgccaccacacccagctaattctgtatttttagtagagacagggtttctccatgttggccaggctggtcttgaactcccaacctcaggtgatctgcccgcctcggcctcccagagtgttgggattacaggcatgagccactgcgcccggcaaattgggcaaatatttatatacaaattcctaggcacggcaggcatcagggtgaatgctgaacaacataaaagttccccatcacacagctctatggctggcccctctacccacgggaaggctcgcgttgtacggtttagtgcctcctgacacctttgccttgatccctgaagaacaatcgggttgaaggcgctatcacaacccgtgccatttgggagctgctaaatgttcagtgacaaattcaactggcattaaaaacgtattgctataaa

SEQ ID NO: 2838 - DNA, 2287 bp, Homo sapiens
ggtttactctaggtttccacaccctgatgctcctgcctttactttgacacctctgactgccaggttttcacagacctgttgacagtgactcaagatctggaatgtaatggatggtttggcaacagtgtttgcttgagcagtttaaaatctggccagggagactcaatgtgagcaagaaaatgatagaataccaagttttctggaggtcagagggagctgagttgagtgttaccgagaatgctgtggggtttgagatgagaaaaatagcttgctaatttaaaagacggattatttttccctaaagaccttgacttatgtaaatgtatattatccataattttaaaaatccacttatggctgggcacagaagctcacacctgtaatcccagcactttgggaggctgaggcaggaggatcagttgagtccaggagttcgagaccagcctgggcaacatagtgaaaccctgtatctacaaaacatagaaaaactagttgggtgtggtggtgtgtacctgtagttccagctactagggaggtaggaagatcacctgagcccatggagattgaggctgtggtgagctgtgaaggcaccacagcactctggcctgggcaagagtgggactctctcaaaaaaaaaaaaaaaaaaaaatccacatatccagccttccaagtcagtctttaataatgtgcacgggccaggcacagtggctcacacccgtaatcccaacactttggaatattagggtgggagcatcacttgaggccaggaatttgagaccagcctgggcaacatagtgagactgccccccccatctctacaaaaaataaaaatcaaaaataatactgtgggcaaactttacttagattttattcagagtagtgcctgtttatttttcatctgtgctacctgtgccggcattccatatgcatttgatttagtctttaaagtaccccggtaaaataggtcttttgtctgcatttttcagatgggaagactgaggttttgtttatttatttttatttatttattttttgagacggagtctcgctctgttgcctaggctggagtgcgatggcacaatcttggctcactacaacctccgcttcctgggttcaagcgattctcctgcctcagcctcctgagtagctaggattacaggcgcccacaaccgcacccggctaattttttgtatctttagtagagacagggtttcactatgttgtccaagctggtttcgaattcctgacctcaggtgatccacccgcctctgcctcccaaaatgttgggattacaggcgtgagccaccacgcccagcctatttatttatttttttagaatcaagatcttgctatgttgcccaggctgaactcgaactcctgggctcaagcaatcctgcctcccaagccaagcagctggtactgcaagcatgtgccaccgtgcctggctcctgaagactgaggttggtttagattaatgagttgcccaaattcagacagttcttaagtggcaaagttaggattccaacccaggtcaacataactaaagcccaaaccccatctcacccctctaggccatcaagtattggctgggtgcggtggtttatgtctgtaatcccagcactttgggaggcggaggcgggaggactgtttgagctcaggagtttgagaccagcctgggcaacataacaagaccctgtctctacaaaaatatataaattagccgggtgtactggctcacacctgtagctacttgggaggctgaggtgggaggatcgcttgagcctgggaggtcaaggctgcggtgacctgtgattgcaccaccaggagaccctgtcttaaaaatgtatatataaaaataaaaagaacatcagacatcaccatcacctcgcttagaatccatggggccttctcctcaaattcaatcttcccaggcatttcatgaacttgcgtctagtttctgttccctctcaaattgcccaggctgtcctgtgagtgacagcagctatttcgtgggcctcctctggaatcatgagaagtcacccaaacaatctcagttttctagctcactccgtcttgacatttctacactgtcatccttggttttcttggaaattaatttgcttttcttcattgtctttctttggagctgctttccttttgttggttactattttatttttagcttctcacaccataccgacatatgttggttattcttttagacatgttttttgttgttgttgtcacctggaacttttgtatcttgaataaatttggggatcaaata

SEQ ID NO: 2839 - DNA, 1440 bp, Homo sapiens
ctggtataatagtctctctctcgcagtgttgccgtatggattcagggtgatttaatgacctcaacagagctctggaacatttgcgtagctggcagggcaaggcgagggacagcccaacgaaggcaggtccttgaagtcctggttaacactggtttccaaaattcgagccggcctgcggtttttccagcacgcctgaaagctggggacactcatgcaccagtgttggaggctgtagcctttgaccaggcatgggaccaggaggtgaggccggctctcaggcatcaaccaaaggatccactgaatctcccttctccccctgccaacaaaggtacaagtagatgttgacaccccctcagacatggaaggagacccatttttttctttttctagttctggataaatggccttaaacaaaatatgcaaacaggctccttgcgtctcccaaaggcagcccaccacagaagccctgccacagcccaaggggttagatgctgccaggatctgtttccgccacagagcagctctgtgcagcacgttcctgccaaccaccctgagtgcttcagggcttccgaggccgtgacagtgagggcagcggcacttctgggtcaccgtgggacaggtctctgcctcaggacacggattgacaagctctctgagtgggccaggagctccttaatgtgagccaagcccagccctgccaccttggccccgttcacctcgaggatctcatcgcccacccccagcagccctgagtacagcttggccatgctcatgtcagccatctcctgcacgtagatccctgcagaggaaaacaggagaatttcacaatgacacccaaatcgaagaagtgcatctctggaatgctgaccatgttgatgaggtgctgtttgtgtggcacagggaggaggtgctcataccaggcacttctctgtgcgcatgcacacatacacacacccctcattattccatctcacaaccacaactggctttagacatagatacagtgcgcctcctccatggtctaactccattccactgtctctgcttttaaagtggaaatgctcctagtgcaaataacgcgttaaactgttgtcatttatttatacctgacagtgagtgagctaatctttttctgagatgagcttttcttgtagaattgggaggaaaatagtttttaaaaattaggaaccatacctactcagtgcctggcactatgatccagttgctgcctcaggtcacccaggcccagcgtaaaggccggggtggtgggaaggtatcatcggaagagcaaaagtggctgagccacatccaagcctggtttgctgcactctattgccaaagactgacactggcctcagtcttactcagatatggctcctcaattgggatggggaagcatctgagcaaaaaaccccaggaaaaataaaaattctagccaca

SEQ ID NO: 2840 - DNA, 6932 bp, Homo sapiens
aaaaagaaaaggccatacagtttcctctggctctcaagaagctccttcttgaaacccagctgccatgctgtaaggaagcacaggccacaggaagaagtcatgtgtaggcattctggctggcagcccaagctgggccccagataagtgccagtactggttaaccaccaggtatctgaggaagttttaagacgacaccaacctcagccaacatcttactaaaatcacatgagcgcccccaagtgataacagcctaattaagtccagtcaacccctgggactataagagataataaaatgattgttaatttaagccactaagttttggggtgattagtgatgcattaggtaactggaacaactatgccacaatctgtccattctccagttgctggatatttgtttccacatttatgctattacaaacagcactgctgtgaacattctcatacatgtcttttgcatgtacgtggaagtttctccagggtatatatttgctaggagagtaactgctgggttggaaagtgtgtcaccttcaactttaccacaacctaccaaactattttccaagatggttggtaccagcttacattccatcagcaaagtatatcctcccattactccaaatcttccctaacacttgagacttaaggtttttgccagtctactgggtgcacaatggtcttatttcatatccttttaaggactggaattttgtactgttcccatgaattaatccaaaataagtgcttaaacctatagtaatgttgcttttttaaattttttattttttcgagacaggggctcactctgttgcccaggctagagtgcagtgtcgtgatcacagctcactgcagcttctacctgttgcgctcaagtgatcctcctgcgctaatttttaaattttttgtagagatggagtttcaccatgttgcccagtctggtctggaactcctgggctgaagagatctgcctgccttggcctccccaagtgttgggattacaggcatgagccaccatgcccagcccgcttttcctttttaagaatgatttacacattggggttccatattaaggcttcattttctaaaagggagttgtcactgggtatgatggctcatgcctgtaattcctacaattacaggcaagaggcaggaggatcatctgagtccaggagttcaaggctgcagtaagctacgattgtgcctctgcaatctggcctgggtgacagagcaagatcctgtctccataatcccagctactcgggaggcagaggctgcagtgagattacaccactgcactctggcctgggcaacagagggagactctgtctcaaaaaaaaaaaaggtatagaaaaaaagaagggaggctccagtagcagccaagcacatctcatgcctagatcttggtttccaccactgttctgcaattaaaaggaccaggctccttggaaaaatggttggctccaggactggggcaggaaatattcaagatgagcctgcagcatctctagagcctgaaagtaaggacacagtaaaaacaaaaacaaggctgggtgcggtggttcacgcctataatcccagcactttgggaggctgaggcgggcagatcaactgaggtcagaagttcaagaccagcctgaacaatatgatgaaaccccatctctattaaaaatacaaaaattagccaggcatcgtggcatgtgcctgtaatcccagctactcaggaggctaaggcaggagatcacttgaactcaggaggcggaggttgtggtgagctgagattgcaccattgcactccagcctgggcaacaagaacgaaactccgtctcaaaaacaaaaacaatgggagtataacaagtcaaagggactctggaaccaactgaaagagctccccatggccaaagtcagactaatgtgagtgacaaaataaagaaagtaacgttggatgataacctcaaatacaaagtaaatatccctgagtccaaactcataaaaataaatgactaagttactaaatgaggagaagagacacatttcctttgcagaagaattccaaataatttatgtaaatcccttgcccccaaggagatggagcataaaccccccaactccttacatgcaggctgtgcagtgaattccttccaaagaggacaaggtgtaaagggagaaagaagagtagctttacaaagtggagaaacttgacaaacaggtgatcaggatgaacaaaaacagtggtgaatcatgtggtcagtgtgtccccttgatatgtgatgaaatgacacttcccctttgaggtcttcctccaaaaaacacgtaactccagtgtaatcatgagaaaaatatcagacaaatcccagctgaggggcatcccataatatgtctgaccagaactcttcgaaactatcaaagtaggcatcaaaaccaaagaaagtctgagcaactgccctagccaagaggaacctaaggagacacgacaactccttacttgtcaatataaatgtctggagccagaatgttatcaaatttgataacataatgtcatatgagatcctggaacagtaaaatacattaggcaaaactaaggcaatctgaataaactatagactttagttaatactaatggatcgatattatttcattaattgtgacaaacgtaccaccccaatgtcagatgtcattaatattaggagtaactgagcgtggggtatacagcagctctctgcactatcttctcaattttttctgcaactctaaaactattctaaggccaggtgtggtggctcatgcctgtaatcccaacattttgggaggctgaggtgagtacatcgcttgagctcaggaatctgagaccagctagggcaatatagtgagacctcgtctctacaagaaaaaaaacaactggccgggcatggtggctcacgcctgtaatcccagcactttgggaggccgaagtgagcaaatcgcctgaggtcaggaattcgagaccagcctggttaacacggtgaaaccccatatctactaaaaataaaaaattagccaggcatggtggcgcatgcctgtaatcccagccactcaggaggctgaggcaggagaattgcttgaacccggcagacgcaggctacagtgagccgagatcaccccactgcactccagcctgggcgagagagtgacactccatctcaaaaaaaaaaaaaaatttaaattaaaaaattagctgagcatggtggcaggtgcccgtagccccaggtactcaggaggctgaggcaataggatcacttgagcctggtaggtggaggctacagtgagctgggatcataccactgcactccagtctgggtgacagagcaagcccctatctataaatgaataaataaagctgttctaaaaataaagtctattacaaaaaaaaaaagagagagagagagagagatttagccctgattttgcaaagggaaatgtctcctctgctgcaggaccccgacaggccttcaaagttgggtctatagttgcagcacttgccaaactaactcaggtcagatgcccaaaggaggggtggaggtggctgcagctcaactcttggctcatctcagcagcagggggcttgggcactggagaaaggggggctgaggctggcccaggccttggccacttgccacagatactgctagtttgcatctggctttagtatccactgatgtgggctaccagaggaagggatgtgtccagaggtggccttgtctcagggcgaccatccacacagaatcactctgctgggctgctgcaggtctggttctgccattcagcatgagccctgggctcgctgcaccaccatctcctcatccgtttatgggatgagaataggaagaccctgccttttatgatgttgccctcaggattcgacaagtccaacaacttagccaagcgttgatttagtacttcctggcacacaggtggtagtcaacgttagctctcagcatcccctgacccaactcctccagcggtctccagctggaagagtccaactgctcttcattcctttatgaaatggggtggtcactgtgtaaataaatcacctgaaggatgccaatcatcttggaggagaggctagttcagatctgcaacggactcatcaccagtatttgcacttaaataatgtaatgtaataatgtgttcttcgaagtcacccctgaattgatcccatgtgtaaggaaaattgttcattctaggactacttgtaatagcacgaggtaggaaacaacctgaatttccttcaaaaaggaactggttaaataaattagactactaagacacgtgtatgcttgtacatggatcctatatgctcctctgctgtgtgtgtgtgtgtgtgtgtacatctcactggaaagattacacaagaaattggttaacatttgtagtctctgaggaagggactagggggctaggagacatgggaagatacttttcactgtagagacttttgtatcttttgcattttgaaccatgtgaatgtattcttaatttttttttttcgagacaagagtcttgctctgttgcccaagtggagttgcagtggtgcgatcacagctcactgcagcttcaacctcctgggctcaagggatcctcccacctcagccttacaagtagctgggaatacaggcatgatccaccaaacgtggctgtgaatgtattatttatgctcaaaaatgcctaacagacagggcatggtggctcatgcctgtaatcccaacactttggaaagctgagatgggaggattgcttgagactagtagtttgagaccagcctgggcaacatagaaagaccctgtctctaaaaaactaaaagtaaaaagtgcttaatagaatcagtgaaaaaaaaaaatctacccctgtgggtcatggctgttggggcgggctcgggagaactgccaagtcaaatgtataacgggtgggccactgtgactctggagcagctgggaggtggaggcggcatcggctcaggtcacaaggatgtggctctcaaggcgagcagcatcctagctgcaaatgcttcctaggacaagccaataaggttggtgcggacatctacacatggacaactctagagagtccaaatccactgttttttttttgtttttttttttgagacagtctcactctgtcgcccaggctggagtgtagtggtatgatctctgctcacggcaacctccgcctcctgggttcaagtgattctcgtgtctcagcctcccaagtagctgtgattacaggcgtgcaccaacacaccggccaatttttgtatttttagtagagatggggttttgccatgttggccaggctggtcctgaactcctgacttccaagtgatccacctgcctcagcctcccaaagtgctgggattacaggcgtaagccaccatgccaggtccaaaatcactgtcttaagacctccgccttgacccttctccaaaagggctatgtttcaaatctgctatcaaggcagcccaggtggctgggtgcagtggctcatgtctgtaatcccagcactttgggaggccggtgagagaggatcacttgatcccaagagttcgagcccagcatagggtacatagtgagacctcgtctccataaaatataaaataaaataaaaatttttaaaaggcaccacagggtagggattaacgggcaaggattctgaagtctgctccctggggtcaaactcagtcctgccacccgccagctgggtgaggccttcagcagttaactcccctctctgtgcctctgtaaagcgcaacaataagagaatctccctggcacagctaaaccctgtgtggtaaattacctatatatgtttttatatcattgcagttcctattacacattgagaaattaccatggctcttaaatttagcaactggaactcttccagttcaccccagcagttgttaaaattacctatgaagtagaatcagaggaaattattaggaaacaaagaaggctgaagctcagcagggaaagtgcgcatgtgtgagctcttcctggtggcaatgacctgaaggggcggcccctggaatctgagggccagcatttgctgtcctttgaggtcaggcctcagccagtctcaggagggtctagcctgggcccccacagagaaaggcatctattactgctctctacagttgtccctcatcctgaagtccggcccttcacaccccatccccagtgcctgggacactgcatgacacacagtcagcccccaatatgacgtaactgaaaaactgaaaataatggatttaggaagatgaaagaagttctggagatggatgatggcgaagggtacacaacagtgtgaaagtacttaatgccactgaatggtacagtttaaaatagttaaaatggtccaggcgcagtggctcacacctgtaatcccagcactttgggaggctgaggcgggcggatcacctaaggtcaggagttcgagaccagcctggccaacgtggtgaaaccccatctactaaaaatatgaaaattagctgggagtggtggcaggtgcctgtaatcccagctaccagggaggctgaggcaggagaatagctggaaccctggaggtggaggtttcagtgagccaagatcatgacattgtcctccagcctgggcaacaagagcaaaactctaactcaaaaaaaaaataaacaataaaaataaaataaaatggttaaaattgtaaatttcacgaggtatattttcacacaatgaaaataaataaataaacggatgagatctagtctcatctttacctgctctctcattaattctcctccaaccccctgacctctcctaggctgtctctttttgtcagttcctgttctctaaacagggaaagggccccagattccctccaatctctatgatccctttccagctggtattaccaggccct

SEQ ID NO: 2841 - DNA, 3744 bp, Homo sapiens
attccaggaccctagccagaataattgacttctttttttttttgagacagagttttgcttttgttgccctggctggagtgcagtggcgcaatcttggctcaccgcaacctccacttcccaggttcaagcaattctgcctcagcctcccgagtagctgggattacaggcatgcgccaccacgcctggctaattttgtatttttagtagagacggggtttctccatgttggtcaggctggtctcgaactcccaacgtcaggtgatcctcccgcctcagtctcccaaagtgctgggattacaggtgtgagccaccatgcctggtctagggaattgacttctttttgaccttctgcactcccttccccaaaaggattgtggcttctgttgaccattgacctcagcagaagttgataaggcaggaggtttccagtcctcctggaaaaccaactgctgagcatgagttgtccttggctgtctctgggcctcgcacccatgggaagttttgaggtagggcccttgctgtttacaacttctgagagagtagtgatgggaccccaaagtaagcttgtatcagagggcagtaatgaccttcccatatccccatcctgtggtcacctgggatttgggttccctggggcggaagtgggaaataggagcccagggaaggacatctgaagcacccacagtttaaatagcgactcttcttggttagccagggctgtgctcatgttgggccctacccaggtcagtggccttttcactctcaaagatcgggggtgacgaagcagcatcttaaacagtgtttaggctgacagatttttccagttgaagaagctgaagtatctgccttttgagggtgactctagattacaagagagactatcagatccaatcagcttttgaaaaatcaggaatgtgcttaaaatgccagtgagtggttgtgaagatcaggtttatttcccaggataggcagtctttctttccctccttttccagttctcttttcctacctgtccttccataagcctggtctctagtgccgaggaccttggagaagagagggcccctagctaagctggagccagaaagaaccttcatggtgagtgtggtttcccaaacttgggaaatgaacctagggtgaggttagggaggatttgtagaattctagcaggtaaaaatcaagcctttttcccctcccatagtaaacttaaccattttcaccctgtacgttatcttctagctcctactaacatctccaattagacaaccgcttcaaagggtgcttagcaccagggattggggttcatggacttaggaggtggtaaggaaactggctggcaccaccaaactgccttagtgaacttggcccttcccaggcaggtaggttgggcattgagggaaggtggcccagtctttgctggcagggtctggccagtctcatgggggcaccaccagtttggtgacagaagtggtgtcatttattgaattccacctccgtttagaaggagatcatggtacaaagcccaggaggggccttaagatgtgaagatctctctgagtaaaaggcaaggggcttctcttcttcacctctgggatagttggtagatcggagagttttattttcagggtcaaggctgtggactgatggggatattggagggtgggtgggttttcctgagagactttgtataatgctgaatgtgtccagagggacaagtttgcagaacctcatattggtatattaaagaaataataaaataaaaaagcactttaggttattttatctttaacccgattgctgcaatttcttttgtgtgtatatatacatatatatactttccacaaagttttattttttgctcagaataaaaagttaaattgaggtgtgaaaagaaaagcacttaccttggtgcaatatgtgtagcttgatggtcgttgtcccatgtggccctggcctggcagcgtttttccgctcaatcagccctgtgctgtgagactgtccatagggaaacactattatgcattctcagcaaccgctcaatctatgcaagccttccctgtgtgccccagggcgccccctcaggctctctgaagaactgctgtgggtcctgttttctgctgactgttgaggccctttttcatcacttcttggtctctcgccatcttttccctcttcaccattacaaaatgatgcctgaaaggaaggaacagattgttcctaggtagaaacctggcaccttctagacttttatatttgtaatcacatccattgtccttaaagacttttccagagtgattgaaaccattgatttgtggaactgcaacaatatttctcaagagtttacaattgtcttacaccaccaatcagaaatatgtttggggaggcatgggtggcagggggcaacatgagccatttccatactgctccccatactacctgtgttggttccttaagcaaaaaggcctccagccttcattaaatcctataaacaaacattacatcccatgaatcattatcaactttcttcctttactccacctcccccattttatcttcaattctcaggctatagaatagacaagttttagaatatacttcagccaaagcagaaggattttcatagatccaatatgcaaatagttctgctgtgacatagatcagaaattgtctgttccttaatatttgggggtggaggcaacaaaactgaagcatatttctgattggttagccattttggcctgtttcctcttgcatgttttttagggagagagggaaacagtcctgtatttcttctgatgccctttggggaagccgacgaccactgggcatttctcactgttactcctgttcaagagagggcttctcagtctgcactgaaaaatgcaaattaaactggatctttatgtcaatgtgtacatagtacaagcttttttactggaattgaggtttaaaaccacacactgcccttttggtggtgtgcctgttgggccaaaaattgggtgataatgtagtgtcactttctcagctcaatgcagtttctactttttcttatgggaaaatttttcataaaacctttttgcaccaaaacccaggggtgttttttgcaatatccttgttatcctcgtagtgtgccaagtcagaggctttctcttgcccttttcctgctgtgttctcaggcctcccaagggctatttgactcaacagtctacatccttcgttgtgttttggagaatgtgggggtgggggtcagagttcaaggtgtctgttcccttttcctgtgaactctttctagtccctatttggggagggtggctggaaacagatttttgctgaatttctggctcagatcttctagccaggaaaggcaagagcccccaagagcccttttttttgacatacactaatcattggccggggtcttggtgacaacttttaaaatcccaaatagttttatttggattatgtaaaagtaagtgtgaaacatgggaacaacggacttccactgagcgatgtgaaaacgttacaggttcagtacttccaaaggaagaaacctccaaacccaaaaaagaataaatatgaatttgtatttttgaagaatgtgaaataatggtgtttgcttaattgctcattttgtataaacttaatattgtactttaaaatatctgctaaaaagtgaaaatttaactttttggaattgaaaaagcaatattaaatactaatgaaatcctaattaaatgcttattt

SEQ ID NO: 2842 - DNA, 634 bp, Homo sapiens
gatagaaattgtaaaccggcgcaatagatatagtaccgcaagggaaagatgaaaaattataaccaagcataatacagcaaggactaacccctgtaccttttgcataatgaattaactagaaataactttgcaaagagaaccaaagctaaggcccccgaaaccagacgagctacctaagaacagctaaaagagcacacccgtctatgtagcaaaatagtgggaagatttataggtagaggcgacaaacctatcgagcctggtgatagctggttgtccaagatagaatcttagttcaactttaaatttacctacagaaccttctaaatccccttgtaaatttaactgttagtccaaagaggaacagctctttggacactaggaaaaaaccttgtaaagagagtaaaaaatttaatacccatagtaggcctaaaagcagccaccaattaagaaagcgttcaagctcaacacccatcgtctaaaaaatcccaaacatacaactgagctccttacactcaattggaccaatctattaccttatagaagaactaatgttagtataagtaacatgaaaacattctcctccgcataagcctacatcagaccaaaatattaaactgacaattaacagcccaat

SEQ ID NO: 2843 - DNA, 1218 bp, Homo sapiens
gcgtccctaggcggggcagggctgtcccgccaggtgcgtctccgccaaggtgggtgcgttcccgccaggtgcgtccccgccaggtgcttcccgcgcgaggctggctgccctgcgaggaggccccagggcaggcgccgccgccgcatctgcgggacgtgcagggcaggcgcccagctccggggctgcgctcttcccatctggccccttgaacacccggcggtgttgggttctcaggcttgagctccctcagtgagcgctgagggcggaggagttgacgaccaaactcccctttccctctctcctaaggtgaccgcaaaggtctaatgaacgaaagctaaaacaaaccttggaagcagaaatgggtgagtgaattattgtaaggcaaacccttgtaaccctacccacatcctgctggagaggagactggaagtaggatcactccatctagattctgggagaagaccctgctccaaaggaccttgatgaggtttcatggtttggtaacctcatgcactgtgggaatgtcagaggaccccgagataatgcttcactgccaagtctgaaaattgtgtccacaagatttgattggtagtattttctatcattgtacaacttaaaatatcttctaatttccatttttttttttgacatgagttgtatagaaatgtgtgcttcagtttctgttatagcaacaactcttgtcacccatagccttacaaaaattcctaattttaatatttaaattttagaaactttcttacaagcagaattacaaaaagagtaactaacaagaaagtgagattgtgatgggataacggaatgtcaagtctaattgtcaggaaaagacaaaataacatgggaatgacaatcaaaatggactaaggacttagaagatccgaaactatgaagctactaaaagaaacattggggaatgctccaggacattggtctgggcaaagatttcttgagcaataccttaaaaggacaggcaacccaagcaaaaatggacagatgggatcacatcaagctaaaaaacttctacacagcgaaggaaacaaagtgaacagaataacatgggaatgttttctgtaatttagtagtaactggcaatagtttacaaacacattttgtgtatactgctgtcattgcactgattaccttctgttgtagtgactttgttctattagtccactcaattaaaatatttggttttgttta

SEQ ID NO: 2844 - DNA, 2105 bp, Homo sapiens
ttccagttatgttgctctcctccccgcagccccaggcggcagcttcgcggcccggcgtccggtcccccggtggtcccggagcgaagctccgcaatggagagcggaggaccctccctccccgacctcgcacgaccaagaccgcccacctttcccccaacgcccggctgtgggagccgttcgagtcttctccgccagggcgctccttcccgggaggccgcttctttgggggaataaggtcaaggattacgggatttggggaagcaagctcggctgggccaggattgcttgcgtagctcgctggaatctaaggcactagagggcttgacggccacgtgaggacgaaccacgcaggcgcagccccgcgccccgggcaaggacttccggcaagccccaaaggggagcgtgcaccgcgatgacgtcctcaaggcgcgccacgtccgcccggcggcgcagctgcccagcgcaacctcggccccgcctcgatagccccggacccctgccccgcccgaccccgccccgccacgggagcgcgccactcgcccgcgcagcaacggcctcaatagcgccaggcccgcgtctacaagaagcccgaccaaggccggcgtgggcgaggcctggctagacgctgacgcaccgctggagctactgacctcgggacgactggcggacggtcgcgggcctggagacccagagcgagacggcctacttcgttctcgagccagcagaacgggttgaacgtgtcgacaaccccacccgccagtcagcggcgcgggcgtgttcgagccggctcgtgggcgtggtcaggtgcgtgggcggggactactgggcggggctcggcgcgggggcggggcctggcgggagtagtctcggggtcggggcggggcccggcgggcggggctcggctaagcacagtcttggcgcagcggcggggcctggtggggcgtggctcggtgagggaggtctcgcttgggggcgtggtctcccccagtaggcggggcttggtgccgggggcggggtctggcgggcgcgggcgcgtgtgcgtgttgtgggcctcgcactggcacgcaagtctcagcaattcctgagaatcctcggaggaagaggccggggcccggtgcggcagcgccttgggggcggaatcgcaggcgcgggtcgggccttgctggggcgcggggcgcggcccccggagaaagcggccgcctcgggacaggagggacccgggagaaacccccctggggcggctccgcatgtcggggtcgcgactctaggcgaccttggtagaggggctcgtttgcgccgagctcgcgacccccgagggagccacggccccgtgaaccacgctgcccgtcctggccactggctgccgcctttgtttcgtgggaccccagcccgcaaggcctgcggagccgcggcctcgtcccgagtgttctgagcgcggtccgagctgctcctgcgtccactctgctgccgacacccgagcgtcgcctggagccctggcactgaggggcgcaggccgagttccagaccagcctgggaaacgcaaagcgaccccacctccacaaaagtgggttttctttaagtttttgactagtccgcaattcacagaattgacattttggcagatgaagattgcaagtaaggaaactaacggtatctcagatttgttctttagcaatttgctaaacctctcctctgactgcctttattaggtatttgttttcgagacagggtctcactccactgcttaggctgtactgcagtggcgcgatcccagctcgctgcagcctccacctcccggactccagtgatcctcccgcctcagcctcccaagtagctggtaccacaggcgccagcacgcctggctaattgttgtattttatgtagagaagaggtctccctgtgttgcccagcctggtcttgaattgggctcaagtgatcctcctgcttcagcctcccatatcgctgggattacaggtgtgagccactgtgcccagcctattattattattatttattgtttttttggtcttgagggagggtagggtggtgggagcccagttggggagggagtgaggagtggtcaataaagtattttaaattgaggc

SEQ ID NO: 2845 - DNA, 2297 bp, Homo sapiens
cttagggccaaggagggaggtgaaggctaaggaagtcagatttgagatgcataaccagcagcaaaagagcctctagaaacgccatggactttaggaagggccaagtgacaccttccatgatgtttggttctggtccagatggatctggaagacaaagatttggggagagtgaccacatggctggtagcaataacaaggcctctggctctgaattgcttcctatggtcctggtagaaactgcatagttcagagccaaggggagatgagaagccttaacgtggaagagggacaagagagatgaattgctccctctgcaacccaactcttcaaagtaagaatggttgagagcaatagtcaccaatttcccaggccagaacctggggtcctttgctgggaccagttctgcactttccctctcctcttcctccctcctttcaatcttatactcaagtaaacccactcagcatcttggctatgacgcttcaagatcctggagcactgcatgtaaagagaagagagaagaaatgggttgaagaaactctggaggacctggaagacctagtggctaagctaggaacctggtgaaagagaaagaagatagtccagacggtgatgggcacttgtgaacagaagactctagctcagaaaagcagacagatgtgtgagggggagagatggggtagaacaaaggaactcgagagtcccctacatgacagcctccaggagggctgagtctgaagtagttacagaagagagacaggggcggtaatgttgataggggaatgaagagagagaagcaggagcagaaaaatgaccaaagatgacaatatgctttggccggtaaactcttataaaacataaaggaatcgattaatccctaacttgatggaacaagctttgaaatactttgttcctgtctgccctgatggttaaactaaagaaggagggaggggaggagacagaatcagccagtcagattctgggcccttcccttttcactaccaagcaatctttaataataaggccacaaaatgaggttgccaaggcttagtggggtggtgggaaagaccccaccactacactaaagtcaagggacaaaatgaggtacccaaatagctctgcaaatagatgaaaaagaattagaactcttgagggtttctttctttttggtggcaggtagagagaaggaataaagcttatggaaaaactggaaaatactgctacttcatacatcaaaggtaaccttacattctccgtaagtgaatgttttaactagaattaaggaagaggaaaaaggaaacgggtaaataagcagctatgggagacctgagtcctgagtccatggggtggctggggctgggtcagcgggtaatatgtcatcaaatctagcctccctctatctggcaggaagtggcatgctggtaaggaacaaaaaggtaacagccacggcttagtgggaagagagggaactgagaaaccccaaacctagaagtgccaagggttagtgttaaaagagacagatacacgtgcatggggcaggggtgattgttcggaccatctggaaaggcctttggctgtggatgcatcagaaaccccaccctgggggatgatctatgaggctccggggctgggaggcccccagcacaggtgtcaaacgtacatgaccacatggctaaaaagccccatatctgtccattactcacaacacacaattccccccacccatattgccatgtccaaggcagatgggaggggataagatgacatctctcttggctcttgggcgggcgagctctggctgaggacctctccaccagaggaggcatcatctgcccgcagactgggactgtggggtcatgattacatgcgattgtatcggcatgctcagttctgtcctttggctggccatctgagtgaggaccgaggtggccacagcttcagctgcagagcgaacactgaggccattgctaggggctgttgctgagctgtgctgaatcacaggggctggagaacccgttggctctgagctttccttggggctttctgccaggaaggagggcaaagagcagagagcaattggttagaaaacagaatggggaaagaggcaggactaccttttgccataattctaaaggagcccaaaagggaaatgaaacccatcttttttttggggaaaacttcccagaatcctggcttctaagtcataaatgggctaggaaatgggaagttgtaagaagggaagaactaggccaaaattaacctatctattccaataaaatgaatctccaacatgttaa

SEQ ID NO: 2846 - DNA, 1257 bp, Homo sapiens
actgtggcaggagcagtggcgctgagcgtgcccacgggccgcggcttgggtctctctcattttccaggtggtatggccgtggacaatggcagtggcgcctggctggcccaagagcccagtccagctacgcctgcctgattccaggcgtcaccaccaacccgggggccgcgaggctgggatcaggcaccccggagccgcttgcctgtggccgggctgctctccccctctacgcccaagcaccaccatcgccgcgctgcgctttccgccgacctcccagagcgtcccgatgtcgccggcggccagaccatgcgcgagacagcccaggcgccagagacctccatcccctgccagggctctggactctccaggcggccaccctctcgctgggactccaggccttccccaggctcttgagctcccgagcttccaacacctggggcccgcttaggacggggtgtgctccgaggcgtcagggcccagggcccacggtcctggggtcccctccggtcctccgccttgccgcggaaaaattattttggattcctcaccgcccctcctgcaaggccccctcttgccccacacacccagagccgccagggctgcccaggggcgaacagccggcccagccccacaggccctttttctcacaatgctcacaccatcgtcgcttgttctgaggaggacccgccatggccaaaggggcaagaaggctctgctttgccccgccctggcactagagccccggcagcctcatcccgggaaagaggggctgacggacacccagacacaccccaccactaccacgagcaaacccaccctgacacacccacggatacacacgggtgcatgcgcgcagacacacacacacaccacacccgggcacacacacacggacacacaaagacacagacacagatagctcaaagggagacctcccctcatattgtcttatgcccaatttctgcctccaaagaaagaagaagtaaaatctaaaaggcagaaatgaaatccacaggcagacagccccgcgccacaccctgggcctggtagttaaagatcgatccctgacctactcggttataaaagcactgtgaaaatccctgtcctgttttgttctgatctaattacctgtgcatgcagcccccagtcacgtaccctctgcttcctcaatccatcaagaccctctcacgcggacccccttagagttgtaagcccttaagagggacaggaattgctcactcggagagcttggttttt

SEQ ID NO: 2847 - DNA, 3268 bp, Homo sapiens
agtttgtatcttctaaaaccttcaggcaaatacatgtgctcttaaatattcctgtttcttggctgtttattttcttttgctctccctgttttcctataagagctgattttggtgtattcagctcatggccagtgtctttctgtttctaggcacctttttacatttatgggggctgctaaggttaccgagtagagccacagacactgacaggagccgagtgagaatgtggctcacccgttctcctccctccgccctcccttcggccaaaatgggaccaatgaacgtgatcaccgatgaagcaccagctgtctgccgtcctttcaggacggtgaaccagcccatcctgataaccccacagttctgtcaacgtcgtttaaaatgcgcaacaaacaaaggccgatgggcagctgagctgtgacgttgaaacagagtggtgactttgcttggttctttaaccgtgactcgctctgagatgagcagaggggccacctgagagttcagctgcgtccttcgggcttaaccatacggagttcttagaagcccccactgttactcattgcatggcttatgcccccagaccagaggaaggggttagctattaacgagctgagcttccccagtagaagaaggtgatttggtggaactgtattttagccctgccttggaatggttaattggaatctcactcatctctttcttccactacctactttgaaaataatttaatccctgtcctttacttcctgttgacaggaagccctctctgccaacccatggctggtcacggaccaatcggctatcaccaggctttggggcgtctgccagggcctctgtgttttgatatactctgacctggcagtgaagctgctgatgaatgcacgacaaagaccagtttgctccgtaaccccaggctcccagcgtcttttccatgagccaaaggcctggtcctggaggggggtgccctgcagctctgctggccttcttccaggggagttcattgctgggggtggccctgcagtgacctccactgtgctggggaggggaagaagaaggatgcaacagggtgaggggagaatttgagaaaataggatgcaaattctccacttgtgaataaagaaatagagagccattgctaagaactatgtttacgcagggttagtgctgggaccagaaaccagtcaactcgtttctgtgtgctttccagggactgggctgggtgtcgaggacacaaagatgaacagtgcgatggaattggattctccaaaaaaaaggtcgaagtcccacaccctctgcaccccatacctgtgaatgggaccttctttgagatggggtttttgcagatgtgattaacatatagattaggatgaggccattaggaccggccctcatccactatgcctggagtccttctaagaagagggaagttgcatccagaggcacaggcaagaaggcctgtgagggcggaggcagagattgcagagctgctgccacgagcctcggaatatgggccgctgaagggtggaagaggcaaggaaggatcctcccggaggtttcggagggcgtgtggctctcacagcaccttgatttcagacctctggcctctagagcaatgagagaatccattctgttttaaagcccccagtatgtggtgccgcattatcacagcccaggaacctaatccaacagggccctgccctcaaagcacagcgcagccacagcctccgtccgatagagctgtagggcaggggcttgcactgaggggctccatggcatggcctggagaggtggccaaggccccaggaaggggtcccagcgtcccactgcccacagcactttgacactcccttccaaggtctgggtctttccttgcgtcccctcctcccactgctggaagttctagtgtggaggggctgtgagaaaaccaacgtaacgtgacagaggctggtgtggcagctctgggacccaggcctgctccctctgtccagagcacttcctctttgcctgctctcccctcctgggtggccaccaagacttagcctcctggggccaggggtgcagaggtgtgtgcgaggggtgggggtgggaggacagctctgtcacctgctcaacttccagaagacgggcaggcaggcaggctccacacagccatttgcctattgggctaatgtggaaaccatttactcagctccaccctgctcaccacctcagccatgccagcagccatggggtggtgggcttgaagcatacatcacctgggccccatcctcatctatagcatatgttgtaataagcaccccagagagccttcttcctccatgcaacctagatacgcttgatggggagttgcattcatggtgctgatgaccgatcaatattcttgattgtatcagataccatctggggtggcatggttttcaacagattgagctaatattgctgaagcacttgttatatgccagacgtgtgcttttatatgagccgtctctctttatctctaaagtaatatgtgaaatattagtattgttattagtcttattatccttaatgtagaaaagacagtgtaaggttcacaaccattctagcccaacctgctgagaaaagtctctgttgtgtcttgtcaggtttttgatatctctgcttggctatggcccagatgccccacgagcagccaaggcctccctggggtaggggatgaggctggacggtcaggctgaggctggacggtgggcccagagagggcggcgtctgctgcctcccttcggtttgccctgtgtgtgtcaggtctccatacgcttcacttggcccctttctagatgaaggtcattgaaggttattctttacccttcttatctcaaaaataaataacctgtcttctccactttcttttctttttcttttttttttttttttgagacagagtcttgctctgtcacccaagctggagtgcagtggtgcgatctccgctcactgcaagctccgcctcccaggttcacaccattctcctgcctcagcctcccgagtagctgggtctacgggcgcccgccaccacacccagctaattttttgtattttttaatagagacggggtttcaccgtgttagccaggatggtctcaatctcctgacctcatgatccgcccgccttggcctcccaaagtgctgggattacaggcgtgagccactgcgcccggcctcttctccactttcataggttccagtctctggttcttctttctcagtttgttgtttttgcttcttaaataatggag

SEQ ID NO: 2848 - DNA, 1462 bp, Homo sapiens
aacacaggctggctgtgaagatgaacattaatccatgcctggtgctttgtgagtgctcactgagtattagccttgatgcagacccactggtttctccttttgccactgggccctgccctggagctcccagggaggtggtggcgatgcagagcgacgtgggtcagggattccccatgcagtccaactggagggctcccgtgcatgcgtgcacatcaggggcggtaaggaagggctggccggggtgtgggaggaggcgacacaagatgggaggtggccctgtctcttgggagcaaaggcagaaggaggtggaggcagctcagggctcggaggagaggggtccgggctccttggctgtgtccctgctgtctctcgctgtgggtattcaccgaatctctcccatcctcggttttcacatctgctgcatgcaggtcctcatggttctcaagtgaggcaggtggtgagcccatcaggccagtgcccagggcttattctggggacagctcctggagaggaagggctgcctccctaaggactcctgccctgccctgggtgcaaggggttccacctgctgcccctcccccactccccagctcgcctcaggcggatagttcccctctcactccaaataagagccacaatgctgacagtggcccccaaggccctgcccagcggtccccagcttcctctagctacatctcccggccctccccttcacccactcctgtaggcgcctcgaacgcgcctcagccctgctcctcccctgcctgcagcgttcctccccaggtctcccccggctctctcacctgcttccggttttgctcagactgcgctgcctcagtgcgcccttctgtcaccatcctgtgtatagtcggaaacccctgctccctttccctgcactgaatcttccgtgtgctccttttctccatggcatttgttagctttggctatcctgtctaatttgcgtatgtatttattttttattttgctgcctgttccctcattcccccaactccccaatggcagggagttctgttttggtcactgctgaatccctggtgacccgagcagtgatgatgcagagttgttgtgatatttgtggaatgaatgaatgcaggattttttgttttaccttcacttggcacaaatgctgtggttctgttcaccactcccccctgaagtaatgaaagttatgggcccatccctgtgctgagtggagctggggacacagtgggggctaggacagactgtatccctgccttgtggaacccacagtccagtgggagaggcgacattacccacatagtcatgcaggtgacagagcctgcccacggcttcaacctgcctccagccccacctgctccaagcagacagatggggcgagtgtagggagtgtgtttaaaagaaaaaagaaacaaaaagtctctctcttttttttttttgaagtacccagaccttttcagga

SEQ ID NO: 2849 - DNA, 2031 bp, Homo sapiens
gtcgggctctgggagagagcgagagagaaatccggttaaaatcagagtcggagggaggtttaaccacagatcggttccgatcggattattccttaaaggggacgcgccattgtcaagagaacggagccaggggcccgagggcggggaccggcggcgctggaggagcgaggcagctgtactaggactgggaacggagctgaagccatttattggtatcttggatggttaacatctaaatgcttaattcctgaaaccactcaagagtcataggattagatgatccaagtcaccaagaaattactgtctcaagtgatacgatccttgaggaattgccatactgtcttccacaatggttgaactaatttacactcccaccaacagcgtaaaagcattcctgtttctccacatcctctccagcatctgttgtttcctgactttttaatgattgccattctaactggcgtgagatggtatctcattgtaaagtcacagatatttttttacttttgttcatgttccaaagcctttaccttctactttttcttttgtaggtaatcatcaaaatttttattattagccaatatggtgtataaataataattattgtaatactaagcaattgtatgttatgtaaaaatttctgttatataaatctatgcataaatatatgcatataatatttgtgtacatatgtaagtttgtggctgtgaggtagtagcccaaagattttttttttaaatccttaaagacctctgggggtgaggaagctagaggcagcttccacagacttcagtgtggttattttagaccacatctacctgtagggattttgaaataccccaattgttgagaactagtgtgtattttgagggctgttactattcagaatgttgtgtgtaaaaacataatagagtcagaaaaaagctgagatctgctgctgtaatgagctcaaacacacctaattgtaagagttatacgttatttctcttctcacttgtctcttctttttgactgaatttaaatttattttataatggtttaggagtctcatcagcatgaaaaagacaattattttattaaatatattaaatacagtgctatggagagtgtaagccatccaaaaatactgatatttagtttttatttgagctttatctaagagacagagcaggaatgctagcttttagattcccaaattttaattattcaggtcctgtttattcttattattagcagttagagtttagtagatttatattccaagtatgtttaatacgacatgggtttttccagtttgtaattcaatgcttgaattgcaatctttagaattatattaacagttatgtcttccttctctcataggcttacataaatctttcaaaattttgggttagcatgtagagaaatattacaacttagcattataaggtatttaatgcaagcagtcaggtaataccaagttagtctagttatatggaagctagcttttcttcttctacttggagtgatcatccctgtttctctcctattagcagaaaatgaaaagaattcacgtatctttaccaaggctgaacattatgatgaaatataaagttgagggggacaactttgatggatgaaaaatgttacctgatttttatttgtgtttagaatattaatgaaattaaatattattggcctcctccattttattgtttgtaacttgcttgttcatgtccttgtccttgtttcagtttgggggtgtgggtgtttttctagtcgatttcatcacagctttgtgtgtagaaacaaaagtgattaactgtgtgtttattatatgcccacatattttttcctgctgtctaattttactttggttttatatacatactcttaggatctttactcacctaatgctgtattttgaacactttcctgtgccatttggtattttttgataatgtaatttcaaagatctgtttagcattctgtttattagattataaaaatcatttgtcttgaacaaaataaaatttgaaatttattttggaa

SEQ ID NO: 2850 - DNA, 5227 bp, Homo sapiens
gcgaggtgagtgggggataccgcggactgagggaggagaccccgcagagcgaaggagcgggctgggggaaacgggcggactgcaggctgggcctgcgggaaaagatctgaaggctgagagagacatccaaaatactaagaaaggtctgaagacagaccctcacagggagggaggatggtgaggagggaccccacagactgatggaggaggcggaggagagagccctaaggggggaccccaggtagggaggctgaggcgagagagctgcgatgggggcgccggggctggggtgaagtggaggaaaggaggtgagaggaggctgcgagcaaggccgaggcggatcctccttggctgcccctgggcagggaggtagcacctttctcctcttatgcccccctgttgatcttcttccaacccacctttttaaaaaaagggacatggtcttgctctgtcccccaggctggagtgcagtagtgcagtcatagctcactgcagcctcaacctgctggcctcaagcgatcctcctgcttcagcctcccaagtagctgggactacaggtgtgcaccaccacacccagctaactattttttgtagagatgggatctcacgatgttggccaggctggtctctgtctcctggactcaagcgatcctcctgcctcgacctcccaaagtgctagtattacaggcgtgagccaccgcgcccagctccttcccatccttaagactcaaccccaagtcagaccaggctcggtggctcacacctgtaatctcagcactttgggaggcagaggcaggaggttggcttgaggccaggggttggagaccatcctagccaacagagtgaaacctcgcctctactaaaaatacaaaaattagccccgtgtgggccgggcgcagtggctcacgcctgtaatcccagcactttgggaggcgggcagatcacgaggtaaggagatcgagaccatcctggctaagacggtgaaaccccgtctctactaaaaatacaaaaaattagccgggtgtggtggtgggcgcctgtagtcccagctactcgagagactgaggcaggagaatggcgtgaacccgggaggcggagcttgctgtgagcggagatcgcgcccctgcactccagcctgtgcgacagagcgagactccgtctcaaaaaaaaaaaaaaaaaattagccgggtgtggtggcgcatgcctgtaatcccatgcctgtaatgccagctactcaggaggctaaggcagaagaatcacttgaacccgggaggcgtaggttgcagtgagccgagattgtgccactgcactctagcctgggcgacagagcaaggctctgtctccaaaaaagaaaaagactcaaccctaagtcagctccaggacgtatgtgcctactctacatgtgtgagtccgaggggaaaaaacatcatatgacctcttctagggcttccaaagcaccccacctggccacggaagagcttagtaaacatggggtagttttgagattgctaaaaggaggaagttaggcatatgtctcttgtagcttaaaataatactgtgaaatttttcaaacctggaaacaaccacttctctttccttttatatatatatatatttttttttttaagacaagatcttgctctgtcacccaggctggagtgcagtggctggatcatagctcactgtaacctcaaactctcagtctcaagtgatcctcccacgtcagcctctttagtagctgggaccacaggtgtgcgccaccgtgcccagctaatttttgtatttttgtggagaggaggtctcaccatgttgcccagactggtcttgaattcctgggctcaagcgatccacctccctcagcctcccaaagtgctggaactacaggcgtgagccaccgcacccaggccattctcttagcattttgtattcccatcttttaaaaatggaaagcaggctgggcgcggtggctcacacctgtaatcccagcactttgggaggtcgaggcaggtggatcacctgaggtcaggagttctagaccagcctggccaacatggtgaaacttcgactctactaaaaatataaaaattagccaggtatggtagcgggtgcctgtaatcctagctactttggaggctgaggcaggagaatcacttgaacccaagaggcagaggtggcagtgagctgagatcgtgccactccactccagcctgggcgacagtgagactccatctcaaaaaaaaaaaaaaaaaaaaaaggaaagcaaactcagttctaaaaagtctacatggggccaggcacagtggctcacacctgtaatcctagcactttgggaggccaatgcgggtagattacctgaggtcaggagtttgagaccaacctgggcaacatggtgaaaccccgtctctactaaaaatacaaacaaaattagccgggtgtggtggcgggcacctgtagtcccagctactcaggaggccgaggcaggagaatcgcttgaacctgggaggtggaggttgcagtgagccaagatcatgccactgcactccagcctgggtgacagggcaaaactccgtctcaaaaaaaaaaacaaaaaagtctgcgtggtattttttttttaagtccaagtaatgaaacatttcctgatggcccatggtttcagaatatatggatataataggataccagtaaaatagttcttttctatcatgtgtttgctcatgcttaaccaggggcaatcataaatcactaatgggtcctaagcaaagttaaaaattaaattttttcattcattcatgtatctatgtattaatttattcatttatgacagggtcttgctctgttgcccaggctggagtgcagtgttgcattcatggttcaccaaaggctggagtgcagtgttgcattcatggttcaccgaagcctcgacctcctaggctcattcaatcctcccacctcagcctcccgagtagctgggactacaggcatgtgccactacacccagctaagtttttaaattgtagttggctgggcgcagtggctcacgcctgtaatgccagtactttgggaggctgaggcgggtggatcacctgaggtcggtagtttgagagcagcctggccaacatggtgaacacactagtctgtactacaaatacaaaaattaaaggccgggtgcagtggctcatgcctgtaatctcagcactttgggaggccgaggcaggtggatcacctgaggtccggaattcacaactagcctggccaaggtggtgaaacctcatctgtactaaaaatagaaaaaatttgcggggcttggtgacaggtgcctgtaatcccacctactcaggaggctgaggcagaagaatcacttgaacccaggaagcggaggttgcagtgagcagagattgcggaggtggaggatacagtagtgagcggagatcgcgccattgcactccagcctgggcaacaagagtcaaactctgtctcaaaaaaaaaaaaaaaaattagccaggcatagtgttgcatgcctgtaatctgagccacttgggaggctgaggcaggataatcacttgagcctgcttaagaggtggaggttgcagtgagccaaggtcgcaccactggactccagcctgggtgacagagcaagactctgtctcgaaaaaaaaaaaaatttgtagccataggatctcactgtcttggccaagctgatctcaaactcttggcctcaagtgattcttctgccttggcctaaccctttatttttaacaaagcatgagaaaacaagttattagctgcaagaaataaaggatgtaattgtaactccttcattgaaacttccttctaactctgtattacagaatattgaaatttgtgaatatcttctggctcctaattttgcacccctggcaattatgcagaagatgatcagaaatggaaaaagagcaggagggtacccagggctttgtgaataggtattaacaactggtttgttgttactgggttttttgtttgtttgtttttttaaggaaaccagaatgtatctattttaagctctccttccctatagttatcttgtcttgctgcattatccacttaatttatcattgttggccaggcgcggtggctcacgcctgtaatcccagaactttgggaggctgaggcgggcagatcacgaggtcaggagatcgagactatcctggctaacatggtgaaaccccatctctactaaaaatacaaaaattagccagacatggtggtgagtgcctgtagtcccagctactcgggaggttgaggcaggagaatgtcatgaacccgggaggtggaggttgcagtgagccgagatcgtgccactgcactccagcctgggtggacagagcgaggctccatctcgaaaaaaaaaaattatcattgttgttgacaataaatgtttttggaagtaatttggaactgttggtttgcaaatcacataataaaagccctcactttactgtagagtcacacttaacattagacaaaactatatatctagattgataactagaccgaactaggtggcttttggccattgctacaaattaaatccaacctggaaaaaatattcaggctgtaaaggcagttccaaaagctgtctccaaaaatcgtttgggacaacaatgtctcattctttttgtcttccatggtgctttgcctaactcctcgaagatagctcaaactcagaaaatgtttatctggttgagtcactttaataaaaatagtcttgttacctcatggttcacatgttatttatttatttatgaaacagtctcactctgtcgcctgggctggagtgcaatggcatgatctcggctcactgcaacctccacctcctgggttcaagagattctcgtgcctcagcctcctgagtagctggaattactggcatgtgccaccacgtccggctaattgttttgtatttttagtagagacgaggtttcaccatgttggccaggctggtctcgaactcctggccttaagtgatctgcccacctcggcctcccaaagtgctgggattacaggcttgagccatggcacctggcttatttatttatttattaagttataaagacaagatctcaccctgtcacccatgctggagtgcagtggcataatcatagctcactgaagcctcacccttctccactcaagcaattctcccacctcagcctcctgagtacatatgactacacccatgccccac

SEQ ID NO: 2851 - DNA, 1349 bp, Homo sapiens
ttgttctactcggttttattcttattgctcaggcttgagtgcactggcctcttctcagctcaacctccgcctcttgggttcgggtaatgatggttccacgtcagcggccctccgcctcttgggtttgcgtgacggttccacgtcaccgaccctccgcctcttgggttcgggtgatgatggttccacgtcagcggccctccgcctcttgggtttgcgtgacggttccacatcaccgaccctccgcctcttgggttcgggtgatgatggttccacgtcagcggccctccgcctcttgggtttgcgtgacggttccacgtcaccgaccctccgcctcttgggttcgggaggtggttccatctcagccgccctctgcctcttgggtttgcgtggtttttctgcctcagcctcctgagtagctaagggaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaaggggatggagcagacactcggcacgtgtcttgagattatcatccgctgagggtggagctgagggtggagctgagggtggaaggggagtgagcagacactcgggaggtgtcttgagattatcatccgctgagggtggaaggggagtgagcagacactcgggaggtgtcttgagattatcatccgctgagggtggaaggggagtgagcagacactcaggaggtgtcttgagattatcatccgctgagggtggaaggggagtgagcacacactcgggaggtgtcttgagattatcatccgctgagggtggaaggggagtgagcacacactcgggaggtgtcttgaggctcagggagttatcagttatagaatgttgttgagttggaggaggtggctggtggcccatcctgttttttaaagtttcagctgtgaggtagggccagtagggcaatcctgaagaatgacgatgctccgctgccgccattctgacctgtagggccaaaggagggaatgttt

SEQ ID NO: 2852 - DNA, 3126 bp, Homo sapiens
acacacagctagctcttcaggccaggcccccagggtttcgtccacctctcacctttgacgacgcggtcagccccgggagggggcggcgggggcgggggtgggggcggtgcagcccgggccggctccggggcggccatgctgggcccggggctcggctaggctctgggccgggcggggttgggggcgggggcggcggctaccagagccaagcggcggcgccgccggggaacatggcggaccctctttccctacagaggggctaagaccggcatgcactgcgcgtgcgggggtgggggcggggtaggctctagggacttgggcaaaattactgaagctaggagagaaacaggacgaggccaagggatcaggttaaaattctttgcatgcagaatgaagaatgaggaggtgctgcgatcgaacgactgcgaggaaacacacccgctctcatggcattcccagtaaactgagaagacgtgattaaacctcaggatctcctactaatagagaaatgtataacgatttagctaccagatctgaatactgaagggttggtaggggaccagagaatagaggaagcattgtaggttctagagtggagaagggaccatccaaaatggagtttgaaagagaattctggcctttgtgtttagagtctggaattgtcaagagtctgaaagcacagaataagactgcagctagagcaatttaggcgccatagtttgtcaaaacaggtaaggggaataaaggggatgacaccaagagatgtgcaaagaatctgaagaattcacctgaaaaggatacaacctcctcctggaaggcagaggagtaaatagggaattggaaattaattccttatttctgcacatgcacagaatctgggcccaggtgacttatggaacctttatagagaccacggtgactgacactcatgggaaagggggtagaggggcaagaactgactgttcatcaaaaattattagatgagtgtgtccacgacaccaggagatatgttgaatcatggacagggaccagcatatccactaagctctatatatcttgatggtgcaggatccaagtgggatggaacaaccaattcctgcccatcctcctgctcaataatacatgtgctcagaatctgttcataatgcatggtggtaagtaagtagtagtccgaaggtccaaggagtacctttctacctcttctttgtgtcaatttctatcctgagaccccaggaaaagaggaagggaaagacccaacaatggattttttccaaaaagggaacccacaagctattttttagagggaagagtctcgggagtgaggcacaggtgaaaatggatctttctggcatggaagggccataacaccacaggggaagggaaagggagaggcccccacggaaggagaggaaggaagggacaggaggcacgtcacaaacttataagatagagggaaggcacctggagtacattgatcaggagtgagtctgtaagaagagcttgaatccccagaaaatcttcctaaggaggggaggaaggaagtgtataatgtactgagtactgaatgctctgtcaggaaagggatgggaaacatcctagcagcaatactagaaaggaaaggcaccctattttaggacccattgattcccaccttgattgtatatccttcaactcgtctctggctcctcacttccactcagtcaaaagccacttcatatatttatccagacttccagccccaatacaaagaaagcaagagcatacaaagggaagaatgacaaggaattaaatagaactgtcttatagatttattaatgaaaaatactttacaaaaacagtatgtttggcctaaaatagttcagctgactctgagggtttacattgacgactgagcaagtggcaataatggctgtgttattgaggacagaaggctgtgttagtgtgcctgactccatctgttcaaaagggtgaatgttatgttggcagctccgcattctaggcctaaggtttggagggcacagggaatgctgacaggccataatacctgggcaggggggctgccctgatgatgtcatcagaaccatgaccacagggctacatgtccccccaaggatgggagacagggaagacaaagggtcaggtaatagggataggtggataaaacaaagagtagaagttgggagtatagtagggaacagaggatgagggctcaggtggaggtggggacataaagcatccaggaataaaatgtgaccttaaaatcctaaggaatggctagtatccagagtaataccatggattcatctttaaagtggctcagataaaacccttaaacagcagctgcttccttttgctagggggaatggaagttggaatttcaaatatcccctcccaaagaatcacatctttttagaggttcctgacacccttaggagaacccaccaattctatgttgagatgagaatagcacaaccatggcagtgatgcagggtaccaacgctgccacagtagtttattttgttgttgttttgttttgttttttgagatggagtctcactctattgccaagctggagtgcagtggtgcgatctcggctcactgcaacctctgcctcccgggttcaagcaattctcctgcctcagccttccgagtagttgggactacaggcacgcaccgtcacgcctggctaattttttgtattttggtagagacggggtttcaccatgttggccaggatggtctcaatctcctgacctcgtgatccacccgcctcagcctcccaaagtgctgggattacaggtgtgagccaccgcgcccggcccacagtacagttttacaaagaaaggtgtagctccaggaaaggaaaggaataacctttaccattgactgtgctgcaggactctagccctgatctgctctcttctgggagcatctgatagaacaaacagaaacccctctcccactgttctcctgtgtccagagtgggaggcataactgctttgcctccagtcatcatctgggggcatatctactcttcgaggaccaggggttcgggaccctggaacaggatctgaattccaagctgacctcaggggtacatgaagactgctagatgagacgggatct

SEQ ID NO: 2853 - DNA, 472 bp, Homo sapiens
cagctctagcagggatgctcctgagcttggcggacatacttagatcctaacgtgccagtgagacctggctgtggagagtagcactggcagccctgcctggactccacttggcatgataccagctccagaagggaagggagtggagcaggcagtgaggagagagcctgggggtcggctggggacagccgtatgtgctagctgcttgcccagcgagtgttcccggagtctcctcgccgcaccccgctatcgggcgctcagaccaggggctcggcctggcgggaaatagcctcgaccgaactgctgcggggacaaagagccgcgagttcgctccctgcccccagtgtctcctaagcgagccttctgctcctaggaaggcgcctttccagcagccgctgggaccctggccagtgtttagctcccaactagtaacagacggaaagaaaaaataaaattatccagaatctagaataaa

SEQ ID NO: 2854 - DNA, 875 bp, Homo sapiens
gggcgacctgggcaccagcaggacccgaggccaggagccaggggcccagaagaatgtggccccgtcccagagcaccacccgagacatcaggagcccatcgtgggctagggaagatcctccgggacctaacggcccaggtcttccacccttggccacctccccaggtgatgcctgaagctcaagggactgtgtccaccctcaggccctgcccgtggctctggatcggcggtccccatcagaggcctgggctgagtcctcaggggtcgacgcaggtcctctgggcagcatggggtggtgccgggtggaccccacggtggcctgtgttcgccacgtggccgtgggtcagttcctcgctggaggagacccttccccagacacctgccgggcacccagccaaacccttgaggcctgggaaggtctctggatgccaccctacaccccgcccagactcctctccctgtggttcctggacagaacattccgtcaccacgaaacgaagtttgcccaggccctgccttcaccctgggaaaacccagccgggcatgggaaggaggaatgctgcccgcctgcccgcccagaccagagtcgccccacatgccaggccaggcccgcatcctcctggggcacacgggagccccaggcttcccggcaggaaaagccccccaccgcagaagggctggtctctggtggggagttgctgctgggtggggtgaccacagggcggggttcaggctggggtatttttaatgatgtagttgcatctggtcaccgccccctgccacccccgattctttcctgccctccccaccttgtgacccagactgtggcttgaattaagaatgttttcagataagtacacgcctttgaggttaaaa

SEQ ID NO: 2855 - DNA, 16305 bp, Homo sapiens
ggggtaggctctttattagacggttattgctgtactacagggtcagagtgcagtgtaagcagtgtcagaggcccgcgttcagcccaagaatgtggattttctctccctattgatcacagtgggtgggtttcttcagaaaagccccagaggcagggaccagtgagctccaaggttagaagtggaactggaaggcttcagtcacatgctgcttccacgcttccaggctgggcagcaaggaggagatgcccatgacgtgccaggtctccccatctgacaccagtgaagtctggtaggacagcagccgcacgcctgcctctgccaggaggcctggaaatagaagaaactcctggttggcacaggggataggggaaaaaggagcgagggattgggagcagaatcagaagttcaaagcttttgtgatcaaaggtgcaatgagcggatgatggtctcagaatcaaagagctgagatgggagagcaacagggcatctgctcagcttccatggatattcctgactctctgggaacaccatgaccatcagctgtagctcttgactttctgattgccagttttatccagccaacagcaagggagaaaagcagggaagttcccttgggcagccagaaagaatggtgaaattaggcccttcagggtttgaaggcacaccctccgccaaacatggacgtgtgccaaaacccctagcagcccaagccccagctgactggggcaggtccaagacgcctaccatggctggaggctttgtaggttttgctgcagctgggctggccaccagggacagccacagggccagcaggtaggagtaagaaacctgcactcaatgtccctgagctcctgggctatggctccacaagctggtccagtgtacctaacatggcaagctgaggatccacagctgggcaggaatagaggctatggccccacccctgccatgctgctctgtgaccctggataaggcactttccctctttgaactgagtatccactccctgaaggttctgaaaactggcatcagaccctctgtatggtgcagatccagagacaccctgggacatgaagaggggctaaaggaaggtgggtagagttcaattccagggcagaccccaccccagcctcaaggacaccagccagccctacagggccctcctcaccaatcatggtaggcagcattgcagggtcagaggtctgagtccggaataggagcaggggcaggtccctgcggagaggcacttctggcctgaagacagctccattgagcccctgcagtacaggcgtagtgccttggaccaagcccacagcctggtaaggggcgcctgccagggccacggccaggaggcattccccgaagccttgctcccctggtgcagcagggctgtgggaggggcgcacattgaggccagcctctttcaccagcagcttagcgttcaccaagttcacatccgcctgcttggaagcctctttcaggaggccgacaatgactgcggggcttaggcagttcccagcattcttcagggatgttcctggggacagagagaagctaccatgaggtcactgtttgttgagcactacaggagggggcaggaagccactggcacctagctctggactatgggctcctcgctgccctggggaccccaaaggcagcttgctccaggcaggtccactcgcccttcagtgggctcagaagaggcataatctgggcccaagccaggaaacccaggatgttttaaccaccctgagaaactcctctccaaaactcagctcaactccactccgctccccaaccctgcacctggcttggccatcctggcctacctattattctcccaggggacacaggaaaattccctactcttaccccttcctggcactcagagccttgccagcctcaggaaatcaaagcagaaagaagtaaccgaagcaactgctgcccagctccctgccttgtttccttcggcgcttggacacccaggccagtgggaccccctggctctgcccttccctggtattgtcaatgcctagggtttagctgccctctccctgcaatctctgcccaactgtgagacacccaagagtccatggggaaagatacacgtctacagggttaaggaaactggagccctccttggtcactcaaccacatccgcacagtactggatccactgcaaaggtggccacagcccactcagcagcccgaggggtggtcagagggcactgttctcattcccactccacggctgagcaaactctctctcgagggctgtcagacggcccaaggtaccaccttagtaagttacagagcacaaagtgtcctcaccgctcctggctcatctgcccctaactctcactttacaagtgaagaatccaagcctcagaagggagagtcacacagcagggaagagacagggccaaaaaccagaatccagcatcctgttgcttaattagggcctccctccagccatcctacgacctctcgcatgaaactctctctctcgtagaggtttctcttgcacccaaaatatctaggtcttaaaaatgctacataaacatgatttatgaatattcagtacatctttccaacgactttttttaacccctccctttaccaccctcccaccagtagtaagggagctatactcagggcagggtccaaggcaccctcactgcctctcactaaccctgtgtcctgcagcaaatacacccagcagggcagatcccacactccctcatcccctcctccccctccctctgcaaggtccccagctcaccctgtgttatcacctggatggtccctttgggggacccagcccaggctcgcatcagtgtccccagagcttctgccagaccaatccaaggcttggtgtgtggagagaaggcactggtaagggcctgggcattcacctgcagaggatggaggagcggggctgtggtcaggaagaggcatggcagatcctgaatcaagatctggctgccaagacccagctccacaagaaagacagtatagggtcactcctgccttggtgcctggtgggtgacaacttccatcagccactaacaacaggacaaggacttgttcctacaaatgaagaaagctgtggagccagaaatggacacagaatgccacaaccactcaaaattgctcctttcagcaaactgtgtctgccccagccccctccatgggagacttgtttctgcactggggaagggattggacagcacaataaaggtgagtctttgacacaaaacatatgggagtcgcagataacttggatgaggagtgacgggtcttctctggcagtcccaacttgccttcatttttattttctatcttgaatttttttaagtgtttacattgttactaaacactacgatcaattatcacaaagttttgatgatcgtgcttcaaatatcaacgcatgcgaagtccactgtgaggcatgttgtgacactgaggggacacaagccccatatcccccaaaagttatgtctaggacctggctggctgccccctgccccacccaggggcctgataacagaaccagcttgttctgggccaaaatttcaattccattttgtggttcaaaatgctctggttctgagttaggcatctggccacttttattgagataacttgtaaagtcaaccatcttagaaagatgcaaatcaaacaggcagctacaagatgtaattagaaggaaacacagatgcttctctttctgttttcataaagatatcattggaagaatttttttttttttaaacagagaaagaatcatggtatgggaaatgactgctgaggccgggcttcacgggagcctctccagtgtgggaggtgacaggtctgcaggcttcttgctgcatggctcctggatcctctccaaggagtcacagacaagaagggtggtggggtggagcagctagctgctgggaggagatctggagcaccatgctgccactgccggggctgagggcctgcagcagcagaggaaagtccaactaagagggcccataacgcaggcacctcggcacatctctctgtcctctgtgtgggcctgcagagcccaagcccggggaggtgtccatcacagggctcccaagtaaaaggaggattctcagtcttccctggtggacaggtgggagaattccagggaggagtcaggcactttgggacaccaacctgaccctaatgttattctgtgtctgaggttagaacagaattgaactggggaaaatgcagggaagaattaggaaaatatatttcttatgtgacaaaaatgtctctttttccaaatggctactctaagactatttgctgatgtgggtgaacagttcaatttgctaagggtagttattttgaccaagaggtttcacctcctaagatggggacactgtgtggtccatttgatggaactctgtgtcctgcagcagatacacccagcagggcagagcccatacacctctcaccccctcctccccatctctctgcaaggtccccctccctcccccaccccctcgctctgccagagcttatattcaggagtccctttcaggaaaagctctggaatgtcactgctacctaatggtaatggcaataaattgcaaggctgcgatggggaaggcagacagctgctttctgagaaggctgaaagggtaaaaccctgaagcccagattggctggcaatggtgatgagctcaaacctcagcctgggaaacgagcagcatctcctgggaggaacgaacctgctcagaggccgaccaggtgcaagatgagtgaagtgtgctctgccctgaggagcccacacagcatagaggacagaggatgcagacaggtcagagtctctgctgacctcctcgcatgctgctggtcatagccctgctgacttccatggactgtgtggggctgctgggcagcaggaggcacccttctttcctcaggatggagggggcagagaggcctggagggctgggctctcaatccagaggtgggagggcagaaccaaaatccccgtctctcctgccacagtgctgtcctcaccagcgaaaatcacccagctgagggtcagccaggacaaccaagaacacccagcccattttcctgaccctttgactccatggcctgggcccacccacacaagctgcagagaggcttaagtcatgtttttttgtcctcagggaacttagaacttaggttaagtagaaagattagggaaaaaaaaaaacaccccatggaactgaaccttaataacaagaaagaacatggttctcagaattgagaaggggctggaaaggccaagcaagacttcagaaggaggcagcaagcccctggaaggagagctatgcctccctcatgcacccgtgtctcccaagagctatgacaatgtctggtacccagtgaaacttaaggaatatccacagactgaatgaatgagacaggacttgaagtgtaagtcaggttaagctcgtaggagacgcacatgccaggaagggcttgatggaagcaaagacaagaagtgggggtcttatgccttgatttggggaaagcaagggggtcagccagcacagagggctcatttgggagtaggtagggcaggctgtcaaggcagggtctggggagcttacagggtgcaaatttctacatggccgtccccaaccacatccccacctgctgcggctgcgtccagctggcacccaagcagcactccttcactcccacggcatgtggagaacaaaggagcctttctctagaggctgggcctgggaagggccacaatctctgcagcaagactacgatataacaggcctgagccgggctctctgctgccaaggcctctgctatcaaggctggagacgggaggctcccgcccacctgctccggagagtgctgactcaagcagatttcccttatcttcagctcccagggctgaatctattcacccacgctgccaccagcccctacaagatgccttccttcctctcctccctctgactcctggcccccagccccaggtggtgatacttacaacccccgtgagagatttccccttcaccatgtccacgaactgaacagcaatttcctccccacagcggctctgagcctccttggtgctggcacccaggtggggacagctgatgacattctcatggtccaccaaggcccggtcccgtggcggctcctgcccagaaagagatacctctaagttggctgccatggactggccacaccctcttgggccaccccaggcaacaggaaagttggagggaaggcagtcaggagttctggtgccttccacttctattttgtcagggtggtcactggactcaataatgggcttccacatgaatgttccatctcagcagagtggacacagcacaaagtgtgaaccagattcaaatctcaccttcaccacttaaccacctaggtgccttgggggtgaaccttgatctaagcctcagtttctttatctgtgaaatgggttgatcctatctccctcataacattactgtggggattatgcacctttaacatgggaggcccttgaccaataggagctactgttgttgttgttactgggcttttccccgaaactcacccccctgcatccatgcagcacttgctgtcgatgtgccttgctggacttttagcacagtgtcctgctcttccaagacactccacgcaggtaactgcatcttggctctcatcaggacaggttgcccatctgtggcacctccaccccaccctccagtgtcttttccacccttctgctcactgagaagattgcccttgggtatgttatttaggcatcttccggccattctcctcagggctctgttggtcccattgaattttgaccatttaaccctgtgagtcctggccacatgtaaccatgtaatcctgtgagtcccggccacatgtaaccatgtaagtaccaccagcaagtggttcaaggatgctgaagagagcaggagaaggtgctgtgttagggaggatggtgatacaaagatggacaaggcttgccctgccttcagggagcttatgatctaagagctgagaaagatgaccaaggttacaaaccaaaaggcactgtgtgccctgggctgggagtacacagtgagtgctacaggggctcagagagggccagtgaccttccaaggacacacagctagtaacctgcgaaccacaactacctaatccaaagtccatgtcctttccccttcctcaccaggggaagctccaatgttggggacaggatctttcaggagaggagccaaaaggattcgagtgcaaatgcactcttccctactggatctggtgtgaggctgagcctctgctccagctgggaaagcagcccaccccgaggaccctgagggaatactgccagtatcctcgggcttctgtccacccagcaagagaagaagggaaaaagaatgcccatggacactgaaaaggacattttcttggcaatgggactgcatttccatcagggtccctcaactatacactaaagccccctctcttcctgctccagaccctcaacttcagaactgatttgtggctttatctttgtcaatatgttagcagtctgagaagcccggaaccaggaactgggtcccctttaaagcccgagttttgcagaaaaccacatagctgcctccataccaggctccgcaaggactcctcaaaccacaaaggtgtgtttttggcaacacagttttctccttttaccatggatgaaagagacaataagctagaggctttctgtaaaacgccaggctttccctgccatgggcctctctgctccctatctctcccgtcctcctgacgctgaggctgccaggcacttacttccgtaaacacgtccagtgcagccccggcacactggccagactgcagggcccggagcagggcgccttcgtccacgatccctccacgggcacagttcaccacacgcacccccttcttgcactgggcaaaggtgttgtcattcagcaagcctggaagaaagcgaagcatcttcctgctggggcagcaccaggatccccacgctcatccctggcttccagaggtcttccctttccttgagccagctctttcccagagcctctctcctgctggacggcagcctctttgctctcatctcttcctcctcagatgctctggggcaggagtccctgttatggatctgggccagactcagtttagaaacatcttagaaattcttgagatattactgtttcaagtgggtctgggaatcagaaagccctgcaggggctgcagaaagcatccatgggggtcactggttgtccctgtgcccagcttacctagaccccaagcacttctagctggctcaccctcccctatccaacgtaggggtgtctaacaaaacaccagcctctgcaggacccaggtggacctctccccacagctggttaccactgtctggggaaggcccagatggagggcccatttgttaactggtctgtggcttctgtgaccaatccacaatgtaaggacacacctacctgtcgtggagggcaggagaggagtgtgcacagtgatgaaatcacagagaggccagatctcctccaggggcagctgctgaacaccaaaggaggccgagacctctggggaaatgatggggtcataccctatagtctggttggaagcaagagagagggaggaagtgtcattcttaattattagtattgttattattaagaatggcaaacattttttgagcatttaccatatactaactaccatgctcagcttaattaattctccagttaatttaccatacactaagtaccatgttccacatactaagtactatttaccatatactaagtaccatgatcagcttaattaattctcatgaccacacaatgatgctgggactgttcttgtctgcttgagagctgagggaagcagggcttccacaatgaggaggggcacagccagagctcaaaagaaggtgcgtctgcctccatgctgtgatcacacacagatgcaacaatagctcatataggtctggacaaggtggagcttggaagtccttagaaagcagggagtcctgagggagggagggcagtcatgtagggagcggacagccaggaaagggagaaggagaaatggcagctgcagctggagggtccagtccaggaaacaggtgcatcaggtactaaaacagagtgagcagaagcgaaggaggaggacaacaggggtacaaggcaggacccagagtgggagcaagactgcatgccctctaaatcaggaagcctgacctgtgtcctcccccagtcactgcccactgtgtggaaaggtacaggtcagttcccctggacctgggtcctcaaccctaaataaaggagctgggcagatgattgcagccatctctcactctcacattcaatcactgggaattatttgaagagaaatcccccttaaccccgagacagaatgtaaagagtgagcccaggattagacaaaaacaaagaatacacagcatagtactttaacagcggttgtctctgggtagtggaattatttttctcctttttgctttcctgtgctttcaagttttctactacattattcataaattacttttgaaattagggatacagtatagatactttagaatataatgggaaagatgggtgccattgctcacacctataatcccagcactttgggaggctgaggcaggaggatcatttgaccccaggagtcagagactagctggagaaacatagtcagacccccccccctacaaaaaatttaaaaaactagccaagtttggtggcatgcacctgtgccacccagaaggctgaggcaggaggatcacttgggcctaggaggttgaggctgcagtgagccaagattgtgccactgcactccagcctgggtgacagaacaagatgtctcagaaaaaaaaaaaaaaataaaacaaaataaaaaagaacgtaataggaaagaggacttcaaattcagtaattctagggcagaagctaaaatggttatgattaaggtgaagcctctggatcccttttttcatcattagccttgtggaataaggaaagccaagtggccccacaccaaccatcaggcaggttttggggaaagatgctgcctctcccacgccctataagaacctccagctcagaacgctggtggtctttttcagacactgctgctcccctcggctgtaacctactcatttctggtggggaggagaaagtgtccaggcgaggagatgggatccctgccatcgttgtcacaagtcttcttcgtctgctggccctgaggccggccagaacaatggccctgttcatctctaatccagatgtatttttttttctcatatggagtggggagaggaagggaacaccaatagagatcacaaggtccagcctgactgacgtctactccatgctcaggagccaagaacaacctgggggctggcaggaggaaggaccctgcaggctgaacctggccccctccacagacaggtgactggggctggagggagggggttggggagaggagcaggtgagcatcttcctcaggggtgagcgaagcactgactcagcttccttctttcacagagagtatctcatttatctgcagatgactgcagggaaggaatctggctgagcaaacctctgttctcattttccatttgagataaccagggcagagaagagctgaactcagctgggggttggggttccgacactaggagacaacactgaggggatggaaagggtgacaacaggcccaggacacacgtgcctgtcagggtcctggtgtgtcctggaaagggtcagatgtcctaatatacagacattggagcacctctgggtacccaccattcaaagactactcccggagagaagccttggggagaaacatgaaggggttccctcacctcaatcccagccccagggcagactcctgatgttgaggcaacagaggaagcctcactttctaagcaggactccagggcagctggtggctcctacctgcctgaggtcacagaagacagccctgagaggctggtatgctggctgcagggccttgctggctcagcagagcaaagaggagagcaaggaggcctcccagttaaagaggctctgaagaagaaccctcaccgtcacgtgctctctctgccccacagctgaatttttagtttagcattggaactctccctaccacggcaatgaaatcttaaacagagacccaaatataaaaataggtcaattcaaagctgcagaggtaaaggctcaatgtgccaccacctgctgtctccctgggcccctccttgctcccacctgtgtccctaaggcaccttgccagaacccgaggctcttgagtttgagaatcactgctctgggcagtaagcattccaggtaacacactgagataggagctgcccatcctggagagtatctgtctttggaatagctaagcataccggcatggcacagggactgtttacctaaaatggatcatgaataaagttaagtggtactgggcaaagaatgccagcctggaaggctgagccgaaattcaccagttcatagttgcattatcttcagcatatcatagaaccttcctgggcctcagtttccttatctgtaaacctgggataataattctgaccctgcagagtcatttcaagcacaggaaccgacacagtagacctcagcaaacattagctggacctgaaaaaatcggtgataactggtgcctcaggttcaacatccaaccctctgggctaaagttggattcatcacaacgctggctacaaagaaactgttaagagatgcttgtctgttccctcaaggaaaaccttgatcataaagcacaaggctcgcttcttgattggtttgtgcctcttaacacattctaaggaacacaccagcatgaatgagctgagtctctgaggtcacgacctgtcattcagcaacactattgagaaaaagtctctcgcagacacaacagtatagagcgttaagacctgtatgactcagaccacaggtaggctgcaggtcaggccacagtgtgaggaatgtcacctcccttgctccggaagccatacttcttttaatgctgccaaatgtcaggttaccttttctatcagctatgccactgacaaccacactgctcttttgtaaaccaaagccctgctcccccagaaaagcttttgacaaatgcttctacatctaaaacttgtctagctgctttttggacccacaagtagggtgcagaaatgtattctagctaaatttcctgtgagggtgcccaaccattctagccttcatatgtctttttggacctgattctgcacccttaagtattaactacctctccttgcttcctgccatccacaaatgacacatggttcaggctgttgatgagaatggtgggcaaggtggagcactattgcatactatctccctccaaactgaggtggcccattccacaacagcaccaagcactaatcccttcaatagcaccaagctcaaggggctccatccgaaccccgagggaatcatgaaagatgtcttaccaaagtccatatctatacacaatctaaatacccatcattgagagaatggccaaataaaaagcaatttatctgcacaataaaattccacacaactgtttaaaaatatgctagatttagttgttctgagataaacatgtttttttcttaacatcacaaacaatattctattgtttgcagccaaagaatccatccacaggcatggaactgtatgcattctgtgcaaatgcatagaaaagtctcggatgacatgctaaactgatgtttaccgtgaggagactagggttcagatggtaatcaagtatagccttgtccaagttttaatttatatgagaatgcattcctttattacatgattaaaacataactttaaatagtccgggtatctgacatctagggatttccatactctaccagtttaataatggtttccaaaaagaggatgaggctagtatgaaataacttgtgtttaataaacacttatcctcatttcctgtctgggtgcttatacatctctttcacaatatgttcaagaatcttcctttccctttagaaaatcttgttctccaagaccggtagaactgatgagctctccgccctaagacaaaattcatccagactcaaaagtatgataatgacgtggttgaggtaagcagctgagcacgagaagaggccacttagactctccggaatgatgaggtccaggcagctccggaggggctgaggtgggagacggaatgatccaagccatgtttcaggggtttacaaagagcatgttctggaagcaagacagttaagaatgaccctccagagacatctggacagaagaaatgcaaagtgaaggcactggcaccctccacaccatgctgggaatgggaataaaacattcagtgggtgacctgctctgaggcacagattaacactgaaatgagcaggccgtagacatctctttcaatcaaacacatgcacgagaggtgtcagccatttcctgacactgatgctcaaggtcccaggtacccatgcacctcttggaagcatcccagggtagagagttgggcagtgccagatggacagacaagcttacctagcacctcaatcattcaggaatgaggtggggcttttcatctggttgaagtcgctgccgaagtctccatgatgaagaatattgccaggaatattgatgtgtagtggtgccacggagaaggaagcctggggaaggggagtcatggggaagaggaccccctggggaagggggcaggagccttggaacggccactggtctggagcctgtctcccagttactgcttcatcaatgaaatgctcacctatttggctatgagtgctcttagttttacttaactcctgacctctgccttttatatcaaaattctccatggactaaaccttgacccttgatcccttacaaaagaggatggaggagggagtgctctttgtggcttatggcatcccaccatccctgcacagagggcaaggctgtggtttgtttacatgatcaatgatcctgctgggctacatctgcctctctcaggagtccagggatcaagaatacacctggcccttctcagtgcagaggcttaggaaagatatctggctgacttaaataaataagatggggagtggaggcaggagggagaggataatattcaatgtgtacaatgggatgctcaccaggctctaggctactgtccatttgctatgagtccttaggcataagcttacaaattctagatgtcaatgtaaaattaagggttaatctattaagatcccttctaactctaagaaggtaggagggatgtagaaaaagggagagttccatagcagctctatgtaaacttttctagatttgacatgatctggttgtcaaaactgatctcctaatgtttaaagacttcctggctgcagtttgaccccataatccctgtaattccctaaaacagaaagtgaacagagagatgtcccatagtagccttagtgggttcatctctttggcctatctgggaagccctgcagatcccctctcttagctgaattgcctctctcatttgcaaggtctcctggattagcccaagtgggtggcactgctactgatggcaaccagagggttgcaatcaggctaagggagtagccagaagcctactgagctcccagagtaggaaaaggcagagacctgggggaagacaggagttaggtgtgatttctgagaccggtgtgaggtcttccagccaccataggctctacaatcatatcatagtgtacatacaagcacttttaaatcttttctgaaatatggagggaaactggaaggacagatggacaatggatgtaaggctctactgtgaggccataaacttgttcctgttttctaaattatcacaggaaagcagacaaaacaaaagcaggaaggaaagaaagaatgggcaggacacaagcaccctccctgtgaggcaggataggtaatcaaggaagtgcagcaaccttggtgatcctatagtcaacacaataagcctcggtattcatattctaactgagctcattcaagcaaagctatcttcagtagggaacttcccatctagacagcctgtgcactttgatttttcctgtcctcaaactgaccccctggctcattataatagtaaaaaacacactcctgggtggagatttaagatgctaataagacatgtgccaaatgaacaagaatgtacagctactactcatgtgcacccagaggaccacccaaaacatgcttactagtaacagctcttcccacctccttatgaataatcatgtaaaactcctataaagggagtttctccagcaataatcaacactgcctcattcgtttttgtttttgtttctgttttttaagacggagtctcgctctgtcgcccaggctggagtgcagtggcatgatctcggctcactgcaagctccgcctcccgggttcacgccattctcctgcctcagcctcccaagtagctgggactacaggcgcccgccaccacgcccggctaatttttttttttttttttttagtagcgatgcggtttcaccatgttatccaggatggtcttgatctcctgacctcatgatctgcctgcctcggcctcccaaagtgctggattacaggcgtgagccaccgcgcccggccaacactgcctcactcttatgagcagcccaccctgaattctctctctcccgaggtgtactgtctactctgcacttaactttcaaaatattctttttcctttgcaataaactcctcaatgctgcaccgtgtctcttgtttaaattcttttaaactaagaagacaggaaccaaagtctcaaaagagccatcaacacctggttcactgggactcagggctattcactcaccagagagctaaaggacccccaccaagtatttccagcttttgagtccagatcagcaggccagtgttctctccctccttgactttaacacttatttagatgggggctccaagagagggtcagaccctcctagaacaaagcttctggcttctgcccagacatgctgcctttcccaaaattgctgcagaaagtcccacatcacagggttccagcaacatcttaccttcatcccaaaggactgcatccgggtagctacctctctcccaatcctgcccaggccaagaattcccagggtctttccattcagctctgttcccatgaactgca

SEQ ID NO: 2856 - DNA, 5430 bp, Homo sapiens
ctactaaaaatacaaaaattagccaggtttggtgggaggcacctgcaatttcagctactggggaggctgaggcaggagaatcgcttgaatctgggaggcagaggttgtagtaagctgagattgcaccattgccctccagcctgggcaaagaagtgagactccattaaagaaaaaaaagaagtttatttgggtaatgccatatggaaaggagatgaaaatatagatgtatatggggatataaacttgttgcagattacacaaaattatatgtttaagcagagaatagtccagttaaaattgggatatacttaatttgctaagaacaatgtaatgctaccagcatgcttaaaattaaaaaaactaagagaatgtaagttcaaaatgagtgtcacatgactataattgatagtaaatcttcacttacctccataacttaggagtcatgaaaagaaagaagttagcagaccaggcatgtaaatcagatgtaagtaggatggaatacagaaatattcctagttctgggtaacccaatttgaggtcattttaagtttactgaatttggattaatcaattggttcaataatcaaggtaaaatggtccaaaagatcctgatatatccagaagacatattactgaggttttacaaggctaatttgaaatgcagattaacattctaggtttccttacatatcattaaaatagaccatattaaaaatcaatttcagaagctgctttatgactggaataaaaaacaattaaagatgtagagtaacattgtatttctgtctgatgctgggaggctattttttcatggcaagtaataactgggtaaacagagagatactttaactttacaaataggaatcctagaaaacaaggttttgctcctagaaaacaaaaatagttcctttcaattaattttctaaaaatggttgcattggtcactttttaaactcctacaatctaagcagcactgaattcctatttgatttttttttttgctaatagttttcttcagaagcaaacctgctttagggtgaaaaaaagtttcagaccttagacagaaccttcatttcctcttaagtatgtttctccatcaaaaacaagtattcaaataaagaatctcaattatctaaacctatttttggccatcttccggaatttcttgttaaatctcctttgaaatgccacagttgcactcttggaaaacttgtcttcctggttttcaaatttctgtttattattacagctcttcagctagaatgccaggtctttgtgctgtactgtttcttgaaactggagactagcacacttcccccaattcaattacttgctttccatttgagaaattaaagccaggtcaattttataaagttttaactgactgaattatttggactttaagttctcaatttcattcccttagcctaatactgggaaagatcttggttttattgagagaaggtaaggtttaagagtattaacacatttcagtcattgactcttataattgatataagcgtagggattttctaacaggcacacgcttgagatatgacactctaaggaaaaaagggagagttcttattcaattctagaaatgtttaagattacatactaatgatatagtttatttacataaatgtgtgttcatattttttctaaaagaaagggaccgactgtccttcataaagagcttcagtcagcttttctacccttatcagccttatgtaactgccaaatttacctctccagcctgacttttacatagaattccagttctgtatatccagccaccttaaatgaagacatttcaagctgaacgcctaaatatcaccttaaatacattgcagaaatggaacatattttccccctcttaaactagtttcttttcttttttttttgacagagtcactctgtcacccaggctggagtgcagtggcatgatctcggctcactgcagcctccactgcccaggttcaagcgattctcctgcctcagcctcctgagtagctgggattacaggcatgagccaccacgtctgactgatttttgtatttttagtagaggtggggtttcaccatgtttgccaggctggtctcgaactcctgacctcaagggatccacccacctctgcttcccaaagtgttaagattacaggcatgagccatcgcacccggccttaaactagtttcttaactatctcctttctttcattggtaactccattgtcttccagtatagaaaatgtataatcttttacacctcccttttatccaacccatcatgatattcaacaactttttcctttgaaatatcttaaatttattctttcacctccattctcctgccactattgctgttcaggtttcttcacccctagattactacagtagtcacatgcccagtttccttgctaccatattttatttcttagacatttctatatatagtattgccacatttaattccaaacaaatcaataggctataatgcctccctattccctgctatatcaagaccaaaatcctctaattggttttctaggcaaaggctcaatagcctagttctaacctagtaatacaaattcatgtaacctttgccttaggttttatggcacagatcccaggttacttctgggggaatgttgcattcaattttggcttaaattcctacctacaaaccagacaagtccattacttgacaactcaatgcattttaatttacaagcatgcaggccacaaattataaaatgaagactttttactgagtcagcagaaacaactgttcaattctcctgtaagtccccagttacttacagttttctgctgaggtgatcatctcatgtggcatttattgccctctactaaaatgagctattatctgacactctgctctgtacagacgtgtttctgtttccattttcagttccttctccacatggtctaagtaccagtagtttagtcagttctcaccttttttgaggggaaggcggcaatggtggtatcaaaatttacacctggaaaacaggtcataaagaaaatcaatatagaagggaaagtgctttaccacaggaattattatttaattgctggttgaattcttgacttttggttaaaaggtagatataacaaatatgtaaaccaccctcaaagccaaaccaaaaccaacagcaacaggcttttcaatcaatgtaatttatacattgggttctggaaaacagaaatgtcctataaattttatataaatgctatataagggtacataaaaatgaatccttattataaatatgacttaaatgtcatagcagtaaacaaatggtacttatttgatccacaaatttctttgccttcttagatttttttgaaagttttggtgtggcttggtttctttttgaagggccgagctgggagaaggaggaaaggcatttggtctcctataaaattgtccaagaaagtttatgagaaagcctatatcactcaataaggtggctccagtaagtttaggcattcaaaaacattccattaattttagagttaccttaaagaattacagcagatcctcaatgcttttgtttctgtgattacggtaatggcatttcttgaagtgaagtagtaaaaggtagagggcactcctaaattatcagaaaataacctgcatatttctgtatttatctagcaggtatgcagcctttctaccactttaccataaaggtattactcctgattttcagcaatcaatggtcacttattttacacctactatgtttaagacactagactaggcttgcagaatatacgataaagaataagatggccccttcccataagacagcatgcatttgttctaagtcaggtatggaagcttaaatgagagaaatggtatttttggctgaggaggaaaagtgaactggaaaaatttcatgtagggggtaaatagcttaagttttagacaattgaagatgaaggaaaggacattctaggagtaaataacttgagttaaggcttggatgaaaatctgagtgaggtttgaaaaagtattatttctctttggcttaacaacagttattatggtattcattgacaattactcccatagtggtaaagtcaatcttacttaaggcaaaaaatatcctagatatagcattttgcctaggcaactctttcctctcaagatttctcacctgatttgctgagttaaaagccacagactcccaattatttagggtaaacttatttatgcctaggtttccttccagtatttcttacaagttttttgtttttttttcttcaaagcaacacaccatggctcttgaagggctgcaggcaatctgaatacccttgttttctttgattagaaatgagggtaaattatgcaaaggaaggaaaacaatctcaaacatgattatactcatttccctaccaattccctagtatctactctttgccttcattatactgtatctactttactccttgctacttcatcatgtcttggttcatgttgttttctgcactcgcaagttatcattccttcatttcacataatcaatcttaaccactttttcagcccagctcacctttcatatcctcttataagtcttctctgataagtttaagtccacatttccttcaagcttctaccacacttaagttagcaagccagagtttacattccattattctctacttgtttcttgtatgttagtataatattctcatacaggttacagttctttgctgacagggaccatcttttataaactatagtgaagtaccgcacctagagtaggcccttaataataaagataatgtcactttaaaaatgcaagcaggaaacgcttcaggcatttaaaagtagtattttaacaataactatttttgattaaataaaactatattcattcttcttttcagaacttgaagcctcaaattatcacctcagatcatcatgctattaaaaagtagatgtgcatatgaataaaactgtccaactctatcacttatacacaacacagccatgaacaaaagcagcagccattcttgataatccaatcccctctgaaacaaacaatttctggcagtaggagacatttacaaatacatagccttgctaacaaccactaggttataacggaaaaggtttgtaatttgaatcctttagagtgtgcatctttcaaatgtgtagtgaaatcataaatacaatgtaattttgttcagtttggaatgaagtgaaattttgcttaaaggaaatgaagattattcaagttgaagctttagttaacctgcattagtcactagcattctacttccaaaaaaaaaaaaaaaagtcaatcttaggaaaaattgcaatcaaacatcaaacatccttggcttaaaacacattcagcacaatttttaaaacctctatacctacattacagaatatagt

SEQ ID NO: 2857 - DNA, 19562 bp, Homo sapiens
aggccgccgcggcggcgcccgcccgcgcctccatccgggtcctggcgcggtgctctcccggcagcgacgggcgcgagggccggggcattcccacggccgcgacggccctctccgcgagcgcgaggtgggtatggcggacgcggcagcgagcgcgggtccgtcgccattttatttcgcggagactcgcggcagcgggtgggcagaatgggagagccgtgcgccggcccgcgcctgtccggctaacgcgggctgggactggtggggcggcctgccccctccagcgggcgggtggccccggggggccggcgggctgctagcggaagtcgcgggcgctcggggcacgggggaggggtgccgcgtggccgccgcggggccggctccaaccccctccgcttcccgcccagctcctcaccgacagggcgggggagggggggtcattcttcacattccttaccccgcccttccccccgcttcaatcaaacttggggcgggcggaaggcccgccttccggccggcgcctgttggccggcgccgcctctgactgtggcgtgactggttgtaggcgccgccaggtgcctctgacgtcacttccgctatcaagtttgtgggccggggagaccttggccttgggggttgggatgaaggagggaaggtaggaagtgcgaggggcggggggacagggcgggaaggcgcgggcggggagggcgggagagtcgtggctggctgcatgcccctgctccccgcggccaagtgcagcctcccttcctgaagcagctgctgcggctggaggtccgctgcggcagccgtccttggcgagggggaggggaacgcgggagcgggaggaaatcgtatcccgggggacggggcttggagatttgcgactcggtgtcaccggaaacagcgctggccttttgagtcgacgctgcaaactcttggaaccgagtgcctctcagaaggcttgctaataaacttcccgggcgggctctagtgtgaggaatgtggtaacctgtatgtccttggccagtaatgcccttcggtctttcaactttttacagtagattctgtgtcagaggtaatggtatgtattcttcaacttaccggtttttaaaaaattgactaacgagagggcgggcagacaggaaaaaggcagggaagacagtgaatgttaaaattttgaggtaaatcaggagactggttgagttttgctttttaacttcattgataatactgctttcttggcatacagttcctaaagttaaagcatcatgtggcattcctttgcatttatttctgttggcctgaagtataagaacattgaatgtcaaattccaaatttatgtgtagtttaggaaataattgtttatatccagaattcttttggtgtttggcggggtctggttttatttactgtatattcgggaagtatgtgtagttagggaagtaaaaacttggaagttactttgggttttgtgagaatgtttgattcattatacatatttgttaaaagtttactttgaaacttcaactttgagaatagacaaatttcttgacgtcctgtaaattcagtggtattatatagcattttaaaatttatcacttaggtgcaattacagtgtgaggggaaaagttaacttttttgaatagttacattgcagtgacagcaagagagtatttttatgtgtagacaggctgtgggttcccctcacttaaattgaagctctgttgaacttgagacacttaagaatcttgcaagtgtgaaaagtggagtgaaacaaaaccatttctaaaacgaaaatgtgtaactgcgttcagttttacacagtgaagaaataagtattaaacaagttagtctcaaacgtttatatcttaaggtcattttattcctgttatcattaactagacatatcttggtttagagagcagcacacaagacattgtgtacttttaatagctaagatagtataataactactcatatgggaattaccgagtgttaagagcgccaaactagtgtttcaaactgtaggtcctgagttatagggtcatgaagtcactttagtgggtggtgatccgaattttttaaaaagtagaaaatattccattgaatacaaaatagcgtgttgattcagctcgacacatgtgtattcctgtaaaataatcctgtgaagctgagtgtcaaaagttgaaaaacaacttctgtagggtgtttttctcgtttatagcattgtgtaaagtattatagtttaatattttttaacgagtattaaatgggctgtttatatttggtggaacatgagccacctactttagtttcacaagttgggaagtaaatttgccatccaggaccagtatgcgttttaatcatagtatttttaatagcctgtgaagcttttctttagaccataagaggtcttttccatcccataatatttattgccaattatttatccatgtctagatgagactagaagaatccgaatccccagtaatgagttgtcagcattgcttaatgtgacctcaggactgatcatcatatgctttttgcctgtgtaggtgttctaagcgttgtataatcacttaagaatggacttcattaaatagacaaaatatgagagccattacactatttttggtattaagtctttgaaatccagactgttttacacttgcaacacatacacttggggctaatcacatttcaggtgctcagtagcaacatgtgactaacagctaccaaatgaacagtgcagttctagtgcactgtttttaaaaaaattagatttttttttaaaattagatttctctagctgaatagttgtagtttcagataaacagccaaaaatgttctgtctctccacagcttcatctcaattgtgaagaaattgcattaggtgatttttttttttttttttttttaaataatagaaacaacgtctcactatgttgcccaggctggtctccaactcctgagctcaagtgatccttcttcctcagcctcccaaagtgctaagattacaggtgtgagccaccgggttcctggccgaatcaggtgatttcttaggccctttctaaatacaaggtttaagtgttttgaggcagccgacagctatacctttaagtctcttgcttctctaagaataagacattttggatcatttgttctaccataacgtaatgaatacaagttgggagcattttgctcttctgttaagcacagttggccttcctgtccaaggatttttgcatccttgaattcaactaacctcaaatggaaaatatttgggggaaaaaaagtatgtacaacaaaaataatatgatcaaaaataatacagtataacgactatttacataacttttacattgtattaggtattgtaagtaatctatgtaggaggatgtgtgtaggttacatgcaaatatgacaccacattttataagggacttgagcatctgaggattttcctctgggagaaggaggtatcctggaggcaatcccctgaggatacttttctactttgtgtgaatttttcattaacaggaagttacagtacttttctggtcacctgagaaacccaccccatatttttattagccaaatatataattctcgaatgcttagaattcatttcttaatgatttcactgttgtgcagtatagactgtgaattgcctactaaggatacagttaattatagtaaactgtggaatctagattaaataattacaccctactttttttcttggcttgtggatgtgtagactacatagtggttttttcaacccaggaacataacagtataatggaggataggaaggcagaagatgtttaaagggttgagaaataatggtatatgtataatggtcagtaagcagaacaagccagccaagttggatattcttcaagactatcttaagtgtctgctatgtgtctaagtgaaaggaaataagcaatagtccttttgggaaacctgacctagtacttagctatttcagacttaatgtgatgtttgatagagtaggaaataagatcttaaattagaattaggttaaattgctttagagaaacttatttataaatgtaaagaatttattatctcatgtgttgcacatgctctatcgaagggagcaaaatactattggagagtttgcttattaatgtaatactcagcctgcatcattgtcggataattttgttgataattcaactatttgagattgaaagaaatctgttaaagtagccagtgttgtaattttgatctgtgtttgattacagcgtatgaaacaaaaatgagactggaggaaatagtttacttgtgaactttttgagctactttgttttaggagtatttaaattaatgtaaaagtgtagggaaatgtcttagctcagaaaatttaaacttactagatattaagtgcttaaaaggtagagtatgcttgcatttcaactaaagtttagagtgttttaggaaattagaggctattttaaaaaatattttgaagttaggagtgtgttcctaagtgttttcaccataagaaaataagtctgtggggatagtacatatgttaattaacttgatttagctataatataaacctattttatgtacaccataaaaataacaatttttatgtcaatttgaaacaaattcattacaaaaatgaaattaggaatgtgaatgttaataagttatgaaaacttacttgatgtaaatgtagatatagacaagtctataactaatagatttgcctgctttgtagcatgctttaaattgataatatttttaactatcacaagtatatctggaaaggtaaaattcctgttaggatagtttgtcaaattaatttattaagtacagttgccatttgttgagttaatttctcagtcattcaatatctttgcatgtatcccagtcctgacagcaaccccatgaggtgtggctgttacagttcccccaaatggcgatgagagaacacagccactaagtagctgcttggctgcttgaccctgaaaccattgcccttaaccattttcctgtactggtatgctgagctgaatgaaatgaagatacattttgtgtaagttgaattttgacttttagttgccataaattaattaaataatttattattgtatatatttttttgagacagttttgctcttcttgcccaggctggagtgtaatggtgcgatcttggtctactgcaacctctgcctcctgggttcaagcgattctcctacctcagcctcctgagtagctgggattacaggtgcctaccaccatgcctggcaaatttttgtatttttagtagagatgggttttcaccatgttggccaggctggtcccaaactcctgacctcaggtgatccactcgcctgggcctctcaaagtgctgggattataggtgtgagccactgtgcctggccagttgccgtaatatatatatattttttttgagaccgcatcttgctctgttgcccaggctggagtgcggtggcatgatctcggctccatgcaacctccaccttccaggttcaagcgattcttctgcctcagcctcccgagtagctaggactacaggcgcatgccaccatgcctggctgatttttttatttttagtagagagggggtttcaccatattggccaggctggtttcgaactcctgacctcatgatttgccctcctgggcctcccaaagtgctgggattacaggcatgagccactgtgcctggccatttgccataacttttaatgagagggtagttccagctacagattgaggtagtatgtgaataaggatagaaagtggatataaaagtatttttgttactttttaagaaagaattatcagaaggctcaaattctgataattttagctaatagtattctacctaagaagtaaacaaaggcccagaaattagatgatatgtccaaggacatagtaaatggggagccagcattaactgtagacagaaaaacttcaagtcctaaatgtatactagctatcaacccactctttcccagtacgcaagcattacatagttgtgattagttagttagggcttttaattaacttccaaatgaatatttccatgggttcttgtaatccataaattcatggattatgttcagtgtttatgagagctggccctaactgaacattgctcggctgtttggttttagtttccaccatttgctgtaatcagtgttttctaaactgcaggctgggaaccattagattataaaatcagttcatgtatataataaaataacatattagagtaagtattgatttgtgaacaatattatttattggattacttatatacatatacttttcaaaaaattgagggtcatgttaatagcacttggtatgtaaattaccagaatgctttctagcaatatggtatttatttacatagctggattgagaaagaataatacaaagtaagcatgtgacaccaaggttggaaaaaaaatgtgtttttgaatgtttgatgaggattcaaacatgttttaaatgagaaaatcggtaggaggttgaggattgtagtagaagtaccagatgctttttcttttagctgttttttttcgttgctgttgtttggttggttttggttttggtttttttttttttttttttggctgttattgttttaaaagtaaggactaggccgggtgcagtggctcacgcctgtaatcccagcactttgagaggcgaaggcaggcaggcaggcagatcacctgaggtcaggagttcgagaccagcctggccaacatggtgaaaccccgtctttactaaaaatacaaaaatgagctgggcgtgatggtggatgcctataatcccagctacttggggggctgaggcaggaaaatcgcttgaacccaggaggcggaggtttcaggagccaagatcacacggttgcactccagcctgggtgacagagcaagacctcgtctctaaaaaaataaaagtaaggacagtgctgattcatgggaaatattttggcttataaagggcctgacgttagggacaagtgtgtctgtgagttcctagtttgcataacctggccttgtagaattgaaatggtctcaaatgtagtatagtttagtgatgcagtactgtctctaatttggggcaagttattaagcttcttaccaccagttttcatctagagatgatgaagtagttggaccttacatattttggatatatggtattaataaatctttccctttttgttacagacgtgttgatactgcagctaggaaagctgagggacttcggctaaatttcttttgcaagatttcaatggcagagaattagtagggccaggatttgaaccctggtttttattgactccaaatgagtaatgctgtgaacattcaaatacacgttttttcaattctcttgccctttttttttgcggggaggggcagggtctcactctcttgctctgactggagtgcagtggtgtggtcatagcttactgcaacctttaactcctaggctcaagcaatcttcctgcctcaacctcctgagtaactcagctgggaccataagcctgcaccaccacacccagccatgttcagttctctagagtatatacctagaaatggaattgctgggtcatatggtgaactgttttttactcatcactaaccagttctgacaccaacaatcaattcttcaactcgacaccaacagagtgtcctacaattaaatttaattctgaaactacctgaagttagtacaaacttcacaggttgagggctcaaacacgtaagactgcccccgcttcagatgcaggtttctacctgaatttttaaccaaccagctataaattagggggtttcacaacctcttccactgggtctataatttgctaggatggcttacagaacacaggaagacactcattatcactggtttattataaaggatttaaatgaatagccagatgaagaggtccttaagctgaagtccaggagggttcctagcacaggagcttctgtatctatggagttagggttacaccagcctcctggcatgaagatgtgtttttcaactcagagctgtccaaaccctgacacttaaggggtttttatggaggtttcatacttaggcatgattgattacattattggcctttgatgattggcttactctctgtcctctctgctttacctggaggttgagggggtgaggctgaaagttccacccctctaatcacaccttggtctttctggtgactatccccctcctgaaactacaggagccaccaatcgactcagtagcattaaacagacattcatcacttaggaaattctgagggttttaggagctgtatgccagccaggatcttcaaatggagacaaagacgaaatacgtgtttctgattccacttaacaactgtttgacttgtctacaagttttgttctccaaagcagctgcaccatttcacattcccaccagcaatctaagggttccaattttctccgcatccttgtcaacacttttattaatcttattagccatcctaatgaataatgtatcttttcatgtgcctgttggccatttgtgcttatgagtcatatctttggtgaaatatctattaaaatattttaccattaaattaggttgttttaagttactttaatgtgtgttttgcacaccagtttacaaagaatgcagatccattttttttgcatgtggctatacagccgtcagcattatttgttgaaaaaacgattcccagttgaattgtcttgtcatggttgaaaatcagttgacccatgtatgggtttatttctagactttaaattctattatattgagccgtatgttttttattacgttttgtaattttaaaaattagtgcttttggttactaaatcactacaaaataaatttagtccctatcttaaaagataatcttcgtagtagctacctcctaaatatgaagtctgtaaattaaagggtaataatacagtttagattacttgggtttattaaagattttggactctgccttcaatccacatattacctttctatctaaaggaaaggatcctgaccctgaatcagatccaggtgattatctttgatttagtcctaataagaccacttagtgtttgctcgcatgggataaatgagtaggttcctttaaaaattagtttctatttgtgtgtgttttttatattatctcgttgtatgttagtgcatttggattatgcatgatgtacaggacttttgggttttgaagtcattggatttttaattagaggctgtcatgtttttctgtaatgattttttgttgtttcttgaaggataagttatttcatgcattttcatttgtaggaactgtaagaaaaccagcagttaataatagtaaaaggtggtggtaagagggtgatttctgaatcttgtaaatacatggttttaggagcggattcagataaccaagcatttaaaatactattaatgaaatacaggaaatgaaaccacagcatagattatgcatgtagccaaaatgttcagttaaacttcattttcaacgtaagtgaatgaaaatggtctaatactatttttcttatcactcacacaggaaaccaggattaccgaggaggaaaaaaagccttcctgtggtgctcaactgtgattccttttcaccattcaccctggatgttctcttcactgtgggatgaggtagtaggttgtatagttttagggtcacacccaccactgggagataactatacaatctactgtctttcctaacgtgatagaaaagtctgcatccaggcggtctgatagaaagtcagttaactaattgtacaatatttaagattaacttgtcttaaagagatgtagtgcagcatttgtttatggcctggaaataaattaatttagagataaagtctgtagcaagtacactggatgggggtggggaaaccttttgcttcttgtcttatttctctgtgtcagaataaatgtatttttttattttgatttatgctgataattttatgttgaaattttctttcgaaagagattgtactttccattccagaagaaaacattgctctatcagagtgaggtagtagattgtatagttgtggggtagtgattttaccctgttcaggagataactatacaatctattgccttccctgaggagtagacttgctgcattattttctttttatttagatgatattaaaactcagaagaattaattttgacattttgtatttacagtttatcagttaattttctctgttcaagtagtacagtaggcacagattaacatttaaatttttcacatatggtatatttcagaaatttgaagttaagcaaaaattttaatgagtagagaaagtaagtagccttcaggaaatcttcatagaggaccaggcccttttggaattgtgaataggtttattgccttacatcctggtacacatgtccaaggtcaggtcctgggtggtaaaggtaaatacaaattggaagggcactgtgtgagccaaaatgagtcagattagtcatgattcatttccagtttgggttttgggtggtcttggagaatgttgtaagcactgcttcattgataggttgattgagccagactttactcagcagcctggaaaaggagagatgggctctgggttctacctttgctcactggtaagttgctaagatttcagctttgccctcaaaccctgaagtagtccttcattcacacagtgggatcactcgaaaatgtcagatggggaagtccataggttgttactttaaagaaaatagaaaaaatgctggaaaaggtttcttcaattttaatacccatgaaggcccatgttttagctttcctccgatgggcaaaccatacactaacttgggccttgtaatcaacaagcaaggctaaaagctctctaagtgcttgctgtttaaactattttgtgttggaagaagagttggaaaagaggcagtgtggaggtgagggagaagttccctccctccaatcatttccaataaatggaaatttaaggagaaatttgtgtttatccttaatatctaagataatcactgtgcagtgccattggtacttttcatgagagtagaaacatcaaacttccttggatgggcccaacccaggtgacttaactctggaccaaatgtatgctttttgttttatccactgtggacagctgcatagataattggtctttgttctaaactgcacataaaaacatgggagaaaatgacatttgttgccttttgatgtgccaaagaagagtgggaatgttctaagaattctttttggcttaatctttgttgaattgaaaatatgtataactcttctgctgaaagtgtagcaagtacagtcatgaaattttgtggtcttcctgacatgttcttccagcataacgttgccaccttcagttggaaacgtatccttatctaataattaagccctggagaaaaattaatttatatattttattaattacataaggacattgttattagctaagcagagtaagtaaatcgaaataaaactttaaaaatgcctttatggagagaatgactatctctgaaagcttgtttttaatgatgataaaattcatgatcagaatttgtttctgtttgctttaattcaggggtcaaaaactgaaataccatcagaggcccaggaggggctagttgtaactggcaaatatagtaaattaatttgctctggttgataggtagcaagcagggtttatatacattgtcacctacttttccagttaacaggagagactggagattttatgaaatttgatatttaaatgttggtaactgggttgggcaccatggctcacacctctaatcccagcacttcgggaggctgaggcgggtggagcacctgaggtcaggagttaaagaccatcctgaccagcctggtgaaacacagtctctaataaagatacaaaaattaggccgggtgtggtggctcatgccggtaatcccagcactttggggaggccaaggtgggcggatcacctgagtcaggagtttgagaccagcctgcctaaatggtgaaaacctgtttctactaaaaatacaaaaaagtagctgggcgtggtggtgggcgcctgtaatcccagctactctgggggctgaggcaggagaatcacttaaacccaggaggcagaggttgcagtgagccgagatcacaccactgtactccagcctgggtgacagagcgagactgtccaaaaaaaaaattgataattaaatgttaaaagtcagcgactccagtaatacgtggtgggctgagtattagactactggcttacatcctctgatgtcattactttcttgttcgtttgtgacttgaggttggattttaagcaaatgtatttgtggctttttaccaaggtcatatggccagataacttttcaaaagcattagttaaagaattctgattagtttgaattagaaacaaaactcaaagaacatgacctaatttaacaggttaatttgaagtgcatctgccaagtagaagaccagcaagaaaaaaaaaatgggttcctaggaagaggtagtaggttgcatagttttagggcagggattttgcccacaaggaggtaactatacgacctgctgcctttcttagggccttattattcaccgataacctgtttccttgctactttgctttggtgtaagcagagttctttctgtaggttttttcaaatgaaaacattgcaagaatatcaaagagagcagtgtttgcgttagtgattataaactgcagcatggtgctgacattgataactgaaagtcaactaatgagaatttgagacttctgaagtacacttagttgctagtgtctcccttttggtgtcactggaaagtttagaaagcatggttttgtttttgctcaggtttctctttctgtgatgcagagactctcagctgttcctcctctatgtctacattatgtctgaaggaaagaatttaacaaaacttgaaatactgctgtttttctacaatgtttgtaaatatttatcttgctgcttttctaggtttgtcttctggatttaaaatttggggcggctggggtggaattgcatggtttgggaatgggtaattgagctgctgctcattatggtatgtaacagtgatttgtctgtttaatatgtacaagaactggaaggtcaataaaatgaaagtggttgtcttgactgggtaatagtgttacatattttgttaaaagttatacatcttttcaataaaaacactgcatacttcaaaactagtgctttttaagtcatccttaacccttatccccatccttgcagtagtagatgcatttttcatttgtaattattatgatttgttcttagtttcatttttcattagcaataatttggtgattggatggtcatttacagatgttttaataaagctaacacgagcaatttccagctcttccatttttgtaaacacttgtgtgactttgtacagacaattaactgctcaggatcaccctcctttttgttttgtttttgagatggtctcattccgtcacccatgctggagtgtagtgaaatgatcacagctcactgcagccttgacctcccggactcaagcttcctagtaactgggactacaggtgcatacaaccatgcctggctaattttatttttgtagagacggtttcaccatattgcccagactggtcttgaactcctgattatcctctggcttttacctcccaaagtgctggccaggacagcctcctttctttacttgagtaattatttgagtttgctcaggcagacactaccttgtaaaaactcttatgtctcatttcactagtctagtttgagcatttatcattctaggaatgagacgaatttgtgcattagcattccatctttttccaactactatgaacagtagtatttttttttattttattttattttttgagacaaaatctcactgtttcccaggctagagtgcagtggtgtgatctcagctcactgctgcaacctccacctcctgggtagagtagacaggatttaggtaattttttgtatttttattagagacagggtttcactatgttggccaggctggtcttgaactcctggcctcaagtgatccaccggccgtggccttccagagtgctgggattacaggtgtgaaccacccttgcctgatcatgagcagtaatacatttaaaagtctccaggggtgagaaagttgaaaggaaattcagtggagtttcccatcctgcccctctgctgcctagccccttgctccagtggaaggaagaatcgtgatctagggatgttctcatacttggggctttaaatttcctttatgaattgagatggttgggtatgttttctaaggtaccttacatggtacagttctttaaagttgaagatttaagttgtggcaaaattgcatcaatttcatgtgcactgatttaggcgaagatgcgtaggaaaagagcaaggaaatgaggtgtgataggattggggtaatttcaaaatgagtatttctgcctggcctagtggttcacgcctgtaatcacagcactttgggaggccaaggcaggcagatcccctgaggtcaagagttcgagaccagcctggccaacatgatgaaaccccatcttactaaaaaaaagtagctggcatggtggtgggctacttgtgaggctgatgtaaggagaaccgcttgaaccagggaggtggaggttgcagtgaccagagattacgctattgcactccagcttggacgacagagcaagactgtcttaaaaatgtttctagtttcacttattctaaatttatgtctaaccatttttagtgaagtatttgagtcacatcagctagcctttttcctacagcgttgaagtaattttctaggttccttgctctccccccattttatttcctactttgctttctgttgttggggtcctatggggagggctgggaaaggagttgggccctcttaggactggtcatcaatctttgttctgagcagtgttttgttttctggttgaatggctgacctgaaggaagcatcagactccttgggattctgaaatcctatttcttgatagaaacccataacttattttagtttgacttaaaaacgatccataagtaagcatgcagggttggtgtaactgcattgaactggtaacatcagaaacacgggtagaaatgaggtaccccagtgatacggaagctttgtgactgatgtcctggattctttctagcttttcttccagccctaacacatggtttccattctcaaggttacctctgtaacaactgactgctataactggccacgtcgtttttccattcatgaagatggaaaaaggaaaaggcagaagggacacttttatggttgaattcatttagttttctcaagaaatgccacctagtgactcctttacgtgtaatcccttggaactatcacagactagaccaaggaatcctggaaagtggtcctggcaggactgattgccaggctgaatacaatcagggtcccactagtaaggaggggagaaaggaaataacacagatagttatctgcagtaattggcattaggaaaaaaaacttgacaaagactgacaagctctgttccactcctgccatttaaagaaaaacacacacacgcataaaaacaccaagtggcctcagatgggcagcactcctcctgaccctgggcttcagaaattttcactgggagtctgatgaggctcagccacagttgtgtgggactgttctcaatttcaagcagaggagcagagaaagctggttagttgcggaggcttcccacattacttggaccctacaatatatatgacttctatcacaggacatggtacagaactggaacaataaagcattttttaaaatttaatttcttgagcaattttagtttcacagcaaaattgagcagaaagtatagtgttcacatatacttccctgtttattacgcacacactgccttcctcactactgaagtcctgaccataatggtacattttaataaagcagtttgtttttcccttttctttgaagttgttccatcatgagaattaggctaaaagtcttagcttactgccccatggaaggaaggacaaatagcaatgaccaagcaacgtatttttagctttgaggccaaaattggctgaaaatgacagaagcagttacttcagagaaaatgattttttgcagttctgcataaatttgaagaggtaaacctggattgctgagaacaatgagttatatgcagtggactagaggaagatgcatattcaaccatgtctttttttccatccaagaagagttactagcaagcagtaagatgagaggaaatgaaaccagtcagactgctgagtgctggagaagcggtccctgtgcacactccggcatgggcatggtaggactacctgtatggattaaggggagtcaagggtcaggggatggttgatctgcatttttttccccagggcataacctgagaccacaaagcttctagggaagggttgtgtacatcatggccccacagcagtgagaggcttgaagaatgctctggctaaagacacggaggtgctgtggcaggcactgttacttgcctacccaaatatccccttgctgggagaaccttgattttgttgaggtatggatctcaggaaagttaccctagttttttgtctaggggtaggcatgtgaccagatttgatcagtgagatgtaaagaccagtggtagggagagggtttctttcttttcttctccctcccccgacccaccccagagtctcgctttgtcacccaggctgaaatgcaggggcgtggtcacggctcactgctgccttgacctccccaactcaagcggtcctcctacctcagcttcccacataacttggactttacgcgcacaccgccatgcctggctaatttttttctgttttacagacggagtcttgctatgttgcccaggctggtcttgaactccggggctcagacagtcctcccaccttgggctcccagagtgctgggattactgctgtgagccactgcacctgcctgcatcatgcttaggtttgaatgtggttgtgtgatgatcagagctgctgcagccatcttgtgaccacgaagggtaggttaggtcaataataccaaccaagagttctgacattactgagctgttgagtcaatgccagcatctgctctcctctacactttgtattatatgagaaaaatgaactaccttatagtgaatgggggttatgagacttgcagggaaaagctctcctcacaggatcccacatagggaagtccagggaaagcccctaaatgtgagggaagaggaaaggtgctaaggggccatcaggaagaagcctatggcttagataaggatggtagacaatggatctctgacatctgtagcaggaccctgaacgtgagcatgaacatgaagtggtaagaggctgatggcaagaccacatttctgaaactgggatcttacaagtggcaggcagcaaggaccaagctcaagacagtatggaccaaacagtaaggacaccccttcttagtgctgacatgagttaagccctttggaaatttagatcctcttgaatttgataaactaactctcctaaaaactgctttaaatcgagacagttctcttaaatggatgaaatttcagtgttctgccattagtagacatgggggctcaagatactcggcaacaaaagtttttgttacatttttgctctcttgaatggcaactgtaaactttgaacctctgcagttaccctaatgcagaacttattatttatagactttttgatgatttacaatgaaatactgatatagaaacagatgtttaaaagaaaactgtatagcttgtctcacttaagtaacgtagcctaagtttcttaaacccaagatctcattttagctacctaggtatattgtccagagtactgaatatgagcacatttcacatgacaggctcttaaatgcaagtgtgtgtgcgtgtatgtgtctgtggtgtgtgtgtgtgtgtgtgtagtccttgcattgcctggcatcttgttacagtaattcatgcacataagaaccatgtccttgctttgccttgcctggtagagaactatgcaaagcaagaacaaggctccagtatgaacaagtttgtattagcatggtatcatgaaatgtaagaactccctgtgtatgctgtatgtaccctttccttcttaaaatatgcccagcacccttctatgtctttgtcttctcattagtcttggaaatactggtcataggtcctcatggggaactaacttctctaagctttcaggttgtatcatccagcccattggcagctacttaggaagctttttatactctaccctgaagtgtggtgttttaactaggtctgaaagcagaggagtgacccagtagagggtcactgaccaaaatgagaaatgaggtggttgagaaaatctgaaaagatgcacaaggtttcaggtataatacatttgtctaatatctcccaagattgcaaataagtttccctaagtagtcttatgattattttattatcttgggcacttcagtataggggaaagaagggcagagtatggtgaatggcagagcagaagatgcctaaatagttgggaaaaataatcctgtgactggaaaactgcattaaaaataatatctggccaggcgcggtggctcacgcctgtaatcccagcactttgggaggctgaggcagacggatcacgaggtcaggagatcaagaccatcctggctaacatggtgaaaccccatctctactaaaaatacaaaacaaattagccgggcatggtgatgggtgcctgtggtcccagctactcgggaggctaaggcaggagaatggtgtgaacccgggaggcggagcttgcagtaagccgagatcataccactgcactccagcctgggtgacagagtgagactccatctcaaaaaataataataataataatatcttgttgatacatccttcttttgtgattgggggaaatggtgacttaatccctaaaggaatcatgtaatatgtagacctttgaatatggcttttttcatttagcctgtttttaaggttcattcttgttgtgatatatatatttttgaaataggttctcactctgttttccaggctggagtgcagcattgtgatcttgactcactgcagtgtcgacctcctgagctcaactgtttctttatatttctgagtagtattttcttgtatagatatcaaatcttctttatcttctttttttttttttttttttttttttttagacagagtctcgctctgcacacccaggctggagtgcagtggtgctatctcggctcactgtaagctctgccacccgagttcacgccattcttctgcctcagcctcccgagtagctgggactacaggcgtccgccaccacgcccagctacttttttgtatttttagtagaggcagggtttcacc

SEQ ID NO: 2858 - DNA, 6721 bp, Homo sapiens
cggagccgcggcgcctgggttttgcgcgaggcctccgccctgggattggggcgggcagtcgcggaggcgcatccctggtgagccggtgggaggggaaaaggatgtcgcgtcccccatccttgcggcctcccgtcctccgtcaccagccccctccgtctcctgcatcacaaggccccgtccccgcggtcccccgcgacccccgcacccggccccgctccacccgccgtgcttcctgcccctccacaccctcgtccccacccgggcccatccccctgtgagccctggtgccctgggatgagggccgaggtcctgagcggagagggtgcttgtaccagccccatggtggctcgagcccaccccgcggcccctcccgtggcaggtgcggtttctccaccggttgtcagctgcggggccgggcggagacctcctcaacctccggccttgtttcagggaggatggggtcgacccttgcgatccccagaggccccccatggctcctcctgggctggctgtcttcctcctgtgggttctgatgccacctgggccgacggcgtcttctcagcccagggcggccgcgcctccggtgagtttcagctgagggcgcacggccagctccgagcctggctccgggtgcagcaccggcctgggacctctgctgtcccgcgtaggggtgccctgcaaatatgtgatgaataagtgaagaaatacgttctatcttctaacttgccggatgttagaaggaaaccaagcttatgcttctcatttatagctaccgttaaggattggacagaagcttagctttttgggtgagacggacaacagtgtttttagaacctttggcaaggaagagctggaaagaacatgtatttgaaagtgactgacaggtcttctggccctagggggccacctgagcaggtgcacccagcttccctccaagacagaaaataaattaagaaggagagcaggaagggccccggcagactccagacgggagggggtgctgcccatcaggcagaaggagcttggaagggaggggccgtggccatgggacgtggaggtgggagcgggggtcatcataggtctgcacactcgggttgagtcccccttccccatcacacacaggacagccagcagtgagctgcttaccccaaggagtcaagggggttcttgggcaacccctggtgctggagccggcagtggacagcaccgcagccagaccttgcttatttttggctcatgaggaacatctgtgaccgttccctcccctggccctgggaggggatgtgtgacctccactcaagacagccatgcggctcctccggctgcgggcggggagggcatgtttcccagcacaggcccaggactgccagctgagaggctgggaggggcccctcacccctagactttgcatgtgaagccaagcgtggagcctcacagggaatctgagatgggagccagtgagatgggggcaggacccagaggggagaagaggtcctggggatgctgtggatctggatccagcgtgcgggagctgaggttccggagtgaaacactgcctttcatggaagcacgtcttcctgtcacccatcggcttcattttaaaggatgaaaatgtatcagacattcaaggagagctgcatcacataaaagaaagaccaggcaaagaaacggaaaataaatggattgagaaatgtgaatgactccaatcattccaatcattggaatgaatggattggataaaactccaatccatagactcagattagggagatatatttatataataagaacaggaaactgtgaagatgaaataagacaaaaaagacacttttgagattaaaaaattactgcaaaaaaaaaaaaccaacagaaggatggaattgtatatttaaggaaatgtttctggcaaaaaggcagcaaatatgaaagaaaaggggatagacccaggggatccattttgggctctaacatctaacagttgttccaaggccgagaacacagaatgggaaaaggaagggggaggcggtgctccagctgattttatgattccagaagccttctatcttaagatgtataggatgtatcttagggtgtataagagaagcgcaagagaaacatttaggctgttttatgtttgagtagagacatgaaagttttaaataaagcagcagcacaatgagtccagcggcacatcagaaagcaaatcaccatgatcaggtcaggttcagggtggttttatgtcatgatatatgtcagtgtgctttacctattagtggaccaaaggcaaaaaatacggttttctacagagaaagacaaagcatttgatttcaatcaacattcgtttgtggtgaaacatgttgagaaaactcatcatagaagtgaaatgttttctttgataaaggctaatctcagaagacatacgtagtggagagcttttaaatgtatttttaaaaatacgaaccaatgagaagattgcctactttcaccgcttctgtttaacacagcattggcagagctgccaccaagaagaacacagcacgttgaaggcacggtggctcctgaagctgcagccctgagacctgattgtaccatggaaggtggggtggctcctgcagctgtagccctgagacctgattccaccacaagtgctgcagctggcagaggccacaggacataggcatagctggtgaaacctgcaactgagggtgtcgggggctcctgggagagcctccgtcccccctaaggagaggggctgcgtagaacctgtgtgctattgtcctttccccctttttcctgctgggagtgggacttggtgccaagggtggctcctgccatcggaagaccccaggatgctgggtcagcggctaggcgggtggagggtggggttgtccccggcacacagcggtgctgctctgccactctgcactgctgggtgtctcacatctcatccctgtattaagcaggtactccctagacttgcagccagatgtataccttagatttaaaagatggtagaatttctctaccagaacaaaaaatagctttaaaaaatataagataaaaagccattcatagtctggcacgatggctcatgcctgtaatcctagcactttgggaggccgagtcgggcagatcacctgaggccaggagttcgagaccagactggtcaaaatggtgaaaccccgtctctactaaaattacaaaaattagctagtcatggtggtacatgcctgtaatcctagctacacgggaggctgaggcacgagaatcacttgaacccaggaggtggaggttgcagtgagctgagattgcgccactgcactccagcctgggtgacagagcaagactcctcctccaaaaaaaaaaaaaaaaaaaaagccattcaccacagtccgcaatgtaaaagacctctatgaagaacatcctaaagttattaaagaatataaaagaaaatctgcataaatggaggatgcacaggatattgtgaaggtgacagttcaccacaaattgatccataaatttaatgaaattacaataaaaatctttacataatttttaaaagactctgttatgagctgaaccgtgtctccctcaaattcatgcattgaagtcccaacccctaatactgtgggggtgggtgcatttggaaataggaccttaaagaggtgactaaggttaaatgaggtgaggtgagcttgatgtcgttaacaagagcaactcaggacccagacacccactgtgggatggccctgtgaagacatagggagaagatggtgtctacaagccaagaagagaggctgcagaagaaaccaaccctgccaaactgtgagaaaacaaatttctgttgtttaagccaccctgtctgtggcactttgttatggtagtaacaaaatagcacagagcccaaaagtttctaaagtctatatggaaaaataaaggcctaaaataactattaataaaataattttgaaaaagaagatcaaagaagagtaactcaccatgtcatattaagacataaaaagccatagtaataaaacaacccagtcttggcaaggattagacagagaccaacacaagagaacaaggataccattaagaaactcatgtaggagcctgtccacgtctacaggaataaaacaagattgagaattttagtagagaatgggaaactaaaaggacaaaaaggaaagtctagaatcaaaaaatacattttaaaacacagaagattagacatggctagagagagaattagtaacctgaaagatcagaaaatatccagaaaaaaaaaagcatgcagaataggatgttaggaggcagagggtacactatagaaaggcctgacatgccatgtaatattagaaccaatggaagaagagaatgaggtagatgtaatatttaaggaaataatcaccaataagttccaaaaactgatgaaagaaattaaatcatgaattctagaggcattacaaactccaagtgcaataaatcaaaaaaaaaaaaaaaaaaaaaaaaaaaaaaaaggcatacctaggtaagacagctgtaaaccaaacaacttccagaagcgggaaactcaaattacctgcaaaagagtaaaagtaagactggcagctgacttctcaacagaaagaggcagtgggtgacaaagcagaaatgcagtttgtcaagtccctgtcccagcgtcacagagctgactgtgaagggtggttagaagctaagaggcagcagattaataattggcatggataaaaaatagataccatgcaaatactaactaaaaggaagccagtgtagctgtattaatgccagacaaagtagactttatacttaaaggttgaggtaaaagcactactagggacaaagagtaatgcctcttagtgatgaaaggtaaatttaccaagatgataaaacatttctaaatctgtatgcacttcatgacataacctcacaatatacaaaacaaaaatagtaagaaaggagatttagagtgaaaactcattgacataaatttaaaacacaaataccacgcatctgttgagtacctctctctccaaggacacatgctgaatgcatcacactgggtggctgtgatgagggaggtgggattggggcatggaaaaactgaaatcaagtgagagatacctccccacaaccaggtgccgcagcccaataggaagagacgtgctcggtcaacttagtttctgccctcaagcaccagagagaaaaggcagagaaaacaggtaagggcatgttgtctattcattagacccatggagttttcaataaaaggacacaaaatgacattcctgtttctgaggaaaggggacacctgtgtgtttggtggtgctgcctggatgtgccagagccctttgctcacctggcctcaggctctgctctgagaagctgggacctcatggcaaggagaccatccctctgggcctgcaggactgggcagagtggctggcctccatagcagctgttcatccgagagggtcaggggagaggccgtgagagggggcttcttgtgagctccaggcccagcttctcctgggctggaggctcctagctgctgtggcaaggagctgtcctggcagtgctgaggcccaggtctggcatctctgcccctccactgctcaaggagatgcttgcctgtggccactctgtgctcttggcaactctgggtgatatgggcgagggcaggacttgctgactgccctggtgggagagggctgtggctgccttgggtggtcaccagtgtctgtgagcacagagaaggaggaagagggattgggcagctctccctcctgcagctctaaaggggaagggcctggaggagtttggccagggcctccctgatgttgcagttcccaggcagtagatgatgggtttgagcagagggatcccaaccaagtagacccctgacaccagcttgatgaggttagaggagccgccaccccaggtgggaggcataggtggggaaggcctttagctgctgggcctttctggaatcctcagcgatctggccaggatgtgggtgtaggagaccgtggttgcctgcagggaagccgcaaggatcacctgggctgcctgagtccgcatttctatggtagtggtgctggagcaagagagccctagcgggggtgggatatcacagaagtggttgaggacatcggggctgcggagcctcaggctggagttgagagccgtggacacaaaggaggctgggaagctgctgagctgggcgctgatggccaggtgcaggcagagccagctgcatggagtccatgatgggctgggtagtgcagcaggtggcagatgaccgggtgccagtcacagtccatgttggccgggaggatgcactcagaggagctgagtgagaggaagaggagcagccaggtgaggtgccccgagaaggagatagatggtcgtcgctcgtgctgggagtccggccaacagctttgggacggtgaccgaggtgtacagggtctccagcaccgagagtttggccaggaagaggtgtgtggatatgtgcaggtggtggctggctctgatggtccccacgacagccaggtcctctaggatggtcaccacatagatgatgaggagtgaccaaatagcagcccttgaagatggcgcagctctgggaagctcagaaagacaaactctgtcaccacagtattgctggaattgtatgtggccctcctggtcaggcagctctggg

SEQ ID NO: 2859 - DNA, 4147 bp, Homo sapiens
tgtgagaggtaaagacattttctgataagggataaaggaagaaaatggcaaaaagcacagacgcaaaaagatgtgctctctagtttttctttagggcatttactcgatagctaacaacagactggggttgtccgtgtaccgtcctgaagggagaggtgtccccatcttctccacctgtgacccagagacgttccttctctttccagatcatcatcctgaccctctcccctgaccatcctttctccccttctaacatctccctccctcacctcccgtttcctttcttcattactaagtttggtttagaatcaatatctctatttcatcatcacccacccacacactttgacttccttcatgagctggctcaaattctttattaaactatttttattgcttgcataaaagtcaacgacaagcttcccttcaccacagaaacgagccttcctcatagcctctccaggcatgggacagtttcccctgccccactccttccggacatgctccccttcctgcacgtccaagcctctaaccctccttctcctccctttcctattggggtctaccgttgcccctagtgacgcaggggctttgacgtggagttcttagcctcctgctctttcttctctatgtctccttcctgaagagcctgaaccactgtgcggatgaagacatgggggaggcgtgtctcacgcacctttgctctacctcccgggcttcctcagcactcactgcttgagatcctcaaccgtcaacctggcttctccatgctcacaaggcttgcactccctaagtttcctaagtgtctacgtctataatacgagcattgaaatatctttcctgcctgatccagagggtggttggaataatggaatggtttttaaatcttcataaacacctacagtattggcatatcaattatcctaccaaccccctgactctaaataactctttttattaagccacaagatctaaatcctctccaatttgttctcccttcacctcggtgggatggtgaatctccaggtcctagggttttcctctgatgtgtctcacaagcccattcttgcccgtccagttcctctttcctcactctttctgcccaggtctccgtccgccaggacttgctgcctgcaatagttgcctaattcacacatttccaattttccctctttgatccattctgctacccccagaataatcttcctaaaccttaatttctaccacatctcatcccattccctaaaatgattatagttcccactatggccaggaaaatatccaaactcttctggctgactctcaaattctctacaatataaccttttctctccagccaaaattatttccaagtcattccaaagccacaacccacaacccactactcctaaatgtaaatgtcataactccctttgcagctccatgtgtgtgcctgtgtctacgttttaaatttattttgcataattcacactgtgcagtccactgttgactgagcatgtagttttgatccactttgtattgaaaactctaagcagggtaatatgatcataaaatataatttgaagggcattttggtttaaataatgactcaccatcgagccctccattggggagtcaggcccagagccaaaccaaaaaaaatgagcgacaagagtcaatgcattagttagaggcttcagctcagtatgactgatctggaaacatatcctgatgcctggttaagaaagctttatggcaataggaaagcaaaaaagcttgatgtgtctgttttaaaaataaaagaaggctaaatccattaacaggtgaaacaactgacaacggacccacatcaagccagagtccttctcagcatcacagaaatctccttacctagggccagctgaccatctgccagatggctagtggttctaagaaatccaccagggaccaaaagcaggggactataagattaggcatcacacaaatgtattccaaatcctggagctggggtcactgatagtctactacagaaatcaaaagaggtgcctcagaagacacaggctggcttcacagtcatccatgtgtctaccctgagatctcagaggtcacaggaagacccaaagatctatccagcagaaacatttggacagaagcaagtccaagagaattctttatattcacagctgctacagttggtcaactcttgattcaggcaggtttcaagcaagtccttcttccctccctggtctgcacaggggtgattttagggaatcataagggaagaaggggacgtttagaaaaagacaaagagtgacaccacacacagagtttcatggaatgtccatattgcttgccttttcatcacagatagtattttacctcattagttcattcatttgacacacagttattgggcctttatggtatgctaggcatttttaggtgccaaggatatagcaataaacaagacagacacagcccttagtttgttaaggaagcaggcaataagtcagcaaatgaataagataattgcagacagtgctaagtgatatgaagaatctgtaagtctacaaagaatggagagtgactgtagagtggtcgggaactttaagcatggtcaaggaaggaacaggaaggaggcaaagatatgcccccaactcctcgctcaactcccagagatgagaggtgcctcttggctccagctctgcagccacttctgctcaaaaggtacgctgcgttgctttctttattcctttgttaaacctggcaccagcaaaacaggcacctcaacacctataaatggttaggaatagatgggcatgcaagcttttctcctctactgattttactgggcataatagtaggctttttgatatacttgatctgatcagaaataaacccgaaaacaacacatgatacctgtaattgttttccctggtttaccttgtgtcatttctaaggcttagattcccatgacccccagctgttctccactgagtgctcactgtagagaaagttgctcttctttttcttcctgttctctagacgcacttacctctctaactctggtctacgcctccttatcaaggcacagatgcagctaaaaagcattccacctgctccctagcaaaggacttctttgttaagctttgacataaggagggaaaacagagacctcaggacttctactgtgttgacattgttttaagcaaggtgggaaaagagaacagataagcaagtcgttctactggctccactttcccaccacctaagtcaattcagagtatttcccgaacattttttacccatagattcagattacccctaagacagatggttatggtttattccgttttgtgcacacaggggtaaaagtcacttaaaattggactcaaattacttcaaagtttgatacctgccaatcaccatttcatcttgggtatacaaaaccatactgcataagctccaattgcctgattctaattttcaatgttttcccctttttaggtaaataccatcttcagtttttttttccttttttttttaatgagcagtttaatggaaaataattgctccaggtacaggtcttctaacttggaaaggatatacctgcttatgaaatactaatgatgacagcaagaaagtctgatttcaaatctatgggtgccaacattctatgtatggtcatggaaatacatatgtaaacttgatacactgacaagtcatttcctatgacattttgccaatcaaaataaagtaaaatgaagaaaattgtttagaaaatctggatcttgtttccttaaggtgtatgtaggaggaagcagtaggaggcaggaggcattttcatttttattttactgcaccagtgtttggagctcagcagctgagatggggtgagtaacacatgagctttgatgagcaattgtggacacagccctttttgccaacatctcactcattaccttttccctccacttttttttttttttccctactagattataacagtctgcatcaagaaacatttcatttaattctggaaaggcacagccatggaaatagaagattaaaatgaaaaaaaaaaaaaagaaaaaagaaaaagagaaaacccacacaaaaaaaatgaaactaagagattctgaaagcagcatttcctaattaagaaggc

SEQ ID NO: 2860 - DNA, 5616 bp, Homo sapiens
acatggaggacttattggggagtgcttgctctacttagaagcctgtctttccctgtgaagagggcgggagccacgctgttcatctttgcttccccacagcctggccagggccggaccagaggttttctctacatgatggttgaagtggatcaaggtccttttgtcggagtgatagatgtcaactattgcagtggctttccactgggttgagggtgaccttccgagatgcagaagtaatctaggcaaggttttcataacaacaataaatttggccacccagggtctgtgaagtcacctgtagggtagccttactagctctcgctgaccacacctgccaggagtgtccagcaggctcgagtgaccttgggcatgcagtgttgctcttaattatctacagattgagccaagctcagaaaacatattaaatgtttgcctttagatggtttctggtttaaagtacataaggacaatgaagcaggttacaaaaaaagcacttaacatttaccctgttcaatgttttacctgtctgagcataccttttctgttatgacaactctgtaaatggaagaaagaagtccttttcaactcaaagcagcaatttcagtggctgtttcaaacattgcctttcaattggagataaaatcaaagaaacaaaacctcaggctttttactgaggaccaacttgaattcattattcaatgattttctgtatcctttcaacatgtgtttgttaagcgaggtgcggtggctcacgcctgcaatcccaacactttgggaggctgaggtggaaggatcgcatgagcccaggagttcaagaccaccttgggcaacatagggaggtctcgtctctataaaaaattagccaagtatggtggcatgtgcctgtggtcccagctacttgggaagctgaggcagaaggatcacttgagcctgggagctcaagactgcagtgagctgtgattgtgccactgcactcaagccagggcaacagagtgagaccctgtctctgaaaaacaaaacaataaaaatgcatttattgaattcacacttcataggaggcaccatgccgtgtgttctgtggatttggtgttaagacttggtctctgcccttgagcttatagtgcagtgaggagacaggagaataaacacatggtagaagctcccacagaggtggacagagccttctgtgggcgcaaaggcgtggcatccagctggattgtggtgggggtggggctctgagatggacttgagcttcattttgaaggatgatcaggaccggcaagaacaagtgagggaaagtgccttcccccgaagggacagtggatataaagtgacaggcgtggttcctgcccaccagctcttgggagaagggcagtggtggccccagggtagatggggtgaagtgagtgagctaggctgacagcagactgggaaaagccttgagttccacctgggagtttgaattcaccctgagtggcatgaagcctctgaagatcttgggtttgtgagtgacttgatcagaggtggccagggaggtgaagaggccaaggccggttgagggactgtcatggcacacccagagagacatcagcacagaaaagagcaagactcagccaggcccgggggctcacacctgcaagcccagcattttgggaggccaaagcgggaggaacacttgagcccaggagttgcaggctgcagtgagctatgattgttccactgcactccaccctggtcaactctgtttcagaagaaaaaagagagcaagactctgagacaagtggttgcaggatgggaagagccagggaggaaggaggggatgttccagtattgagcagcgggcagtgccacaccccatgcagagtgtggagggagggggcgggctggcaccgtgtggagatggcgatgaggttactgcgagactgggcagtaagcatatgtgttttggcctggagccaaggagagtgtactagacgagagcattttggggatgctgtgtgccatccaagctggggactgggttgggtcttcccaggagaatgtgcagagtgagaaaaacgagacggaatcctgaaccctgtggactcctaatacagtcttaaagtcagtaaggtaacagaaggccagtcagtaacccgttgccttttgggggaatggggcagggtagtgggcttttttctttttttttttgttgagacagggtctcgctctttctcctagtctggagtgcagtgtcaggatcagtggctcactgtagcctcgaccttctggactcaagcgatccccttgcctcagcttcccaaatagctgggacgatagacttttttctttttttttttttttcgagacagggtctcattcccactgccgaggctagagtacaatggagggatcatgagatcatggctcactgcagcctcgacctctcggactcaagcagtcttcccaccttagtctcctgagtagctgggactataggcgcacaccaccatgcctagctaatttttgcattttttatagagacggggtctcactttgttgcccaggctggtctcaaattcctggactcaagcagttctcccactttggcctcccaaaggctgggattacaggcatgagctacggtgcctggcctggccttttaatttgtctcttggagtgaaggatggagtatgggacgggggggatgccagtgtccttgcagtggccttcctgtctcacgtgtctatttgccttttggggaacctccagcttcagtgtcgctcttctcaaaggacctagttcacctgcagtctgagggttgctcgtctcagacgttcccacaggtagggctctgagaaaagccttctcagaccgagagacccaaggctgcagagccctcaggggcacctcactctccttccaggaccctgtttctgtgtggtccatcagcattggcagcaggtacaactttggaaaaagtctgctgagaacagaggccacgtgtgtgatgcgtcccccaccccctgagtcctccacctgaggggtggaatggatgaggccggggaaaggctgtgctgcagaagcagcccctatctgcccgtggccagcacgtggtcccccagggctggctgagcctctggataaggcttgagctgttatctacaccctccaacagaacctgctcacaggggcgcaggcttcatggcctccgaggactgtgcatatgcagccatggcttcctgcaaccctccccagtgtgttcccttctttttttcttttctctttttgttaattgttttttttttcttttgagatggagttttgctcttgttgcccaggctggagtgcagtggtgcaatcttggctcaccacaacctccgcctcccgggttcaagcgattcttctgcctcatcctccctagtagttgggattacaggcgtgtgccaccatgcccagttaattttgtattttcagtagagacggggtttcaccatgttggcctggctgctctcgaactcccgacctcatgatccgcctgcctcggcctcctaaagtgctgagattacaggtgtgagccaccgtgcctggtcgttaattgtttttttttaagagactgggtcttgctctgttgtccaggctggagtgcgatggtgcagtcacggctcactgcagcctcaacctcctgggctcaagccatcctcccacctcggccttctgagtggctgggactacaggttcttgccaccacaccttcctgattttttatttttttgtagagacagtatcttactatgttgcccaggctggtcttgaactcctggctcaagggatcatttcacctcaaccttccaaagtgctgggattacaggcatgaaccactacaccggcctgttccctttttcttgcaggtcattgagaacacaccacaggggacctgggaatctactgaggatacagatttcccacaatccgagactgtgtgtctgcctgattgttacataattttaattgggtgccacacaccgagagaggttgtttactggtgggccattcggtttccagtaaaagcccttccactcactgtggcatggtaaatggagctcatcacatggtcccttcagcctttccttgaatcatttccaccccttccctaattaccctctgtgatccctttcccggcaagggtccttctagccttgctaccttggtaaacctgtggccttaggatcgaggtgtggacattaacttttctgctctggcggcttcctgggctgtcctctccatgttcccagcactcaggggcactgtcctttcctggcagcctagtaaatcccaggcctctgttttgggccctttggcttcttggtgcctgttatgctgaagcgtagaagtgtcttagtcagagccccaaaggacactcaccggcccacgttctcatggagctgggtagctctgaccagacttgccctctggggccctgtcctttgaccacgctgtctctatcccttctgaggctaaggcttcctcacactgcaagatccagccgaggcaggccttggcgctgggaaagcaccgtgtcacagcacctgcaccttgaattggcatcgtcagtacacctgacccgggctggggtggggccatgcctctgtactcctctgcactcaggtacctggcacactggcattcgggaagcatgtcttgaatgcctattaaaatgattaggaccgggcgtggtggctcacgcttgtaatcccaacactttgagaaggcaaggtgggaagattgcttgaggccaggagtttgagaccagcctgggcagcatagtgagactttgtctctaccagacataaaaagtaaataaaaataaaatgattaaacatgcacaactccacctcgagctggatctctccttaggtctaaagacacttgctgagaacctgatgtgtgcctggccttccaaggcacacctgtcactggcttggaactcagaccaatcaaaatgcctgtgctgctgacagctgagctctcttcctctggttctcctcctgtgtcctgggggtgtttttccagacctgctgtggggagaacctttgggctcagatgataaagatcctgaattagcagagtcctgtgccagctccagcccctgcctttgggtggaccggactaggctggggaaagaaagatgtctggctatgaaagggtggctggccaaggttgaggctcagcctgcccctgctcaggctccgagcagcaggctcagcagccacagttaggcacgtttgcacttccaaccatcacaggcaggcgggccaaccggcccatggtgtggtgactaacacctcattaatggtcataccccttctgtacctggcatgtgccctccattgtgtgcctccggcaaagagcccactatcaagttccccagtcagcagctacttggtagtcactgtggcatgtcggtcaccattaatatttgaaagatgcctgtgctctgcttcaggctgaggcaggcaccccttaccttcctgttatgtgaagatgcctgcaggaaaggtcacacctagggtgggtggactagtaatgctccctgttgttatttggccttcaaaattaaatttgtcttgggcccaa

SEQ ID NO: 2861 - DNA, 1119 bp, Homo sapiens
tatagataaggacatcatcactcggtttcggatgttaaaatgtctaggtgggttaggggtgatttgagatcacacaaccttgtgccacaaagaggaattcccaggtcagagggagacattttattgccatgttatgatcttatcattgagttgaaaggcaatcttgtttcattttggattctttcttatgtttatgtcttataagggcactttgaatttccaagcaaataataattttgaattggcttttaatcattgacttctagcacagttatatgatcagaaacgtgctgtgtgatttgattgctctcaaatatattgagatttgctggaacaaaataagtcaggttaatttttgtaaatgtaccatgcatgcttaaaatgaatgtatctacatttgttcctgagatacaggttgatggacggatggctacatggatgtgatggagatggtttactatcaggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcgcccagaagcagggacagggagctggttggggaggaccagaaatcaggtttgtgaaggttccagagaggacctgtccttgcgaggagtgtgggagactgagatgggggaggggtcattggaatgatgcgggcgctacttggcattgtccattgtgaggcaccaccggggtcatcagggattggtggagagggagtataaagccccaggtttgctaagggagggcccagaccgaagaaggtttggcggatagcagaacctttttgtctccctctgattgctcctaagcctcacgctcccttgccccgcgtgtcctgttgcttccctgatcttctccgtgacctgtagctaaaccttccaccagcgcttgagaacttaatttgaaccggatcctttcccagacccctttcttcttctcctcctcctcctccacctcctccaggtgcccaacagcccccttctcctttcccttcccct

SEQ ID NO: 2862 - DNA, 1869 bp, Homo sapiens
aagagagaatgagaatgtagagccatttgctggctcagcttaaggccacagctttcttagcaatgcagcttgtacagttgtcagagctttctggtagaaccctagtctgggtgcaacagtcacagagacaaatatgaaaataggaacatgtatgaaaacttaaacccttaaaaagaaagacgcttagcctctatttatttccaaataattgctgttcaaggcattgctctttatctcttgggccccatgacagagtggcttaaaataaatcatcaagtcttcagggcaagtgtgatttattttttggtcatatactgctgctttgtcattctatgtaattattatattcagccagtctgcttatcattggttacagcttcataatgtcacaaataatcctgcttatgtttatctgtctaggtgtcagccatccatgccataaatcctataacaacctaataatattctcttcatgtgttttgtgcagaagctacattgcaataagtatggctttcacataaatagagagttttggagtacaggagtgactcggggaaaagtgtgattccacagatggtgctactcagacaaatcaaagggctgaatgtagtatctggcaaatccatctttaatgcagccattcctctacatggctttggtttagagtatacattaatgcattaactctaggctagtacagagcttaatgatgcatccctgcttaatttctaccaatttcacagaggatatttttgtctcctgcaagtaggaatcaagaaagtttactagatgtgctcatagtgtagtgagccttatgtgggaaaaggaaaaccaacacctttgaattctttcattctgtgtggagttgccctaaattaagctgatgcttcagtgtcttcatcccttacacaatcagttgcatcactcctccaccacagagccataaaactcactggtctagtcagtgctttagatgtttcaggtgcctaataacttttggcaacttttttttttttttttttttttttttttgctattggcctataggtcatctcagcattatcaaaactaagtttgataacttacattctatttgcatacggcttttaacttgttaggaatggaaatccacctttttgaagttccactgtgttacagagtctttacaagttccaatcttgtaaactaggtatgattatccctttttatggataaggaaactcatgttcagaaacttaagtaatcttctcaatgatatatatctagcaactggtcgaaccaggattcaaattttatgtctaataattgtgaacaaaatccatcaaataaccatccaaaacccagcctgtgaacgcatttaaagaaattttgctctagaatcagcactgattttcaactctgctgtcttctgtgaacattgcataataaactaacactaagtcaaacacagaccatgttcccacccaagtcagccttggttcccaagcacaagtcgctttcagaatagcttgttgttgaagcaggaaaaaaaaaattgtgcttgatttggccttgagtagcaatgtgaattataaaggaagttaagcatggcttgctagaagagtcccagcggtgctggtgcttctatagaattaattggagagtctttttttttttgaagtcccaggcagccaatgagtgaaaatgcataatttatgcaagtgttggggaaaaggcacacctgtgccaagataagattttcctatcttggatgagtgggaagtttaatttttctgcaaaaataaattggaagcctaaatattagaacttatggggaagagttatgccttctaatgtatttaaataaacgtgaggttcttttgttccttt

SEQ ID NO: 2863 - DNA, 5356 bp, Homo sapiens
agcctttctgaattgccccggtgatggggccatacaacctccgctgcctcctccttccccgcctcactcgtgaaggctcagtcgtgattttttcaaagttaatcggcaccacctgcataccctcggcaaccattactcaccaacacgccctcaccgttcccagtcccagttctgcgacatttaaacttttaatcgtgttcaaattaccctaccatcttgaatgtaccagtaagccacactttcaactttttcagaagaataaaacccccacctcctccggccgtagacaccggggggagttctcgctccccgcatccccgcgcttccctactaacccccacccgacaccaccaaaacaaaagctatcagattgcaaaagacagcgaatgtggagcgacactgcttattaactacgtacaaaggaagtgcggggcggcagaagagagggcgacacgacgccgaccacaacaaaaccaaggccagggctccgcgctcgcaaaacacaacaccctccccgcgccgccgcagaccctggcgctgaaaccacagcgtacgacacctctcgccagggacgggcgtctaggtgtccccgtgaggcggcgactacaccccgcgctgcgagcacgtgtgtcggaatgcacgtcggctccgaccacacacccaccaacgcacactcggatgcggccctagtacccctccatcccccggcccgggagaaactgggagaccatcccagagccctctgaactggggacccagtggcgctccccggaagagacaagctgaggaagactcccggcctcgcacttcccggggggctgcccagagagcgcttcccctcaccccaccgcccagccccgggacgccgggggcaggtaacccaacgaggagcgggccaaagtgacgggcaaggccaggaacccgaggagcccgaggggcaaaagcacgttgggcgacgggaggcagcgacgggcgcttggagacgtgtcctggggcttcggggcctctccgcagggcacctcccccctcgagggcaactcgcaccccgcgggccgggcggctgcccgctccccactgcccggtcagccccagcagcggagacgcggtgcggcccagggtgctgtcgctgctgcctgcgcgccgcaggggatcagcgctgtgtgcggagaggctcttgcgcatggaaggggcgaggtgcgggtcgcggggcccgggaaccgcggagcccgccccggcaccaacttccctaccgagtcctcgcgcctagccgggaaacacggctgggctgtcaggacggagaaagagaaaagcccttcccgcgcggggatgcgcggagccagggcccgcggggctccagacgaacgagcccgggtcccgggtccgctgcagcctccctcccggcagagccgccctgcgccccaccccgccgctcccgagcccgggggcccgacagctgcgacggtggcaactcgggtttcgcaaacagggcgcagcccctcggaggaaaagttcccgcagtggccgcgggcggcgggcacatactcactttctccactcgtcggccagagcgagagcgcggcggagagaaacaggagcccccacagcgaggtcggggaccctcctccggagccagacttcattccttttatttgggatgaaattcccctttctcaaaaaaaaaaaaaaaaaaaaaaaagaaaagaaaagaaaaaaaggaaatgaaaggaaacaagtctcaaactcagtcttcgctccccctccaaaaacaagggcgaaggaaacaatactccgaaggcggcgccgccggggccctccgggtgcgcggacggggcgggcggcgcggggcggcccctcagcgccggcagcagcggcccagggctcggcggagtcgggaacccgaggcgcgccggggcgggctgtcggcgtcgtcggcctccattttcaaacccggagaggcaggaaggggggaaaactgcaaagaaagggggcaaagcccaaatctgcctaggcgaggaaaaacaagcccggccctggccgcgcgggaggcggccggacgcccgagcttccgccgcgggagggcgcgacgcagttcgcaagatcgccccgaagtccgggtcacaggcgaggccggcgaggggcagaaacgcggagtcaaaatgaatgagcggctccccctcctcctcctcctcctggctccgctcgccgccgcctcctccctcagcgccgccgccgccgcggcgagctccttcccaaatccaggacacacacaaagcggcgggccggccgcgccgcgctcagcactcccgccgcgccgcccggctctgcgccgccgcccgccccgcgccggcccccgcccggcccccgcccgccgccgcctgctctgcgcgggggctccggctcgctgaaggtcacagccgaggcgaggcgcgccgtggagctgcccccgcgcgggaggggcgtggagggcgcggggggatccggggagcggggccgagggtctgcgagcgccggccgtgggcaggctcgctggcggcgtccctctcgctctcccgcctctctcgagttcgcctggtgcgctcgctcctcctcgggttttttccctttttttttccgctcagcggagttaatgctggtaaacaagagccccagcctcgccgcgccgccgccgccgctgccacacactgggggctcgcgcgcgcgcgcgcgccctggcccgcgcacacgcgcccgctcgcacactcgagcggccaccgccgcagcagcggcgcgccgagggcccggcccaggccggcgcgcgcaaaaaaccggagcccggttccccaagacgtgcggagcggagcccgggcgtggggcgcgagactgcgaggcgccgcccccatctcccgccccaccgcctcccgcgcgcacacagagacacgcgcgcgtgcccacccgctcccgcccccaccgcactgcgccggccaccccgcacgcgccctcccctcccgcccgactccaaaaacaatgcccccgccgccggtccggtctcggcggggcaggggtgggtagccagggaaaggctaggcaggggaggggtgggcaggagaggggaggggtgggcggggagtgcggggctgggagaggttcattgaaaacaacaacagcgcggctggaaagcgcgtttccccggttcttgaaaagcttcattgtttcttgcagctgttgcaaaataaataaatgcgtgcatgcggcatttttttcgctgcgtactggaaagcccgaacgtggcggaaggggcgcacctgggagaaaggggaccccccccccaggctactacgccgggcactttcacgccaggctggggtgcccgcggcgttgcgaccgtggagcccggagtttgggggctcagggggagcggagggggaagggcgcggcccgtgtggctcggcccagagtggctcgaggagagaggaccccgccgcccctcgcgggccccgcgccccggaaggggggcccagacaggcagcgccgcgtgccccgggcgcgtccccgcggcggccgccagagggcgcggcgggcgctggggagggcagcccgcggagagtcgcctccctccctccgggggaggaaatgtgggggcccgggctgggggccgactcggctgggtcgcgctggcgtggcctcccggaccagccgcccgccctgagcgctctccgcggcctcgcgcagctcagggctccaccacgtgggcggctgcggggagcggccggggcgcgtgcacgctgcgggtctccgaagctcggggggcgtgtccgggtcccggggcgccgaggagggggtggaggctggggccgggaagcctcccttggccgcggtcccgacccgggaacacgccgcatgcactcgggatcagcggctactgcggaaacccacccgcacctgtctcgggtcctcccaggcacgttcctcttgcttcgtttgctacgtaagtgactggaaaccagtaccgaccctaagtctccgcggttgttttcttgaatgtgcaggaggagaggtttccccaaagcgagactcccctaggactgccatctaatgaataaatgctgcggagaccaggtcctcaaagagggaaacagcccagcagtggcaggagagaggagtttgaaatacgtggacttttacaaacagtgattggaccatgtgtcgcccttaatgtggtccggtttcatgactcaggctaattgatgccagtaataaatttttttaagatagctaataaaagagttgtgaattgtcgagataagaagtggttgtctcaaacaatcgggtaggatggtagaagggacctgatgtaaaggaaggtagtaggtttcttttactctctaattctaaaatacttctgcattagaacgtgtatccatcgttcgtaaataattttttaagagctgaaaacaagtcaaaagctatcataacggaaacttagccctttttttctaaagttgtttcctagatcattttcctccttggaaatttctagctcaattcagagtcagttgtatagaaagaaaataaaccttgttttacctaagaaagttattcatatgatgggatggttttgtttaactgaaattcagcttgatttttaaataaagagtttcagttttggatgttcctagatttaacagtgaaataaatttattagaatcttaaaatgtattatttaaaaattaggcactacacatgaagaattaaagtccagtctactaatttttaaatatttcttaagttctctgcatgaggttggtcttgattcctgcagatccactctggagttaaatgcaaaggaatattgatatataatttcattatacttgatttcagaatttttaatacatacttgtaagacaaaaatttagagctgatttttaaaaggctagtgctaatataaaatcttcaaatactacccaatgtatttttagtattagtaataaatatgcctgtttatttgtccccaagaacataaagaggtctatagaatttttaaatgtatataggttgttgtaggggttgtaggatttgtttttgtgtgttttttttttactaaaatgatttttatttgtgaattttttaaatgtttgtgttttcctgaagtagtaggaaatcaatcgtattaagttattttaaacagtgaagtgggagatgtatcattatatagcttaatatttagggaaaaaaaaggaacaaaaatttaggttgtctttacgctctaacttgaccacatggacaaaggaggtgatttgtatttcttcaatgattatattttacatacacaagtcaaacttattttttcaaccttgaaataaaatcatgtagacaa

SEQ ID NO: 2864 - DNA, 5359 bp, Homo sapiens
agcctttctgaattgccccggtgatggggccatacaacctccgctgcctcctccttccccgcctcactcgtgaaggctcagtcgtgattttttcaaagttaatcggcaccacctgcataccctcggcaaccattactcaccaacacgccctcaccgttcccagtcccagttctgcgacatttaaacttttaatcgtgttcaaattaccctaccatcttgaatgtaccagtaagccacactttcaactttttcagaagaataaaacccccacctcctccggccgtagacaccggggggagttctcgctccccgcatccccgcgcttccctactaacccccacccgacaccaccaaaacaaaagctatcagattgcaaaagacagcgaatgtggagcgacactgcttattaactacgtacaaaggaagtgcggggcggcagaagagagggcgacacgacgccgaccacaacaaaaccaaggccagggctccgcgctcgcaaaacacaacaccctccccgcgccgccgcagaccctggcgctgaaaccacagcgtacgacacctctcgccagggacgggcgtctaggtgtccccgtgaggcggcgactacaccccgcgctgcgagcacgtgtgtcggaatgcacgtcggctccgaccacacacccaccaacgcacactcggatgcggccctagtacccctccatcccccggcccgggagaaactgggagaccatcccagagccctctgaactggggacccagtggcgctccccggaagagacaagctgaggaagactcccggcctcgcacttcccggggggctgcccagagagcgcttcccctcaccccaccgcccagccccgggacgccgggggcaggtaacccaacgaggagcgggccaaagtgacgggcaaggccaggaacccgaggagcccgaggggcaaaagcacgttgggcgacgggaggcagcgacgggcgcttggagacgtgtcctggggcttcggggcctctccgcagggcacctcccccctcgagggcaactcgcaccccgcgggccgggcggctgcccgctccccactgcccggtcagccccagcagcggagacgcggtgcggcccagggtgctgtcgctgctgcctgcgcgccgcaggggatcagcgctgtgtgcggagaggctcttgcgcatggaaggggcgaggtgcgggtcgcggggcccgggaaccgcggagcccgccccggcaccaacttccctaccgagtcctcgcgcctagccgggaaacacggctgggctgtcaggacggagaaagagaaaagcccttcccgcgcggggatgcgcggagccagggcccgcggggctccagacgaacgagcccgggtcccgggtccgctgcagcctccctcccggcagagccgccctgcgccccaccccgccgctcccgagcccgggggcccgacagctgcgacggtggcaactcgggtttcgcaaacagggcgcagcccctcggaggaaaagttcccgcagtggccgcgggcggcgggcacatactcactttctccactcgtcggccagagcgagagcgcggcggagagaaacaggagcccccacagcgaggtcggggaccctcctccggagccagacttcattccttttatttgggatgaaattcccctttctcaaaaaaaaaaaaaaaaaaaaaaaagaaaagaaaagaaaaaaaggaaatgaaaggaaacaagtctcaaactcagtcttcgctccccctccaaaaacaagggcgaaggaaacaatactccgaaggcggcgccgccggggccctccgggtgcgcggacggggcgggcggcgcggggcggcccctcagcgccggcagcagcggcccagggctcggcggagtcgggaacccgaggcgcgccggggcgggctgtcggcgtcgtcggcctccattttcaaacccggagaggcaggaaggggggaaaactgcaaagaaagggggcaaagcccaaatctgcctaggcgaggaaaaacaagcccggccctggccgcgcgggaggcggccggacgcccgagcttccgccgcgggagggcgcgacgcagttcgcaagatcgccccgaagtccgggtcacaggcgaggccggcgaggggcagaaacgcggagtcaaaatgaatgagcggctccccctcctcctcctcctcctggctccgctcgccgccgcctcctccctcagcgccgccgccgccgcggcgagctccttcccaaatccaggacacacacaaagcggcgggccggccgcgccgcgctcagcactcccgccgcgccgcccggctctgcgccgccgcccgccccgcgccggcccccgcccggcccccgcccgccgccgcctgctctgcgcgggggctccggctcgctgaaggtcacagccgaggcgaggcgcgccgtggagctgcccccgcgcgggaggggcgtggagggcgcggggggatccggggagcggggccgagggtctgcgagcgccggccgtgggcaggctcgctggcggcgtccctctcgctctcccgcctctctcgagttcgcctggtgcgctcgctcctcctcgggttttttccctttttttttccgctcagcggagttaatgctggtaaacaagagccccagcctcgccgcgccgccgccgccgctgccacacactgggggctcgcgcgcgcgcgcgcgccctggcccgcgcacacgcgcccgctcgcacactcgagcggccaccgccgcagcagcggcgcgccgagggcccggcccaggccggcgcgcgcaaaaaaccggagcccggttccccaagacgtgcggagcggagcccgggcgtggggcgcgagactgcgaggcgccgcccccatctcccgccccaccgcctcccgcgcgcacacagagacacgcgcgcgtgcccacccgctcccgcccccaccgcactgcgccggccaccccgcacgcgccctcccctcccgcccgactccaaaaacaatgcccccgccgccggtccggtctcggcggggcaggggtgggtagccagggaaaggctaggcaggggaggggtgggcaggagaggggaggggtgggcggggagtgcggggctgggagaggttcattgaaaacaacaacagcgcggctggaaagcgcgtttccccggttcttgaaaagcttcattgtttcttgcagctgttgcaaaataaataaatgcgtgcatgcggcatttttttcgctgcgtactggaaagcccgaacgtggcggaaggggcgcacctgggagaaaggggaccccccccccaggctactacgccgggcactttcacgccaggctggggtgcccgcggcgttgcgaccgtggagcccggagtttgggggctcagggggagcggagggggaagggcgcggcccgtgtggctcggcccagagtggctcgaggagagaggaccccgccgcccctcgcgggccccgcgccccggaaggggggcccagacaggcagcgccgcgtgccccgggcgcgtccccgcggcggccgccagagggcgcggcgggcgctggggagggcagcccgcggagagtcgcctccctccctccgggggaggaaatgtgggggcccgggctgggggccgactcggctgggtcgcgctggcgtggcctcccggaccagccgcccgccctgagcgctctccgcggcctcgcgcagctcagggctccaccacgtgggcggctgcggggagcggccggggcgcgtgcacgctgcgggtctccgaagctcggggggcgtgtccgggtcccggggcgccgaggagggggtggaggctggggccgggaagcctcccttggccgcggtcccgacccgggaacacgccgcatgcactcgggatcagcggctactgcggaaacccacccgcacctgtctcgggtcctcccaggcacgttcctcttgcttcgtttgctacgtaagtgactggaaaccagtaccgaccctaagtctccgcggttgttttcttgaatgtgcaggaggagaggtttccccaaagcgagactcccctaggactgccatctaatgaataaatgctgcggagaccaggtcctcaaagagggaaacagcccagcagtggcaggagagaggagtttgaaatacgtggacttttacaaacagtgattggaccatgtgtcgcccttaatgtggtccggtttcatgactcaggctaattgatgccagtaataaatttttttaagatagctaataaaagagttgtgaattgtcgagataagaagtggttgtctcaaacaatcgggtaggatggtagaagggacctgatgtaaaggaaggtagtaggtttcttttactctctaattctaaaatacttctgcattagaacgtgtatccatcgttcgtaaataattttttaagagctgaaaacaagtcaaaagctatcataacggaaacttagccctttttttctaaagttgtttcctagatcattttcctccttggaaatttctagctcaattcagagtcagttgtatagaaagaaaataaaccttgttttacctaagaaagttattcatatgatgggatggttttgtttaactgaaattcagcttgatttttaaataaagagtttcagttttggatgttcctagatttaacagtgaaataaatttattagaatcttaaaatgtattatttaaaaattaggcactacacatgaagaattaaagtccagtctactaatttttaaatatttcttaagttctctgcatgaggttggtcttgattcctgcagatccactctggagttaaatgcaaaggaatattgatatataatttcattatacttgatttcagaatttttaatacatacttgtaagacaaaaatttagagctgatttttaaaaggctagtgctaatataaaatcttcaaatactacccaatgtatttttagtattagtaataaatatgcctgtttatttgtccccaagaacataaagaggtctatagaatttttaaatgtatataggttgttgtaggggttgtaggatttgtttttgtgtgttttttttttactaaaatgatttttatttgtgaattttttaaatgtttgtgttttcctgaagtagtaggaaatcaatcgtattaagttattttaaacagtgaagtgggagatgtatcattatatagcttaatatttagggaaaaaaaaggaacaaaaatttaggttgtctttacgctctaacttgaccacatggacaaaggaggtgatttgtatttcttcaatgattatattttacatacacaagtcaaacttattttttcaaccttgaaataaaatcatgtagacaaaaa

SEQ ID NO: 2865 - DNA, 6995 bp, Homo sapiens
aatcctcttccgctcagggccctgcttctctgtgaggcgggcgagggagagagggaggagagatttcatgccatggtgtcctccaaagctaggtccttacctaatgttacggagccccctgcgtccacctgacagctgacagagcagaaaggaaggtctgtgtatggggaaagcacagcggtgctgggagcattggtgccgcccacctcacctctcagcagtgactgtgagaccatttaaacacctcgttaccagcccctcaagtctgctaagcctgggcctccaccgagcatccactcactccaggcacctctcctgggcctccccagacctcgtaccacacatgaatgcggtgggacagcttagcaccggtgacctggctcacacaggacaggtctctgttcaatacacgtgtctgtaattcaattccaccttccccgtccctcctccaaacagtgcagatataaaatggcagacacagtttaaaacacatcagtaaatcaaggccaactggtcagtactgtacctttcttcttgcttctaggaacctccatctcatgccatggtgcttcgaggagcgtaccagccttgcagcaccacaacagggactgggctggaggcatctgaaggcatcaacacagagcactaacaagacacggtgtgagagctcggctgtttccacctcagcctcctcgtaacaagcacaccctgcactcatctgacccgttacagaacactcggctggcgtctaacgcaactcacgtgctgtgtcttttaaaagaggcaggaggcaggggcggggaagagaagaccccaagcaccaagagtcgggggcacagaagatgcctcctcctctgcctgaccagtgccctcctgtggatggaaatcaggggccagacacctctgaatcctcctccagctgccctgcgggttctggggttttctaggtcatggggtgaaactgcagaggtgcagcgcagaggcaaggctctgccaaggcctgactcggggaagaagggccaccaggaagacgtgggcctctgaagctctcctctgaggcacctcccttcccttccattcagcactcccaagaagcctctcttcaggacttctccctcggctggtgtttgatcctacagaggtgggagacatctctaacaacggactaactggatcccacacctgcccggtcactggaacacagaacggtcttaactagtctctcagctcagctcccagggcccgactctcttgctgttcaccaccatggtccccgtgaatgtgcccgtcgatttcctaagaggacgctgcccacccactctagttctttccaaggtatctgaggctgatttcttaggaattcggtctggggcatgctgagaatgtggattcgtatgtcctatgggacaagcctgcaggaaggcacacacctggccacatcgacctgcgtcacactcatgggcaaaaccccaagtactgcaggctgccatcgccaccaccagctagtctgtaaacagtcctcaacgcacagatctgagaaagcacttgagctttggccccagcccctcatagaacctggcaaacacggtggttggggaggcagcctcgccaccggccaatgagccccagcctacagccatcattggcgtagccacaccttagcagtgagcttgggtcacaggcgcttggctgtgggtctctgcgtgcgccccatgctttccctgcaccctccatgctgcccgggggccggccctccccaggcttgcttctcatagccacctctaaacaacagaagcaggcctgcggctgcctccctctaggaaagaggcgacgaagctgctggagaaaccccagctcccccaccgatagccctcaagtcctcctctctccaggaggggcccacactcaccgagcagctggtctgcccacagtcgcctggagaagcagctgagaacctctgcagggccctgatccccaagacctagccacgcacattcagaggcctgctccctccgtcacccagagcaggggggttaatgttttggagacacgaagccccctgagaacacgaggaaagcagaatccccgagatacacagactttgcaaagctgcacacagcacaggagactcctgggagcagacggcatctccttattccattgaccatcagaagtgaaaagcgagtgggccccacttctgtgctgcatgtggccactaggggtggacacagggaggagctggggcagagttggggttgcggagggaggagctggggcagagttggggttgcggagggaggagctggggcagagttgtggctgcggagggaggagctggggcagagttggggctgcagagcgaggaggcggggtggtgttggggctgcggagggaggagctggggcggtattggggctgcggagggaggagctggggcagagttggggctgcggagggaggagctggggcggtgttggggctgcggaggggaggaggcggggtggtattggggctgcagagggaggagctggggcagagttggggctgcggagggaggagctggggcagaggtggggctgcggagggaggagctggggcggtgttgggaggagctggggcggtgttggggctgcagtatgtttacatcccgaagtgcaggcgttgccatgctcttaagttatcaaaggaccctaggaggcgtgtgtcagaggaacaggcagaggcaaaggcgttccttagaagtcagtctttaggctggcaggccaggagcccacgctgcgtccccgctctgaggggcagcaaagagctgctttgtggcaaacagaacatgtcccactcctgcagggcggccatctcaggtgcagctcacacccaacatgtgcagaatgggcaggactcggtgcccccagagacttcctgggtgggctccagggcctgagcctcagggtcagggccacatccctcccgctccccaccaggccctccctctgcttctgctctgagctttggtgaagaaagcctgagttggcttcccttacgcggccaggacagctttacagggctggctcccagcaattcgcatggaaggtgctgccaacctcctggtgaattctggtgcctggagccaccacagggaccttgctctgccccacactcaggaaaagcttgctcccaggaagcagcaacttttcacccagctctccctgtcctgaaacaggactttttacttgtcctgacaccaaaaaagtccaatatgaaaccagatctcccaggatgccaatctctccactgtgaaacaagcacctgcagctacgagcatctacaacgcccacaacacgcgccagacaccacccaagctccggagcccagcaaacttgcacgtctgtcagctctgagacactggccactccagtggcttctggggtagagggaaagccccacccacggagcgagacccccatgtgccacagcccatggctcaacaatgcctgctctccattccaacccagcgacaccatggtctgagagcagctgagcgggtccttgacgtgcacacacacagcccgtacctgtacctgcactgtcaggcaccacacaagtgggtcccgcactgcctgcctgcctgcccctcctaccccaggcctgggatgacctggagccgtgtgcccctgagaaacgctcctctgagaggagaggctgcaaaacctgctccctgccctccacacagtgcagagcgcaggaggcgcggggtgttgtctgcaggtaagaaaagggtgagagcatctggagctacccctaggacagccagcaagttcctgtagcattctgcaaatttcctgtttctaccgtccaaatggaagccaaatacaatttctatgaattccaaatggtattcaccaagttgcaaagtggaaaactggcaagtctagggactaagtgcggctacagcaccacagacagatgtggccctgggtgcctctgaccccggggtgggggtgggagccactccacagcactcagaagcccccttccacccctgccctgcagtcggaacacggcctgcaggctctgagggctttgtgggctcaggcagcctggggctgagggcagaggtccagggagagcggtggagggtgccaggagaggctgtgtcttcccaagtcaagcatgttggcggtggcacctgtgtccgctgacctgagcctgggcggccacccacctcatctttaagaaacaaggcccgtagggcctttcttcaaaccacatccacctcgccagccctctgaggctggcagcacacctcactacccagctggccagtggaagattccacggaaccctctcctcctcagcacagagctgagacccctccatgagccccatgccccttcctggtgctggtgctgctggagcacggccttggcctggggcagcaggggccacagtggacaatgcttttgggagctggagcccacttcctgcccctgcatccagccatggcctttctgaggcagcagagactggaggcgagcgtcccgaggcaaacggcggtggcacctggctctgtgcaggtgggatgggggggatgtgacgcgcctgggggtgccctgtgctggtgggatcggagcgggggctgtgaccttcccgaggggtgctctgtgcaggtgggatcggaggggggatgcgaccttccttggggtgctctgtgcaggtgggatgtgatgtggggggcctgcaaccttcctgggggtgctctgtgcaggtgggattggggggggctgtgaaccgcctgggggtgctctgcagggagtgtcttctctatctggctgcctttttttttttttttttttttgagacaaggtcttgctctgtagccaaggatggagcacagtggcgcaatctcagctcaccgcagcctccacctcccaggctcaagcgaccctcccacttcagcctcaggagtagctgggaccacaggtgggtgtgcctctggctgcttttaacatcctccctttgctgttctgaaaacttcacgtcagagtcatatttaaatgtgtaattactgctctttctcctgcttataattcattatactttttgaatttgaggcttgtgtttttatgaaccttgaaaagccctctgctgccggcctctggagccaccgtctccctgccctgctctctcctctgccgaggtgcctgttaagctgcattctctcctccacagctccccgcttcctgcaggcttcctgtctcactttctttctgtgctccagagtctaggcaatctcttttgttagaacttccaattcaccaatactttcttatgttgtgtctaataagctacatcatctgctcactgggttttttatttcagtgattatagttttcatttccagatattccatatgccttaaaaacatctgcatgatactccatggttttaactcccctgatgaatactgtgcatttaaccatcccagcacgtgaggtccctggggctgacccctgctgaccctctcagaacagctttcttcctcaacgtcttgtaattccaaccaggctcttcgtctgtctacactctgggagccggaaggccgggatgaggaaggcttttctagcaagagtcttttaggagacacaggccacgatactgtcaacataggaaaatgtgcaactcctgcgtcccaccgtaaaactcgaagacgtcaaaatacattcttgattctgctccacaaagggatgtttccatggcgatattttcaaacaacagaaagttcacggccgatggcggttacagctcatggaactgatgggcagggccgggtgcagctttgtagcacggctgctgctcacagattctcttccatttgactaaaaaccatgctgtccacaccaaacatctggcctcatccggatgttcaaagccatgaaatacagcacttctggccaagaagtctaaatcacagccgatctacacgaggcggatggtccacaacgccaagttcctacccgggcactgagctcaacgctcgcacaactccaaacgagggcgcaaccatattcccactgacatcctccttggggcagcaagacaagctccgaacagcctgtcctgggccaacaagagaagctggcgggcgcccgctgagcactgtgagccatcttgtgcatccagcggtcaccatggtgaacaagaagccaggaaggaaggaagcaatgtcggcaaaagggctcagatgacaaccaaacagaacggtttcccaccctgggcctcctttccacacacacagcatcgtgggtattttaaaataaacaagatcaacgtccaaacctgcgctgaggcctgagctgtgtccgtcactcctgcagggcacaggcctgcctggccgaatgcatgggcggtgagagcacagggctggggggacccctctgtcgaggggccacagctcctcacacagcagagctttatggatgaaagggctgagaggcacagacaggctgagaaatgggcccaaagtcccacagcatggagccaggaggtagcagacggcccctgcccgcccccctcacttggctgactgctcccacggcagccaccacctttatcctgagtcccggggtcctccatcaaatcgctgagcctcgggtggtcttgtggaccccagcttgtctgtgttgtgttgacaacatgggcctggctaccggcctaagtgcacttctgaggggtgtcagggaagcctttgctgcggcttggggattacagaattttaaacagcaagaaccttccctttgctagtccaagcttccctttgtatgagaaactgcttacgtctagagaggaaaaatggttgagaaataggaggaccagagaccaatcacgcggagttcttaatcatgtgaaaatattttattttgacgtgctttttcttgagtgcctgaatgtggtggctcttagggtaaccccagaatcctcactgcggcaacaagacctgg

SEQ ID NO: 2866 - DNA, 35285 bp, Homo sapiens
acacggaagcaactgcaaggactaagggagtccgcagcctggggcattggagcccttcgccatacccctagtgcgtcctcaccccctcagcccgtgcttcccagggcgggtatcctcggaaggcccggccctcacagccttggcaggccaaggtcagaatgattggagttgggggatgggacgggggcatccctccaggaccagctctccaggaggcccacattctttctgcgggaaccactccaaaggggcatgctgttccaggcagcccctcgcgcagacactccggctttgtcgaggtaggagtacgcttactctggaattctgccttgctagtgactgacacaggctgttaaagtgcttgaccctgcaggggtgggtggggggttccttggaaaaggtaagggcgctgtggaaaagaggcccctacataaatcctaatctctttgggattttgcccctgctcgtgcaactttggggatcgaacgggatgggggtgggcagctctgaggctttttacgggttcagcctttcccattttcccccatcgaaggacccaataggatgcataggacatttctatgggcagcctgggaccatccctgacacagcaaccacccccgctcctccccaccataggatatttctacttctttgacagagtaacctaaacccctgggggggctgggagccacagattcctgtcattccaaagtgggggtgggggcatggctaaaaaaaacgtgaccacgctgttcctggtgtgtaggtatggatttagaaatcggtccactcagaacgcaggggctttcaaaagtttcctctaggaagcatctgtcagtataccctcttaatgtttgacagttctaatcacaattatatttagaatttgagaaacccccctgtgtgtctaatggctgccagcgtgatgccagagaaccctggcaggtggcctgcagtaagcagaaggcccacaccttctgcagagccaggagcagtgcccgagtcccccggtctgtgtctatcctttcacccacatggtcactgtggagatgaccatctgaccagacttcggagcccccaggcagaagaaaggctgcagggggcctgggaaggtggcctgggagtaggtgtgcaggtgggacccatcgcttacactgtagaaggacacttccccggcttcgaagtccaggaagatgcccatgtggctgggaggctccatcagcatgaccggggttagggcagagaaggtggataagtacttggtccccttggacagctgcaccacccagaagccgttttcggggcacttggggaccctgtctttccggctcacgttgtccctgcacacacccagggcccacaacgcgtccccggtgatgttcatgcccacctcccagtagtgcctcccagaggagaaggccgtctggcccacagcacaggggtaagccacaaatcggtccttgctgcagaacccactgccctccggcgaagagccgaggtagcgcctctggcggctctcatacaggaggaggtaggggtacgcggaggtggcatcaggcaccacatcctctgtagatgggcgtggtggtggagagatggggagaggtgtggggcattcagggtcaaaggtgggagtccccgggccctagtggtggatgtggccaatggtcccctaactccgcagaggcctcccctgctgtgaatctggggttacttgatgcttccacacaccaattgtgtgtgggccttggtggcaataaggtacagggggctgggcagagagaccactgggaactcaacaagattcatcccatgaattagaaccaccagtaacgccgccctacgaaggcacagtgaatagccagtgaccgtcaccaggcagtgcacttgtagaaccccccccattggtggcttccgaggctagggggtacagtggggcatcgccaagagatcctgggtcagaggtcctggccctgggtgcccacttacctagaaagcctcttagcacttcaatctgtccgggaactctgcacacagtcctgggtctggttgggggggcaacctctgggcactgcacactcacgttgttcttcctccggtgggcacacacaggggagtcttattgactcccctggcccgacagtcttattgtcccccccgcccaccgctgccactgcccccgcccctgcctgaggggaccacatacctgctcaggggttccttcatgtcctgcaaaagacagggacggagggtggggagtgagccaagctcctggctcacctcaatgtccctgctcccttcttgtccgtgtcttagggcaagacccatcctgtcccctgggcattcccttcccacaattgagcttcatggcactcctgagccttccccactgccctagctcccactaccaccagagcccccagtgcctcacctaagctgagctaccctgtcagcccacggccacacgcctgaggtcctgcaactcaggagaggcggagggaccccttccaggcaagtggccactcaacactgaccctcctctcccatttcaggtgggtgcagcccactcagcaggaatggggtgggggcgcaattgggtgcagtttggggagggaggggggtgggtaagagactgaggcacctggggattttctgtagcctctttagggattcagagttccctaaagagatcactgtttacttctctggcctggaagctacaagggacttgttttccaaaggccatatttctagttgccagagcgtgaccctaactctaggcagggactctcatgcaggtggcgcgcttggccctctgctcataggagcacccttctaccagctgcaggggcttttccctcagttggtcagcaaaccaatgtagtgggttgtgaacaggctgctttgtttttccttttccttttttttttttttcctagatgtgatctcaccatcacccagggtggagtgcagtggcgcaatagctcactacagccttgaactcacgggctcaagcagtcttcctgcctcagcctcctgagtcctgggaccacaggcgcacgccaccatgccctgctaatatttttaagtttttgtagagatggcgtcttatcagccgtaatcaagccccctctccagggccatggcacacaggctggtcccggcagacaggctggctgcttcacctccccactgccgttgccacacaactcactcctgggacagtgcacctcctccacaccgagacatggagtccctgtcccaaagccacacctggctgccaggtgtcccaagccacctctctggacttggaaggaaatggggacactgtctcaggttggaacctgtaaggggctgacttgtgtccccactaattcacaggttgaagcctgaaccctcaggacctcagaatgtgactgtgtttggagatagcatctttaaggagggagttgaggtcactggggtgggccctaatccagtctgactggtgtctttatacaaggagatgattaggacagagacgtgcatagagagatgatgccatgaggacgcggggaggagacggcatcttcaggcctaggagagaggctcaggaggaaccaggcctgcccgcaccttggcctcagccacccagcctccaggactagcagactgggagctaacagccctttcccgttggctgcctcttccccaagcccagcgccccctgcccatgcctgtcagagctcacatcccaccctgcctgccaagcctactggctcacctgcagcatctggaggggcccctgtgtgctccgctcctccagctgcagcagcagcagctccagagagtgaccctgccggtccaggcaggccacgctctcccggagcctgctggcagtctcctcttcttccgtctccagagcctggaggagcctctgctcttcttccaccaggcattaggattaaggttaactaaaggccattgagaacccgcagaagcaggaaaacctgtttgcctcccccattagctgcctaaaaaaataaagtgcctggcctggcgcgatgacttatgcctgtaatcccagcactttgggaggccgaggcaggcagatcacctgaggtcaggagttcaagaccagcctgaccaacatggtgaaaccccatctctactaaaagtacaaaagttagtcgggcatggtggtgggcacctatagtcccagctgcttgggaggctgaggcagaagaattgcttgaacccgggaggcagaggttgcagtgaactgacaccgcaccattggattccagcctgggcaacaagagtgaaactccatctcaaaaaaaaaaaaaaaaaaaattaaaaagtgccctttcatgaaggaatttccagtggtcaaggcatctataccagaaagagagttccaaaaacaactcttcacctgagacacttgtttaaatacttaaccaacatcacctgcctccccagcccagaggcccccaagccctattcctttgtggtgctgacctacgcccctgccctctggctgcctcctttgtggtattgagcccccaccttctggctgcctcctttgtggtactgagcccccgccctctggctgcctcctttgtggtactgagcccctaccctctggctgcctctttgagtctgatttttgaggccccttctctccaccctatgtgtgcatctgtaatttaaaattgcctttttatctttttctctgctgttcatctgtcttaagtcagtttcattctgaggccagccacagaacctagaagggtagaggcaactttcttcttttcctgccactgcggcagcatatccccacgggcagacacagacgtggaaatgcaggaagatggagcagcagcaggaaagggactggacagccctgggcacccacctgccactcggctaagctctgctcctccctggcctgcagattccctgtcctggtgatctgctcccgaaggtactccatgtcctcctccagcttcaactgtgggacacacaaaccgcaggatttgggatcagcgatccccctacctcctgcctagagtccagttgtgctcgctgaaactgcacccaccccagagaccctcctcaggaggggcaggggatcaaaatacgtcacccagaatgtgccaccttggattattttgagctgaaggcacttaaaaaagggcaggtgtaagaattgctgtgaccctcggccttcctaagagcagaaggcacagccaccatgccagagaggactgccctaggccaggaggaaagccatgttcttaccaagggcgggaaagccgaaaccagagaaatctgtgcaaagggaccctgctaaactaaccctcatcctcctcaggtacatgtttggctctaacatgcttccatgggcctctggctccttgggagcgactcctgggtcatggaaagcttacagggaatgaatttcagtgctttgcttctgcttatctgtctcaaatcagtttggttctcagagccacccaaaatactctgagaggagaggtaagattttgcaatgcctgcatcatacagtgtaggcccacattgtccccagggacacccctacccagccacaggccaccttgtcccctggatgcctcctccccagcccctgactcgggccactttgtccctggacacctcctccctcccccatgatctgggtcaccttgtccccctggatgcctcctccccggccccttgacctgggccccgatgtggcctaccttgtacccctgcactgcctcctcggcgggcagcaccctgtgcagccggtgctcccgggactccctgcacaccacacagatggggctctggtccttctggcagaaaagcttgaggggctcgtggtgctcctggcacaggtcttgcttctgcagaccaggatgctgctgcgccatctcggccaccttggtcagcagccggttgggcagcaggttcctctgcggggacatctctctgcactcggggcaggggaaggagcccttccgcttccgcctccccttcttgcccctcgccttttcccagctcagctggatgcaggctcggcagaagttgtggccacaggtggtcatcacagggtctgtgaagtaatccagacagatggagcacgtagcttcctcctgcagttttctggcgagttccacagcctccatggctcctgggagacacgaggcaggttcccgcttgagggactctggagagagttggagggagcagcccgatgatctgggcgccggcagtgtgcaaccgtcctgtacagcctccctttacagaggagggctaggactgcagtccagttagagagtccagagtcatcatttttagccttgtcaacaacagacacagatgcctccccagaaactacacagaccctccctgaccaatgctctgcaggcccctccgcctctcctctccactgggcctggaccctacccgtccacttccgcctgctgctggctacccccagctccacatctcatcagctcctcctccccgacagaccgttgccggctaggccttcaacctgcctttctggagaagcctgctaggtcagcttagggagaagcccctacccttggagccttcccttaatcactttccatccactgaccccacccagatccccactccaactcccccatacatccccagctgtctttgctggcgcaactctcccattgcaagtagcctgactaaagagcctttcaaatgtcagaattttttctttaacaaaaccccgtacaccaaaggaagaagggatgggctatcagaggaaaaaagctctcttccattcggtagtgaggtggggttcagaaaaaacacgcgtgtgcatgtacgcacagacgaacacccatacacatacccatgtatgtatacaaacgtgcatgtgcacacacgcatacccacgcatacacaccacacaaatacaaacatgtacgcacagaaacactgatccacaaacacagcacacacaggcacagatgcacatatcggtaaacatacatgcatgtacacacaggtacacgcgcgcacacacgcacaggcacacaagcatgcacatagatgccccctgcaatctcaacactcgcgaccccacgcagtggagatctacagactttcgcctacgccacggggttgctatggggaccgagttgcagaaggagttgaaaatcgcgtctacactgcaagcacgattctccccttccgttctgccatcccctaaagcgagggcgtctaggggtctcagacttccccggctctgtcccacgtccagtttctcggagctttctgcacgccaaccacccggcgccagccctccgactccccccaagagccctaacggaggcacccagcccaccctgaccgaagccgggcagggacagcggcagcgggcctggggctctggctctggctgccgggatggctgtccttcccgctctggtccgctagggtcccggtagagttaccttgttgaagcgcgctagcccctccagggacgcggcggccggcggaggcgggaaggccgggcgttggagggcgaggaggaccgggttaggcttaggtcgtggcccaggcgccacaggagggtagcctaggcggcggggtgggggctactcaccgcggggaaggggggcccgcacagcgcctagtgcacctggccgagcgctcgctgccgggaaaggctgggtctgcccccacgaagcccaggaggctgcggcccggcccggggcgtggggacctggggtcgggaggcctagggactttgtggcgtcagcgggggctggggggcggcgggggaggggaatgctgggcgagggagtgttcggcggccgggactggggcggcgcctcttaggagaggttgggggtggcttggggaaggaaggcggcagggggtggaaggctctggacgagccggggacaggcgcagcgggtgctgactgggcggtggggaggatgtggtccacagcccagcgaagggaggagtcttgttggcctggggtgggacttttaggggaggttaagggagtgtggagggtggggagttggggggttacttgggggtggggagtggaatggggacagctggtggggctaggggcgggcaggcgagcgtcagggtggggggagtgggattggaagaggcttctcaacctggggttggggctgcgggagggcacgcgagccccaggctggagggttaggtgaggggctaagttggtcggggtaggggatggagaggagtttgtgtgggctggggtgggggcgaggcagcaggagcgagtgcctgttgagaagctatgaagggggtccccaggagcagccagtcagccgccaggtctgcccacatggttggcagtcagcatcaggctgagggtacagggaggggcgtcccaatcctgtgggcggaccagtttggagggaccacctggcaggtcaggtcccctagaaccaggcgggacggggtgggtcttgccgacaccccaggtggttttgttaccagaaacaggtcctgatccagaccccaagagagggttttggatcttgggcaagaaagaattcggggcaaatccatagagtaaagtgaaagcaagtttattaagaaagtaaaggaataaagagtggctactccatgggcagaccagcccccagggctacaggttgcccatttttatggctatttactgattatatgctaaataaggggtggggtattcatgagtttcccagaaaaggaagggcaattccagaaactgagggctcctccccttcttagaccatatagggtaactgtgaccttgtcttggcatctgtaaactgttgtggcactggtgagggtatctcatagcatgctaacgtattaaaattagcatataatgagcagtcatgataaccagaggttattctggtcgccatctaggttttggtgggattttgctggcctcttcaccacatactgtttcatcagcaaggtctttatgacgtgtatcttgtgccaacctcctatcccatcctgtgacttggaatgtctaacctctggggaatgcagcccagcaggtctcagaattattttacccagcctctatacaagatggagttgctctggtttaaaagtctcttacggtttcagccaaaatgccgcccccagccctgcccaggtcctgactggtggccatttctcctggccttgagtccccacgcctagtcatcacgcttcatcctccagtagagggatgcacctttcacatggagggttcatctcctgctttcaggaacaggagccagaggcctgcgtgccctgagtcagagtcctgggattggagagagaggacagatgaagaaactaaggcttggcccacacagggggtgcagacaggcaggaaaacagggccttgaaggctaagaggcaccattctgcaatctcctgggtgtgcgggtgtagacagctggccacaggcatagatggctggctttccctgggctcactcggtagagtgtttcttctgtggtctctcatcactcgcacacacaaaggggtctgtgtgctgtcaggtgcgggctggctgcgcacactggccgattaagtgaattacccttgtgaacccagaatatctgaggctagtttaagtcaattaggaagtttattttgccaaagttaaggacacacgcccatgacacagccatgtgcccaaggtggtccgagcacagcttggttttatacattttagggagacatgagacatcgatcaatatatgtaagatgaacattgggggcttccaggtcataggtagataagagacaaatgtttgcattcttttgagtttctgattagcctttccaaaagaggcaatcagatatacatttatctcagtgagcagagatatgactttgaatagaatgggacgcaggtttgctctaagcagttcccagcttgacttttccttttagctagtgattttggggcccaagatttattttccccaataaattggggattgggcagacccaatcctctgcctgtcatttgcatcagtgaggggattgtgagctgcaggtttccttcaattgggaaaacagaatcacagaattagaggggaaatggaatatatctatatcttgcatagcaccacacatgtcctagtcacctgctgacacgttatcaccctttgttacaaatggtttacaagcagctgagcctaacaacttctttgggttttcacttctttcctgtacaccccatgcatataaaaatattaagatcaatacaacatggatgcctttctcctgttcgtctgtctttggtcaatttaattcacagtctcctcccatactagcatgatgtggggaattcaacaaatacttgttaaaatgtggcatcagcccaggatgctcattattaatgctttttaggctcacctggttattgagctgagaaatctatcatcatgataaaacaattggaataaccttcatatcctcaagtcattaagaaaaaatcagatagcagttatgtgtcctgataaattgttaggtttaataaaaggcaggatgtacagtatatgtagtctgccactatttaggtaaacataattactgtatatgtatctcttggaaaatatacaagaaataaacaagaaactccatctgatgagggaaattaagggctgaggaaccccctaattgagggaggctcaattttcactatatatccttttggaattcttaaattgaattctactttaataatttaattcttaaattaaataccactgctgtggattgtggttttttttttcaaattatttaagcaaaggatcagcaatgtcagtcttgaaacacaagtcttacttacactgctacaaggtaaatatcctttgcccttactgaatgcagcccccactaagttattaacattgtagaaaagattcgagagcaaaatttaagtgctcatgcaatttaaaataggctgaattaaatggaaaagaagaggggctcctgaaaatagggtaagagagccatggcctctttatgtcttcaattcagactgctcaacaggagagtccactgagccacagaaaaacaaatccggattgttatgaactgaatgtctgtctccaaaattcacattttgaaatcctcacctccaaggtgatggtgttaggagatggagttctttggaaagtaattatgccataagggtggagccttcatgaataggattggtgcctttccagagatttattttcaccttaccccttgcaccacatgaggacgcagtgagaaggccctgtctgtgaaccagaaagcagaatctcaccagaagctcaatctgttggcaccgtgaccttggacttgccagccaccagatctgtgaacaataaattcctgtcgcttataaaccaccaagccatagcattttgttatagcagcctgcatagactaaaacgaaagaagacagattaatgggagaaagcatacacatttcatttgtacatgtacatgggagccttcacagcaaaatgaagacctcaagagtagttaggcctaagtgcttatccactggatggaacaaagggtagtaattgtgagaaagcaactggaatacctagggaggctggggaaggtaagagctatttttgtttgtttgtttgtttgttggagacagagtctcactctgtcacccagcctggagtgcagtgatgtgatcgtggctcattgcaacctccacctcctgggttcaagcaattcttctgcctcagcctcccaagtagctgggactacaggtgcgcgccaccacacctggctgattttttttgtttgttttgtttttttagtagatacggggtttcacgttggccaggctggtctggaactcctgacctcaggtgatctgcctgccttggcctcccaaagtgctgggattacaggcatgagccactctacctggcgataagagctactttaacaaagcctgtttgtatacattttgctgcacttcagtccccatgcctagtcatgctgtttctccctgctggtagaggcaagcacctttcccatggagggttcatcacctgctttcaggaaaaggggtcagagggcccttcttacacctgctgttcttcaagtgccttcagctcaaaataattcttatatcaaatctgcatattttggggaggtctattctgctatcttgttgggagctgaaagcctgagggtcgtgaccaactcagcattccactggaggctatatgactaaacagcaaactgtttatcatgaatgcaggatgtgggcaaactcgcatctgtgcctgccaccagaaggtacgctgagggcctcattccctggctctgtgctccttgaggttatctactgggacatctggagcctactgttcaaagaatgcagtcatgcaggcctgcactaagtcaagcagctgaccacaaccacccccttatccctgtctcctttacttaataagaagggctctagaagctcagggcccttgttcactagaagcaaggagccccctgacccctttttccaaatatactcttttgtctttgtctttattcccacttttgtcctcctttgttcagtccaccaaggcccatagcactatctcttaatgcctaactctcctttctattatttctggaattttaactttttgatatttagaaccactctttccacttttataaacactgcatgctcaggctacctccatagtgtacatgcgctcgaagagttgagtacacagtgaacagatatccacatttcagttactatctcacatcgttagaacccacaggatacagaagcaaaggctctggtcgtaattgtaagggtctggctctgttgcccagaatggagtgcagtggtgtgatcacggcttactgctcactgtaacctggaactcttgggctcaagcgatcttcccacctcagccttctaagtagttaagaccacaggcacacgccatcatgcccagataatttttgtattttttgtagagacagagtcttgccatgttgtccaggctggtcttgaactccttggcctcaagaaatcctcccatctcagcctcccaaaaagctgggattataggcatgagccactatgcctggctggaaagacttcctcaagtgcccacttacacgacccagaaagacttcagttacttttttcctgtgtctaaacttccttccttagctcctcaccttaggtcctcagcaatcagttctgagatacaaattgccctgtattgccttgctgtatctttatagggcacaattagtgcactatccactccattaatcagtgaaaacaaggaacatataaggccaagctcttgttttttgttgttgttgttgttgtttttgttattgttgttgtttttgacagggtctgttgcccagattggcctcaaaaactcctgggctcaagccatcctctcgcctccccagtagctaggattacaggcatgtgccacactgcccaacttagactctgttcttcatacaaagaccagaatgacagggggctgcttaagtggcttggtctcctacagaaggcaaagcttgatcatgatcctgtcaagaatgcattatctgcatccagttccgcaaatgtagctaactgcccaaattcctgctccctccaggctatccagcaagatcatcagcaaggttacataggtttagctctccaccactgggcaagactttgttaggacaagggctttgtaaagcacagaagacttgaacttcacctgctcgggaggctaaggcaggaagatggcttgagcccaggagttcaaggctggccactatgctcacgtctgtgaatagccactgtactctagcctgggcagcatggcaagaccctgtctctgaaaaaacaaaacaaaaagggaaaacttaaatttatcccaaaggagtctagtattgaaagtcagagctgactttcaaaaccagaacatagctgtccctgaatattctaggctttctggatagccctccaaggatctggcactcataagtttaaatacatcctgagatttaaagggtatgatgttcagttgtgtgtgtactaataaattgatgaagcttttgaattttgagtcaacaggctataaattgggttcaaagagacttataaaatccactgttgcctattgatagcactttatgcacatcccttgctatgtataagagcaccttttactatcattgcttctacacacaatacaggcccccttcactcaagcataagcaccttgaaagcagagtgggcagcagccacaggaaatggattttattccctccatgatcccagcatggggtagtgcttggcctcattcaatttaataaagcctttcacaaataaatgattccaacctgtaccagagggagacaatccctacatccttatcctcacagccatcctcaggttttcctgacataagtctactattggatctgtggcctgctgccctagctgtaggatttctcagcaagttggtctctgtgtctctcatccccagagcactgccagactactttgtggcgctgggaagcctgtttcaaagtgctgggcacatgggccacgcctgtctgcgactgctcagtaaactgacttccagggcagagtgccctctttgaactttgggctggggtttcccagtattgatttcacttaggaattaacaatgcacatgcctagctgggcttctcacacacaactagctagtcatctaccctaacagaagacagggtgaatttacaacatacatgactagccagccttttaactgaatgggagattgggtatgttaacacatacaatgagatggacttctaacccgagatgggccaacaccacagctacatatgtgtgcacatgggtgcacgtgcacacacacacacccctagccagccttctaacctaatgggagatagcccaagttaaaaagatacacaactagccagccttctaaattaacaggaggtaggctgagttaaaacacacaagtagctggacttttttttgtttttttttttgagattgagtctcgttctgttgcccacgctgcagtgcagtggcatgatcttggctcactgcaacctccgccccctgggttcaagcagttctcccgcctcggcctcccaaagtgctgggattacaggcgtaagctgctatgctggtgaagtagctggacttctaacttaaaataggccaagataatacatactacttgctggccttaacaggagatgggctgtcaaggcagaagactagctggactggtaacctcactggaaacaagctgcgtgtacacacacacacacacacgcaggacttctaatttgaaagaggctgagctgagaacacacaagaccagccagccttccaacctaactgtagataggctgagttgacacaactagctggggttgcttacctaactggagatagaccaattaggctaccctcaacaccccgtccccaaaacagaccaaccatgattcttatctaaacggataggccaagttagccccacacactactagctggatttgtgactggagacaggctgagaggtaacgcgtgtgagtagctggcctcctaactggacagggtgaacacaggattcaccagcctcccaccctaatcagaagtaggtaagccagcacaggccagcggaaggaaccccccgaaacccaagagactagcttgctacagcaactcttcgaccaggtgggtggctcttaaaagagcctttggggtgaacgttgcgcaacctctcaggtggcgagatagccctcctaggcccgctccccgcggatacggcgtgccagctggatgtccttaggcatgatggtgacccgtttggcatggatgacacacaggttggtgtcctcaaacagccccaccaggtaagactcgcacgcctcctgcagcgccatcacggccgagctctggaagcgcaggtcggtcttaaagtcctgagcgatctcgcgcatcagccgctggaagggcaacttgcggattagcagctcagtggacttctggtagcggcggatctcgcgaagcgccaccgtgccgggccggtagcggtgcggcttcttcacgccgccagtggcaggtgcgctcttgcgagccaccttggtggccagctgcttgcgcggcgccttgccacccgttgacttgcgcgcagtctgcttggttcgggccatgaatccgaaactgttggccccgcggtgtcctctgcccagacctcagcggattgctcgcttttatagagcttgccgcgttcccattggctggcctcaggtggcgtgatggcccactgctctctgattggcccacagggaactccactcgggcgcctctcccttatattcatgcctgttggtcgtggccaccagagctggcaccagcattgtgaagggttgatgcgggtaggccgcggtggtggggatcatctctctccagcacaagcttcctcatgtcttctcagcgctcctcttctcccttccccatgacttgggtggcaagagccttccagaagccagcacatggcattccacttttttaaaaaattaatttatttttttattttttgagatggagtttcactcttgttgcccaggctggagtgcaatagcgtgatctctgcttactgcaacctccacctcccaggttcaagcgattctcctgcctcagcctcccgagtaactggaattacagggattacaggtgtccgccaccatgcctggctaattttttgtgtttttaatagagatggggtttcaccatattggccaggctggtctcgaactcctgacctcaggtgatccacccgcctcggcctcccaaagtgctgggattacaggcatgagccaccaggcccagctggcatttcacttttttttttttttttttgagacggagtctctctctgtcgcccaggctggagtgcagtggcgcaatcccagctcactgcaagctccgcctcccgggttcacgccattctcctgcctcagcctacagagtagctgggactacaggtgcccgccatcatgcctggctaattttgttttgtatttttagtagagacggggtttcaccatgttagccaggatggtctcgatctcctgacctcgtgatccgcccgcctcggcctcccaaagtgttgggattacaggcgtgagccagcgtgcccggccggcattccacttttacacagtgacaaagctctgggatgcagccagagttaaaggaatctcccactttttatgacctgcaaagaactcccttacctgtacggcttagatgagccttaggattctgaagaaggtaaagatgtgcctttctggcatattgtctattttgagataaaggcacttaaaaaaaaaaaagaagaagcaggtgtaggaagatcattctgaatttcttgttgtttcttaaatacaagagatgaaattcccatatgaaagatgttctccttatagtaaaagcaagggaacgttcttatcatcaaggacgggaggtggaagcttccaaatctcctccaactctcaagttgaaatttgatccctaaagttggagcccagggaggggggggccagtgggaggtgtgtgggtcctggggtgtcaccctctgaatagagtcctgccctcctttagggtgagttttcactctgttggttccctgaagagctggtgttgaaaagagcctggcacccctctcccctctctctctggcgtcctctctcgcggcagccctgtgacctctgcacatacatgggttccccttcaccttccaccatgagcagaagcagccagaggccctcaccagaagcagaggtgggccctatgcttgcttccttcctttctccctccctcccttcctttctccttccctcccttcctcactccctcccttcctttctccttccctcccttcctttctccttccctcccttcctttctccttccctcccttcctttctccttccctcccttcctcactccctccctcccttcctttttttcttctcccttcccctcccctcctttccctccttttttcatcttgctctgttgcccaggcccctcttacctcagcctcccaagtagctgggaccacatccagctaatttttaaatttttaatttttttgtagagatgggctgtcattatgttgcccaagctggtcttgaattcctgagttcaactgatcccccgaccttggcctcccaaagtgctaggattacaccgtgcccggccactatgcttttttttttttaattttttgacctgagtctcactctgttgcccaggctggagtgcagtgatgtgatctcagcccactgcaacatccgcctcccgggaagttcaagcgactctcctgcctcagcctcctgagtagctgggattacaggcgtgagccactgcgcccagccactgtgcttcttgtacagcctgcgaaaccataagccaaataaaccttttttttttttaataaatcatccagcctcaggtattcctttaacaacatgaaacagaccaagatagaagccaagagaaatctatacaaacaaactttattaaactaacccttatcttcctagttgttgccacagttactactctttgttcaacctagtgtgtaagtattttgacttagtcatttcttcaccccattaactatcctcactcaagccccgtggccgtatcaaatctcacaacttaatagtgtttgtccacctctgtatataagtgactctaactgcctctttgcatcttcatttccttatgagggctcctgtaccacattaaatttgtattaaataactgtatgtttttctcctgctcatctctctaatgtcagtctaattcttgggcccaccctggaccctaagataatggaggtagaattctgcctcccctacagcgccccttgttgatgcatgacaggcccactgtctttgtctgttttgcgttgctgtaaaggaatactagaagctgggtaatttatcaaaactttttttggcttatggttctgcaggctgtataagaagcaaggcttcagcatctgcttctgatgaggacctcaggaagcctccattcatggtggaagatgaaggggagcccctgtgtgcagaggtcacagggaaagagagaggaggaggtgccgggctgtttttaacaaccagctttggcaggaactaatagagcaagaactccactccctacaagggagggcaggagtctattcatgaaggatctgcccccaggacccaagcacctcccaccaggctgcacctccaacactggagattaaatttcaacatgagaattaatgagacaaacaccttattcaaactatagcacccactacattgccatctttgccttatcaatgattacctgaactccttgtccccatgcgtcaatccacacaagatgcttgtttgcccagccttggttcagcttctcccctcccccaacgccctgatgtttggcctctcctggagcaggccaggctcagggtaaagtatcctcaatctcttgtcccctcagccacccttcatcccacttccccagacgtggttctttccagcctcattcattcctccctatataagaaaactccttctctgcgtcacctttgggagcttgcagacattaaggtcaatgctttctccctattgcagtattctggtatctcctattgcaatatccttttgcataaagatatctccttactaaatctggattggtttttttattggacagtggttgttacacagaaggcctgctgccctctgctcatcgggtctggttggctgggcagacagatggaaggaccctaggaccatccacctgtgaagtccacccaggctcgcccctggtgtaaatgatgtggggtctgacctggccagaccagatgctgctcaaccctttaactgcctgggaggatttggacacgttccatcttcctggagctgtccctcactcgagagaggcagccttgggactctccaggtgtccttagggctaacggggctgatgatgggcggatgatggattccaggcacctgctgcgacctccccaggagcacctgcaaagcagccctttctgcctcgtgactctacccaggcctccctgtggagtgtggcacaggcttggccagttctccgagtgcagccaagaggctcataggttttgggcacatgtctgcgacctcacttttccagtcataagggcttttgcttttagattctcaggggctttgagctcccaaaccacccagacatagcacaggatgccacctggttctatgtgtctgagcaaacaaatgcactcacatgaagcacagaataaagggctgcctaaatgcggacccacccacccctggcaaggcttgaaaatagcctctatattacatgtaaaagcgctttttagatgattagctgaacagttcattttcttgatctccaatcattgagttctatgtcgttaaaacccctagaaggaccaagacgtagagaaaaatgtcccctgaaaacttcccaagagagatttcctctgcaaactgaagagaatgtgagatacaaacattccccacaaggaactggtctgtcgaggccacacgcattctgtaaatcagtgctttttctctgtctcctcgttttctctccttatggtctttgcatgtacagctgaggcagtaacgggacttgtatcctcgtgttaaagttctttgagatttgggggtcgtacgtggttggtcatattgcatcatctctgtaggagcattcccatcagcaaacaatatgctatcgcttctccaatttataaattggcttttctccttagtctgggcagcagcaagcctgaaaccatctggactttcacaaactcactgtaagggcagagatgggggtcttacaggaacaggcactccttctaggtctggggtaaacagtgcacaaagcgatggtgagctctgtcctcctaagactcttccaaagccagtgtgcactagggtttcccactgtttgttagaaagaacgccttccctctccatccaatgtgcccttccatctggcatcccacttctctggcccactctgcaggaaactcctcacaagtcctgtccatactgaccatccccaagttccatcttcccattctgtgggcctggtgcatggtgagtgctccatgtgtgtccaggagggtgccagtgggagacgactttcagtacggtctgtgggatgaaccagtcagtccacagtcacatcatcaattgggacggagccaagtgccagtcatctaccttggagcttccagaagctgcaggaaacactgacatatctctaaagcaggggagtatgttggctgtagccagttttttttacaatcggatctttgctgtgttcatagccactttctaagggccccagcgtgggtgtgtctccactgtcctgattccccaccgcctcaatagtaaaaaagaatcctgccatgtgttcagtgtttttctgaaggatcctttataatgtcttcttctttctttctttactttttaaatttgtctgcaaaacaaggtattaatctatccatgatagaacacactaaagcaaatttttctccttaaacaggtaagatgaacttccatccagattgggtgctctagaatattttcttattaaggagatttcttttcttgttcagtttgaatagatggcaagaattcctcacaccatgagctttttttgttgtcccatgaacccctgtcgcagtttgatgaagcctatggattctgtcttagaaagactttttttttttgagatggagtctcactctgtcacccaggctggagtgcagtggtgtgatctctgctcattgcaacctctgcctcctgggttcaagcaattctcctgccttggcctccttagtagttgggactacagggaccagccaccacacctggctaattttttttttttatttttagtagagacagggtttcaccatgttggtcaggctggtcttgaactcctcacctcaagtgatccacccacctcagcttcccaaagtgctgggattacaggcatgagccaccatgccaggccaaaaagtttttaaatgcacaaaaatgttaaaaaattattaatacaaaggaaatcaattatattgaaataagttgtgaaaacatataaaattaacttgtcatagagttataaatgtgcatctttatgaatgcattaaataacatttgaattaggaagtatttgtagctactgtcatttcaaagtcgtgatgggtgttaagggtcttcaaagatatttgccatgactgcactgtaataaaactccatcctctctccgcacatcaattatacttctttctcaatgttttcatgattgccctggagtttgtaatatacatttacaacctaagtctacttttaataacactatcctgcttcatgatcaggagtggtagctcatgcctgtaataaatctcagcactttgggaggccaaggccagcaatggcttgagcccaggagtttgagatcagggcaacatagtgggaccccgtctctacaaaaaatacgaaaaaatagccgggcatggtgtcatgcaactgtagtcccagctacttgggaagctgaggtgggaggattccttgagcctgggaagttgaagctgcagtgagctgagactgtgccactgcactccagcctgggcaacagagcgagaccctgcctcaaaaaaaaaaaaaaaaagagaaggagccaaacgctgatgccccctaggcccagtgacagtgccagcacaaggcctatacaggcacttggcaaatgcgctgtgttcttattgttgcaaatggcctgttagcttcccaggtcacaacgaccccaaataactcccacacctgcaccatgcacccagtaggcactcaataaacattgacgtcaggaatggtccgtgtgggtctggttctggttctcgtttgtctcttcagattgtgtgttcttgccttttggcacgtcttgtcattttgtgttgaagctggagataaagtatcaggtaatcagaactctggtatggctgggggtggtggctcatgcctgtaatcccaacactttgggagactaaggtaggaggactgcttgaggccaggagttcaagatcagcctgggcagcatatcaagaccccgtctctaaaagaaaaaaaaaattaaaaaaaaaaaaaacttagctgggcatgttcgtgtgtgcctgtaatcccagcacgttgggaggccaaggtgagagaatcgcttgagcccaggagtttgagtctgcagtgatctatgactgtgccactgcactccagcctgggccacagagtgagaccctgtttaaaaaaaaaaaatcgggaacataggccgttagcgtgagcatttacatcatctggctcgaaactgggctctttttcatgtttattatagccgaagttttgtttacctagggtccttgttctcatctcccctcctgactttaaacttccctaagagctccttcacacactgtccggtgtatcatagtgaggactaagcactgaccttttatcttacccaaataagctctcaccttttatcttacccaaattcccacctacggggtctagggagtcaacccctacaaaccataaattctcatcagatgggttttatttgaccctatatattgtgactgacttttcaatctgactctggcataaaattttgagacaaggaaaaaatattcaaccccaaaatatatattccttgccatgccttgaaattgccctgaaaaatctcttgtgggaaaaatccacattctatagagaatcccctttcccctttgttttccttcctttctttccagatccaggagataatcaactaagagccaggcacccttttaagtcccataagaaacaatttacaacctgctgtctctgaagttggctatctgagcacttcctctgcacaataaaacttggtctccacaatcctttatttttaacctgaacatttcctttctatcgatcccaggtctttagacaagctcaaccaattatctgccagaaaatgtttacatttacttatagcccggaagcacttgctttgagttgtcctgcctttctgaaccaaaccaatatatttcttaatatttgattaatgtctcatgccttcctaaaatatataaaaccaagctgtacctcaaccaccttgggcacatgttctcaggacctcctgagggctgtgtcatgggccatggtcactcatatttggctcagaataaatctcttaaaatattttatggagtttgactcgcttgatcaacagtagctctttctgtcagactgtactcacactggagccttatggcgtggtggccggcctggggtggaggaagcattccatagtgttatgatgaaatctcagcctcttatttggcctgtgcccctggactgtgaccttcacaggtgtttcctagctgcttttgtctccttaaggctagaggtggctgaagtggagggaatacctttctcgaaaggaaaataaatctgaaaggaaaataaatcttggtgccccagaatcactaagctaaagagaaaagtcaagctgggaactgcttagggcaaacctacctctcattctattcaaagtcacccctctgctccctgagataaatgcatatctgatggcctcatttggagaggctaatcagaaactcaaaagaatgcaaccatttgtctcttatctacctatgacctagaagcgccctccctgcttcaaattgtcctgcctttgcctcgagttgtcccacctttccggactgaaccaatgtacatattacacataatgattgatgtctcatatttccctaaaatgtataaaaccaagctgtgctgagaccaccttgggcacatgtcgtcaggacctcctgaggctgtgtcacagatgcacatcctcaaccttggcaaaataaactctctaaactaattgagacctgtctcagacatttgggggtcacacctcccccagctggattaagcctgttagtgtctctcccctgaagggtaggcctttcttgggggcatgtcctgagtgtacttcaccatggttgctttcccgcctcctgccacagcctggaggggtcttttctattgcaccaagagaacctagtggggttcctacaggtaaaaaccaagaaaagagtgggccacccacacccatactgttggaattcaattttccacaaattgaaaaaaattaaaattcccaaaatggaaacaccttcagtccccaggaaattcttactctcaggctgttccacactgatggctggagatttcctgccagtcaaaggctccggaagcttctgctccaggtaatcctgggcttccttctcactggggaaggatgtatttcatcatcacacaggacgctggggtttggtgtgcgttgttttatcataataagaaatgatcaatttattttatccaaactttgctatttacttaaaaagataactatccaatattagcaaaaataattttagaactaagaatttttgcttttcaaaatttatgaacataatgagtcacatttacagatttcccaatggttacaagccctcccattcccgagagtagccccgcttcattctggcggtggagagggcttggcaggctggtatgtgcattctgattggctgacatcctgcagtggtttggtccaattagagagctgaactggcagcatcttatttaaatgtgcactttaatccaatcagatgctggatttctctaagccctcatttgaatgtaagccatacaaatgggaccagctgtgcaaatgacatttgcaaggcaatgccttgtctcccactcaaactccatttctccacctaggaggagaacttgaccgctagatgtggtttgtgttcagaataatcaggggcgggttacaagctcccccatcacgcacctagtgtccacaagtgtgcacatctccactaagttccccagctgcaaggaagcagcttgtatttgcagtaaaagctgtagttggcagtgtcagctctttttgccagcctaaagcttgtgagagacactcaactcaattccacctgagtctgatgaatttaatggaagaaaactgaattcccaggaagtgtggtggtctaacaaattccatcaataggaagcattttcttgagttctgtacttcaaatatgctatggaagcagccacattccttgttgatgatagtcagggttagtttcaaagggttctagttggcacagggatttctgaatctaaaagacaaaaatgtggagagaaaataagttagtatgaaaagacaaggggaatagctgacaataccagctcctagtgtcactgtcattttgtacattcgggccgaccccctcctgcccctcaatggtataataacatggtaactacgatgggattcttgattgaaaggaggtgaggaggaatttcattctttctgaaagtctgaactattgacacagagtatgcaatcttatgtcctctcctgagtcttagaaatcccagaaaggctactcgatagaaatcagtgtcctcacctggaactgtactaaatggatacagcctggatgagcacagcaaggtaaaagggttgaagcactcatctctttttcatgtcagaggagtgctgaagctcttatatagtaactttctccttctttacacagattatgtgtatttagcagttaactgtgcaccgtcaattcataatgccaacgaaaatgttgtctagacagggcttcagtatgctctgtctattcttacgaattccagaagccggctgggcatggtggctcacacctgtaatcccagcactttgggaggccgaggagggcggatcacgaggtcaggagtttgagaccagcctggccaacatagtgaaaccccgtctctagtaaaaataccaaacttagctgggcgtggtggtgcgtgcctgtaatcccagctactcaggaagctgaggcaggagaattgcttgaacccgggaggcggaggtcacagtgagcagggataatgccactgcactccagcctgggcgacagagcaagattccgtctcaaaaaaaaaagaattccagaagcctctattaacccaaactatcctggctacctctaaaacagactttgcattcattttctattgttgccataacacgttaccacaaatacagtgggttaaaccaaagtccatttattgtcatacagccctgaaggtgagaagtacagatcaccctgtgggcagcgctggtaccctctgaggtctctctccttggcttgcaggtggctgtgttctctctgtggctcctcacattgtcttccttctgagcgtgtctctgtgtccaaatttcccttttatcaggacacaagtcccactggattaggacctaccctaatgacctcctttcagctacctctgtgaacatcctatctctaaataaggtcacattgtgaggtgatgggggccaggacatattatttccaatattcatatgaattttggggtgtgacataattcagcgtatagcacacagtcactatagatgtgagatctcatagaatcaccacaaactgcaaaactgacccctgatcacagttgtcaaacaaacttagccatgggcctttgagggaatcccctgtggtcagctgcctctaaaatgcctgaaggattcctgcctcttggtgtttgtgcctgtgggcggtccacacccctcgatttactgactggtttgaacaagtgggttctggcagcagtgatgacacttgtgggattaggttatagaaagacctcggcttctcactgggggttccctcctgctctccctgtgcggctccgtctggggaagctggtggccaggctgtgtgcagcgcagaacagaagcccacaggaaagaatctaaaagtggatcttggccgggcctggtggctcatgcctgtaatcccagcactttgggaagccgaggcaggtggatcacctgaggtcaggagttcgagaccagcctggctaacatggtgaaaccccatctctactaaaaatacaaaaattagccgggtgtgataattacgtctgtaatctcagccacttgggaggctgaggcaggagaatcacttaaacatgggaggcggaggttgcagtgagccgagatcacaccactgcactccagcctgggcaacagactggggactccatctcaaaaagcaaattaaataaagtaaaaaataaaataaataaataaaactggatcttgaatctgctgacagtcacatgccagagcctgggggcaggttctgcccgagtcaggtctgagatgactccagccctggacagcgctgatggtagccttctgacaggccccaactaggcagcactgcgattcccgactgccacacagacactgtgggacaatatgcatatgttgtctggagctgctaagttttgaggataatttcttaggcaaatatcacctcccttccggaccaggtcagccatatgttggatctctatttggttaaaaccgcgagtcactttgtaagtatcaaaatctgccttatgtagcctttggcccctaaatcaagctgttaagcaatgagaacctgaaacttcaaggagttttatagccagtgaatagaagaaagttccttttaggatagttgggataataaaataatgtcagctttttattgtagacttctaaatatctctagtgtactaaatcagggacttggattcccacattagccaggatttaggggtgaactgccaacaaacaaccccacaaccgcaaattggcctttcctgcctgtgggtctgtgagtggctacagggcccccaaatgaaaggggggtgctcaggtgcaattagtgcacctctcatttggggattcttagtttaagagtgagggaatgctattcatcccattgaaagaggtggggagtcagcattagctggaccatattaaatctaaaacagcccaaatccttgtcataataattcattattcttcattccacactcaacgtacattgctcttgaaagataggagaatatcctccccaaaggataccaccccctccccaaaggatgccacaccctccccaaaggatgccacccctccacaaaacaatgccacaccctctccaaaggatgccacccctccccaaaggatgccataccctcccccaaacgatgccacaccctctccaaaggatgccataccctcttcaaaggatgccacccctcttcaaatgacaccactccctccccagatgatgccacaccctctctgaagggtgccaccacctctccaaaggataccacaccctctccaaaggatgccaccccctctccaaaggatgccacaccctccccaaaggatgccacaccctccccaaaggatgccactcctctccaaaggatgccacaccctccccaaaggatgccacccctccccaaagggtgccgtgccctccccaaaggttgccacctctctccaaaggatgccacacactttccaaaggatgtcataccctctccaaaggatgccagcccttcccaaatgatgccacccctcccccaaagatgccacaccctcttcaaagggtgccacccctccccaaacaatgccaccccctccccaaaggatgccaactctccccaaacaatgccacctctcctcaaaaatgccacaccttctccaaaggatgccacccttcctcaaacgatgctatcccctccccaaaggatgccagccctcctcaaacgatgctacccccctccaaaggatgccacccctccccaaatgatgccacccaaaggatgccccctcctctccaaagggtgccattccctccccaaatgatgccaccgactctccaaaggatggcacctcctctgtagagtgtgctatcccctcccgaaaggatgccaccccctccaaaggatgccaccccttccaaaatgatgccacaccctctccaaaggatgccaccccctccttaaacaatgccacccctccccaaaggataccaccctctctccaaaggaagccacccatctctaaaaggtgccaccccctcctcaagggatgccacctcttccccaaaggatgccactttggcacaaggattatttggagctgaaggccaataataatccattgttgagaaacaacggatgtaaaaaagctttctgcttgcccctattttcctaaaagcaggacaaaatggacaaagttgtctttgcctctccaccaggaaggaatcaatttaatcatgtgagatgattttagatgcttatcagccaggagacagcaccagtgaaatctacatgccaggccttaactcgccggccctctccaccactgcttctcataactcccctcctccacatctttcactgttcgccttagctgaaggcactacacaggccggagttctctagctgaactaaggaaaagtcctgcagcaacagtatttgttagaatgttggggtgctcaggcctccaaaacagaacctatctctccgaccttctcccaccctccttttacctactcgttttgctccccaggcaggccacagaaatgaaaactgtagtctttccccacctttctgtctcggacctggccataaggacattttctgacttcccttttctgattgtgggtcataagactcccagttcagagagggtcctgccccatacccaggaggaaggatgctgcccagagaggccaagaagagtctgaacacatgggctctgctggggttccccgctcagtctgttggggttacatccacactttctgtccggtcacatttctacatggctgtcttctatcatgtccatccaatgaagtctccataaaaggcccaaggggacaggttttgggggcttctggagggctgaactcgtgggggcttgcaggaagggtgagggagaattcatttgcaggctgggagggtggcgcagcccaactccgctgggtcagaaggccctgcgcttggacctttgcagaactctccctctgcattccttcatctggctatttatttgtagccttaaactattctttaaataaacaggtaaatgtaagtaagtgtttctctagttttatgagctgctctaacaaattaatcaagcttaaagagggagtcgagggaactccaagttacagctggtcagaagttctggaggcttggacttgcccatggtgtctgaagtagaggcagcctcggggactgagccctcaacctataggatctgatgcaatctccaggtagatactgtcagaatttgtttatttatttagtttttttattgttatgattatttgagatggggtcttgctctgttgccgaggctggaatgcagtggtgagaccctagctcactgcagcctggaactcctgggctcaagcaatcctacttcagtctcctgagcagctgggactacaggcatgcaccatcgtgctcagctacttatttcattcttgtagagacagagtcttgctatgttgcccagactggtctccagttcctgggctcaagcaattccctcccacctctgcctcccaacgctgggattaccaaggcatgagccactgtgcctggctgaagtcggaattaaattgggttcaaggacacctaactggtgcccactaaaacattggttgcttgcttgcttgctgatagggagaaatcctcacatgtttggtcacagatgtcttctgtgttcattgttgtgttgtgagatcagaggaaaaacagttgttttttttctacatcagaggacacaaatattcagaccatagcagctgtggcaggaatttgctgttctattccagccaacacctgaagactggtccaggctcttcctttcctagagcatttactgaaaccagctcacaactgggaatgcttcctttggcgtgttgagatgtccatgtgtctcctacaatctagcagtggctcctcgaggaacccagagccattcctttgaaaccaggagggagaaggccttagtctctgccagaaggtagaatcctgactttgggcctggctgactagcagacacagatggtctcatctgattggcacggagcccccgctcaccccatctccttccctttaagacaccccgccacccctacacaaattacaatggaggcgactctgtactgactgcagctggcactgaatggaaatctgttttcactgctttaatgtccagctttatctttgcgttaactgaaaaaatcacaggatctataaattggaaaagcagatttcacttcttgtagagggttacagcctgcaaagtggccatccctcgggcagggaagcacagccttggccaaacccagtgcctgggccaagcccaggcactttgggggagggaggagttggggcaggagctctgtgcttgtttggctttgccaaacacacatattccacagcctacgggaggactatggagatccatgagggtagccttcacacatgttcacggaacacacatgcacatgacatgtgatgcatgcttaccttgaggtggaggcttcacatgtaaatgtattccaattaggtctttccaggactcaaaggtgctcaagtgcacagcgtctgtaaactggccaggactagcccaaggtcgtggtctctcatcagcagaaagctcttgaagtcagtgtcttgtccagtgaatgctgccatcatggctggtggagcagggggtcggagagtcagcctctgtgagctgggtaagctgcaattgtcttaatgttgcttagctggaggccagtgcttggttagctgctggagtaaaagaaaacccttgcagcagtgaaaacatggtttattctttaagtgtagggtgctgacttaacccttaggtcttgtttataatttgtcaccttattgccacaaagactccatcctgtgtctgtgtttttttaaaaaattctcttaacctcacctggactgtctctatgttaacatgaatgctgtcagttgtgtctaaacctcaacagaaaggggtataatgagatgtgtctgactcccaccctatcatggccagaaactcagtttttaaggttctatggggtcccttttaccaacagagtgtctgtgcagttggttaggggtgcttaggattttatttttagtttacagtctctaaatcaggagacacagaccggctggcctatttgtagatatgccaattagcatccagtgaaggctggccccgggtttatgtgaaatgaggagggtgaaaccccaacctgcaagaccctgggcccaaattgcagtagcaacaatgccaaagttgcagcatttttcacaaaacaactctcacctattattttccttgaatttcttgtcatagcaagtgcggaagattcaccagaaccatcaggcagaaccacacatttgttttcagaaatgtctttcctttctttccacaatgttgctttggcttaaatgtttgtgtcagagacgtgtgaaccagagcaactccatcttgaataggggctgggtaaaataaggctgagacctgctgggctgcattcccaggagattaaggaggttaaggcattctaagtcacaggatgagacaggaggttagcacaagatacaggtcataaagacgctgctcataaaacaggttgcagtaaacaagctgccccaaacccaccaaaaccaagatggcgatgagagtgacctctggtcatcctcaccactacactcccaccagtgctatgacagtttacaaatgccatggcaacatccagaagttaccctatatggtctaaaaagaggagaaaccctcagctctgggaattgcccacacctttcctgggagactcatgaataatccccaccttatttagcatataatcaagaaataaacataaaaatgggcaaccagcgcaccatgccactgctctgcctatggattagtcattttttattcctttactttcttaataaacttgctttcactttatggatttgcctcaaattctttcttgcaccagatccaagaacccttttttggggtttggactgggacccctttcgggtaacatttgtgtccccagcccaaactcatctgtggaagccccaaccctcaatgtgaggatggcataggaggtggggccttggggagataattaggtcatcaaggtggagccctcactgatgggattagggccactgtaaaatggactccagagagctgcctcaccccttccatcacatgaggttgcaaccacaagactgcactctacagcccagaagaggaccctcaccagaccccagccctgctgacaccttcatcttgaactttcagcctccagactgtgatcaaaaattctattgtctacaaattgctcagtctctggtgttttgtcatagcagcttgaagtgactgagacaaatgtcctcacttgaggatgaggcatcagcattatcatggaaggactaccaatgatcatggtgactttttttcttctttatttctttaaactgacaaaaattgtatatatggtgtacaaggtactgttttgaaatatgtattgtgttgggaatatggattggggaatggctaaatcaagctaattaacatagacattacctcacatatttatttgtggtgagaacacctaaaatctactctcttagcaattttcatgtactacattgctgtgaattatagtcattgtgttgtacattagatgtcttgaactgactcctcctgtgtcagcgtgccctagccccctcctgtgccctttagtcagcgtctctggcccccagatcctggtgaccatcattccactctctgctttatgatatcaacctctttagattccgcatagaagtgagattatgcagtgtttgtctttccatatctggctaatttcacttaacgtaatgttctcatttcacccctgttgtcacaaatgagggaatttcattatgttttaaggccggaatagtatttcattgtacatatgtaccatattttctttactcattcatccgacaatggatacttaggttaactccatgtcttggttattgtaaatggtgctgcagtgaacatggtgcagatctctcttctggatacggat

SEQ ID NO: 2867 - DNA, 1488 bp, Homo sapiens
ccattattctgctgactgcagtactgtagagcataaagtttcttatccacactgtttcttagttcagtctgtcaatatcactactccacgattattgttgtttgtttttctttctccctgtcttttacctcaaaaatctctattgtgatgccagagagacctttctgaaacctctccttttttctgtgtttaaaaccccccagtgccgcccatgaaatacacagcaaagtccaaactccttatcttgcttggatcctcctttccaccctttttaactgttcagccatatttctccatgtacttctgagattggaacccagggcaacaaagctaatgtgggttctccaagattaacacaactgaaaggaggcccctttatgccatctattctaggtcccttggaatataattaaaaacaggaatttcaacattgaaatgtaatgatgttcaggtaagggcagtaaggtacattgacttgagtcaatctcccaccatgtctggggactgggacagctgagccaggggtcctacctaagggtcaggcctgtgtcttcacttctcctttcaaccctttacttcttccagagttgaacggcttactttccttctctcactaggccatttcatggcttgtgtttgcctgaaatacaactctttccctccctggtctacacctgctcaccctgaaagaaatacctctgagcccactttctttcttggaagcattttatgactcttatttctgttatcaacacagcttttatttatgtctccatgtatcctttgaagaaacacaacttttcaggttctatgttttatttgcattcttagtgtctggcacattgtctgacacagtgtaaaagctgagtagaattttgcctgatagcagatgtgcctgaagtgagggtgtccaaaatttcattaaatgacgactgctttaatatgaattcttggctaaggcaggagaatcgcttgaacccaggaggcagaggttgcagtgagccgagatcacaccactgcactccagcctgtaatgtcttacaataacagaatgcaggagagcacatatcaatgaagaaaagacaaaatgtacttatccatgaagctgaggttaagaaaccagtgtcttcaagagccagggacagcactgggtctgtgcagagttgagagatggtgatgacatgtggtttccagcattcctcacccagtccagggacactgtgggtgtgcccagcttaagtccagtaactggaaatacaagcccaagttctggagagtttgagctgcagagatatatatgggaacactttgaatcttgactcattggccataaccagcagagtggaaaatacaagaagagaaaaaaacattgaactgcgattttataacatcctttactaggcagagagaagaggaaacaccaggaaagaaaactgtattacgatgtgaaaacttaatgttgagaaattcaggcatcttggggttagt

SEQ ID NO: 2868 - DNA, 2031 bp, Homo sapiens
tacatatctacttattggaagtgggactgtcattgtcccagttactgatgaggaaattaggcacagagaagtcaaatgacttgcttaagatctcaaatccaggaactgcagaagtgagatttgaacccatttccaactccaaggcctgtatagtaattcactattccagaatactcctgtagcaacctggccattcgctgctgagccaatgccccctctctttccacaaactcttctcctgtagcttcgaagctatggtaggtgaccaggagtcttggccacacttcttccattgcctgcccaggaggtatctccaactttctcttacacacatctgtatgatacactaagacctttttccaaattgcacagagagagaaaaagggattgagttgcttccatatttttgctgctcattgtcctcttttcagtactattttattttcagaattttttctagccacacttttcttctcaagcacagcaggtagcctttgcatagctatgagagtgacaggattcttgtcaaccagaccatagacgcctacccagccaggtgtaagaaggtccgctgtgggcagagaagttgatgagccagcacggtcagtcctgtctttcgctagcagggactattgactgctctgtgccagacattttgttaaaaagtggtgttatcggcctggcgcagtggctcacgcctgtaatcccagcactttgagagaccgaggcaggtggatcactcgaggtcaggagttcaagaccagcctggccaacatggcgaaaccccatctccactaaaaatacaaaaattagccagacgtggtggcgcatgcctgtaatcctagctacttgggaggctgaggcaggagaatcagtgaacctaggaggcagaggttgcagtgagctgagatgatgccgttgtactccagcctgggcaacaagagcaaaactccatctcagaaaaaataaaaataaaaataatggtgttaccaagacatagaaggtggggtccattctttgaagtgaccactcattgagtaaattaacatcatttctgtttcatgccattgaagagctgtgaataataatacccttgtgtcaggcttcctgtggtctagcactgtgtcccgtactttatagtttatttcctttaatactcatgcccatctagggtagtaggtaccatggttgttcccagttgatatatgacggaatcgaggcttagcagaataagaagtcacccaaactcatacccactggtcagcagtacagctagaattcaaagccacacttgtctaggtccaaaatctgcacccctaattaaccactcctggtaagaagctggttataagggctggtcaagtcagctatggaagaattctcagaaagtgactctaaaggtgttctttgaaggttgtgtaggaattcaccaaaactggaaggagacaggccttccttgcagggaaaaggaacgtaaggggcaaagttacagagacataaaaactcacaccatctttggaaaaaggagactcattttgagaagccaaagagtaaggttaagtgagaactctggacatttgggcctgtgggtattgggcagcagcccctgacatgatgactcgtctgtgtgacagcagaatgaatgaccacagcagagccagagggcctttgcagccctgttggtctcaaatttactcatgtatagcacatgcaacctgcattaataatcacttctttggaatgttttctacctggaaagggaattagtggatgtaacagttcattccccaaacataaaattttccttgacgttttgattgttataactcatttaagtgggaaagtataagatttgatatctagccctgaagactcatcattgagcacagtgctagaaagaaatgcctaccaggctaggtgcagtggctcacacctgtaatcccagcactttgggaggccaagacaggaggatcacttgaggccaagtatttgagaccagcctgggaaatacagtgagaccttgtctctacc

SEQ ID NO: 2869 - DNA, 11188 bp, Homo sapiens
cgctggagctgggtcagtccgccgctcaccccgcggccgcaccttcccgccttctcaggtaactaagtgcgggtctcgggcctggcagaagcttcttcggccccgtgccctcgcctggccccgccccgtcggttgtgtgcttgtctcgtcctgcccccaggccctgccggtccccaccgttaggccggcgtccctgcccggccccgctgcgggctggcgccagctcaggaggacgccccgaagccgaggcctcggaagcaggtttttcccagaccttctcctgtcccgcgttccccctaggccggccgtagggaccagaccccaccctaagcccatagccggccttcgcgctccgggtgaccctggctggccctgtttgtctgtgggtcctgggatgcgccactcccggcaggaaggggcgccgccgaggcccggtctcagcctggaaccccgctcctgccgtcggggcgctttctgcggctgcccacacacgaccccaggcaaggggtgggggcgcgggaccctccatgacatggcggcggggcgctctcacttctttgaaaccagcgtaaactggacccgccccacctcccataccttgggggagccccgggaaaggctgtggcctgggggtctgcagggcgttggcagtggaggtggggagagaccccagccctttcctgtcccccccaccagccttgccttcctcgccgtgagccggggacagtggaggggagtcagggagggcccaccagatggactttcttgtgactcatcctataaagcccctcgggcttagccaccctccccaggacccgtgtggtctcccggactgtgctggaagcttagagccagaatgacttttccaccctcgggctggctggctcagtgggcagcagggacagggggctgtgaagagaaaactcactcgccagggtcaggggccgcttgctcactgaggaaagcagaggggttcctgccgcttgcctcaggaacaaagctagttggtgaggcactgccttgcagttgtaggagaggaataatggcccccgtgggtgcttggttggaacgattaaaggagaataacagtttagcacgattatttcacacagttgttcaaagagatggctttgaattccagcttacatggcgtcttcaacaaaaagtaattgtttagagaagtgacaagatgaaggaggactctgagtcctagtctccctcctcgagtccctgtgtgagcagaggtaaacaatgaaaactcaccaaccaggagaaattcacctaggactggcgcagaaggtatacaccatgagcctggaaatgatttaaaaaacaacacaggctgggcgcggtggctcacacctataatcccagcactttgggaggcagaggcgggcggatcacttgaggtttgcgagttggaaaccagtctgaccaacgtggagaaaccccgtctttactaaaaatacaaaattagccaggtgtggtggcgcatgtctgtaatcccagctactggggaagctgaggcaggagaatcccttgaacctgagagatggaggttgatgtgagctgagatcacacaattgcagtccagcctgggcagcaagagtgaaactccatctcaaaaaaacaaaaaaaacaacccacaactgtgggccaaagggacacagcgacaaggggtcccaatgggcgaggctggaataacttgaatagcagaataaagtagcattggattataatgcacagggctgaagaaatatcgatgagtctttgctgatgtaataagtgactgaatgagctgggcagagtgggacctgtagttcagctactcagaggctgaggtgggagcatcagttgagcccaggagtcaaggcctagtaatatcccatttccaaaataaaagactgaattaataaatagatgggagagaggagacaattgaccatgcaggaggagtccaaatatttgttctttgaggcaggatcttcctctgtcattcagaaggctggagtgcaatggtgcgctgttgccttgctgcagcctggacctcctgggctcaggcagttgtcccacctcagcctcccaagtagctgggaccagaggcatgcacatccagccgagtccaaatagtgtatgcagatatgccctcacagaggtgacctgaactttctgagttgtgagtgagcttcacctggggacctccttttaggtagcagggaaaaagaggagggtgagccacacccaggcacctccttccagagagcatgtgcctcagcctccagagtagctgggattgcagacatgtgccaccagcccgactaatttttgtatttttagtcgatacgggggggtctcactatgttgcccaggctggtcttgaactcctgggttcaggtgatcttcccacttcagcctcccaaagtgctgggattacaggtgagataaaacttccttattcacagactacatgattgtctatatagagaacactcatctaaagcaacagcaatgattgccacaaagaccctcgtagagccagtaagtgagtttggaatgttcaccagtaacacatacaaattaatcttagggctgcgtgcagtggctcatgcctgtaatcccagcactttgggaggctgaggccgaggctggtggatggcctaaggtcaggagtttgagaccagctgaccaacatggtgaaaccctgtgtctactaaaaataggaaaactatccaggcatggtggcgggcactgtaatcccagctactcaggaggctgaggcaggagaatcgcttgaatccgggaagcagaggctgcagtgagccgagatcgcaccattgcactccagcctgagcaacaagagtggaactctgtctcaaaaaaaataaaagacccggtgtggtggctcatgcctgtaatcccaacgctctttgggaggctgaggcaggcgtatcaccaggtcaggagttggagatcagcctgaccaacatggtgaaaccctgtctctactaaaaatacaaaaattagccgggtgtggtggcacacacctgtaatcgcagctactcaggaggctgagacaggagaattgcttgaacctgggaggcagaggttgcagtgagctgagatcatgccacatttgaacccgtgaggcagacgttgcagtgagccgagatcatgtcactgcactccagcctgggcaacagagccagactgtctcaaaaaaaaaaaaaaaatcttacttctatagacaataaaacattggaaactgaagttaaaaacacagtagctcctgagagagagagagaggtataaatctaacaagacaaaacaggatctgtatgctaaaaagactatgtatgtggagagacggcacacagcacgctcatagactggaagactgaacataagatgccagtctcagaaggatctgtgaaattaacaaaattccaaaacattgcagtaggactctttttagatttagaaaagatgattttaaaatgtatacagaatggtgaaggagctagctaaaacagtaaaaaggatagataaaacaatgttttaaaaagaacaaaaaagttagatgaatcacattacacagttttaacagactttaaagccacaaaaatcaagactgtcgtattggcaaagaacagacagatgggtcagtgatcagagagtctagaaacagacccacataaatagggccatttgatctttgacagcagtgcaaacaaaagcaaccctgtggagaaaggattgtccattcaacagagcagtggggcagttggtcatccatatggtagaaatggaaccttggcctaaacctcacattgtacacaattaactccaatcatatgtaaacgtaaaacaaaactataaaatgtttggaagaaaacagaaaaatacctttgtacctgatgacatttggtagagttcttagacatgatcccaaaggcataatccacagaagaatccataaaagaaaaatttgtaaattggactttatcaaaattaaaaacttacttttttgagatagggtcatgctgtgttgtccaggctggagtgtggtggtaagtcatagttcactgcagcctcgacctcccgggctcaagccatcttccttcctcagcctcctgagtagctgggactagaggtgcaagccactattcctggttttaaaaattttttccagagtctgagtcttgctgtattgcccaggctggtctcaaattcctagccttaagtgatccttccaccttcggccccaaagtagttgagattacaggcatgagccaccgtgcctgacctaaaaacgtttgaactaccaaagacagtgtgaaaagaatgaaaagatgaggagaaaatattcacaaatcacctgtcaactaaggacctgtatttggaatacacagagaactcttaaaactcaacagtaagaaaacagtccaactaaaaagtggaaaagacctgatcagacatgcaccagcaatgacacagcattgactgttgggcacaggagaagaggcttgacaccaccagccaccaggaaatgcagattcagccaccacgcaggacacgaggcacctgcaccacagccgcagtgcaagagaatgctggtggtgccccaagctgccagggtgtggacctgctggaaatggaagacggcatggtggtttcctataaagttcaatgtacacagccacatgacccagcaatcccactgttgggtatttagagaatgaaaaacttaagtccacataaaaactgtacgtaaatgtttactgatgccttattcataatcatcaaaagctgaaattcaaatgcctttcattgggtgaactggtaaactgtggtatatctatgcagtgaaatactcctctgcagtgacaatggggagagactgacacattgggcaccatgggggtgggaagaggtgaaggaaggttgggggaaggcgccgtggtcaggtgtggcactaaggagatttgggggtggagccattctgtgtgtggactgtggtggtggtcgcgtgactgtacatgtgttaaagcttcaaacaaaaaagttaaaaattttagtttaaaatattaaaacatttttaaaaatggacacgtattcctgaatttttttttttttgagatggagttttgctcttcttgtccaggctagagtgcagtggcgccatctcggctcaccacaacctctgcctcccgggttcaagcaattctcctgcctcctgagtagctgggattacaggcatgtgccaccatgcctggctaattttctattttttttaatagagacggggtttctccatgttggtcaagctggtctcgaactcctgacctcaggtaatccacctgcctcagcctcccaaagtgttgggattacaggtgtgagccactgcccccggcattcctgatttttaataagctgtaacagaagataatttctctatttggtaaatggtatttgtcaaaaccctgcagcaatcatgcttaagtcaagatatttaaagtattcccattaaagtcagacaagcacagttctccttgctatcactgtgagtgttttccagacatcccagcagggtgagagaactgaaaaagagggaaggagatgaatattggagacagggtttagtagtttgttgatgatacaatcatctgcatgtaaatccaagaaaatcccctgaggaaccctgaggaccagccgaggagttcagtccgtgccagatccagtgggtttctctactccacaataacccatcggagcatgagccacaaccctccacctccatatgaaagaatcacaaaagctggaagagaagtgtgtaaggaccgcctgaggaagatgctaaaagagggtgagttggcagacatgccacatcgtgggtgaaggatgtcagctgccccacaaagtaaactgtacattcattgcaatcctagttaaattctgatgagattaaatgacacaggataagctgcttctggagctgatctaacagaagaaaagccaacattaaaaaaaaggctgggtgaggtggctcacgcctgtaatcccaacactttgggaggctgaagcaggcggatcatttgtgttgaggaatgtcatttgtggtcagcctggccagcatggtgaaacccatctctactaaaaatacaaaaattaggtgggtgtggtggtgggtgcctgtaatcccagctacttgggaagctgagacaggagaattgcttaggcctgggaggtggaggttggtggtgagctgagattgctccactgcattccagcctgggtgacagaatggtactctctctttcacacacacacagacacacacaaaataaagaaaaagggctggcgtggaggctcctgccataatcccagcactttgggaaaccgaggtgggcagattgcttgagttcagttcgagacgagcctgggcaacatggcaaaaccccatctctacaaaaataaaaaattagctgggtgtggtggtgcctgtagtcccagctactctggagggtgaggtgggagtatggcttgaggccaggagcccgaggttacagtgagccatgattgcaccactgcactctggcctgggtgacagagtgaggccctgtctccaaaaaaagaaaaaaaaccccacaccataaagggggtcctactgtgtccggaattggtgggttcttggtctcactgacttcaagaatgaagccgagggccctcgtagtgagtgttacagctcttaaaggtggcgtgtctggagtttgttccttctgatgttcggatgtgtttggagtttcttccttctggtgggtctgtggtctcgctggctcaggagtgaagctgcagaccttcgtggtgagtgttacggctcttaaggtggtgcgtctggagttgttcattcttcccactgggttcgtggtctcgatggctcaggagtgaagctgtggactttcgcggtgagtgttacggctcttaaggtgctgtgtctggagttgttcattcttcccactgggttcatggtctcgatggctcaggagtgaagctgcagaccttcgtggtgagtgttacggctcttaaggtggcgcgtctggagttgttcattcttcccactgggtccgtggtctcgatggctcaggagtgaagctgcagaccttcgtggtgagtcttaacagctcttaaggtttcgcgtctggagttattcattcttcccactgcgtctgtggtctcgatggctcaggagtgaagctgcagaccttcacgatgagtgttacagcttttaaggcggcgcgtctggagttgttcattcttcccactgggttcgtggtctcgatggcttcaggagtgaagctgcagacctttgcggtgttacagctcataaaggcagtgtggacccaaagagtgagcagcagcaagatttattgcaaagagcaaaagaacaaagcttccacagtgtggaaggggacaggaccaggttgccactgctggctcgggcagcctgcttttattctcttatctggccccacccacatcctgctgattggtccattttacagagagctgattggtccattttacagagagctgattggtccgtttttgacagggtgctgattggtgcttttacaattcctgagctagacacaaaagatctctacgtccccaccagggtagctagatacagagtgtcgattggtgcattcacaaaccctgagctagacacagcgtgctgattggtgtgtttacaaaccttgagctagatacagagtgccgattggtgtatttacaatcccttagctagacataaagcttctcccaagtccccaccagactcaggagcccagctggcttcacccagtggatcctgcgctggggctgcaggtggagctgcctgccagtcttgtgctgtgcgcctgcactcctcagcccttgggtggtcgatgggactgggtgccgtggagcacggggcagtgctcgtcggggaggctggggccacataggagcccatggaaggggtgggaggctcaggcgtggtgggctgcaggtcccgagccctgccctgccctgcagggaggcagctaaggcccagcgagaaattgagcacagcagctgctggcccaggtgctaagcccctcactgcccggggccagcagagccggtcggctggccgctctgagtgcagggcctgccgagcccacgcccacccggaactcttgctggcctgcaagcctgcccacatccctggttcccacccgcgtctgtctctccatccacacctccctgcaagctgagggagccggctctggccttggccagcccagaaaggggctcccacagtgcagcggcgggctgaagggctcctcaagggcagccagagtgggtgccaaggccaaggaggtgccgagagcaagcgagggctgagagggctgccagcacactgtcacctctcactaccagacccgagcagagctgtggacaacacagtatgggaattaagcaggtgagatgaccagagtcctcactggcactagaagatggcagcccaggagaaagctaccagccagagcgaggcctgccagagatagccacatctcctctcagagaatgggggtgatgaggccctgcaggccaatctgccctgtgctgtggggcagaggaagctgtgggactggacaactccaacattcacagttgtggcaccagctgcaggtgagaaatgtgaggagggaccctgccccctcaacctctgaggggccctggcagactgggggctgtcgccacctgagggttcccagccttcctacaaggcagtgtgcatggtgatgactgaagtctcggggtaatctcccagcaagaggtcaggtcctggttgtgcgtcccagggtgtcagtgaaattggctgctcccctgacccagggcaccttcatgcgtcttcacagcaggactactgtgaccaaggccagacctttcatctttcaaaagactttgactaaaaatgctttaaaaaagcaaccttcggctggacgcgctggctcacgcctgtaatcccagcactttgggaggccgaggcgggcggatcaccagaggttgggagttagaaaccagcccagccaacgtggtgaaaccccgtctctactaaaaacaaaaattagcctggcgtggtggcaggtgcctgtaatccagttacttgggaggctgaggcaggagaatcgcttgaacccaggaggcagaggttgcagtgagccgagatcacaccactgccctccagtctgggtgacacagtgagactctgtctacacacacacacacacacacacacacacacacaaagaaaaaacataggaataaatgtagtggtcaaatggttgtttgtccaacgtcgacaggagtcttatcccttgagcaggccacaccttccccaggaattggcgtgggcagacactctggggtgggcggggtgggcccaggggagcatctccttcctcacaattggagcataagccaccaaaaaaaatgaaacaaatgtgctttgtgtactttccttgactgaggagtaatgtgggtaagagaaaggactctttgcttatttatggatttaggactctgtgctgatttatgtaagcacagttgcatttctgtgtaagcggaagacagataattctttctattaaaggggacgttcagtgtagctactgcagagcaccgtcaggacacaggcctcccaaccaatgcaggctcagccctccacagcccctcaggagggactcagtgcatctcaagggagttttatccttaaaaactagaagccatatggacatctactttgggaggatttggtgggcctcaggggcctctagcagcagaaggccctggcttcctgaacgcagacggtgcgggtctcatcacagcaaacccccttgtttttctgttcctctgctgcctttcaggggacactgtttggctttcacccggtcacaggtgtactaacacacatgactaacacaggatttttgtcttatgcacacagaactgcatgggagaaacaaaaccaccagcgagcagagaggccgaggcttggctctgctgtgagagcgtcaaggtccctgcagccctgagctgctgcagaacccacaggaaccaacttccagagcttgtttctggggtcctggtgcagggaccccacccactgtgctcagatggagcttgaagctctcagacctcaggctcccgtggctgctatcaccaggcttcatggcccagtccccaaagtgggtggacccaattttgaggacttgtgtttcccctactccctgcagttgacgctgacatcagtgtctgcttgtggtttcagccagtatcttgacatttctaagatggacagatggactggccgaaaataagtaaaatacactttgagtcagtgaagtctttttttttttttttttttttttttgagatggagtctcgctctgtcgcccaggctggagtgcagtggtgcgatctcggctcactgcaacctctgcctcccgggttcaagtgattctcctgcctcagtctcctgagtagctgggactacaggtgcgtgccatcaggcctggctaattttcgtatttttagtagacatggggtttcaccatgctggccaggatggtctcgatctcttgaccttgtgatccacccgcctcagcttccaaagtgctgggattacaggcatgaaccactgcaccccgccaagtccttttttttttttttttttttttttttttaaattgagatggagtcttgctctgtagcacaggctggagtacagtggcgtgatctcggctcactgcaacctctgcctcttgtgttccagcgattcgcctgcttcagcctcctgagtagctgggactacaggcccctgccaccacacccggctaatttttatattttttagtagagacgggatttcaccatgttagccaggctggtctcgaactcccgacttcagatgatcagcctgccttggcctcctacggtgctggaattacaggtgtgagccactatgcccagcctaagtcaattaagtcaagtctaagactgaacctatttttaaagtttactgctttaggttgtgagaatataattttggccattctcctttccttccaattctggttctcttaagagtttcagaattgttgta

SEQ ID NO: 2870 - DNA, 7327 bp, Homo sapiens
gttggacccggctccgccctaccccacggggccgcctggagaggtgctgggagctgggtggagcttagaggaattaaactttggccctgcgcctcgtccagcctaggttccacccttttctgggaacgctggagtgcagtggcaccatctcggctcactgcaacctctggctcccaggttcaagcgattctcctgcctcagccccctgagtagctgggattacaggcacgcgccaccactcccagggtcttactctgtgacccacgctggagtgcaatggcaccatcacgacttactgaagcctccacttcccgggctcaagtgattctcacacctcagcctcctgagtagctgagaccacagatggagttttgctcttgttgcccaggctggagtgcaatggcaagatctcagctcaccacaacctctgccttcttttttcttctgtttttaaaacttgtggtaaaatctagataacaaaaagtttgccattttaaccatttttaagtggacagttcagtggcattagttacattcccaatgttgtgtaaccaccactattatccatttccagaaggttttcatcacccgaaacagaaactctgtacccattaaatagtaactccccattctacccttctctccctccataacctctgttttaccttctgcatccatcaagttgcctgttatagataattcacatagaatcattcagtatttgtttctttttgtatcacgtatcaaaatttcctttttttttttttgcttttgagacagtcttgctttgtcgcccaggctggagtgcaggtgcacaaccatggctcactgcagccctcacctctcctgctcgagagttcctcccacctcagccatctgagtagctgggactacatgtgtgcgccaccatacccaactaattttttggttttttttgtacatacggggttttgccatgtggcccagggtggtctcgaactcctgggctgaagtgatccacccaccttggtctcccaaagtgttgggattacaagcatgagccactgcgctggaatgcaatgacacgatctcagctcactgcaacctctgcctctcgggttcaagtgattctcctgcctcagcctcccaagtagctgggagtagagccatgcgccaccacgcccggctaatttttgtatttttagtagagacggggtttcgccatgttggtcaggctgatctcgatctcctgacctcaggtgatcacctgcctcagcctcccaaagtcctgggattacagacgtgagccactgcgcctggcctatgctttaaaataaaaatagagattgggtgtctggctattatgttgcccaggctggtcttgaactcctggcctcatccttccccctccacctcccaaagcacggggattataggtgtgagccaccacatcttatccttctggtgcattttgaaggtagagaccctaagtcagatttgctgatgaatcaatgtgggggacgtggcacagttaaccactccctcccctcccctccccatccccgtcccctctgtcgtcccctccccctcccctcaccccttccctctccttttttttttttttttttttttttttttttgagagggagtttcgctcttgtcccccaggctggagtgcaatggcgtaatcttggctcatcgcaaccttcgcctcctgggttcatgcagttctcctgtctcagcctccagagtaggtgggattacaggtgcacaccaccatgcctagctaatttttatatttttagtagagatgaggttttgccatgttggtcaggctagtctcaaactcctggcctcaagcgatctgctggccttggcctcccaaagtgtaaggattacaggcatgagcaccgccccagcccacacccttttgcttgaggcacttttttcttctttttttttgaggcggagtcttgctctttcgcccaggctggagtgcagtggcgctatctcgagccccgcctcccgggttcacgacattctcctgcctcagcctcctgagtatctgggactaccggcgtctgccaccacgcccagctaattttttttttgcatttttactagagacgggttttcactgtgttagccaggatggacactttcttcttcctttggaaatacatcctctggtttccctcctccctcgctggcctctcctctcagactcttctgcctgctctactccaggtgcattgaaatgccccagacctctgtgtggggagtcttctatgccacacccttcctagatgacatcatctggccctaagttttcagtatgagtcaatgtgttggtgatgcccagattcccacctccagccctgatttcttccaagtgctctagagtcatatacttatttgcctgcttgatgtcccttcttggatgtcaaacagtcatctcaaaattcaactcttgatcctctcccctgctccaaacttcgccatctcagtaaatgcgttatattcctcctggttgcataggcttcaaacctaggagtcatccttgaatagaccctctttcttgcctccgcgtttgagctttcagcaagtcctgtcattcagaccattcacacgtattgaaaatccatccctttcttgccgtcttgactgaacgttctgatgaagtcgtcaccactgctccctggacctctgtcctcactaacagcgcttcctgtttccattcctgctgctccagagtccatccatctcctcccttttcagagaggcttctctgaccaccctttgcaatggctgctccatggcccctgctagaacaggctgtcatgctcttgtgggtctgcttgtatatttatctcttttctgcctccactagaaggtgagctctgacagggcagaggttctggctgcctggttccgtgctgcattttcagagtctagaatagtgcctagcacatggtacgtgatgaggaaatctctttcctgatgaatgagcgaagcagagaatcctcagaatccgaggatgctctctctctgtcttgggagctagaggaactcttcatttttcccttcatgaatctgctccactgtcctttctgtttattggcttcctcagtgtttggtttgccatggcgccatcttggtcccatttctcatgctctgctcagctcaaagcagtccacgggttcaactctcagtgccccaggaaggggaaacccacttcacttgggtcaagtgttcattttccatcctccctgtctccaccccaatcagcaaaggctagtggctggtggtaaaaggaaggctagtggctgggggtaaaaggccaccagcagagggggctctccagaggcaggcccatccccagctcctcccgagtaagtgccaatcacccagaggtggatcctctttcagggccctgacttgcaaagctgaggaccagcttcctgtcagtggtaaccctcagtgagggccttgtctgagcagccagcagcctctgagacatttccacatgggcactggctaacttaaaaaagataagtattcacccttcccaggaggtactgatgtcaggaatagccaagagtgcagtcttggtctgtaaggaggtggcccttccactccatacggcccttcccaggatactgctgtatcctggggtctgctcgtggtgccagcaagcaggcgttccttgggagcccccctcagccctcccacccactgctgtcctctctccctgcccccatctgtgtaaggaccctctgatatatgttcacttagtaagctgtgtgtgtgtagtggggtgtctttgtcaatgatctgctccttttctctgaaaactttaaggactttgatatttttggattcacaatagtatgtgtagatgtcagattttcctcatctctctcctgtggcctctgtgggttctctcagtctgaggtctttcatctctctttaattctgggaaattaatctccattctgtcttcaaatatcacctcccttccatattttccccttccttctgcaactcctattacctggatattaacatttctgtttctgtcctccatgattctaactttttaagttattttccttgttttttttttatcctttctttcctatcagaatttctcaagttgatctttcattttcactaattcttttcttgaccgtgtcaatttattccattaattctgttctgtatgtcaatattatattttttaccctgatctttccacttggctcttctgtatggtttgttgtttttgtgacatggtcatggcggtgtgggttgtggtgggagggggttacccccgatatagtctggatatttgtctgcgcctaaatctcctgtcagaatgtaatagtgggtgctagaggtggggcctggtgggaggtgtttggaccaggggggcagtgttagtgccccgcatatgctctctttgcgaaaataagcaagttattaaaaaatctggtcatgtaaaagtatgtgacacctctccccctccctgctcctgctttctccatgtgaaatgcctgctcccacttcgccttctgccatgattgaaagatccttgagtcttcatcagaagctgagcagatgccagcaccatgcttcctgtacagcctgtagaaccatgagccaattaaatctcttttctttataaattacccagtctcaggttttttttttttttttttgagatggagtttcactcttgtttcccaggctggagtgcaatggcgtgatcttggctcactgcaacctctgcctcccgggttcaagtaattctcttgcctcagcctcccgagtagttgggattacaggcgtacaccaccacacctgggtaattacgtattttcagtagagacgggtttctccatgttggtcaggctggtctcgaactcctgacctcgggtgatccgcctgcctcggcgtcccaaagtactgggattacaggtatgagccaccgtgcccagccggtttttttttttttttttgtatagcaatggaagaatggcctcgtacacacgctagagtggaaagtcccaggcaccaaggcttcccaccctagaagcaagctcagggctttctcttcatccttccagggagagcactgagagatgatggggggttggcagggggcatcccttggattatcattctccagacttaggcttggaggggagggtggagaagtggatttctgggtctggtccacctcacctgttttctcagcttctcacccactcagagctcttgccccaattctccctttcatcctgcagatccctgcgcctgactcatctcaggcgaggaggcaaatcatcagttatctcaggcagcagcaggacgagactcctttctgattttctccttccctggccacctctccccaccccatattcactcattccaaacctctggcctccccagcaactctacatcctcatctccatctgttccctctctcgatgctgtgggtgacgttggagagggaagcccggagccctgacctagtccggcgtggagagaggaatggaaagcagtgtcccttttgagaaggcaaatttacagctggcttttgtaatcctagctattttttgtttgtttgctaagtctttgatagtccccagtgtggtttgtctgccagtgatctcagcaccaccagagagcttgttagaaatgcggcatcccaaccccaccacagccctcccaagtcagatactgccacctcacgaggccccccagggatccacaagttcattaaagtttcaggaatccaattctactacaaaatatacatttataattaggaaaaggatagtttcttttaaatggtagaacttccccaatgagtcagctacctgtatttctggcctgtcaggctagacactggagaccattctgcatagaattgtacctccctgaactactgttaggccttagggtggggattcatctttcccttctccccaccatggagacaaaatcctcttaaacatatccgggcctggcatggtggctcacgcctgtaatcccaacactatgggagtccgaggagggtggattacctgaggtcgggagtttgagaccagcctgaccaacatggagaaaccccgtctctactaaaaatacaaaattagccgggcatggtggcacatgcctgtaatcccagctactcgggaggctgaggcgggagaattgcttgaacctgggaggcagaggttgcagtgagccaagatcacgccattgcactccagccttggcaacaagagcaaaactccatctcaaaaaacaaaaacaaaaacaaaaaataaaacatatccagcagtaggccagacacggtggctcacccctgtaatcccagcactttgggaggctgaggcaggtggatcactggaggtcaggagtttgagaccagcctggccaacatggtgaaaccccatcctttactaaaaatacaaaaattagctgggtgtgggggcatgtgcctgtaattccagctactcaggaggctaaggtagaagaatcgcttgaacccaggaggcggaggttgcagtgagccgagatcgtgccactgcactccagcctgggctacagagtgagactccatctcaaaaaacaaacatggtggctcacgcctgtaatcccagcactttgggaggccgaagcaggtggatcacctgaggtcaggagttcgagaccagcctggccaagatggtgaaaccctgtctctactaaaaatacaaaaattagccaggcatggtggtgggcgcctgtagtaccagctacttgggaggctgaagcaggagaatcgcttgaacccaggaggtggaggttgcagtgagccaagatcatgccactgcactccagcctgggcgacagagcgagactctgtctcaaacaggccaggcgtggtggctcatgcctgtaataccagcactttggtaggccaggagttcaagatgagcctggccaacatggtgaaaccccgtctatactaaaaatacaaaaagactggcgtggtggtgggcgcctgtaatcacagctacttgggaggctgaggcaggagaatcgctcgaacccaggaggcgaaggttgcggtgagccaacattgcaccactgcactccagcctgggcgacacagcaagactctgcctcaaaataaataaacaaacaaacaaaaatatctggcagcaattttcaagcattcaaaagagatgtgaaggaaaaaaatttggccgggagcagtggctcacgcctgtaatcccagcactctgggaggccaaggtgtgcggatcacgaggtcaagagttcgagacca

SEQ ID NO: 2871 - DNA, 11781 bp, Homo sapiens
gcccgctgtagcgccacagctctttgggcgttgattctagggtcagggccctcactcacactgctggaaggttaaagtcgacttcacgctagtttaaggaaatatctgacgctgataaccatgtcccaagcactgctctaagttcccaatgtgtccggaattggtgggttcttggtctcactgacttcaagaatgaagccacggaccctcgcggtgagtgttacagctcttaaagtggcgcgtctggagtttgttccttctgatgttcggatgtgttcggagttttttccttctggtgggttcgtggtctcgccggctcaggagtgaaactgcagacctgttacggctcataaaggcagtgtggacccaaagagtgagcagcagcaggatttattgcaaagagagaaagaacaaagcttccacaatagaaggggacctgagccggttgccactgctggctccggcagcctgcttttattgtcttatctggccccacccacatcctgctgattggtagagccgagtggtctgttttgacagggtgctgattggtgcgtttacaatccctgagctagacacaaaggttctccaaggccccagcagagtcgattggtatattcacaaaccctgagctagacacacggtgctgattggtgtatttacaatccctgagctagacataaaggttctccacatccccaccagactcaggagcccagctggcttcaccaagtggatcccacaccagggctgcaggtggagctgcctgcgagaacggcaccgtgcgcccacactcctcagcccttgggtggtgatgggactgggcgccgtggagcagggggtggtgctcgtcgaggaggctcgggcagcacaggagcccatggagggggtgggaggctcaggcatggcgggctgcaggtcccgagccctgcccctcggaaaggcagctaaggcccggtgagaaatcgagcacagcgccggtgggctggcactgctgagggacccagtacaccctccgcagccgctggcccgggtgctaagcccctcattgccgggggctggcagggccagccggctgctccgagtgcggggcccaccaagcccacgcccaccctgaactccagctggcccgcaagcgccgtgtgcagccccggtgcccgctcgcgcctctccctccacacctccctgcaagctgagagagccggctctggccttggccagcccagaaaggggcctccacagtgcagcagtgggctgaagggctcctcaagtgctgccaaagtgggagcccaggcagaggaggcaccgagagtgagcgagggctgtgaggactgccagcacactgtcacctctcaccaacattctaaatcataaacacccaggccgggcgtgtggctcacgcctataatcccagcactttgggaggctgaggtgagaggatcgcttgagctcaggagttccataccagcctgggcaacaagggaaaaaaccctaccaaaaaaaacacaagaaattagctgggcgtggtggcgcgtgccgatagtcccagctacttgagaggctgagccgggaagattgcttgagcccagcaggtcgagaccgaggtgagctctgaacgcctgattgcgccactgcaccccagcccagtgacagggcgagaccctgtctcaaaataaataaataaaaataataaacaaccgaattcagtggtcccgttagaatattccaggctccgagaagccaggtgctcacagcgtcgggatttgcccccagccagggcctccgctccctcttgcctcgggcagatgctcctggaacacagagctgcggcctcggtgctgatgctgagtgctgtgacccagcctccccctacttttttcctaagggtataagcttcactctgcctggggctttggctgtaagttggagtctggctttacccactgtgggcacccaaggccaaggtgggtctgattcaccactgtttcctcagccctgccaggctctgaatatgcctttaggaatcattctggaagatttctttcttcactggactatataagtgcctctgcgagaaaacaggccctaggggcaggtacttagtcagtttagtcatctgtttcctcagcttgaaatgggcttggcatacagcaggagcccagtaaatgttgctttaatgctcatttcccaagagatctttattaagcacccactgcatgtcattgtgtctaggcttattcactgtgtacctctagcagaaagttaaggggaccctccatgcttgatggccagaggtcactctcagctcctacaggtcactctccggtccttaaacgtggccctctccatcttcaaagccagtaagagcatgtcggatccttcttatccttccagcctctctgtcatccccttctgctcccagctggagaaaactctgcttttaaggggcttgccatggtccaaatatgtgagtccccccaaaattcatatgttgcaaagcaatccccaatgtgatgatattaggaggtggggtctttgggaggtgatgtggtcatgaaggctcagctttcatgaatgagattagcaccctcataaaacaactccacagggccgccttaccccttctgctgtgggaggttatagcaaaaagatgggcttctatgaaccagaagtgggccctcaccaggcaccaaacctgctggcaccgtgatcttgtactgctcagccttcagaactcagaaaatacatttctgttgtttagaagacacccagtttctggtattttgttagagcagcgtgaacggactaaaatagtgcttatgtggttgtgtaacagcatcgattccatgttaaagaacaattttgcttgctcaattataattattgctttgcttaagttttagactatgctaaaaacagcctcaggaccttcagcactgatcaacaatcctgggcatgggctgaccgacagttttcacccagagagtgaagatcatggaggagccatcttaaattctgcccagcgcaggctcccaggaatcctaatgtcacgatctcactgcagccaatgtgacaaacacagcagtaattaagtctagagagctaaacacacctcaaaaagaattgtctcttggtatgagtggaatggaataaaatacatggaaacccacaaaagtttcgagagaggacacaagcacaggtttgaaagaggctttcgcggttggactcgctttcctctgcgtctctgccttcgctatgagaagaacgggcaccggtcttgggaagatggtgagagaaacacagaaccaagctgctctagacaggcctagcctagaccaggtggcccgcagaccattactgagcccagcctggatcatccaactcccagccaaactgcagaccatgaggaatgtttattgttgtcacggagatttagggtggctcatgcagcaaaagccagttgatggccgtaggtgggattataatcccggatacattaaaatgccagtctcttcttttccccatgtcttcatttgctcactctcaggtgaagggatcttgcttggaggcccagacgttctggattttctctttagaaactgtggcttgaagcatcctcttcaggaaacaatatttactccttttgtatctccaaaacccctcctcaccccttttgcaacccaaacccaagtgtcttctgtgtcctatttttcttcttttgaggcagagtcttgctctgctgcccaggctggaatgcagtggtgcgatcacggctcactgcagcctcgacctccctggcccaggtgatcctcgcaactcagcctcccgagtagctgggactacaggcacataccacaatacctggctaatttttttgtatttttttgtagaggtgtggtttcactatgttacccaggttggtcttgaactgagctcaagcaatctgcctgcctcggcctcccaaagtgctgggattacaggtgtgagccactgcgcctggccagcttgtacattttacaatcaagattacaagactactgccagctgtaggccacatcaggctctgagaagaggggatgtggacagaggtaaccaggacaaaaggaaaaaaaagtccttaatttcaccttctctgatgccatttagttcatgccgatcatctgtaattcacatctgtgaactttcagcccgtttgggagaagccttccctcaagtgcttaattatggcacaggatggtctcttttacacaaacgactgtgcaaagacatagaaagtggaatttatttctatcagaattaattcagaaaatctgggtaagttccacactccatttaacactcattacacataataactggtcagaccacattgtgtatgacttaacccacattacatgaatagtctaggaataacaaaagaatttactatttatttatctgaaacaatgttgattctgggtttggtaagattctgggctcgacacaattctgagtcatgctaaattcttccaccaaaggcagctgccataatggagtgtctggtacaggaagcgcgagccactggagtgtgggacgcatcacggccacaacaacaaagctgtctccacgtccactgctagccgggcggggcagtaaaacgtggtgtcttgcacgttgtattttcaagaaacggccacaatgcaattgctaacagttgcacctgctcttccagaaccttgccatgcccatcaagaggtggagtctgtgtctcctccctttgaccctggcgggactttgtgaaggtgatatggcaaagagatgctatgggacttccgatgcttactctcctgggttttgtacatttggacgccaaagccaccatatacgaagtctggctcccctgaaattgccatgctgtggagactatgtaaaaagatctctggtcgggcgccccagcactttggggggctgaggcaggtggatcacttgaggtcaggagttcaagaccagcctggccaacgtggagaaaccccgtctctactaaaaatacaaaaattagctgggcgtggtgtggggtgcctgtaatcccagctactcgggaggctgaggcagaagaatcgcttgaacctgggaggcagaggttgcagtgagctgagatcgtgccattgcactccagcctggataacaagagccaaactccatctcacaaaaaaaaaaaaaaaaagatcactgaaagagatatccgtatctggaaatggagtgctgccgaaggatgctgaagagacaaaggaagcctattggctttgagaaggctctcagtggagacctaaagaagagtgaggcatctggaggtgctgcagcccaccaggctgctgtaacagaatgtcatagcctggggggcttagaaacaaaggttcctcacagcgctggaggctgaaagtccaagatgaaggcgctggcagattcagtgtttggggagggagagccctttctctgtgttttcacatggcaggaggggcgagggagctctctggggtccctttgataagggtactaatcccatgcatgagggctccaccctcatgaccttgccacccccaaaagcttcttcctaaccccatcacattgcgggtaggatttcaacatggattttgaggggacacagtaacaggaggaaaggggtccctgttacacagaagcagagtttagcaatacctaaactctgcagaaacgtggaagagacagcatgtacttatgaaacggattccaggcactgctgaagagttgcctgacctctggttgcttagagtaaaatgcaagcggaactcttaactctgaaggatctggggcttgtgggtttgtaatcaccactgtttctccctcccagcctctcaggatggcaaggaatgctaacgttaagaaatggtttctgaggctgggcgcggtggctcacgcctgtaatcccagcactttgggaggccgaggcagtaggatcacctgaggtcgggagttcgagaccagcctgatcaacatggagaaaccccgtctctactaaaaatacaaaattagccgggtgtggtggcacatgcctgtaatcccagctactcgggagactgaggcaggagaatcgctggaagccgggaggcggaggttgcggtgagccgagatggcgccattgcattccagcctgggcaacaagagcgaaactccgtctcaaaaaaaaaaaaaaaaaaagaaaaagaaatggtttctggacagaggtaagcctagggtggtgctatcaggaaaacgtggctcacgcctgcaatcccagcactttgggaggccgaggcaggcggatcacgaggtcaggagatcgagaccatcctggctaacacggtgaaaccccgtctctactaaaaatacaaaaaatgagccgggcgcggtggtgggcgcttatagtcccagctactcgggaggctgaggcaggagaatggcgtgaacccgggaggcggagcttgcagtgagcggagatagcgccactgcactccggcctgggcgaaagagctagactccgtcttaaaaaaaaaaaaaaaaaaaatgagaccaaaggcatgaccacaaatcccctgtcttcacccaggctggctgcttccgcttcacgttcagtatatttaaaagttcttgccatgagacagggttttcttatcccctcatccaccccgtcttcccctttggtgaaggagggtgagtttgttaagacgttgtggaggaactaaggcttccaaaggtttcgggcctgaggtgacgagaggggccagaacctaaaggaagagccgaggtgcaggagaggcaaggagccaacatggcgacaaactggggtgggcagcggagagggggactcagaatgccctctggggtggactcagaagaccaaatttgcagcatccctggcctgtgaaggtcgcacagagtgaggctgcactgtggtaatgggctgctcctacccacccccggtgaaccctcagggcacaccctgggggtgggctgcacctacctacccacgctgaaccctcaggcgcgccagcagcggctcccggcaaggggaacagcctgggactgtggggttgagctgcagtcaagtggctgaggcttctgaactgtgataaaagcaccgcgggctcacgcctgtaatcccagcactttgggaggccgaggcgggtggaccacgaggtcaggggatcgagaccatcctggctaagatggtgaaaccccgtctctactaaaaaatacaaaaaattagccgggcgtggtggcgggcgcctgtagtcccagctacttaggaggctgaggcaggagaatggcgtgaacccgggaggcggagcttgcagtgagccgagatcgcgccactgcactccagcctgggcaacagagcgagactccgtctccaaaaaaaaaaaaaaagcaccgcggagagcgggaaggaggcctgggaggagactgcactatcacccagtgagtgtgagtatgcgtgtgtgtgagcatgagtggtgtgtgagcgagtgtgtgtatgcgaatgcatgtatgtgtatgagtgagcatgagtgcacgtgtgagtgtgagcatgtgtgagtggtgtgagcaggtgtctgagagcatgtgaatgcgcatgtgagcatgtgagcgagtgtgagcatatgtatgtgtgggagtgagcatgagtgtgagcttgtgtattgtgagcctgtatgaatgtgagcatgagtgcacatgtgagtgtatgggtgtgagcataaatgtaagtggtgtgtgtgagaacatgagtaagaacgggtgtgagcatgtattgtgggtgtggatgagtgtgagtgtgcatgtgcatacatgtgggtataagtgtgagcgagtgtaaatgtgtgtatgtgtgtgacattgtgtgagcatgtgtgtaagcgtgtatgactgagcatgtgagtgcacatgtgagtgcatatgcatgtgagcatgagtgtcagcgggtgtatgtgtgagcatgagtgagtgggtgtgcgtatgtgtgagtgtgaccatgactatgtgagcgtgtatgagtgtgagcgtgtgagcgcatgagtgtacatgtgagcatgaatgtgaacggatgtatgtgagcatgtgtgaacctgtgtatgtgtgtgagcatgagtgtgtaaatgtgtgcgtgcgagcgtgagtgtgagcatgagtgtgtgtgagtgggcatgatgagtgtgcgtgtgaatgctcgtgtgagcgtgcgcggccgggccagagccgctgggcgcagggagcgggaggcctgggaggagctgcaggccgaggctgagccaccttcctcaggagctgttcccatcacctctaggcggcgcgggaagcgctcggtgtgcagcggttcctgaacctgcatcacccacaaagaatttttttttttttttttttgagacggagtctcgctctgtcacccaggctggagtgcagtggcgcgatctcggctcactgcaagctcggccacccaggttcacgccattctcctgcctcagcctcctgaggagcggggactacaggtgcccgccaccacgcccggctatttttttgtatttttagtagagacggggtttcaccatcttagccaggacggtctcgatatcctgacctcgtgatccgcccgcctccgcctcccaaagtgttgggattacaggcatgagccaccgcgcccggcaagaattttaaagaaagtaggatcggcccgggagaagggcagggaggaggcccgcggaggcttggcgaggagacctgggtgccaggagacggcggagctccccgagctctggctttaccaggtcaaggcccctgtcacgaggcgcgcgccctcaggaggcgacaggggggcgacccccgctatggcttcagggccccacccggaggcgaacattcccggctctggacgagcacggcacgcaggacccggaacccagggtcccgggcgcacccgcctcgcggtccccttccgcatgtccgcgccccctcgctccaggcccagggtcggccaggagggaaccccggccgcaggctcagggaggcttggggccggggacggacggcgccgtggggcccggcggccagcggccagggcgactgtcccacgcgcggctgctttccgggacttgagctggaagaaaaaaatacggactccttagaggccaaataggaaaaagaataagcaggtaacccaagcataggagcgttcaagctagccttggctctaacggtgtctacaaaccttggtgaacttgagcaggcgacagtctagagcctcagaacgttggcagctatggaggacacatggctcagactgccctttaggaatgaaggtcttattccagctgctgagacagccccaagccagcagccatcttcagagattgtcaccccatccttcctggggcagctgcatttggtgattgatctctgcagaggtagaaagcccagtcctctcaccccaacgtggggagggctctgaagagccatcaaaccgtcctagttacccattgctgcataacacattttcgcaaaacttaaaagcttaaaacaaacatttattaccttacagtttccatgggtcagggagctgcgcagggcttagctgggtgcctctggctcaaggtctctggaggttgcagtcaagatgttggctgggctactgtagtttgaaagctcaactgggatggtgaggggcgaccttttcgaaaatcaagcctgtgattgttgccagtccttggtcccaaaccgcacagcctttacactgggttgcttcacagcacggtgtctgctatacccgggctgagcaatgctgagagggagagagggcgtacacggtggaagccaggacatcccaccgcttctgcagaattctccactagaagcaagtcaataactctggcccactctcaaaacagagattctacaaagacctgaatgccaggtggcagggattgctgaggcccatcttagaggctgcctgtcacaccgtcttcagaactccctagagagttggctgaagcgtctgctgaaccttcatcatagctagacttctccttcgccccatcctggttcttttccttccctcccacaggggtggatcctaagagcactcactaataaccttcctaactaaatgacatttcagagaatgctttgctgcaacagaaatctacccagggatcagccaactgtggcccactgacataatatcaactcatttaattttcctgatatccccatgaggtagctactcttgagtatacccattttatagaaggggtaaagtgaggtgaagagacttgcgaaacattacaaagtgagtcagtcggcagtggaccggagattcagctgcagtctgggccacctcatccttactccaccttcctcctacatcttacatgtctaccagcagtacagtgccttttgttacccaccaaacatgtcaccacaggacatatttatatgttttctgaaggttccctgctctaaaatgtaagcttcatcagggcggtaacactgttctattttagaacaatagctggcatataagatgcccctcaatagagttactgcctgcatgtgtgacacctggcacgctgtctttgaattattttgttgtctttaccaccaggtctcatgtctgtattcctcctccagggtctgggcgcatcgtgtagccagtgcttttgaacacaggtacctagggcctgaagtgtgccagtttctctcttactccaacctcatttccatgcctggggattatctgttcttccaattgcagcttcactgaatgcattataacccgcagtttactgcatttgaggacaatgagacagacactgtgatcttcagaaacatgttttattttctttttcctggtgaagtttaagggctttggttcatttggataaaaataggtttttaggttttacatttttacaagcaacaaccattattacatgtgggtgtgctgtttttgttttgttgttttgttttctgagacaaggtcttgctctgtcacccacaggctggagtgcagtgacatgatctcagctcattgcagcctcaacctcccaggcacaagcgatcctcctgcctcagcctcctgagtagctgggatacagacggtgactcaatctgcccaggctggagtgcggtgacctgaacacagctcactgaagccttgacttcccgggttcaagcaattctcctgcctcagcctcccaaggagctgggaccacaggtgtgtgccaccacatctggctaattgttttttatttttggtagagagaggtctcactatgttgtcaaggctgatgtcgaactcctgagctcaagtgatcctcctgcctcagcctcccaaagtgctgggattacaggcatgagacacagcgcccgactcacacacttttaaattttgttctccgcctgatatttagctttacggcatagaagaaatggtttaacccccttagcgacatggcagctctatgccctttattgttctactgctaaaggtctttgggtttctgtttctccttttttttttctttttaagaaatgaaattattttcttttacctacgtaaaaagagtataccttggcggagagcgtggcacggctctacgcacccctccctgcctgcccagcgccttccacgcgggaaactccccgccggtctcagctccaccccgcgctgccccgccggctcggcagcactcgcagccggcgatccgctggtgcagctccacgatccgcctgccc

SEQ ID NO: 2872 - DNA, 2099 bp, Homo sapiens
atgcatccgtttataggctctccacaagggtcacattccattcccagagctatgaacatctgcttttctaggataggaatcttggtgatgtgaaacctccctgactgcacgtccattcataggctctctgcaggggaaagcacatcacgtgctgttggctcattctggcagtccaacctggcattgtctttacacaatcctgcatgcaattatgtatttacaataatcaggagcatttcatcttttattccatagcaatagtttcagggggtctccctacatcaacctctggttccctctggtgctgttttctgagcacactgtgaacttccttgctggtaagggtgcttgtgctgcctcccctatgggaatgcccttttcaacccagaagtcactcagcttgtcagggtccaggtcactccatgaggtcagctggcaaggcttattcccaggggctggcccagcacagctctccaccattggttgggtggatcctgaactcctatgaggttgggcatgttgatgagccatctcccctctggactaagaggcccatgaggatggcggagaccacagtgcaaatgtggccctcaatacatgttggatgaggcaagttctatgtcaccaggagctcagtggggtttagcatccttggacatggctccacattagaacagtgataacagaacaattattgtgagctcctattgagacaggaaaatagggcctagaaacagggaacttaaggccactctgtgctaacttcctaaaagagaaaacaccagggtctggaggcaggaaatctaaggccaattcactctgacttcccaaagctggatcaaaaggaaaataccggggtctgggggcaggaaacctaaggctgattaacacaaacttcctaaagctaaaccaaaagacaaaaaccccatctctccatgctgagtaacaaaggatcagaggctactctccctacaaccatccctcttccaccacatctcagatggaaagggaggggagggtgccttgttgaccatgggccaagcagggaccatcccttcatctgcatagggtgccagttcacctcagcctttaattagccacagaccaaatccttcatccagataaggggtagtcattaagaacctcaaatagggtacttaaagcccagaaaactttgtaactgggcccttgagccacttgctcagacccactctcaccttgcagagggctttctcactttaataaattcctgctttcactgctttgttcctgcatttcattcctctgctactttatgcattttgttcaattctttgttcaaaacgccaaagacctggacaactcgtagtcaatctgctgtgctaagtgctctgctagtctgtgtcatttactgtgcacacccatctcttgggtggatattaggaatgagcccatttctccaatgagccaagctaggccatggaggggttgagccatggtgcagtttctgcagtgaagaagcaacagggccagaataggcccacatggtcagactctcagacttacaaccttactcaagtacaatgagtgttccaatgatctgagcagaagaagttgtctttgtaagcagaaaatggctgaagaaagcaaaaagagaaaacagagcagattagtcattgatgtggtttggctgttttgtccctctaaatctcatgttgaaatgtgaccttcagcgttggaggtgggtttagtgggaggtgtttgggtcatagaggtggatctctcataaatggtttggtgctgtccttgtggtaatgagtgagttctctgttaggtacaaaccaccccaaagagcttcttggtactgccaacactccccgcaaacctctccgcgctgcccacccttcccccaaaccttcttacatttccaagcccttatctaggcaccgcagtgaagccagcctgatagaagactttacctatcaggccttgctgcgataaagcaaaccccaattacaaaccatccggaccaaacggggaggttgtgggaagcataaacaaactttacctacaccctccagtaccgtaaacatcacaaggtgatatgtggcagaattaac

SEQ ID NO: 2873 - DNA, 2435 bp, Homo sapiens
ccaccttttccatcactgggttcccccaccccgtaagtgctcttgcttcctagagaaagatctccctagggccaggtaaatcagggtgaaaggccatgcctttggaagtgtcccagcagtgaggtcactgggcagtaacttggagaggtgagaaaagaggagtgaccaaagaggtgacttccccggacagtcccccaaaagacaagatgcatgcttacatgcatgcaattggtccctgagattcgaggcccagaggaggatgacttatccagatgctcccccaaaagacaagatgcatgcttacatgcatgcaattggtccctgagatttgaggcccagaggaagatgacttatccagatggtcccccaaaagacaatatgcctgctttcatgcatgcaattggtccctgagattggaggcccagagggagatgaattctccagacggtaccccagaagacaagatgcatgcttacatgcatgcaattggtccctgagatttgaggcccagaggaagatgacttctccagacagtcccccaaaagacaagatgcatgttttacatgcatgcaatcggttcctgagattcgaggcccagaggaagatgacttatccagatggtcccccaaaagacaagatgtgcacatatatgcatgcagttggtccctgagacctgaggtctagaagggctctcttccaataccctcaaatatttccccaccccaactaatgcttccttccttgccgtgtcgagggaccgcaggcctgactgcactctcttgcaggagggtgtgactgtggctttgggcaatagccacaggcaggtttcatctgtaatcctttcgtagtcagcagactggcctgccaccaccttgagtctaccacttccaagagtgtagggacaaagcagctgttcacagggccaaaaatccatgcagatagaggcacatcattcacccccactcactgagccccactctgcaccagggattcttcgggaggcagtgcgctaccagaccatgcttccttagcattcattctggatttgtagggaggctactacgtgctaagcactgcacagggcctaaatggggagagcaacaggaggttcacaaaacagagcagatcagggatggctgctctggtcttccgggatgtgcagggccaccaaccctttctggccccttcccccgcatgtcctcctgatgctcctccctgcctctgccccgagctctgggccctctctgtcctcctctcctgccagttcacccctgatgatattcctatttaaaaataaatcactgcagtctttaattgcagactaaataattgcttcattttatttaaatgtggctcttggaggctctggaaacaattagaagaaaacatagggcagtgctgggtgcatgttttcaagcatataatttttttttgttattatcataccgacgttcgtaggatctggaaaaagaaagtgtggccctcctcccgagttagtcatgcataatttacatgcaataataataataataatgataataataataattcctggcttttcccatatttcatgcttggctcccaaggaagctgggcagtcgtcactgtgctctttccggaaggagagaggtaagagcaggcccagctatccctctgcagacctttcagaagtgacagcagcctggtccttctgtccggaggctgggtttgaggtgggcccagagctggcctgcatgtgtgtggtctaagtcctaagaggttccccggtcggacctctcaccatgtctacaattccagccttcatccagatacagtgtgagagccagatagggccttggaactcgtctttttataatagaggcagccaggcccccaagaagtaatcttaccctcaggttacaaagcttgttagtagcagaacaagaaagaagactcggtgtgtgaaataggtgagcagggtccttagaaccaggaagacctaggtctgggtgcctctgctgccacatcactgttggtgcaatcctgggcccatttcttggtctctttgtgcctgtgtcttattttggaaaataaactggaaaataataatacttgtttatcatgaggaatcaagaatggaatatatgcaaaagcttccagcacagcacctgtgcaccatggaggctcatcagcattcacctgttcttcccaaagctctgcagtcttcaggagtctgctgtttacatgcaaatgtccctgggaggggcagtgcctttgactcctggaggacagtaagggctatgtgactcctggaggacagtagggcccttgagcctggaaggtagctatggagagggaggagaaggaagaggaagatgacatcaccccggccctctgtccagcctgatcttgcgtggaccatgctgagacacccatgctgagacacctgctgcttt

SEQ ID NO: 2874 - DNA, 10024 bp, Homo sapiens
gttatctgccgacagcgtaatgcgaggcaagtgccagccgttccgcccggcatacaagcttatggagcagccccctttgaagatctccaggtagacttcacagagatgccaaagtgtggagatctgattcctagattgggactgcccttacggatcagctcagataacgggcctgcgtttgtggctgacagtacagaagatggcaaaggtatcggggatcacatggaaaccgcatgccgcctcctggtctcagagttccggaaaggtttacagcaagactatgattccctgatgggctcttcctgcctgccgcatagatgacatcaggtcactgagactgactgcggtattgcagtaaagaaagagtttaattaatgcccagtcccaacgctcaaacttgcaccagcagcaagatagcagaggcaggaaaagagctggctggaagacacatactctctgaagatcaagggggaggccgtccgcgtactacatagcagtcacgtcaggctgggacaattcctgtttacagagaactataaaagccctgccccctcctcacttggggctgatgccattctaggcctcagtctgtctgcatccaggtgcttattaaaacagtgtgttgctccacaccgcctcgtgttgtctgttggcgcgctctccgggttccaaccaatgcaagagccttggggctggccctgaaacctgcgaggggcttccgtccacgtccccagtggacctaccacccctccatctgggaaagcaggccacagcagccggacaaaggaagctcctcagcctctagtcgcctctctgtgcatgcacatcggtcactgatctcgcctactggcacagacgtgtttatcggccaaactgaccctcacaaaaagctaccaccgaagtggacaggcccctacactgtgatactcagcacaccaactgcagtgagagtccgaggactccccaactggatccatcgcaccagggtcaagctcacccccaaggcagcttcttcctccaaaacattaacagctaagtgtttgtctgggccaatttctcctaccaagtttaaattaaccaacatttttttcttaaaaccaaaacacaaggaagactaaccacgtgcttccaggaatggcctgtatctacccaaccactttctatacctctcttccaaccaaaagtcttaatatgggaatatccctcaccacgatcctaatactgtcagtagctgtcctgctgtccacagcagcccctccgagctgccgtgagtgttatcagtctttgcactacagaggggagatgcaacaatactttacttaccatactcatatagaaagatcctgttatggaaacttaatcgaggaatgtgttgaatcaggaaagagttattataaagtaaagaatctaggagtatgtggcagtcgtaatggggctatttgccccagagggaagcagtggctttgcttcaccaaaattggacaatggggagtaaacactcaggtgcttgaggacataaagagagaacagattatagccaaagccaaagcctcaaaaccaacaactccccctgaaaatcgcccgcggcatttccattcctttatacaaaaactataagcagatgcatcccttcctaagccaggaaaaaatctgtttgtagatctaggagaaccattgtgcttaccatgaatgtgtccaattgttgggtatgcgggggagctttatgagtgaacagtggctgtgggacgggatagacattcccccttacttacaggcatcccaaaaccccagactcactttcactcctcaggaatgcccgcagtcctggacacttaccaacccagtatgagggacggtgtgcatatcccgcaagtggactgataaaacccatcgcgccgtaggtgaaaacccgtcaccaaaccctaacagtcaatgcctccatagctgagtggtggccaaggttaccccctggagcctggtctccttctaacttaagctacctcaattgtgtcttgtcaaaaaaggcctggtactgtacgaacaccactaacccttatgccgcatacctccgcctaagtgtactatgcgacaatcctaggaacaccagctgacaatggactgccactgacggattcctgtggatatggggaacccaggcttactcacagctaccttatcactggcaaggtacttgcttcctaggcacaattcaacctggattctttttacttccgaagcaggcgggcaacaccctcagagtccctgtgtatgataaccagagaaaaatgatccttggaggtaggagggagccaaagattgtgagaggacgagtggcctctgcaacggatcattgaatactatggtcctgccacttgggcagaggatggttcatggggttatcgcactcccatatatatgccaaatagagcgattagactacaagctgttctagagataatcactaaccaaactgcctcagccctagaaatgctcgcgcaacaacaaaaccaaatgcgcgcggcaatttatcaaaacaggctggccctagactacttattagcagaagagggtgcgggctgtggtaagtttaacatctccaattgctgtcttaacataggcaataatggagaagaggttctggaaatcgcttcaaacatcagaaaagtagcccgtgtaccagtccaaacctgggagggatgggacccagcaaaccttctaggagggtggttctctaatttaggaggatttaaaatgctggtggggacagtcattttcatcactggggtcctcctgtttctcccctgtggtatcccattaaaactcttgttgaaactacagttaacctcctgacaatccagatgatgctcctgctacagcggcacgatggataccaacccgtctctcaagaataccccaaaaattaagtttttctttttccaaggtgcccacgccacccctatgtcacgcctgaagtagttattgagaaagtcgtccctttccccttttctataaccaaatagacaggaatggaagattctcctcggggcctgaaagcttgcgggatgaataactcctcctcctcaggcccagtcccaaggtacaaacttgcaccagcagcaagatagcagaggcaggaagagagctggctggaagacacgtaccccctgaagatcaagagggaggtcgccctggtactacatagcagtcacgttaggctgggacaattcctgtttacagaggactataaaacccctgccccatcctcacttggggctgatgccattttaggcctcagcctgtctgcatgcaggcgctcattaaaacagcatgttgctccacaccgcctcatgttgtctgttggcgcgctctcggggttccaaccaatgcaagagccttgcactgatgacatgtccccagggtggttgggccacagcttggttttatacattttagggagatatgagacaccaatcaatatatgtaagaagcaccttggttcttctggaaaggtgggacaacttgaagcaaaggcaggaacactccaagcggggagggagcttgctgggcacagaaaggtgagacactggaggctgcattcttttgagtttctgatcagcctttccaaaggaggcaatgagatatgcatctatctcagtgagcagaggagtgactttgaatagaatgggaggcaggtttcccttaagcagtgtccagcttgacttttccttagtgattttggggcccaaaatatttttctttcacatgggcaacatgggaggatcacttaagctcaggagccagaggctgcagtgagcagaggtcacaccactgagacgctgtctcaagaaaacaaaactaggctgggcacggtggctcatgcctgtaatcccagtactttgggaggctgaggcagatggatcacaaggtcaggagtttgagaccagcctgaccaacatagtgaaaccctgtctctactaagaatacaaaacacccagggaggcggaggttgcagtgagccgagatcgagccactgcgctccaacctgtgccacagagcgagactctgtctcaaaaaaaacaaacaaactaaaccaaacccacttttaggcctggagtagtggatcacgcttgtaatcccagcactttgggagtctgaggcaggcagattgcttgagtccaggagttcgagagcagcctgggtaacatggtgaaaccccatctctacaaaaaattttttaaaaagctgggcatagtggtgcacgcctgaagtcctagctactctggaggctgaggtgggagaatcgcctgaacccaggaggcggagcttgcaatgagacgagatcgagccactgcactccatcctgggtgacagactgagaccccttctcaaaaaaagaaaaacaacaaaatatcactgagctccagccgggacagagtgagaccccttctcaaaaaaacaaaaacaaaacaacaaaatgccacttgtaactgcagctaatcacagcatggatattcggggccatttgagtcagtgctcctggcttgcagtccataaacttggcccagagaatctccacttgcacgagttttgctcctgcttctgttttctgtttttgagacagagtctcgctctgttgcccaggctggaatgcagtgatgtgatctcggctcactgcaagctccacctcccaggttcatgccattctcctgcctcagcctcctgagtagccgggactacaggtatctgccaccatgcccagctaatgttttctatttttagtagagacagggtttcaccgtgttagccaggatggcctcgatctcctgaccttgtgatctgcccgcctcggcctaccgaagtgctgggattccaggcgtgagccactgcgcccggcctcctaaagtgctggaatgacaggcgtgagcccccgcgcctggccacccctgcttcttcctttaggtcagcacctgctaggtttaagacattgtgggcggggacaacagaagggatattttcaaccttttttggtaagaagagttgtttcttttttctttttttcctctgccctatcttataatgctaaaagagttgcttctttatttttatttatttatttattttgagacagggtctcactatgttgcccaggcgggtctcgaacatctgagctcgtgaccctcccatgtcagcctcccaaagtgctgcgattccaggcatgagccaatgtgcctggccaagagttgctttttattttattttatttatttatttagagatggagtcttactctgttgcccaggctggagtacagtggcatgatcttggctcaccgcaacctccgcctcccaggttcaagcaattctcctgccgcagtctcccaggtaactgagattataggccagcgctatgatgcctggctaatttttgggtttttagtagagatggggtttcaccatgttggccaggctggtctcgaacttctaaccgcaggtgatctgcccacttcggcctcccacagtgctgggattactggtgtaagccaccacgtccggcctccaagtttctattttacatttctcatctccatcctgccaagtgtctattccgcacagtactgactcatttgctctgaaggatgagctgaggagttctcctgggctacctcccaagttcctatttgtgtcctccaggttcttggtttatcttctgtttacttgttagggtttataacactctcattctgtcttgtaatctccatagttgtttagccttaattcacaggcaaataggttctaaggtctcccccagtactactgtggccttcaattcttgatttttttcttttttttttttttgagatgactttcgctcttgttgcccaggctggagtgcaagggcgtggtcttggctcactgcaacttctgcctcccaggttcaagcgattttactgccatagcctcccaagtagctgggattacaggcgcccgccatcatgcccagctaatttttgtatttttagtagagacgaggtttcgccatgttggccaggctggtctgaaactcctgacctcaggtgatccacctgtctcggcttcccaaagtgctgggattacaaacatgagccaccgtgcctggcccaatttttgaatttttaatgttagttcatctcttgtttggctggatttcactgtctagttttcctcccacgaagggcttgaggaggtgagagtctctgaatacaggcagttgaaagatggcatatatgggccagcacggtggctcctgctgtaatccctgcactttgggaggctgagggggagagatagcttgaagccaggaatttgagaccagcctgaccaaaatggtgaaatcctgactctagtataaacacaaaaattagccaggcgtggtgccgtttcctaaaggattggcctcagccacttactcagcctgaggctgctctgagactgcagagggtcagggagagaaggtggtagaaccaaggaagctgagcacttaaaacacccacttatttaatttaattaattaatttattttttgagacggagtcttgctctgtcgcccaggctggagtgcagtggcacaatctcggctcactgcaagctctgcctcccgggttcacatcattctcctgtctcagcctcccgagtagctgggactacaggcgcccaccaccacgcccggctaattttttttttgttttttttttttgagacggagtcttgctctttcgcccaggctggagtgcagtgaggctatctcggttcactgcaagctccgcctcctgggttcacgccattctcctgcctcagcctcccaagtagctgggactacaggcgcccgctaccatgcccggctaattttttgtatttttaatagagacggggtttcaccgtgttatccaggatggtctcgatctcctgacctcgagatctgcccacctcagcctcccaaagtgctgggattacaggcgtgagccaccgcacctggccaattttttgtatttttagtagagacagggtttcaccgtgttagccaggacggtctcgatctcctgacctcgtgatctgcccacctcagcctcccaaagtgctgggattacaggcgtgaggcactgcgcccggcctccaacagaacgtgggaaatcacatagacccaaacaatggccccttgggtgaccactgtattgccaccagatggactatcaagaaatcatctgcagtgatagctacaaaatgcagagctgtgcttggtgctggctattcggttttaagcccttccaatgggtggaggagagtaaaccaaaatcccagaaagactagcccaacaggactagttctaagggaagaactttatttttttgagacggagttttgctgttgttgcccaggctgtagtgcgatgctgcaatctccactcactgcagcctctgcctcctgggttcaagtgattttcctgcctcagcctcttgagtagctgggattacaggcatgcaccaacacgcccggctaattttgtaattttagtagagagggggtttcaccatgttagtcaggctggtctcaaactcccaacctcaggtgatccatctgcctcagccttccaaagtgcagggattacaggcatgagccaccgcgcccagccaggaaagaactttatacaagtctcatgctttatcttaaaaatatatgcaaatcaaaatatattcatgttcattttaatattaagggaatttccatttccaaagcatcaccgcccatcacagtagttccacggatcccagcttgagaactattaaatgaaaaaccaaaaaatgcaaatagcaggatagaaaagttgtaggtacattaaaatggttacacctaccaccaccactggggaatcctgtaagatgttaatggctgggaatgggggctcacgcctgcaatcccagaactttctggggccgaggcaggcagatctcttgaaccctgtctctacaaaaaatagaaaaattaggcggacatggtggccagtgcctacagtcccagctacaaagtgggctgagatgggaggattgcttgggcctgggaggacgaggctgcagtgagctgagatcgcaccactcctccgggcaagagtgaggctgtctcaaaaaaaaaaaaaaaaaaaaaaaaaaaaaaagggtgggttagcatagtggattttaggtaagtttactattttctttttggtaatgtagttttaccacttttattataaaaaatgtgtttagaagaatctggctgagttgctaagtctcccgtgtggtaacacaatttgaggcagatgaccacaatactagttttcaattttgatatttaaaaaaaaaaatttttttttgagatgcagtctcacgctgtcacccagactgaatgcaatggcatgatctcggcttactgcaaaccccgcctcccgggttcaagcgattctcctgcctcagcctcttgaatagctgggattacaggcacgcaccaccacagttggctaatttttgtatttttagtagacacagggtttcaccatgttggccaggctggtctcaaactcctgacctcaagtgatccatccgccttggcttcccaaagtgctgggattacaggcgtaagccaccgtgccctggccctcacctacattggttactttctctaagtcagactgggggtctgtctctgcagagtgctgggggagcgtgctccatgtgatgcacaggagccccccacattgcccccaaaggtgtgacttaaagttatctatcacaagggatgggaggttacttggccaacccagaaaccctaaataggtaaaatagctcattgagtgcctgtggccagcggggagcaacttcgtccctgcaccgcacaaaacttcacctcttcctactccgtccctgcaccgcacgaaacttcacctcttcctactccgtccctgcaccgcacgaaacttcacctcttcctactccgtccctgcaccgcacgaaacttcacctcttcctactccgtccctgtactgcacgaaacttcacctcttcctactccgtccctgtactgcacgaaacttcacctcttcctacttcgtccctgtactgcaagaaacttcacctcttccgaatctcaccaatgaaaatgtcctcaagtttatataaaatatctaacagaggcaaacaaaacaattcccttccttttctgatggtaaaatactgcaatacaatttgtttgcaatgcagtagttaaaattagtaacattcctgttccttttttttgattgagtttcactcctgttgcccaggctggagtacaatggcacgatcttgctcactgcaacctccgcctcccaggttcaaatgattctcctgcctcagcttcctgagtagctgggattacaggtacccactagcatgcctggctgatttttgtatttttagtagagatggggtttcactatgttggccaggccggtctcaactcctgacctcaggtgctccacccgcctcgccctcccaaagcgctgggattacaggaattatccactgcacctggccaaaactcctgtttctaatgatcaaaaaccagggctgtaggattagaagtcactattactggctgggtgcagtggctcacgcctataatgccagcattttgggaggctgaggcaggtagatcatgaggtcaggagtttaagaccagcctggccaagatggtgaaaccccatctctactaaaaatacaaaaaaaattagccaggcatggtggcgtgagcctgtagtaccagctactcaagaggctaagtaaggcaggagaatcacttgaacccaggaggcggaggttgcagtgagtttagattgtgccgctggactccagcctgggaaacagagactccatctcaaaaaaaataaaagaagtcactattacattattgatactcagctgataatcagtttaatgcgaaattgactaggctgagcacagtagaatcacaccgctcta

SEQ ID NO: 2875 - DNA, 1067 bp, Homo sapiens
ggccatctttgaatcttctggcagactagagaatctcagtctcagaaataagattacagtggtttaagtttttcatatgtacttattatacacaaaaataacattaaaaggtaacagtaatgatgacaatagtaatagacttagggctctagatataggaattttagataccaccttaaatatgttcagggagataagaaacaagattcaaaatgtcagagcaaacaaaaagaaggcaaatttggaaaagaaccaagtagaaattttagaactataaaaatacagtaactgaaattaaaaactcgatgtacaggtaggtaggtgcaagtagctggtagtcccagttactcggggggctgaggcttgggggtagctggagcccagaagttcgaaaccagccagggtaaaatagtgaggccctgtttgaaaagaaaaatggggtgggagggggtggggaaaacagaaaacttagtggatgagtttagcatcagattagacatacttgaaaataagtgaactggaagatggcttagaaggagagatctggaatgaagcttcaagatacagtattacagaagaaaggaaaagatatagactatacatcgaaaagttttcgcaaaaattggaataatgaaaggagagggaaagttacatgtatagcagaagcagtattttaaaaggaaatgatacctaaaccatagattctcgaagttgtacacattgcaaggaagataaacaaaaagaaatctacacctaactacatcgtaataaaactgcaagaaaccaacgaaaataggaaagtctaaaagcagccacaagggaaaaaaaatacgttcagaaaagtaatgattagactaacagctgacttcacaacagaaacaatagaatctactaactgcaaacctagaattttgttaaatttagcaaaaatactttccaggaatgaagatgaaataaggagggaattaattaacagtgtaccagctgaaggaaatacagaaggaaagaaatgcaagaaagaatgatctcagatggaaggttagagatgcaggagggagaaaagagca

SEQ ID NO: 2876 - DNA, 3118 bp, Homo sapiens
ggactacaggtgcccaccgccatgcccggctaatgcttttttttttttttttttttttttttttagtagagacggggtttcactgtgttagccagaatggtcttgatctcctgacctcgtgatcagcccgcctcagcctcctaaagtgctgggattacaggtgtgagccaccacgcccggcttgttttttgttttttaacagacagggtcaacctccaactcctggactcaagcagttctcccacctcagcctcccaagtagctgagactacaggtttgtgccaccatgcctggctctttttttttttttttttcctttttgagagctgcactccagctctgtcacccaggctggagtgcagtggcacgatctcagctcactgcaacctccacctcccgggttcaagcaattctcctaactcagcctccagagtagctgggattacaggcatacaatgcccagctaattttttgtatttttagtagagacagggtttcaccatgttgcccaggctggtctcaaacttctgagctcatgcaatccgcctgcctcagcctcccaaagtgctaagattataggcatgaaacactgtgcccggcctcattttgtattttttgtagagatgtgggttttgctatattgaccaagctggtctagaactcctgggctcaagtgctcctcccactgtgggcttccaaagtgctaggattacaggcatcagccagcacgcctagccttttttttttttttttttttttaattttgttttgagacaggttcttgctgtaacctaggctggagtgcagtggtgatcatggctcactacagcctcgaattcctgggctcaagcaatcctccagcctcagcctcctgagtagctataactacaggtgcatgccaccacacctggctaatttatttttaattttggtagagacagggtctcactatgtttcctaggctagtctggaacacctggcctcaagtgatcctcctgcctcggcctcctaaagggctggattataggcaggaccactgcgcccagcccaagaggtgagttttcaagagctgagaaggcggagccaggccctttcctaagctgacctgtacactccagtcaccccacagtcctgcccagcccctcacaagccagatcccttgtcaccccacagccctgctggcccctctcaagctggacccctcatctctcaagcaggctgcactgcactcatttccatgatgctcccatgcgtacagttgcgggggtatcctgtgagggctaagggggagtcctgtgagcactatggactctgaaccacttactctccatatcactggcacatagtgtgaactcctaaagggcaagagccttgtctactcacttacatgctgggcaccagtattgtggggctgggctggtgatagctgctcaatgtgatctacggttttgttttttgagacagagtttcactcttgttgcccaggctggagtgccatggcgcgatctcggctcaccacaacctccgcctcctgggttcaagcgatttgcctgcctcagcttcctgagtagctgggattacaggcgtgcgccaccacgcccggctaattttgtatttttagtagagacagggtttctctgtgttggtcaggctggtctcaaactcctgaactcaggtgatctgtccgcctcggcctcccaaagtgctaggattacaggcgtgagccaccatgcccagccttcaaagtgatttactgaatgagtaactgaatcaccagctccttgccttttgcttatgttggcattttgggagaggggttacctgaaacaggaccccctcccctgtctcttctcagcatccaagacttatttacctaagcccattccttcctctgagctgcatgcatcccaactagagtcttccttccatatcgcagaaccaagcacagtcctggggctttgcagtgcttagctgggctgagctgtgactgagttgcacagtgggtgctccctaagtctgtaagtgactaaaacgacctcgatcttccctgtgacttccaggtgagggaggaaaggcaagagtcatgtgctcaggccccggtggatccactgccaggtttctgcacagactcagtgatctgcaggtgcccagatcattgctatggagggtttcgctcatggacctgggtccccaacactctgccagctgaccatgcccctagtccgagctgagcatccccagcaaaagctcaggagtccaagcacacacagccttcaacagctcagaaataactttccgaatgggttttagaaaataacacgagaatgtcttaaggaacagaggaacctcctttttttttttttttttttttgagatggagtctcactttgtcgcccaagctggagcgcaatggtgcaatctctgctcactgcaacctccccctcccgggttcaagccattctcctcctcagtctcccgagtagctaggactacaggagtgtgccacctcgcccggctaatttctgtatttttagtggagatgtggtttcaccatgttggccaggatggtctcaaactgctgaccttgtgatctgcctgcctcggcctctcaaagtgctgggattacaggcatgagtcaccgcgtccggccaggaacctcttaacttcttttgtgattttgtggggaacaatctgggcaacagtattgaactaagaaaggttttcaaccctgggcaggtcaccacacttcttggtactcagcccccacccagtgatgctgtttgaggctgtgcacctgctggggaccgtgtgtggtgggaggggctccagagagtgctagagttaatgcttttctgtttagaagactatatgcttctcatggcctcttggagttcagcagggccttagaaagcatctcccaaccacagagacgcgctgcctggctttcctgatgatgatgatttggcctgatcttggacacctgcggtaatagagagctcactacccctcacgaggttccttgcgccagcgcggggaagcctccctccatctgcaggtgggcctcccctgtgctggtcagctccctggtgtgtgttacacaggacacagagaagatcat

SEQ ID NO: 2877 - DNA, 10263 bp, Homo sapiens
aagcacctgtcctgcgagcttaggggtgctacaagttgaccactgcagcagtaaagatgactctgaagaatggcatgggatggatcctttcgaatgcacttgagcagcggtctccaaccacagggccacagagctggagctggatctaccatgaaagacctctgaatccaggaagagagactgactgagcaacatgttattcagggtctccatctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcgtatacgtggattccagaggggtgacagtgaaacgtgggaccatccagttgcaggaaaacaagcttaagacgcccactgattctacattatgctcctacctcccggcagcctctccaggcccagaactttctccaatcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcatctgcctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccagggcctctctacatgcagcttatgcctcacggtggcctctccaggcccaactcctgtcccaggacgtcatctccgggcccaaaacttactcaagtcagactctgtagtcccaactgctgcctcctggtggcctatgaaggcccaaaatctcctcaagttgacctttccaggcccagctcctgcctcctgtcagcgtctacaggcccaacctctacgtcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccagtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcagtcgaagctcctgcctttcggcagcctctccaggcccagctcctcctgcctcccagtggcctctttcggcccagcccagctcatgcctcccggcggccttcccaagccccgcttttgactttcggtggcctctgcaggcctcgacaaggcccagcctcctgcctcccgaaggcctgcacaggcccagcctctgcctcacagcggactctccacgcccagctagctgtcgcctcattgcggcctcccgagtccaaagctcctgcctctcggccgcttcggcaggcccagctcccacctgccagtggcctcttcaggcccatggggctcgttcctcacaacggcctttccaggcccagtttttcccttccggcggcctctccgggcccagaacctcctcaagtcggcctctccagagccacttgcaccctccgggcgtcctctccgggcccagctcttcttcctggttgcgtctccaggcccgactcctgcctctcaacaacctctttggactcagtgcctacccatctcctggcggcattggtcggcccacagcttcctcaagccaagctccccaggcccaggtcaggcctcacggtggcctctccaggatgagctcctgccctccgatggcatctccaggccccaaatggtctccggtcggtgggctcctccacgccaagcttgggcctcccggcgaccgctgcaggcccaagttgtcctgaagtcggcctctcctggccctgcctcccagcaagtaagcaagctcttttggctcaactcctgcccagctcccaaccgcctttctaggccccgaactttctccagccaagctctgagggcccacctcctgcctcctggtggcctgtacaggcccagcactggttggagaacagcctctgcaggccccgcccttgcctaccaggggcctctccaggcgcagctcttgcccccacggcggcctcccggggccaagtccctgcctgcctcccagcagcccacgtgcggcccagctcctctctcacggtggcctgttgatgcccaccctcccacgcggacagaggtcagcctgagccccttgcctcacaccggcccctcccacgcggacagaggtcagcctgagccccttgcctcacaccggcccctcccacgctgagagaggtcagtgtgagcccctgcctcaacaggccaccgtgagggaggagcagggtcgcacgcgggctgctgggaggtaggcagggacttgggcctgggaggtcgcggtggggcgagagctgggcctggagactcccctgggaggcaacagcggggtctgcagacacccttctccagctggagctgggactgttcagtcactgggagaagggatgtgggtctgaagagcttggttgcagaaacttcggggtctacaaaggccggcgggagctgagccaaaagagcttgtttgctgggaggcgggagatgcagccaggaggaacagctgggccatgcgggaggcagaggccgggcctcctcaagtcggcctctcagacccacttgcagcctcccagcgtcctctccgggcccagctcttcctcccggctgcgtctccaggccggactctggcccgactccaggtcccaacaacgtctttggactcagctcctgcccagctcccagaggccctggtaggcccacaacttccctaagccaagctccccaggcccagctcaggcctcacggtggcctctccaggctcagctcctgccctccgatggcatctgcaggccccaaacggcctccggttggtgggcttctctaggcccagcttgggcctcccggtggcctctgcaggcccaaatcgtcccgaagtcggcctctccaggcccagctccggcctcccagcggcctctgcaggcccaagtcgtcctcaagtcggcctggaagtgggcctggaagagcagcaagtcggcctccccgggcccagctccgtcctctcggcggcctctccaggtgcaaaacttcctcgagtcagcctctccaggcccagctcttcctgcctcccagtggcctctttcggcccagcccagttcatggctctcggcggccttcccaggccccgcttttgacttttggcagcctcttcaggcgcagaacttgatctccagtcggcctttgcaggcccggcctcctgcctctcaaaggcctgcacgggcctggccttggccttggcctcacagtggactctccacgcccagctagctctcgcctcactgcggcctcccccgtccaaagctcctgcctttcggccacttcggcaggtccagctactgcctgccagtggcctctttaggccaagctcattcctcacaacggcctttccaggccccgtttttcccttccggcagcctcttggcctctaatttgtttatcttttgtgtataaatcccaaaatatggaattttggaatatttccaccattatatattttggtaggtaatttatttggagtgagtttctgcaccatgcccgaactttttgttttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgatgtcaggagatcgaaatcagcctggccaagatgatgaagccccgtctgtactaaaaatacaaaaattagccggacgtggtagcgtgcacctgtaatcctagctacccggaaggctgaggcaggagaatggcgtgaacccggtgggaagagtttgcagtgagccaagatcgcaccactgcactccagcctgggcgacagagcaagactcggtctcaaaaaaaaaaaaaaaaaaaaaaaaaggcaggccttactccgtcccaaactgaaaggattaaatggctttacctgggagaagataaccatcctgccctccattgctacccccacatactgtccatgttctcagggggtactgtgagtcctgggatctttggggttgcccacctgcctgtggtagttatggagaccccccaggtgtttaggcagggctggggtgtccccttccaaccaggctgtcaaggccccaactctggggcagaggcagtggcagggcagccagggttgcgccagagcctgagcaggttgaggtggggtcaggcagggctgggagtcagggcaggggcagcagcagtggacccgctatgcacacatcgtcttctccaaggtttgtgtgcagaacatcctgcccatgctgccccagcagcttcagttggcacctgccccagtccagcctctgggaaccatgcagcagctcccagcggccctgcacccaccaccagcatccgtttcacctgcagttgaagatccgtgaggtgcccagaagatcatgcagtcatcagtcccacggagcagcccgtgaggctgaggctcctcccactggaccgccccccaactggcaccactgctgcccctgcccctactctcagcctcacgtgactctcgggcagaggcagtggtggggcagccagggcagcgtcaagagtctgagccaggtgaggtgcggtcaggacccccacagggctgggagtcagggcaggggcagaacaaaccttggaggggaagatgtgtgcatagtgggcctggagggcggctgtggcctagtggacaggaagaagcagtgggcctggaagagctgcatgatcagggccggcactggtccagggcacgtgcagtgaagaggacagcgccttctcggtctccggttccctgagcctgtccttggcttctccacctgtacaggcaaaggggaagctgtccccatcacacatggcacacttgggggtgttgggctttggactgcagctggagcatcttctcatcttgcatttgggcgtggtggggtcctccagtgtgggatccatgtccgtggggttccctctgccccgaccccgaaagcccagtcagtttctcttcaggctctgccccccgggtggctcagcccagctcctgcctaggaaagccttagtgttgggagggaccctgatgactgaggagcctggtagctccaggtcgcccacactttcaggtctcttgcaccagaaggtggcaggatccattgggaggaaacaggtcaccttggaaggcgtccctgggcccccatccccaggggtaggggccgtagggggcccgctctgctgccttgaccagactcctgggcattgaaggctcctgggcccagtaagaaggaggtgggtgccaaggttgaggaggaagcatccgagtatgtgtaggaggaggacaaggtgggaccatagactttgccaaaagctgcaggtggatcgggggaccctgggggctcaggatccagcaaggggcggcaggagtaaaggaggaaggaatgacaggtgcaaataccttcccaccaaagcccttgttgccctctggctcctccccagagttgtccccactctcagtcggtcacccactccttgaacttgagatcggtgtcagtggtgctaaagccatcatcagcaatgacatcatcaccccctcctcctcatggatgaccgtgtgctcctcgtcacttgctatgtcctcactggccatgtgctgggaatgagcagctcaggtgggcagcagcagggctgcccactggtcacctccctcaccaggggctgcaaagtggcctggagctccatactgagtagaaggctttgggccagagtatgatgcagtgccagacaccacctgtgtcagttcccgtagtgcctgacggtctatttccctgccgtccaggctgtgtaccccactgtgggagaaggcttgggccaggctaagccaggttccctgactgtgtgcagccattctgccccacagaagctgctccttggtatccgagctctggagtgtttgggctgcaactgacaggagttcagaggacaccccaggggcagtggcagtgcccgtctctgatattctccgctcccacgagcccttgttacactcctgctagcccctggcttgtgggcttggcctctgagctggacttctttcggtccttgttgcaagtgggccaccttcacctggaaggccaggtcgtggtatttctgcgtctcattgggccccagggtgtaccaccgcttgctcagcatctggctgacggtccggttgtcctggttggggtgaccctggtgcgccctgccagggcctggtgccgcttgctgaagatcatgaccgccactcatgggccaccggatgtggtccttgtcccatttgttggggctgcatccatccttctcagaagatgagtcctgttccttgcgcagggcactgagggactgggcctgacatcatctggctggtagaggcaactgggtgtcaggagacatgatggagaggaaagcatcatcatggtcattctctgtctcactgtccagcagggactcccctgaggggcccagggctcctcctccatggtgggaggtgagcttttaccaggttccaccacccccaaagtgtgtggggttgcgggccctgggctttcagggcaggtggctccagggggccacccagggtcagcactccctgtcccacctggtggacactcatgagcaacagctgctgacttggcaggttctttgctctggttggaggccactgagtgactggcaggttgctggacctcacatagctgcagggaggggtcaggaaggggacagagtaccaggagaacacagccacagagcaaggttccacgttcctccacacaaacatgctgacgccactggaggcctcgctggacgcagacatcaggggcctgtgggccaagtacatggtctgggcagggggttcctggcaggggctcacacctcctcagccccctcctcagccaaggcagcttggacccacggaagtggggatggaaggggagcatgaggccaggcctcaagtttttgtttttgttttttttttttttgagatgcagtttggcaggctggagtgcagtggtgcgatctcagctcactgaaacctccacttcctgggttcaagcaattctccggcctcagcctcccatgtatatgcacctttactgctgaatattatatattttcttatgctttcatgtgattgattagcattctttttttttttctttttgagacagagtgttgctgtcgcccaggctggagggcagtggtgtgatctcggctcactgcaacctctgcttcatggtttaattgattctcctgcctcagccccctgagtagttgggattacaggcacccgccaccacacctggttaattttttgcatttttagaaggcgtgggtttttgccatgttggcctggctggacttgacctcctgacctcaagtgatccaccctccttggcctcccaaaatgctgggattacaggcatgagccaccacacccagctgctttctttcatttttacttgaaaaactccattaagcatttcttttaaagtagacctagtggtggctcatacctataatcccagcactctgggaggccaaggtttcaggatcgcttgagcccaggagttcaagaccagcctgggtaacataatgagacaccatctctacaaaaaatgcaaaaattagctgagcatggtggcacgcacctgtagtcccagctacctgggatgctgaggtgggaggatcacttgagcccgggaagtcacagctgcagtgagccatgatcgcaccactgcactccagcctgaacaacagtgtgagaccctgttttttattttttatttttatttatttattttttaaagacataggtagctagagtaatacagagatgaaagggagagtattcacacacgcttcttaaaatagaaattactaaattttattttacttaaaataaaatttagctgtgaggattctccacaaggctgctcatgacatggcagatggcttccccttgggtggaatgacaggagggcgagggccaaggtgagggtggtacggagagagaaaaaactaccaagatgaaagctgcagtgccttttataacctaatcttggaagggacatatcactacttgtgccttatcctttcagtcacacagaccaaccctgatatgttatggatagggacttggagactgctccaaagaccaggaggtgacgatcactggggtcctctgggagactggccaccacagttgccttttccttttcaggtcacttacaagggtctttgttgctatggaggtggatgtgggcataatcaaagggtacatgttgtacaggcctttattatacaaacctctacaataaaacaataacacatcactgccaagacagttatacagtgttaaattggaatggaaaggaaggaatcagaatttcatgtgatagaacacttaaaagtctgcctgtgcacatgtatgaatatgcattagggagaagtaaaagagtgacctgaaaatcttcctaaagtaatattatctagaaagtttgagaggtttaactgtggctaacaagatttcctgaagataaaatgttcctggggccttaatagttacaagaactttaccaaatcaagaaagcaaatatataggagtctaaaaattatttagttttgcatattcatttcagagtaccaattatgattttatttctttttaatttttaaaagtttagaaaaaaaacgagaaccaattacaatgttaaaaggaaacaggaaggatagatttggggccaattatattactgtttgggtttttgttactataaaaatggaaatattaaagattttaaaaaatgagtggtaatagagtacaaatctgcaaatgatgaatcagcaattatatttttataccaaatggtatgtttgtgatattgatatagtattaatgcactgtgaatttatttatttattttgagatggaatcttgctctgtcgtgcagactggtgtgcagtggtgcgatctcagctcactgcaacctctgatatggtttagctgtgtccccacccaaatctcatcttgaattcctatgtgtt

SEQ ID NO: 2878 - DNA, 5349 bp, Homo sapiens
tttggtctctttagttggactccggtgctattttcctcagtatatttgatggtctaccacaggggtccccaacccctgagccacagaccagtgtgagtccgtggcctgttaggaactggcctgcacagcaggtgagcagcagttgagtgagcgaaactccatctatgtttacagctgctccccgttgctcacattaccacctgagctctgcctcctgtcggattagcagccttgttagattctcatatgggagcatgaacccaattgtgaattccgcgtgtgtgggatctaggttgcacaccccttgtaagaatctaatgcctgatgatctgaggtggaacagtttcatcctgaaaccatacccccgtcccaatctgcggaaaaattgtcttccatgaaaccaaccggtccctggtgccaaaaaggttggggaccactggcttacaagatactctattcccatctttagttctcttgccccaaacatagaattaactactctactagctgtgtttgttcttttggtgtaaaaaaatgatttgaattcaaaacatggggttctgtcaaaatagcacagtgaatttgtgaattgatcatgtctctgctccaaataaagaaacaaactacaagaagagaaaaaaacaaaagaactggttcaaaaacaagataaagaattccacacgccagaaacacagcaaaagcgcaaaacgtgggacgagaatgaagctgtgggcttgttgcatgtggggcctggcaatcgggctgagagttcagctgctgtgggctgaaggggtctgaataaactccagcatattaggcaccaaattaagaaagaaaaccccactgtatcctattcttgattactctagtgagttcttgttcctatctgtgttagtgattactggaaagggtgttctgatccagactccaagagagggttctcggatctcatgtgagaaagaattcagggcgggtccacagagtaaagtgcaagcaagtttatgagagaagtaaagaaacaaaagaatggctattccacagacagagcagcactgagtgctgctgcttggctatttttagggttatttcttgattaaatgctaaatatggggtggattattcatgagttttccaggaaaggggtggggatttcccttcttttctatcatgtaaggtcacttctggacatttttatggcccttgtaagctgtcacatgctggtagaagtgtcttttagtatgcgaatgtaatacaattggcgtttaacgagcagtgtggcgaatgtaatacaattggcgtacaatgaggtcactttggttgccatcttggttttggtgggctttggctggcttcttcactgcaatctgttttatcagcacggtctttatgacctgtattttgtgataccagtctttgagacggtctcattatgttgcccaggttggtctcaaactcctggcctcaagggatcctcccgccttggccttccaaaatgctaggattacaggtgtgagccactgcgcctgatttgaacgtttggattttatagtcaaggtctgctgactctctgtcattggtccacactggttaaaatctggaatgtctgtgtgtggggtacatgagaagtagcctgagtggtaaatgttgactgttatcctgtccctgcactccatatgtggtactcacccctaagcatcagctttctgccaagggcacaggatgcctcttgataaatattatatggcagagaagagtgcaggagaaagggtctactttggataggattttagggaaagcaactcaaaagaggtgtttcagcctaatgacctgaaaggtaagaaggagccagaaggccgggtgcagtgtctcacgcctgtcatccaagcactttgggaggctgaggcgcaggagaatcacttgaacctgggagggggaggttgcagtgagcggaggttgtgccactgtactccagcctgggcaacagagtgagacgccgtctcaaaacaaacaaaaacaagtggagtagttaagcaaccgcatacagaggagttggacacccacctcccctcccagaccccagctcctgcccattctccaactgccgcagaccagaagtgtattcaggcccaaggcttggggacttgagggacaacagaaggctagggaggtgcagagctgaaaatcggcagatagatagaagtcttgaaacttgaagtggaggctgagtgcggtggctcacacctgtaatcctagcacttgggagtctaaggtggggagactagcctgggtaacatagcaagacacttgtctctacaaaaaattagccaggcgtggtggcgcacgtctgtagttccatctacttgagaggctgaggtgggaggatcgcttgagcctgggaggtcaagctgcagggagctatgatcataccactgcaccctcagtgacagagtgagaccctgtctctcaaataaaaataaaaaacttgaagtggatgaaaagatctaatatgaaaggtgaaaatataaagctaatgatgtgtaagtatgagaatagatttgggactttaagctggggaaggacttcttaaatatgattcacaaagcactaaccataggggagaatggatagatttgtctacatcaaaatagaggatttctgttccacgaagctccccacagataaagtaacagacagatgggactgactgaagagagttgccacacaaaaccgaaacaggagttgtttcctgaatattcaagggatgtctgcaaatacgtcatgacgacaaacagccctgaaatctcaatggctgaacccaagttttattccagctaacatcaaattgaatgcaaggcaagtgtttctctaggacatctctgctctctaaagggactcagcagtcaggctgcaccctgtgtgacttgccatctcaacatgtccctcctctatcgcccaggcgagagagacaggagagggttttcactgtctcagtctcactctctcatcaggctggagtgcagtggcccgatctcggctcactgcatcctctaactccctggttcaagcaattctcctgcctcagcctcccaaggagctgggattccaggcatgcaccaccactcccagctaatttttgtatttttagtagagacggggtttcaccatgttggccaggctggtctctctcctgaccttgtgatccacccacccttgcctcccagagtgctgggattacaggcgtgaggcactgcttttcattgtccagaactcatctcgtggccttctctggagcaaaggggtggcaagtgtagtctgcagtatgtccaggaaagaggaatgtggaacaggatttgggaacacatagtactgttgctgccaccagcagttacaagctatgaactgaatgaatctatacatacagccatgaagacatgtctttaaaacatagttttgagttttaaaaaaaggtaggaaagaatgagattaaagggaaacttatagaaattaaaacacatgcacatagaacattatgctgcatgggctgggtacggtggctcacgcctgtaatcccagcactttgggaggctgaggtgggcggatcacctgaggtcaggagttcaaggacattatgctgcatgttcttcgcggatccatccatatctaaggacatttattaaacacattgaagtggctatagcttatgtgtgtgggaaggaagggtggttagaatgatagaggaaatcaggtaaaaaaaatcaaaggacacgtttgatgatggtgatgatgatgatggcagtcatgaactgaggagtgagattcatgccactctacatttgaggttctttctccagccatgtaactctggcaatggagtagaatagggaggagggggaaggtgagaacgtaggtagaaagagctgttgggcaactgtagcaataaaacagaaaagagatgaatgtttgcacataggcaggggcagcaggaatgcagaagggcaggtgtcagagagcgtccacgtggtaggacccacaggaccaggtggctgaatgcagaggctgaggctgagcagggcggccagtatggctcctgtgttctgatggcgtgtagtggcgtgaccagccagggtctgctccccaggcacttaaactgtgagtccattaatcctctttttctttataaattacccagtcttgggtgtgtctttatcagcagtgtgaaaacggactaatacataagggctcagaagggccaactggatgggcaaagaagccattggtgactttagtgagagcgactttagtggaatggtgggggggcaaaagccagattgcagatgattaaggaaacagttggaagacaaggaaggcaacagacatagattagccatttgctgaaggttaactgggaaaagaaggatggaggaaggctataccgggggctgcagagtgcagatgtgcatgtgtaatatgggagggagctgagggtttatatgctgaggggtaaaaggtgggatggagtcaggattgaaaatgaggaagagaggccaggtgcagtagctcacgcctgtaatctcagcactttgggaggccgaggcgggcagatgacaaggtcaggagtttgagaccagcctgaccaacatggtgaaaccccatctctactaaaaatacaaaaattagccaggtgtggtggcacacgcctataatcctagctactcaggaggctgaggtgggagaatcacttgaacctgggaggcggaggttgcagtgagccaagatcatgccattgcactccagtctgggtgacagaaaaaattagctgggcatggtggcaggcacctataatcccagctactcgagaggctgaggcaggagaatcgcttgaacctaggaggcaaaggttttagtgagccgagatcacgccactgcactccagcctgggtgacagagcaagactcggtctaaaaaaaaaaaaaaaatgaaaacaaagaaaatgaagaagataggggctctacatgaaccaaggatcctagctggttattttgattaaaagatgactcaaatgatgttaacactgatcagactttagcacgagagctgcagagaaggaagacactatgatgagaatatatttggggttttgagctgggaaaagacttcttaaatatgatccagaaagtactggccataaggaaaaaatgttaacagatttgtctgcaccaaaatctaccaagagagtcctttcaactagaactgccgtcaccacaatgatgaacatggggaaagaggagaggtacctgctgtatattctcaggccttttagaacacatggagttgttcctctggccacat

SEQ ID NO: 2879 - DNA, 815 bp, Homo sapiens
aactttgtcatgaattgtcagtgctgagttcctggtagttggtaaaaagaattgccttctctctgatatcctgttctgcgggaagtccttgtggtttagattcacagtttctcattgttgctagctacagtcgtctcctccctcctagccttccctccccacagctctagctattcccatatccctccccattcttgtatcacttgccccacagataccctcgtgattagaggtcttttgctggaggttgactgtgctgtctgctctctgacacagctggctattctagtcccagaagaaagaggagagacttgctgaagatctggatgggacaatagaagtttggggcacattaaaaagaagcagcaagaacatcaacaaaaacctcagatgattcaaacaggcttcttcttggctttgtggaaccttttgcagttgctcagaatttgagtttttgcttcagaggatgatgagacaaggcaatagagggtgaggaggatcatgttggattcttgcttctctgtctgcctctccttccagttggaaaaatcttcagtccataagaagcattatcaacaagcctgaagaacacatcttaccctgatcctggatgctgttggagttgagaattacatccacttcaccaggactttatggaggctgttcaagaaaaatagaaggaagcaatacttaaggatttctctgtttgcattagtcctgtgccatgttacattttggagattgtttggaacaagtgagggagggctctgtcatcttgatctaggaggatacctgagtcccttgactacacagat

SEQ ID NO: 2880 - DNA, 1473 bp, Homo sapiens
gcagtgatgtcaaccgcatccgccgcagtccccggcagccctaaaacgcgccgcggcccgcggaaaccccagcccggctcctcccgccagggccgaggaggagaggacgcgcgggtccccggagtcccccactccgtctgcctaagccgtggagaccgggagtggacgcacggcggtgcctggacccccggggaggtggaagaagaggagagggaagggagctgtggagtcaggtgtcgatttgacgcccgcggccgccgaggggactctgcccggcactggtgccgcctggggggcgttcagggagcgtggggcgccgaccgctgcagatgcggcggcgcgcgtgggctcgggcaggcgcccccttttcccgggatagaaacggataaacggaagcgcgtgtgagtgtgggggtgcgaatcgccacctccggccttggctttcccgctcttccgagctctcccacttctcactttccccaaatccgcattttccttggcacagctctccccgagcacgaaggagagggaggtacccgggggcagtgagaatgacgtgtgctggtgcagagggggtgggggtctgcgggcctggatctgtggacgggctcctaatcctcttgttttcggaaccgtcagcagatgcggcttcctttacctgaataatcctttaaaggagtaataatttttaaaaaggagctcgacctcagccaaagaggacggcgcacgagattagggcttgatccactgcctttggttgggccggctgaatcgctggggactgcggccagtctcttaaaaaaggagaacaaaaagccgaagaccttgtgtggccgccgggacaaagcaccttgggttcggcgagaagggacgcgcaggagcgctgaacccagaacacgcgtggccgctgcggaagggcgtccgcccggcgtgcggaacgctgaggggactctcatcctctgtctcgccccctttttttgacccggggatccagccgcattatacacgagtgaccttttaaatctacgtccaccctttacctgcgagaggactgcagcaggcgagttccggaaggctgaatccccaggtcccagccccggaccgcggcaactcgcccctgcggcacgcccggcccggctgcgcccccactcagcgatggaggaaaaagcctggatgcgaaaggatgggggagaacaaagagcctttggaagacgtcgctgttatctcattgtctgtgtgattgggggagctgcggcggggaggatgctgtggtcccttcctccggcgttccccacccccatccctctccccgctgtcagtgcgcacgcacacgcgccgctttttatttctttttcctggttttcttattccatcttctacccacccctcttcctttctttcacctttccttccttccttcctcctttccttcctcaggagaaaggcctctctctccgtgttcacagcggacctt

SEQ ID NO: 2881 - DNA, 655 bp, Homo sapiens
gagaggcagatcatttccagagctagtggatgcccagtgtttatagcattcaccccatgccaggcgtgtgacagggcttttgtacatgtgatctcacttaagtctcaaaacatacctgtggttaggcctattttatggagagctacgagctagttagaagtgtgataccattttacagatgaggaatcatttcactcactgtgaagtgcaaagatttcccagaggtctcatagctgaagtgggagaggtgtgatgtgagcccttggccaaccttggcctcagatcgtcttgtcaaggagaaactggaggagtggcttttgtctgtgagcatatactctgcccagccctgtgctttgggctttatatggtatttgtgtccttttttgcagagtccgaaattgaagttcagaggaagaattgccttccaccgcatcttatcagaccctatgggtgccagggtgtgtgctgggagaagaagacagcaagagagccatgcagggggtgacacagctaccagggacctgcgttagctagcagcaggacggtgaagtcggttctagctctgcgaccttggaccacactgttcactcccatacagtggtctcagaaggacgtccaccttgggctgttgtgaggattaaatgaattaatccac

SEQ ID NO: 2882 - DNA, 1992 bp, Homo sapiens
agaccaatcacgcggagttcttaatcatgtgaaaatattttattttgacgtgctttttcttgagtgcctgaatgtggtggctcttagggtaaccccagaatcctcactgcggcaacaagacctggccaccaccctcacctcgaccaccacggccttcgctgcagccccactctgactccccgggggctgctcacgtgccagcacccactggccaagcatcctccggcaggacccaagtcctctgtattcagaggccgaccctgctttccagagactcacgaggtggcagagagtcaggctgtggcaggggcccctgtgtatcgaggagaggaggaagagtctgcagaggtttctagggaaggagatagtgtggaagtgactgtggctctggtcctgcctgggaggagatctacaggggaggggcctggccttgggctggccctgccctgcgtgggatctgtgccctgcgtgggatccctgccctgtgtggggtgcgtggggtctgtgccctgtgtggggtgcctgccctgtgtggggtgtgtggggtctgtgccctgtgtggggtgcctgccctgtgtgggatgcatggggtctgtgccctgtgtgaggtgcctgccctgtgtggggtgtgtggggtctgtgccctgtgtggggtgcgtggggtctgtgccctgtgtggggtgcctgccctgtgtggggtgcgtggggtctgtgccctgtgtgggatgcctgccctgtgtggggtgcctgccctgtgtgggatgcgtggggtctgtgccttgtgtggggtgcctgccctgtgtggggtgcgtggggtctgtgccctgtgtggggtacctgccctgtgtgggctgcgtggggtctgtgccctgtgtggggtgcctgccctgtgtggggtgtgtggggtctgtaccctgtgtggggtgcgtggggtctgtgccctgtgtggggtgcctgccctgtgtgtggtgcatggggtctgtgccctgtgtgaggtgcctgccctgtgtggggtgtgtggggtctgtgccctgtgtggggtgcctgccctgtgtgggatgcgtggggtctgtgccctgtgtgaggtgcctgccctgtgtggggtgcgtggggtctgtgccctgtgtggggtgcctgccctgtgtggggtgcgtgcggtctgtgccctgtgtggggtgcctgccctgtgtggggtgcgtggggtctgtgccctgtgtggggtgcctgccctgtgtggggtgtgtggggtctgtgccctgtgtggggtgcctgacctgtgtggggtgcgtggggtctgctacacgcttggtgagaaactgcatcagggcttcccgccgtgtgttgctaacatccccacacacgtgagtgccttgggaccctcgtcaacacactgagctgaggccactggtccacggcacactgcagtgcacatgcccttcctggccagaggctcccaggggcgccatgctctccaggcacctgccccgcctgcgagcacagcctggcccctgctgcactctgctctctctgcccgctcgggtccactgcagctgagcgggtgggagaagcctcttcaacttcacacacttgtcgcctctagcactgggcaaggtctggcattcagagttccaagaagtcccacagataccagtggctaagtctgtcttccctccaggaatggggaagcaggagccgtcagaacagccgtctcctatctgaggcaccaggaacaaacatgacgtcaggaaaagactgaaggtgccaagcacctaacgctgaaggaaccagcatgtgcctggcagcactgcagagagcacaccccaggcaccagagaccagggtgtcattcacaggtcaaagcaaaataagaaaatcataatttttccccttgttccaaagaaacatccacgtgcagagggcaggcagcttcggcccatggcgctcctgacgagggctccctcgtggctgccccaggacaagcaggaccccggcg

SEQ ID NO: 2883 - DNA, 16047 bp, Homo sapiens
ggagaagtcgcccggtttctgcttgctggtcgcgaaattttatagctataattaactcagggcggaacagctagcagaatcctcagcgttcgggcaaagggcagagaatccagccagaagcaacatgtagatctaatgaccttctccaggagtcgaggacccactacctcgctgaattctcagagtcaaaatgcgtctctacctgctggtcccagaacagtcccctgctgctgcattgaatgaatctcatctcacttcctcgagtcagccctacctatatttgatgatcacaaaccttatccttacgttgccagcagtaacattctgcatccctcacccactccactgtgtccttttcctcccactgatcttcactctgccttttctaggggaactctgaacagtatttctgagaaggggatgaagatcgtctcccaagtaaatatgttgagtttgactgggcaccgtggcccacacctgtaatcccagcactttgggaggccaaggcgggcagatcacttgaggccaggagttcgagaccaccctggccaacatgatgaaaccctgtctctactaaaaatacaaaaattggcccggcatggtggcatgcacctgtaatcacagctactcaggaggttgaggcaggaaaatcacttgaacctgggaagtggaggttgcagtgagccatgatcataccactgcactccagcctgggtgacagagtgatactccgtgtcaataattaaataagtaaataaataagttgaggtcaactttcaaatgatcgtcatgagaaagctacacagtattaagtaagtgtggtttagccagaagaaaaagaaccaggtagaattcacacccagctctcggtagatggcagatttcactttagggaactgctttcctttgaccccctccccacttgctttcttggcctgggatcctcactccagcatgtcgtgcagtcttcagaatgcgatatccttttccttacgactcttctagcaattaatgtaatttgcctgaacatttaaaaaatgacctctcataatttcataatctgaatctttatgtgtctttcttgatccccagggcatagagaaggttacctggcccagactagatgtgcagtaaatggtttttgtatgtgtgaatgaatggaagactgaagttagttattatagatgagatattatggggccattccgagtccggtattcaaggagtttgcaaagttgcagatgacaagtttgctaatgtgtgctgagtgttcgtgcctagtagcatgttaagtggtttgcttgggttgtttcattcagtcctcacagcggactcgtgaattaagtgctgttattatcacgtttttgcagatgaggaaactgaggctcaaagaagataatgtgcccaaggtcacctcgctaggaaagagtggagctgagatttaaactgtgactttaagcccaagttcaaggcttcttactagttttaactacattcccataccccttttaatcaatcatgtaaataaaatcttaattcttttaaaaaattaatatgtgtttcagcttgtcctgtagagaagactaatacttacaaatgggaaatattcgtcaagctttattttttctagtttgtcttatgaaattaagtttttcagcctttcccaatataaagctatattttatattaaatatgctttttatttatttttttgagacggagttttgcgctttttgcccaggctggagtgcaatggcgcaatctcagctcactgcaacctctgcctcccaggttcaatcgattctcctgtctcagcctcccaagtagctgggattacaggcgtgtgccaccaagcccggctaatttttgtactttttagtagagacagggtttcaccatattgttcaggctggtcttgaactcctgacctcgtgatccacccacccttggcctcccaaagtgctgggattacaggcatgagacactgcgcccagccaagtcttagttatttctacatgtaagtatttcatgatccgtttgtgatttggacatcaaatgctgagcataatgcttcgctgacctcacctgagacctgcatccactgaatttttactgtatgtgcttagggccgaatgtaattaaagtcttgtttatttacttctttttttttttttttttttgtaaataaggtctcccgttacgcaagctggagtgcagtggcaggttaatagctcattgtagcctcaaatgtagccttcccagtagctagtgaaggcctttttagaggggctcttgctttgaacagtagcaaatatatatttgccatttttgtagtgagtgtctgcatttgtgcagtaaatgagctcatgagtaaactgaggagtacatggactcatctcctcctctttcttttcttttttttttggttcaacatatttctgttgaacaaatgtacatacacactgaacagctatatcctgtagttcagtatatttctgttgaatgaatgagtctctaccacttgtttataaatataaacatttatgtaattttaatagtgaataacatacatgttttgtaacttgctcttttcatgtcagcatatacagatctgcatcgttatttataattgctttattgtactcctttgtggaaattcccctctatttaatctatttaatcttaatagaggggaaattcccctccatttaatctgttccctactgataatcacttagatttttgcctttttattttttgttttgttttgttttcttttgaaacagggtctcactctgttgcccaggctggagtacagagactcgatcacagctcactgcagcctcagactcctgggcttaagttgcccaggctggtcttgaactgagctcaagcagtctgcccacctcagcttcccaaagtgccgggattacaggtgtgagccactgtgcccagcctatgtttttatattaaacagtgttatagcaaatacaagtatatgtgcatgtttgcaggaatcgctagtgcagagtttgcacattatgaatagccactgccaggcttttcaagtcctttttttaccaatttacagtttcactgaattgggtgaggaaatttcctgccctacaccctctgtctcactttgttttgtgctgctgtaacagaatatctgagactgggtaatttctaaagaacaaagatttattcttacagttctcaacgctgggaagtccaaggtcaaggggcccacatctggtgagggccttcttgctgcatcatcccatggtggaaggtggacgggcaagagggcatgcttgcctgcaggagaggaagaggggggaaggggcctgtacttattcttttatcaggaacccctcctgcgataactaacgctttcatgagggcagggccccgtgacccatcccctcttaaaaatccgccccctcaacactgctggatggggaatgaagtttccaacacatgaactttggggaacacagtcaaaccatagcattctgccccagccccccaaattcatgtcctctcacatgcagagtacattcattccatcccaacaggtttaatgttttcatttgttccagcaccaagtcaagagtccagagtctcatttgaatcagatacaggtgagactttgggcaagatttctcctaaggcagattcctctccgccatgggcctgggaaattaatgtgcttccaaaatatgatggtgggtcaggcataggacagcaattcccattccaaagggattcgtttcctgttgttgctgtaacaaatcaccacaaagttaatggcttgaagaatacaaatggattatctcacatttccggagatcagaagttcgaaccagatctgcctgcactacaatcaaggtggcagcagggctgatgaatgccttcctggacacgtgaggggagcatctgcctcctcaccttttccagcttcttgggtctgcccatgttccttggcctcttcctgcatttgtcaaagccagcagcatttatgctgtgcctttcttccaaagttgtgtcttcacggacttcctgggcaactatgaaggacctctgtgattacactgggcctgtggggataatccacgctaatctccctttatgctgattagcaactttcattccatctccaaccttaattcccctttgctatgtaatctaacacattcacaggttctggagattcagaaatggacattactggggaggggagagcatttttctgcctactctagatccaaatgtcaacccaaggctgaacagccctgatttcaaaggacatatgcacacatgacacatatccacacgtacatgcattatacacacatacctgtacacatttagacagatatgtggagcatctttacaggtcagaacacaaatatacacctctacctcctttttatggctgcagagtaagccattctgtggatataccatgttctacttaactgcacgaaagcaaggcagcaccaccaaaccctccagcctcatattcaatctaactgaactgtggactgaagacagctcaagaccgtcaaacctccacatcacaaacggttcctccaaggctgtagggatctacttgagccttcataatagccaacagtagcagccatatttgctaggtgctttctatgccccagacactcactgggttgacacctacatctattctaattctcaaaccaggcaaatcggataggatccactattactcccattttacatataaggaaagtgaaactccaagaggtaacttgcccaggaccccagcactaataagtgggattgtgggattcaaacccagagggcttgactagccacccctagacttagtttatttaaaccagggagcagactacacctgaaggctcaatccagctcactgcccattttttatggccagaaagctcagaagagtggttatttttaaatgactagaaaaaaccccaaaagaataataatattcggtaacacgtgaaaattatatgaaattcaaatttcagtgtacatgaaagttttattggaacacagccaggctcctgtgtttatgtgctatctatggcggctttcaggctacaacagcagagttgagttgttgtgatagataccgccgtgtgatctgcagagctcaaaactgactctctagccatttatcctttctccagtcacagagaatctggtcctcaatctttctgactgcttcacgctgagaaggggcattgtgggataatgacgaagaacgaaaacgtcatgcctatagctgaagtactcacaagtgcctggctggcatccagcttgatggaacatggtaatatgggtccttttatcttggttttagagcaacatttcaagccatgctaagatgattaataacatagataacatccggatgcggtggctcacacctgtaatcctagcactttgggaggccgaggtgggtggatcacaaggtcaagagatcgagaccatcctggccaacatggtgaaactccatctctactaaaaatacaaaaattagctgggcatggtggcatgtgcctgtagtcccagctactcgggaggctgaggcaggagaattgcttgaatccaggaggtggaggttgtagtaagccaagatcacgccactgcactccagcctggcaacagagcaagactatgtctcaaaaaaaaaaaaaaataataataataataataatagccagtgtggtggcacacgcctgtaatcccagctactcgggaggctgaggaaggagaatcgcttgaacccgggaggtggaggttgcagtgagccgacatcacgccactgcactccagcctgtgtaatgggagcaaggctccatctcaaaaactaaaaataaaaaataacatagataataaaaattttaaaaataccacagaatatggagtggatcccttgggaaatccaagagaagactcagagttctgtgttctctgtatggtttcttatttcaggtctttggctgggctttgaatactaacttaaggccgtagaagggttcacacaaccatgagtgtttcctctagagggatccaagagggactagttttactccagtacgagacaggacctccagactaaagtcagatccaactgcgctggatgttttacttggagccaaccagatgacttctatgaacaatagggatgtcttcctggtttggtggccttgactctggcttaagctgttccttggagcaagtgggcagcaatgtggccacatctcaagtgtgctcataaatggcacagaaaaggggaagagttccctaacggtgagataaaggagactgaagccagtatgaaattcttaatatcagagaatgagggacttcaaaatctttgtagtgacctcagagatacgtaggaagcatcagagcttcagatatggcagcaaactacaagttattggcatcaattacaacagaaaggcagaaatgagcgttcctgaagcaagaaagcaagcactgcaggatcggttgcaggaccggcagctattggcatcaattacaacagaaaggcagaaatgagcgttcctaaagcaagaaagcaagcactgcaggatgcgttttaggactggcagctattggcatcaattacaacagaaaggcagaaatgagcgttcctaaagcaagaaagcaagcactgcaggatgcgttttaggactggcagctattggcatcaattacaacagaaaggcagaaatgagcattcctaaagcaagaaagcaagcactgcaggatgcattgcaggactggcagctattggcttcaattacagcagaaaggcagaaatgagcgttcctaaagcaagaaagcaagcactgcaggatgtgttttaggactggcagctattggcatcaattacaacagaaaggcagaaatgagcattcctaaaccaagaaagcaagcactgcaggatgtgttttaggactggcagctattggcatcaattacaacagaaaggcagaaatgagcgttcctaaagcaacaaagcaagcattgcaggatcggctgcaggaccggcagcgagtcctgaagtcaacacattcagggaggccagaggttcccatccacactgcatcccctccattcgggtggtacccatcatgcttccgtgttccacgatgagtacatgggtttttgtgacataatttcatcacagcaataaatagatagtccaatgaagttttaaaacacaagtttccagttggccactgaaggcatattgctcagacttctaaagtagaaggaacaattagctttgatgaaaatgaaatctacaaactacaaacaccagataccatccaggagctcaagcaaaagagaagtcaggatactgatgaccatcccctgctctgacagcacttgagaactatcgaggaaaataagccattagactccagcacaatggcgaccccacagggaagtgcagggtccccccaggttgtcaccatcaccacggctcacgtttattgagcccttatcaataagagcctgccactgttccaggtgctttgcaagaaatagttgcctaaaagtttacaataactctatattatcatcctcatgttacagagatgtggataagatgtggcacagagaagtgacttgcccaaggtttcctggctctgctctgaatctcggcagtattacttcaggtaccctgtccttaacctacctgatacatgctttacaaatattaacccacctaatcctcaagacaactatgagactgatactactattatacccattttaaagattagaaacctaggcacagagaagctcattaaattgttgagcattacagacatgacaggaggggccctgaacacaaacccagggtaccagaaagagatcctgaaactggtgatggcttctgagacctactagatgagttggaaacccggagactggatattacaagggcactcagggcagggagaagagagggaagagagagcagggaggagcagacacagctgacatggctgggggagaaccccaccccattgaagctcaggtacacggggcctactgaagtctgtgagcaaacttacttgcccacagggtgggcaggattgccgagggccagcccaattccaggccatcaggtgtgcagaccccgctgaaggactgcagaaaacatggaaaggaactctgctggactccgggcctccaaatgagtaccagacagcaaatgtaaaaaaaaaaaaaagatcttcagaaaggctgttacatgcatttaaagaaaagaaaaacaggcttagcaaaccatggccaccccacgctgagaaagtatggtgagacccaatggatggaaactactggaaggctgatttagacttgattgaacagcgtcttccggaggattagcagtgccagagtagataccattgaactagagtgtgtgaatggcaaggaggtttcacctctgaatcgggggaagacagaatgttttccccattggagaagtcagcgaccatatttccactatggaggaatccaagaacggtccggcttggatggcacaatccacatggttctgcatgacctgccacagctccacatccatggggaccaaccagggcctgggcagctgctgggctctcttctgatgtggacagtgtcttgctctgtcacccaggctggagtgcagcggcacaatcatagctcactgcagcctcaaactccttcaagggatcctccccactctgcctcccaaagcatgaggaatagagacatgagtcattactcccagccattgtaaacttcatctcctttaacacttccaataattgcaggacagaccagataatggttcttcctatctattgcttcaagtttcattctcattttaagtgatttaaggttggcttctgtgattcttccttaaagtaatgttaaaggtgtgacttcagtttcatttagagttcataagatgactctaaatgactagccaagatgacacattcatctggaaccccagggaagacggaagtaaaaccctcctttttctcctaaatatcccaaaaggttgggtgccctaggtccaagggatctgcaagcctcctaaagaaatttccattgtccctcccggctggtgtgaattgtaatctggtatctatatcccaggaacatttaacaaacattaaagaaacaccataaagctaacaagctgttaccaactgtgaagtcattagctagaggaatcttggattgtccaaaagactgaaaaagcccaggcagatcccatctcttcctcataactgttccactggaaattgtcatttttcacaggagacttttcgtttttttggtgacaaggtctggctctctgtcaccgaagctggagtgcaatggcaccatcttggctcactgcacccttgacttcccatactcaggtgattgtcccacctcagcctcctgagtagttgggaccacaagaatgcaccaccacgcctagctaactttttcttttatttatgtattttcagatagggtcttacgctgttgcccatgctggagtgcagtggtgtgattatggctcactgcagcctccaactcctgggctgaatctatcctcctacctcatcctcccgaagtgctgggattacaggcatcagccaccataccttgccttaatttttaaaaattctttgtagagatggaggtctctctacattgcccaggctggtcttgaattcctgggctcatgcaatcgtcctgactcagcctcccaaagtgctgggattacgtgcacgagccatcatgccctgccttaatttttaaaaattaactgtagagacagggtctccctctcttgcccaggttgaccttgaactcctgggctcaaactatcctcctgcctcagcctcccaaagtgctgggattgcaggcataagccactacacccagcctaacatgaggcattctttttatttttttttgagacagggtctcactctgtcatacaggcaggtgggtggtgacagcgaccatgaccacgggtcaacctgggcctcagacactggggaaaggtggccatgtccagttttctcaggaaattaggaggcaggtcatccgaggagagagggtgtgtctggggtagggtggagtagctttcagaaaagtgtaagtctggcaaaagcactcaggaaaatgggacagaaaatgagccaagcgctggatggcagcgttcattcagcccagctgagcttggaggccatgaaatgctggcagccccacactgcaagactgcagggtctttctgggccacgccccgaatcccaggtatggaagtgaaggacccaaaaagaggaacgaatcaggctgttattctgcagaacaggtgaaagaaaaaagccaagtagacagagccttggaagtcaaagagtcacccacatgcctgacccagtcagaagaaaggggaccaagccagggcgggagggactgtgtgggaaagaggaggctgaaaggaggagagaccgcgggcagaggtggacaagggaccaaggtgaagacctttgaggtgcttcttgaaccacagtggtgaatgtctttctggacaagagtgccagtgcccaccgccatcacaggacacagccccatccgcactcccgggacagcaacatctcattgtcccaaactctgccaatttcatcagtgaaaagtggagcctggaagctttgcatttcttcaatgacttcgaattttttaaaatggtctcacagatttcctggtcatcggtatttcatctgaaaagtctctttctgtgatatctgctcattagagcggagttcttaaaattattagagagtgttatacattcagtatattcacctctgtggtggttgctctcagttttgtccagttagtcattcatcataaatttaactttgatatcataataaaacagacaaaagtgtagttattatgtgcttaaatctacaggtgcttttttaaaaagttctttttagagacagggttttgccctgtcgcccaggctggagtgcagtggcgcgatcttggctcacttcagcctccacctcttgggttcaagccatcctcctgcctcaaactccagagcagctgggactacaggtgaaaatatcacaattatatgttagagagagagagaatgaatcattgtaaaacaatgaaaaggtgaagaatgtctgttacctgtgtaagtaacatctacatcaaccctcacctgaagttcctcacctcttcccttgctcttttcttcagcccaaacacggtgttcaacgttcttcccagtcaccgcccaaggccgctgtcttagccctgccgtcatcacctctctgagcctactgcagtagcttcctatctgggttccctttccattcctcccgggtcccgactccatcggctgccagttgacttcccacagcaccaacttttctcagccttctgcctatgagagctccccaaattctaccacgggagccctcaaaccatgatcctccccaaaacgtgaacagcagcttctcgaaccatggacagatggcacagatgacaaccgaagccaatcaccactgcctgtccctggaagtggacgctccgggtcatgggtggccatgtatctcggtcctgctatcctgggtggttggaggaattctagcagtgagagttgaaaaccgctcggcgcgcggcaagagaggatgaagcccgagtctgacctgggaagggagctgctccccgggcagtggaccccagggctggcggggaggcggcctcggtcagcccagttggtctcgggccgctgggcctcagcccccaagcctggtgcccgctggccccggaggagctgtcccgccccctccggcactcgccttccggggcttggtcggctagctgcttcacgcgcgcgggctgggggccccaacggcggacgagcgctgctcccaccgctccagcgcccagactgtagcggctccgcctccgcggtccgttggccccgcccccacgtctcttccggggccccgcccacccccttcgggcccgcccagcacggcctccccttgtggcctggagccccaggccgagggcgcagagaccagaaggccgagctgggcggcgacccccgttcttgcccggtcacttcctgcggcgccgcctgcccgctggcaaactgtggctgggagaccctttaaatagaacgtattagccaaaactagaagagcaaaatatgtaccatgtttcaatttaatgggattgccaggtgttttaagggtccgccgcaacggtccctcgagtcccggggtttttgtccccatcagatcattcgtggtgtggatcttccgggaggttatgggaaagggagaccagcagccggctccgtgggcggccatactgctcccccaggaaggccaggcaaatcttcagtgctgggatccccctagtacgttcattttgtctagggtccaggtggggccatcgagccccttgcccacaggattggtcctttggcatgcagataagcaacaccgccaagaaaagcccatggggtctttaggctgttaggagaccaccagggagccattcctaaatcttcccaggtgatggttccaaaaaccctggtgtttggggaaaggaaaaagggttatccacaggactatgctggaacactttcccaaacagtgtctgcctggctgtcccaagcagccggtgatggagcgatggtcatgaggctagaccaaagaccacagagtctagcctcactctagtggaactcaggcacccacccgttaggatgtcgtgttgctgctgcccccaggtgggagcctgggaaaccacctggccgacacgggccacacctgatgggacctcacaaggagatacagtccattaacgttcgtcagggtgggaagaagtggcaacacctactgagataacaaaactcattagctgaagggcaagctggccagcaactggcagtgatgttctcaatagtcctggccgccttataaaaccagctacttaggccgggcacggtggctcactcctgtaatcccagcactttgggaggctgaagtgggtggatcacaaggtctaggagttcaagaccaacctggccagtatggtgaaaccccgtctctactaaaaatacaaaaattagcctggtgtggtggtgggcgcctgtagtcctagctacttgggaggctggggcaggagaatcgcttgaacccgggaggaggaggttgcagtgagctgagatcgcgccactgcactccagcccgggagacagagcaagactccgtctctaaataaataaataaacaaacaaacaaaaccagctacttagtaaaggagcagctagttaaagctaaccaggggtcctcaatcaaggatgggccacactgtttgtgatgccaatcgttttattcacactctttactccattgatgaaagagggattccttccccccacgctcctgcccccgcccctgtccccacccccagagatacggggatggccgaacacacaacacttgatgcaggacggatgcaatcaacagcagctgactggtcacagatactccagtccaggggagaaggaccctgcacactatgcagggcaatgtggaggctacactccggaacacggtaacaaggaggggctgctggaggcaggctttgtagtaacaaaagtgcagagtgagccctggttcccacgggagggtgtgactggcttgtctgaataattcgtccttgagctggcagggaactgaagcctactgtttggggataagcaggctctgtgtctgatccctaaaataaggagagtgtttagccagagaatttcatctgcggaagcagacagggagcgaggcttggagttcagccatttgaggccctcttgatttaaatggatgtaaagacagaatttgatatgaatcctaatttcaggccttacaccacaatacactattaaaaagtaagttttccgagaactagtcattgagttcagtgtcacaagattttaaataaacattctaaactcaactgtggcatagtggttcacgcctgtaatcccagcactttgggaggccaagatgggaggattgcttgagccagaggttcgagaccagcctgggtaagatggtaaggccctatctctacaaaaaaaatatataaattagccaggtatggtgatgagagcctgtggtcccagttccatgggaggctgaggtgggaggaccacttgaggctaggaggtcaaggctgcattgagccatattcacgctgctgggctccagcctgggtgacagagtgagacctcatctcaaaaaataaagaaagaagataatttcacctattgcttaacatagaaaatgggagccctcagaatgagactcccttaacttccccaagaaacttaaccatccttttttactcttacagttgtgaatgtcctccagtaaagaccacatgaaacactttgtagttaagcaagttgggtttattacttgttgcaaggagggaagactcacaccatgaggagcctatcagtaagaggatgttagacctttaggatctgggctttggctgggtgatttgggggagggtccaggggtttgctctggatcgagtgctgataggaggtaggaaaattctatcatccggtagcggtatcttttctagaaagaggtttggctggagtagggctaaagctacaatgtgtaaagaagccacagtcactcctatcagctgggagaagggaatgtctggtattctgtgggtggcacagtgaccttgcttttgtccttacacagaatgatgacgtggtctcgtgtcatctcctatcatcaccactgcagagtgtccttgtgtgagtggtctgcatgattgtttatgtccaataggagaacaacatggccttgttgtgggcaccagccagcttccaaaaacatacggcctggctcacagcaccaggcaagctcctagaagtcagttttgcttttctgtttttcacagtggaggaggtgagccttaaagagatcgataagggtttgcccggcagaagaaaacagcgtgagcagaggcatggagtctgcagtagaactgcatgttaggtgaacctgatatagggtcaggaggggtagcaggagagatttctggacaggctttcacacagtgaatcgtggaagctcccccaaatcacccagccaaagcccaaattataaagatctaacatcctcttactgatatgttcctcatggtgtgagtcttccctccttgcaacaagtaataaaccaaacttgcttgactacagagtgtttctggtggtcgttactggaggacattcacaactgtaacagtgaaaaaggatggttaagtttcttgggggaagttaagggagtctcattctgagggctcccattttctatgttaagcaataggtgaaattatcttatttattttttgagtacaagttttatcctgagggatttgaagtgaggaactgacatgacctgggtttgcatttcagaaaaatccccagcagctgcgtgggagaaggcttggtgacaaaggggaagcctccttttctttcccacacccacagcccctgcacctgctgtcctcgctcatccgatctattgcaacacatccttattctacctttggccagggtgatttttcagaatcacagatcttttcctgtaacttccttaaaaccttttgattcccaatcaattaccagtgaaaaatctgcacttcattgcctgacacacaaactgtacctttcatcatctgttccctctagcctggtatctggctttgcattagttaattcttgcactgctaaaaagaaatacctgagactgggtaatttataaagaagaaatgtgtgtgtggtttgttttttgttttgttttgttgttgttgttgtttttgagacagagtttcgctcttgttgcccaggctggagtgcaatggtgcaatctcagctcactgcaacctccg

SEQ ID NO: 2884 - DNA, 4643 bp, Homo sapiens
gagatggagttttgctcttgttgcccaggctggaatacaatggtgtgatctcagctcacagcaatctctaccttccgggttcaagcgatactcctgcaccagcctcctgagtagctgggattacaagcatgtgcgaccacacctggctaagtttttgtatttttagtagagacgggttttaccgtgttagccaggacggtcttgccctcccaacctcaggtaatccaccctccttggcttcccagagtgctgggattacaggcgtgagccactgcacccggcccgagacttgattcttgaagctgcacacaggaatctcactttgacaaaccccctaacacacacaaacccccaccaccgctgccactgctgggacccctaattaaaaataataaaaataaataagtcagccaggcacagtagctcacgcctgtaatccatgcctaggatcccaggtggacagatcacttaaggccaggagtttgaaaccaaactgggcaacatagcaagaccccatctctacaaaaaatttaaaaattagccaggtatggtggcacacgcctgtagtcccagctactcaggaggctgagatgggaggatcacttgagcccaggagtttggggctgcagtgagccatgacggcactactgcgctcctgcctgagcaacagagtgaaactctattaaaaatattaaaaattttttttaaaagttgttcctctcacataaagactgtaagtccgtcccacattgcctggatttttaacagagcagtgattctcagtgtggtcctgggtcccacagccagcagcatccgcatcactggggaattcgtgagaaatgcacattctcaggcctgttggcctcctggagaggaggctctggggtggggcccagccatcggcatttaacaaaccctccaagggacccgacacacacacctttgagaaccaggatggaaaacatgctttttcaacacacattccctatctctgcacagcagggggactggatattctcccactctgcagatgaaaacactaaagcccagagaggttaagggatttgcctaaagtcaatcacctgcccctcccacactacacacttcagaaatttacctgagggggggtttcagcaaccttccagagaatgtggttgcattataaatgccacttaatgagaaaaatgagcccacctcggctgggcatggtggctcacgctgtaatcccagcactttgggaggccgaggcaggcggatcacctaaggtcaagagtttgagaccagcctggccaacatggggaaaacgcgtctctactaaaaatacaaaaattagctgggagtggtggcgggagcctgtagccccaacaactcgggaggctgagacacgagaatagcgtgaacctgggaggcagagcttgcagtgagctgaaattgcaccactgcactcctgcctgggcaacagaatgagactccgtctcaaaaaaaaaaaaaaaaaaaaaagaaaagaaagaaagaaaagaaaagaaaaataagaaaaatgagcccacatcgggaaaaatgcagcctgctccaaagggggaagaaggggaaagagcaagattttccaagaggatgtgctgtacctccgggcagatctccagaggctttgaaatgatcaaagagaaatcaaaagggatgggaaaaggaggagagggagaggagatgcagccggaagcagctagcctaggctcctaagaagcctgtaactaatgcccccaaagctgtgcaacactgcttcccctagagtccccgactgggtacccagtgctagcccctgatgggcccggcccttcctgaaagcatccagtgccctgtccccctccccactcccctgtgaaggctcaggtcccccacccccctccacactcacgcgatgctggtactgcacttctcacaagtgtggagcttgggaggggtggccagggccctggaggcgggcagggaggactgggggctcagtgagctgggcaagaaggctggcgtgccacctgggggcagggcagacagacatgtggtgagagcccaccaaccacagcatcctcccaaagatgctctgaggaggtggtcttggaaagcacccttataagagaaaccctaaagtcacgctgacagtggcaccaggtaaggaggaaggtgatcttgccagatccatggctgaggctgggcaagggcatgaaggaggcaggtacaaggccgagtttgcccatccaaggccacctggggccatctgtgctcagtgtcaggtgaagcaggtgctccctctctaatgacctggtaataacagtgtgattagataataactggagatggcaacaggagcgcaatgcctcggtgtggctttcaaagtgcttttccatgccttgtcacatctgagctctcaagccacacgaagatgaagcccagggctacggggcagctgtcgcccgtctgcagctaaggacgctgaggcctccttggcaaagtcactgctctctccctgtgctgcctcctgggaccttctgaggcctcagggtcaaaacagaccagatttgctccaaaccttctcaccccaccccctgtgcctctgcaaatgccccttggagctaaacatcagcgttagaaccagccacctgccaatctccaggtgtgccctgtccatatggcctcttacatttgctcccaaaatggaaatctcaccttcaacctcacagttgttcctggaggccagtttccagcctgcatctctgtactccccactcccctgctccctttccattgccaccccaatgggactcaactgaggtccaggagcccacaccagccactgggaaggagagccttggagacagccaggcgggccagtgcccagggccaggggcaccatttcctgggaaaccagcttctctccattttaaaattcaaagtcatagatgaattatgaagcctctctggccactctcctacctgtcctgtcatctccctccccttctccccactgttctagagggcattggtgctgagcaccttaaggacaggggctgtgggagtagtaactcccacagcagcgctcacttccatgggagctggccaggcccatctgccccaatgaacggagctccccaagggcaggagtggggtcatggccacctatccccaaactctgcacacatctggtccctcagatgggcacagtcagtgtctgtcacatgaataacggaactctggcaagcctccgtatgtcttgctcgcctggcatcagtatttaatggctttcctgggttagggcactcctcagcctgattcccttcccgagggccctcactgcaggggcttggcctccactggcgccctttcatgctatcaggcccccattctctcactcccacaccccaaagccctctggccgccagcctccaccttccacagtgcttcctgccaccctcttaatgctgtttaagtcttgatgttttttctaaggccaagaggccaagtcaaatccctcttcctccaagaagccctccctggaggcccagccccaggccctgccaccgcttttatcactcgaatgacactttcccatcccagctggctactgcccactactctgtgggagcacgctggtgaccctcccggaccctcccggaccgtcagctccttatgggcaggggctggggcttcgcgctctgctcggctccgtgcctagtcctggggtgagcacctcacaggcacttaagaacactggttcactgacccatccagtcagggcccggggtacggaagggaacctccttcccctccccagccccccagaccctcacctctctcctcagcctccagggcttcctgcaagagccgaaaggagctggactgtcggggggccgcccgtccctcgcgattttcctgcagcatcttgaagacttccgagtcctcgtccaggaggaggcttcccccttccgagtccatgctgcagggtgggaggcagccaggaatgagggtcccgtgccggagcttaggcaagcaagggggtggggggcaggagaagagcgtgggggagggggaggaatctgggaggtggaggagccaactgggcttgggggaccccatccctctcggggaagcccgtctccctcctgcccctcccagccttccaagaccccaacccgaccctccggggcctgctggtacctgggcctggaggaacgagggcccggggaaggcggcagcaccagcaccgccgagtcgccagcgcggccgaggccggcctgttgggaggaggcagccggggaggagtcagggccagagccttgggccaacacacccaggagggcctagcccggctgttcccaggcccgacaccagggggcccccggccctcgccgaccagcggacccctgccccttcccttggagccagggcgcagagactgccagggtccagagagggagggaggcatgcgggttctgccggggaccgggcagcaggaaggcagcaggtgacagctaagcacagagtcctctgtcacgcacgctattatctgtgtgcaaagacattgcacactggggcctggctccgatcccacggaaccagcagagaggaagcacgctgcccttttgcactgaggagat

SEQ ID NO: 2885 - DNA, 3492 bp, Homo sapiens
agaaggctttagcaagtcggggccagtggcgcaatggataacgcgtctgactacggatcagaagattctagaagcccatggaaacaaggcgatgacggcgcttgagggtgaccagacctcctcaatcattccatcagccacccaggactcaacagcagaacctcagaggactcagctgaaagaggttttcactcgagcactaaccacagagaaatgggaagtgccatcctgctgtcatacgcagccgatggctgggtaggactaaatgcccttctgtggtgagatgaaccaagacggcagatgggggaataacatcagtgagagagagattacgaatggatccttgtattgcagatcaaactgggttgtctcttctcaaaccacccaggcagtttctgaatgtcccaagataggggtaggagaaaagaaaaaaaagacaaaacaggagacggtgggtaagaaaacctaaaaggcacaatgaggcaaaggcctaagatggaggctggctttgggatctgaaatccggccacaatcctccttgttttacctcaagtccaagaattgtcaaaaagaaaacccagaagggctattcattctaaattttaaaatcttttcttcctggcctaccaagtccttgtgttttctttctaggcgcccataaatacaaccccattacagttctatttggctaataatttacagaacatttaaaataccgggtaggtgaacatctcttcatggcttttgtgtaagggcctgaagcgaagagaaaaacaactgattggagattcctatctggcgccttctccagggaaactgacaaccagagaaatctgttgctaggatttctaggacatctggaaattccctttttgttctttctcaacaatataaaatggtatattcgcaaacctatctgaatcacctcaatctaggccactttgaaaatttcatttaaaaatgtaatcacagatttttaaactaattacccaatttgcaaacaaatcccagctacttctggtcttgaacatggagcaaaggtgtgtcagtaaggccaacattcttaggttgacagagacaggttaacacattggctggcttcatttacccccctgccacgccccacactgagctggatgatttgatgggaagagagggtccccacctcagggttcacttccccagccccagcgttcatgggttttcaggaggctcagcctgtgaaaaagaaccaatgatgatgcacaccctggctgaagtgacatctggccaaaggattccaacagaatgaattccatcaacatggaaaagataatccatggcaccaattctgtgctgcttacaggcaatggttaccaaatgagtcaaaacatggcctagaagtggagccgggcccaatgaaaagcctgagttcacacgtgctaggggctccactgaccggcctctgcagcccagcacccagtcctcttgctctgggtgcaaggtgaggaggcagagtgcacacaccggctcctgtgtccccggcctggctggcaatggtaaaatgggctgcctttcttttgcagcttcttctaatcgaaataccaaagggtactgacctctggcctcagggatgtgacttgcagtgcaaattttacctcttcagtgcagagagtggtcttgaaatcttgccagtgtgtggccctccctcagctcctgccaccctggggagccaggatgctgaaatgcataaggcaaaagcactgaatcggatctattccccactgacctttagttacgatcactctgccctgaccagctggagttgggcctgtgtgaagccagtgatttccaacacactgaagaaggtatctgagtccagtgtgaaagccaaattcctcctgaatctgtgatttggtgaagctctgtgaggtattttttgtgtgtggaagactgaaagtgaagggaaacaactaaaaaaattaaacagacaaaagcagtgtaccttatcctggtttcttcaaacataatgcctgtgccaagaattgggcaggagagaaaccaacgaaatgaatataataacttatcctgaggcgctccctcccacgctggcttagagatctcgcacacacaaaaactctccttgtttataagaagctgtctctcagtatgcgggcagctcttcccaaaagcccgtcattaaataagctaaaaacaggtgcaagcgatgtacctgcatgggttcctgagacttgccttgcagaagcggccttccaagtcaccaactcttgagaactccagagaaaaacagcgcaaacacgtgggcaaaaaaaaaaatcctggtgcctgcaccaagttcttctcccaaagtatgttttactcacatagggcaaatttctgtcgcggactcagctgcctttaggagagtaaggatttgaaggggtacagagaatgctgtcagtgtctaaggaggaaaccctgcctcacctatttcaaatcttgactctggttttctaagcaaatttatcttaggatacaaagcacacattagagcttccttcttgccttaatgcaattaaatttgcagccattctgcagaagaactgaagctctcaggtgaaaagaagccttaaatcatgccatgatatatgtcgggggagggaacatttgggtataggtattttcctgaaggaagagaaagggttgaatgtattggcagctgagctgtcccttcaaggggatattgtgaaacaagctcaataaaaacctctccctctgaagcatgaaatgttcccagaggggacaggaggattcctttggtgctatgatgcaacctcaggtcatgtgctcgcacatgctggagcattttcctgagtaacctgaggaaaatgtggcaacagagaaaagcacttggaaaatacacgcaggaggcaggtagtgttcacctccctggttaaaggaaaggcaccccccacatgctcacaggaactctccctcctgcccctcctcttcccctaccccacttccaccccaggggccaccggaagcagcagcagcaaccccggctcctcatcccctgccgtgatgtctgcaagtggctctggctagaagtggtgctggtgaagggctgtagatgagggtctcttctccagcctcttcacgtggcaggagtgacagaacaggtggtcctccagcggataacagcggtggccatcttcatcattgagctccagaccacagtcctgtggggaggcagacatgtccaggggaagcaaaacaaaacagactgcaagactgacctgaaggccacagtccccaaaatcagcagagggtgctgtgtgtttctgtataggcaggaaatgccagtgcagaaacacagctcctgccccgtggaggcctgtccaacacaggagacactgccacaaggcacttgctgtgaaccacttaaaatgtgctgtcagtgtaaatgcagattccgaagacttaggacaaaaagaggatgtaaaaatatct

SEQ ID NO: 2886 - DNA, 4818 bp, Homo sapiens
agctgaggcacatgccttgggagctaagtggttactgcacttgaccactatgaagactggtgtgggaagggtcgctttggatgcacttgagcagggctccccaacccctgagccatggagccgtaaggagccacacagcaggaggtgggaccatccagttgcaggaaaacaagcttaacatgcccactgattctacattatgctcctacctcccggcagcctctccaggcccagaactttctccagtcagcctctacagaccaagctcatgactcacaatggcctatttaggcccataccctacctcacggcagtctccgcagatgagcctactgcctcacaacagcctccacaggcacagctccatcgttacaatggcctctttagacccagctcctgcctcccagccttctctctaggccctgaactttctgaagtcgacctcaccaggcccagctcatgcttctttgcagcctctccaggcccagctcctgcatcttggtggcccctccaggcccagcctctgcctcccgtcggcctctacagtcccaacatctgcctcatagcagattcttgaggcccagcatctgcctcactgtggaccccccaagccaagctcccaacctttagcagcttctacacacccagctcctgccacccagtggcctctttaggccaagctcatgcttcacaagggcctttccaggcccaactttcgtctcatggcaaccttccctggccagattcctgcgtgtctcccagcagcctagacaggcccaggtcttgcctcacactggcctctctacatccagctcatgcctcacagtgacctctccaggcacagctcctgtcccagaacgtcatctccgggcccaaaacttactcaagtcagcctctctagtcccaactgctgcctcctggtggcctatgaaggcccaaaatctcctcaagttgacctctcccggcccagctcctgcctcctgtcagcgtctacaggcccaacctctgcctcatgggggcttctccaggcccagctcttcctcttggctgagtctacaggcacaactgctgcctcacaacagccttttttggcccagttcctgtccagctcatggcagccaatgtaggcccaaaacttcctcaagtcatactctccaggcccaccttctgcttcccggtggcatgaacaggcccagctttgacttgagaacagcctctgcagggcctgctcttgcctcccaggggcttttccaagcccagctcttgcctcatggcagctgcctcaggccaaatttcttcctgcctgccagcagcctcaacaggcacagctcctccctcacggtggcccatttaggcccaactcatgactgtcgggccatttccaggcctagtgcctgcctcctggctgactcttgaagcccaaaacttcctcaaatcagccttttgcccaacttgtgtctactgtcggactctacaggccagcctctgcctcacagtggaccctgcagacccagatggtgtctcactgtggcatcctcaggcaaagctcctgcctttcggcagcctctacggggccagctcctgccttgcagtggcctcttcaggccaagctcatgccccatggcgacttttccaggcacagcttttgccttttgcagcctgtccaggcccagaatgtccttaactcggcatctccaggacgagctcatcctcccagtgcgtctacaggcccatctcctgcctcacaacaacctcctttggcccaactcctgctgagctgctggcagcctctgtaggccacagacttcttaaagtaaagttttccaggcccaccttcggcctcccagcagcctcagcaatcaaactattccctcactgcggccaccgaaagccaagtttctccctgcctcacagcatcctccgaaaactgagcatttgcctcacggtggcctccccaggccacgaatctgcctgcctcccaggcaggtgctgcctcacaatggtctctttaggcccagcttatgctaaaaaatggactctccaggcacagctcttgcctcctgttagcctctgcaggcccaaattctccaaaagttggcctctcctaactcagctcctgcctcatgtcggcctacacaggcccagactcttaccacacagtagaccctccaggcccaccacttgcctgatcatagcctcctgaggccaagctcctgcctttcggcagcctctacaggcccagctcctgcctcacagttgcctttgtaggccaagatcatgccgcaaagtggcctttcctagcctaacttttgctttttgatgcatactccagtcccaaaacttcctccagtcagccggtccaggccaagctcttcctcccaaaggcttctgcaggccaaaatcgtcctgaagtcaccctctgcaggcccagctcctgcctccaagtgctgtgtaggccaagctaatgcctcacagcacactttccaggctgagcgtttccttttgtgcatcctctccaagccctgaacttactccacttggcctctccagaccaagctctccctcccagtggcctctacaggccaaaactgtcctcaggtcagcctctccagggccaactcctagctaccagtggcttctacaggccaaaatcgacctcaagtcagcctcttcacacccagctcttgcctctgagtggcctctccaggagcaaaactttctcaagtcggcctctccaggcccagcctcctgcttcccgagggcatgtacaggcccagcctctgcctcacagcagactctccacacccagctcttccctgtctgcggcctctccagtccaaagctgctcctgccttttggcagcttgtacaggctcagctcctccctcacggtggcctctttcggcccaactcatgcctcttgcaacctgcccaagtgtcagctcctgcctcacactggcctgttgaggcccagcttatgcctctcgtggcctcaacaggcccattccctgcctgtcggcggcctctacaggcccggcctctacctcacagtgggctctccaggcccacctcttcctcaccgtggcctcctggggcaatgctcctccctctcgggagcctctgcgggcccagctcctgccagtggcctctgtaggccaagcccatgcctcagggcagcctttccaggcctagtgtttgctgctttgcatcctctccaggccctggacttcctccagtcggcctctccaggcccagctcttcctctcggcggcctctgcaggcccagactgtcgtcaagtcagtctgtccagggccagctcctgcctcccggtggcctctgcaggcccaagtcgttctcaagtcggcttccccaggcccagctccggcctctcggcggcctctccgggtgcaaaagttcctcgagtcagcctctccaggcccagctcctcctgcctcccagtggcctctttcggcccagcccagctcatgcctcccagcggccttcccaggccccgcttttgactttcggtggcctctgcaggcctcgacaaggcctggcctcctgcctcccgaaggcctgcacaggcccagcctctgcctcacagcagactctccacgcccagctagctctcgcctcactgcagcctcccaagtccaaagctcctgcctctcggccgcttcggcaggcccagctcccgcctgccagtggcctcttcaggcccatggggctcattcctcacaacggcctttccaggcccagtttttcccttccggcggcctctccgggcccagaacctcctcaagtcggcctctccagacccacttgcaccctccgggtgtcctctctgggcccagctcttcttcctggttgcgtctccaggcccgactcctgcctctcaacaacctctttggactcagtgcctacccatctcctggcggccttggtcggcccacagcttcctgaagccaagctccccaggcccaggtcaggcctcacggtggcctctccaggctcagctcctgccctccgatggcatctgcaggccccaaacggcctccggtcggtgggctcctctaggcccagcttgggcctcccggcggcctctgcaggcccaagtcgtcctcaagtcggcctggaattgggcctggaagagcagcaagtcggcctccccgggcccagctccgtcctctcggcggcctctccaggtgcaaaacttcctcgagtcagcctctccaggcccagctcctcctgcctcccagtggcctctttcagcccagcccagctcatggctctcagcggccttcccaggtcccgcttttgacttttggcagcctcttcaggcccagaacttgacctccagtcggcctttgcagtcccggcctcctgcctcccgaaggcctgcacgggcccggcctcggcctcggcctcacagcggactctccacgcccagctagctctcgcctcactgcggcctccccagtccaaagctcctgcctttcggccgcttctgcaggcccagctcccgcctgccagtggcctctttaggcccagcttattcctcacaacggcctttccaggccccgtttttcacttctggcagcctcttggactctaatttttttatcttttgtgtataaatcccaaaatatggaattttggaatatttccatcattatataaatattttggtaggtaatttatttggagtgagtttctgcaccaagcccgaattttttattttattttccttattatttggtgttaaacaggtttaatgacggtcatggcaactttctggcacaataaaaaatatccccg

SEQ ID NO: 2887 - DNA, 1124 bp, Homo sapiens
tgagaggatttctttatttcgcgttcagacccaacacactcggacaccttggggccctgtgagggctaagcagggtggtggcgtcagctcccggggaggccccactccctggggaggaaatacacggcagggggccgcacccagccccccacggagggacccgtgttgctctaacagggacactgaagttgcctctgccgccccgtgaggggcctgtggcggccccagacccagcccagccaggccagaggagcctcccaggggccctcaggtggtgaggtgggggcttcccggccccggtgcccaccggcccttctagctgcctgtgctgggccaggtgtcctctgaggccggcaggagtctggcccccgctgcacctgcgcttggtggctggcaggggcggggtagggaggtcaccctcgaggccggggtccccatgtgctaggggaagacctgccttcccagccagtgtccacagggcagcaattccacgctctgaggctcagggaccaaggcagggctgggcatggggctcagggccttggaggtttttctcagctctcaacatcacagcacagggcccgtgagtcaccccagtcctctgggcctgtgtacccaagccggatgcaggccggggagtgcacgtggggctcctctgtggcgccagtgtgaagctgctctccggggcggtcgcagcctccaaaccctggtgctacgagtccgtgcctcaggcccagggaccacaggccgtctgctcatggctgaaaatgaggccaagcagctcccaagtctcgaagactccactggtgtggaggcagaggggcccttccagggcagggcagccctcggggcagcagcaggggcaagggctctgtctcacgcacacgggcacaggcacgcaggtgccggccctgccgctggctcccaagaggccgatagcccggtagggaggtcacacacacacagctgatccctggaggtaaagaaacctagacgaggagagtggaggctgggcctgcgcaaggaggcgccaaggggggagaccactgcccacaacagggtcagtcccgcgagagggtcagttccgcgcctgccgcctgcccgcccagctgcagggtgctcgc

SEQ ID NO: 2888 - DNA, 5986 bp, Homo sapiens
agtcccttcccacccctcttgcttgtcttacttgtcttatttattctccaacagcactccaggcagcccttgtccacgggctctccttgcatcagccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgaggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatcggcagactaggatggaagtgccctgtgagctggggggcccttcaaagggccaaggagaaaacgcaggccgagggaccagccttccaaatgggcttcaagctccaatgacctccgctcgccccctcgaaatgtctggaaaacataatgggcagattttctgtcttcaaagtttccggctaaacctcttcaagttctttattgtttgggactgagacactcagccatgttaatgggtagtttcttttgtatttgccttgaaaggccaaaatatttttatattgccacagacaaagccacctatttaaaaatgaactccatgtccgtcgtttcccaccaggagactatgtaccatgtgtgtgtctctatgtattctggggtcttgaaacaggtttctcatggggatggtcattcaccacggtccagaggggcagaacaggcggcgcttgccttgcccagggggcctggggaacgtgggccctcatctcagatctgcccccagtatgtttaggacgcgagccccagaaggatctgggagtaaacttaacattcactgtgtctctgctctgcatccgccatttgtgtgtgtttctggactgtgggctgtgtgtaccttggttggtgactcagtgagaagaagcaggaatgccaaagatactgtgaatgttctgagttttgttgctgttgttgttgagaggttgtttcactggtatctattgcattgtataataaatgaccagatgaatgaatgagtgaagcaagagagaatgaataaacaagtaaataggtaaagaagtaagcaagccaggatgagagtgtgtgtacacaagaccatggttcatccgctttgatggctaggcaatcaatatataaatagaaaaaaaccagtgaatcactaagtaatagggcaacacacaaagcgatatcaggtgattatggactaaggggtatgtgtaactcaaatatatgcctctgacatttgacaatgaaaaagaacctaaatgaaagaaagaatggatgtatgagtagtgaagtgcagaatgagacatagattttgaggcccgtcaaaatgaaaagatgcaagttagggaacaagtgatcaaaagggagaagggaaaggttttttttaaaaaaccaaaacaacaaagaaaggttaaaaaaaaaaacagactagaggatgagtaatgagtaactctgtaaggaggaccatgtcagactattgtaagctaagcattaggactgatacaaataatatatgctcctggcatagaaaaataaaccacagagaacgagttcaaagaatagcaaagaaagaaagaggacccagtgggcgaaagatgagagtgtacttttaccaaaagttatctaagcctgagcacttgaagtctgcacataaataaataaatgacaaaagaaagaaaaaaaggccaaaaagtctacattgcgtgtgtggatggatgaatgagcagtgggagtgcagcgccaggtgacaagatgttgtgaggggttttgagtcatccagtcctgggcactgaggtctgttagatgaaaggatatgagaaaggtaatattggtaaataaagaaataggaaacaatgtaacaaatgttaagtacagaaatacattaatgggtggtaaataaagatgtaaaagaaggcaatgcgatcgatggtggcaaaagatcatcacagattaagggctatggctggtccacttctagaaaaccacaggctgtccattaaataatgaacatctaagtgaacaagtcagtgagtacctaaatagacaaggatgaggtgaatgagaagacatggccccatgggtcctcctgatgagggtgttggggtcccccctgggcaccccagctgcatgaaaatgaaggacaggaggtatggaaagctatgacagaagagagaaaggaacggtaaaaagaaataacaaccaaatggataaatgggtagatccacgagaagagttaggctaggacttgtcataagggcacctgactccactaatagaggaataaatgcctaataaaaagagagcaagcaggaaggaaggatgctatgaatgcaggaaggaagtaatgagtgagacgtggaaccgcacggccaaggatggacgtttgcgggtggctttttgatgcgtacagccaagccactccatggcaatgagctccgaagacaaagtgcaagagagaatgagtgagagagtgagagagagagaaacaataaaaaatgggaagaaatgtaaaaaggaagaaaggaagagaggtaatatattaaggaataaatacatgcatgcagatttaagacagagccatgctagaacaggaatgaaaggctgtgtgaaccaagcagaccgcttaattggcaccagtgctgctggtatggtcaatcacctactcaactaaggaacggctcaaagcatacacatgggagggaggagtggggccacagagagagggcccattagttgcagattacgatgtatccagttaggtgcacctgccttcgagaagtgtaaaaataagtatttacatagaaagaaagactgaatggatgcacggtgaatgcatgaatgattgaacgacagaaaagatttgcattgaccgatgaggagggcattgtagacagggatgagggtcattgatcctgggtgcagatctccaaaagaatgacagaaagaaagagggagtggtggaaagaaacaataggatgggaaaaaatgaaaatagaaaaaaggaagtgaaagagataataaataattagatcaaataagttgatgaaaggggactggtttagcacaagccatccacattaattcaaacctgtggctctgaagtttgttttttaaatgaccacaagtgtaagactgaatgaaagaataaatgcgtgcattccataggatgcaagaaaaggagtgaggaatgggaaaattggaagaacgagagagggagagatgtaagaaaagaaaggaaaagtgaagtaggcatatgaaagaaaaggcacttcttggacaagcactgaaatataatgagacagttttacccattaaatataataaacagtaaacgttgaggttcatcaataaaagcacagatacctgaatagaggagtgacctgaatagaattcgttcagccgaacgaatgagaatggatgattttcactatcctgtgcactcaaggcccaaaagagaaagcaagagaggagagaatatggaaacgtatgacaggatgtatataagcaatacaaacatattgaatgaataaataaagacataaatatgtgggagagtggaccacgcaaggacaaaaagaggagagaaggcagcaagaattatgactaattcaaaactgggttcctgagatagttaaataaatcctgcaccaaatccccagggggagaaattaacaaacaaaagacagccccacacggaccagtgtgcagaaggctccaggaaccgcagattatggttaatccaattctgtgcacctgaggtccataaataaaagaataagtattgaaatgaaagaatgacagaaagaatgaatggacacatgaacgactgaattagaaatggaaatgcctggcacagccaggaaggagctgcccatgggattgtcattcatctcactctgggcacctgaggtccataagcgtgaaaagaggcaggaagagaagtgtcagggagtcaaagatagagctaaggaaaggcaaaaatgaaactaaatgaaagcgaaagggaaaataaagaaaaaccaataaaaaagagaacgaatacgtgggtgtatctgtaagagtaggatctgttaggattagtcataagactgtcagtaatcctgaagatggatgagataatccaggcccaggttcccagggggagggaaaatggagaaaatataaaaagatgtgaaaaaggaaaaaggaaaggtaataaacaaacaaccaaagtgataaatggatagttaagggaggttgtctgaacagggattataattagtttacatacatactccttaaacagataaatacattacacctttcaaagaataaatgaaaaatagagagacatacctggctccaaaacaaggctgtatcttctgccactgtaataaaatagatgcaattgaggttcataaataaaagaataaatacttaaacgtgaaaggtgactaaatgcggggaagaaagattgcaaataaatacatgggccaaagatgtttggtttgcccatggagttttaattaaaaaaattaataaggaaaacaaatacccaaaataaggaagactgacaaatgagtgagtggatgagagagtgaatggtgcttgacgtaggagcagtagtgctttagggaccagcatgaaggtggtgaccgggagccctgattcatgggattctgtccacctgactttataagaaccaagaatggctgggaatggtggctcacgcctgtaatccc

SEQ ID NO: 2889 - DNA, 1804 bp, Homo sapiens
cccactccaggggccaggcacagtggcttatgcctgtaatcccagcactctgggaggccaaggtgggcagataacttgaggtcaggagttcgagaccaggtgatccgcccgtctcggcctcccaaagtgctgggattacaggcgtgagccaccgcgcccggccggtcgttgggattttaacagccctgaggcccctcacgctgccaggtgccagcccaccctgcagccctgctcccctgcccacacgcagaagccaccagaggcttctggactgagcccccactgtcctgcagccgggctggcctgtccacaccacagggcgtgctcagctactgagcagaagcgtcacggacagggcagatcaggccaggacaaagctcttccgccacaggcgggggtctgaaggcatctcagagggcccccaaacaagggacgctgcctggaaaccccgggacaagatgacctcggttcagatcttagcaccttctggcaaccttagagaaagcttctggagggaggggctggttcccaggatgggcagaagccggaaagtctcagactgagtgaccctcgggggcttcagaaggcactgggtgggctctgccagagtgagaaggcagctgatggctgctggagccagccccgggagtgggggtccagctatggtctggagagggggacttgagggttgcagtggccacacagacggggcacaggagccaaaggaagggacacagcaaagcccaagggtaaaacggcgcgccgtggactggtctgagggcagaggctgtaggggagcgaggggcggtgtggctgacaggtggacacagggacacgtgtcctgtggacttggccgctcagtgggggtgtgtcccccagcagtggcgtgtgagggatggtcactctgatgggacactgaccacttggcctccagcaagatctaggcccaagtctaggctgaagccgcccactcagccccgggacatcgtccccggcagctctgctgagcacgccagctccggcactctccgggagtcatggccggaagtcaactgtcctggcttccagggccacaccttggccaggcctggtgatggtcatttccagccgctccagttgggctgatggggccacatgaggccggggatagaaggtggctgcgctcagacacccctcccggccccactggatgcccagggcgctgacctgcaggactcggatgggttttctcctgccacccctgcctggccggccaccatcccagcgccagcgccctcctgagaggtgcaggggccgcgtggggcctcccagagtggcaggttggcagcctgcacgccggtgacggcgtccttctccgtggtgaggcttggtccctcctcgccagaaacaccaattctctgacgtgagctgcacatccactgcccagccatgtttactcttctgcctcctgtagacgcagccgcggcggctctccctggcaggccacccgccgtcctgccttttctccgggtcaggccgcctgtctgccgggctccacgatgagcgcgttctcaagctgagcaggcgccagaatcccatagagaggcttgttgagacacagcttccccacccccagctcggacgcaggggcctggcgtggcctcctcacgggcacggtgtggaaacaccactggcggttaccgtggtctgccgggtgcatgagcccctggggtggccccgtcccttgtttctgaccagccggatcctctccagcggcaggagcagagagggcccggaggtccagacggtgctctctgcggccagc

SEQ ID NO: 2890 - DNA, 677 bp, Homo sapiens
cttccggacgcgggctcgcgcctcccgggcgcacctcggggcccgcgggccgagtgtcgctaggacgttttccgcaggcctagcaggcggaccccgcggctcggagcaagcggtgcaggtaagcgggcccgggcaccgctcggcatctcagggcccctgcggccctcccggctcggcacggcgggtcccgcggtctccgcgagaagcacctccttcgacggccaagggccccggcggcgactggagagagggctctgcaagggctccgcagcctgctccgggacaaagaaaagagcttttgtttctctccagccggtggggcttctgctgcataaatcagcttagcgaagagccaaacacaatcaaacccaaacaaagcccgaagctgggggggaaaccaccctaatgtacattcactgggtgatgctggatctgtgggaggggacgccggcgaggtcgaggggaaaaaagtctgtggcgcatcaatcagcgcagttgcttccacaggtgggcagggaggccaacaccattagttgcagctttgcagccccgtctgcggagcagcgggcaaagacaagtcggcagcgtcctggctggcaagggaggaagctcgggatgccagcaacagggggaggcggctctgggagcgccctagaagcacccgccgacacccgcag

SEQ ID NO: 2891 - DNA, 6767 bp, Homo sapiens
gctgaatagctgagaggcgcacccgggcggccagctgggctcggagtgcagcggggttaggatggacgaggacgtgttgcaccctgaagagcctcatcatcggtgagagtggggtgggcaagtccagcctgctcttgaggttcacagatgatacctttgatccagaacttgcagcaacaatagacaatgcaggaatcacatgaacctgtccatccacagataaagtggtaaagaaactgccgtattagatacatgatggtatactcttcagccataaagcttcgggaaaccctgtcatccgcaaccacgtggagaaacctgtccatccacagatgaagggatcaggaagctctggtatatatactgaagggaaatgctttttggctaccaaaataatgaaattttgttgtttggagcaacacagatgaacctgtccatccacaaatgaagacatcaagaaactctagtatgtacacaaggcaaaacacttcagctatcaaaatcatgacattatgtcacttggagcaacacagttgacccgccaaggcagcctcttcctccatagatggatgaacgctgtggccgctgctcctgcctgggccatgccctgatgctgccaacaccactgctcctctatttataagtcttagtagagttgctgacccagcaataactgaacagctgatatgtacctcacactaagccaggcgcttcatatgtatctaacttgaaaaatgctgagctagttaccttaacaccattaacttttacttaaaagtttgtttttcttttttaatcccagtgagctccaaacaagttttaggaggctccccaaaaccagtgaagactttaactaaaagtagaatttcaaagtattagaaaccaaaccccaaaattaaatgtgaagatcagtgtctgtactgagctggcccatctggtggacacaggatttgcgttatcgactgcaatgttacccaggattcacgatttctagcatctgtcagggttaagaaaattggattgagtaccaaatacagcagagcaaacccggctttgaggcaagggccccatcaagtagtcatgcagtacttttgttagggttctgggtgcaaatcttcctcgtccctcccaccttctcctggcctccttgtaaacccaaaccgccaggtacctcaattttcttcaagaccaggctgttcttaatgttggtaaattggtcaaggaaatgggtgagccactgcttgctctgcacatcgtcctcagagtgctcggtcttcaggcagtacagcagctgcatggctttggcctgcaggagtaagtggcccattcctaggctgtccccaaagatgtgtcctctgaagaagctggtcaggtagagggggtgtccactatggttatagatggggaaggagatgctgcccaggtcgagcgttttgtccacctgccaggtgtacaggagtgggttgggggcaccacgcagagcatcttgtacctcgcgcacacctgctggtactggagctggcttgcgtttccctgtgccacacgcagatcctgcactgtactgtccagtcaactgacttcagcaaagatgtctgggttcagcagcgagttgctgtgtgaggccaccagaatggaggtgatatcggcctcagtgctcatcctggaggtggagaagtggtcagagtcctctgtggtgaaatggccctacaccaaagtgggagacattcagaatcgaggcgaaattggcctcagtgctcctcttggaggcagagaagcagtaggagtcggtggtgaaatggccctgtgtgaatgtggaagaccagcagattggaggtggaattggcctcagtgcttgtcctggaggtggagaagcggtcagagtccttggtggtgaagtggccctgcacaaaacgttgctcccccttggccggtgaaagaataaaagaaagctggccacttgcatttccgtttcagtttatagaatacatgttttggaaatagtatcttctagatctgtctttttctcttctgatttaacttagtaaagctaagttttatctcttcatagtcttgcttttgtttcaaaagcttttatgagatttgtttactgtctgtggctatatggcagacaatttgttcaagtggcatgcctcctctttctcacattgacctcctcaggaggagtttttcaagggcaatgagtcttctctctgagataagaatagtagccagaattaagagggtaaagtgcattgtggaattaagtactgattccagtggaaactcactttatggccttagacaaatatttacccttctgatcctcagttttctgtcaaagaacttctgctcatatccaattcctataaagtgggagtactctaacctgatattaccaacattaggttagattttatcctaatgttaggtattagaatatatcctaacattactagttcttcactcttactaaagtgcatgttagatttcttcaatgatttttttaaattggcatggttgatacaaagcatccttctatccaaatactgtgctcagtcgcctaagtgatagtttagaaccatactatctctctgtggaaagaatgctggggctcctggctacacactttgagtagaagggaaaatacccctcttgtatttatgatgttttttctttctacttgattaagaagaaagtacaaaaaggtgcttattgaagcattgtcaatttgggaacaagattctcaggaatgaaatatttgtgactgttctcagcatgaaaggtagagagaagattacttgatcattatgtgcttatttgaaagtcactttcctcccatgcctcaacatctcactttttagaatgcacactgaatgcctggaatctctttgttttagaaaagacaaagatgcattgttaaaaaaataatatttctggggaaaaggctcagtgctcaacggttactctataaagagatttaaaaagaaagtcaagggaagataaggaaggtagcatggctaacaacctcgtgggttctactagcattatttcatgcaaaatgtcattaacctttatataggagagaataagtctgggaatcaactggcatctaaactccatttcttgttttgtcactgcttccctggttgactatggaaaatacatttggtcttttgataccttggtttcaacaactataacatgacttaagaacttttatgcatggactttgtaatagttatctatttctgcatacaaattacttcaaaacttaaatcgtcgtttgaaacaacaaacactatctcacagtttctgtgggtcaggagtccagacatggcttattgggtaaccgcctcaaagtcttactaggctgtaatacagttattggctagagctgctgtttcatctgaaggttcaattgagagaggatccacttctaagctcactcacatggttgctggcacaattcaattcctctcaggctattggattaagggtctcagttccctactgactgttggtcagtgaactttcctcagttctttgccatatggggatccatagaacagctcactacatggcaactggcttctatcaaagtgagcaataaggaagtaagcaagagaggtttgcaagacaaaagctactatctctttataatctaatctcagaagtagcatcatatcccttctgccatattctgttcattagaagtaaatctctgggtctagccatactctattgcagagatcacacaagggtgtgaatacagacacagggattgttggggctcatcttagaggtcgtctcccatagagttagctgccaatctgaggggtcacagggacccatgcatctgggccagaacactgggatttcatcccttaagcaggacaacattcattcagaaacatatatatatgtttatatgtttctcactaatcaaagagagaagcaaggcctgtccctgacgagctccctttctcagatccgccctgaactgcctaagttaaatccatgtaccttgactaggtgaaccatagagtccaagcctagagttgggtcctgggtttaatcctggttctgtcttagccctatgaccttaggccacttctcttcggcttggttttctttgcatcaggaagtgtcggattagatcccaacaatggttctcaaattggagtgcctgtgaaaatcacctggggtcatttgaaaaattcctgatgcctagcacacccctgacaaattaaatcagaagatctgagggtgagattcaggcaagaggacttcttaacagctccccaagtgatttcattgttcagccaaggttgataactactcatttagaagattggtaatcctaactctggtacatgggaactatctgaggagctttaaaaacaaatacagaagccagaatcttaggacaattaaaatagaaatccctgggggttggtcccagacatggtgtctttcaaagctccccagatgattctaatgtgtagccagatttgtggaccctcaggtttaatgatcttcaagaatcctctatctaaggttctaagcttgtccgaatggacttgtagagctataagcacgtgtaccaccttctcaggaaggtggccgctccaatgctctctgactctaaagaatgaaatgattattcccacccgaacatccatcttctctgggtttaccgtcccctacttacagtccgtaaaaaggtcaccctagacttgacctcagtctcattgtgacacacacagcacgccagcgttcttaacctttttggttacagagacccttttagaaacttcatgaaaattgtaagtcatctcataaggaggatcttacatgcacatcaaattgagcatacaattttcatggatccctaaactcttgatacaaagttaattctatctcactataatataaaagtcaaaaacttacataacccagaaaagcagaatttgcaacatagtagaaatagaccagagtgaaagttctaatcctggttccacaactcaccagtcaacatttaggagtcactgaatcacttgatgcctcagtttactcatatgcccaattaagaattataaaatcatgcaccacataatgtcttggtcaagtacagatcacatatgacgatggtttcataagataatactgtgtttttactgtacctttgtcactgtgtttagatacacaaatacttacattatgttactattgcctatggtattgagtatagtaacctgctgtacagatctatagcctaggagcaataggctataccatacagcataggtgtgtcacaggctctcccaccttggtttgtgtaagtacactctgtgatgtttgcacacaacgaaatcgcctgatgacacaatgctcagaatgtgtctccatcattaagagatacatgactacctaccccatcaatcttgcctattccagaaacaaagtgaaattaataatataaaattggtttgatcaatttatgaattacattgtcattgaaagtaggagaactagaccaggaggcactggtgtgaccctggagtagatggaactgtttgtgcatgtgtctttcttaccttccattctcataaagaattagcacattccccacatacaccctggccagaccgtgtctttgggactgcagcactaaggtgtgtttttgtttgttaacttattcccagtgcctgtgttgaccaggaggctttgggaataaaggtacataaaggtcttggagcctggatgagcctgtggtcaagagatggcaggcagtgtccttgaatttggaatgtgactcacactctgcctgtaggggaagaaaagagagatcagactgttactgtgtctatgtagaaagggaagacagaagagactgcattttgaaaaagacctgcactttaaacaattgctttgctgagatgttgttaatttgtagctttgccccagccactttgccccagccactttgacccaacctggagctcacaaaaacatgtgttgtatgaaatcaaggtttaaggaatctagggctgtacaggacgtgccttgttaacaaaatgtttacaagtagtatacttggtaaaagtcatcgccattctctagtctcaataaaccaggggaacaatgcactgtggaaagccgcagggacctctgcccttgaaagcgggatattgtccaaggtttctccccatgtcatagcctgaaatatgggctcctgggatgagaaagacctgaccgtcccccagcctgacacccttaaagggtctgtgctgaggtggattagtaaaagaggaaagcctcttgcagttgagatagaggaaggccactgtctcctgtctgcccctgggaactgaatgtctcggtataaaacccgattgtacatttgttcaattctgagataggagaaaaaccgccctatggtgggaggtgagacatgtttgcagcaatgctgctttgttattctttactccactgagatgtttgggtggagagaaacataaatctggcttacgtgcacatccagtcatagtactttcccttgaacttaattatgacatagattcttttgctcacatgttttttgctgaccttctccttattatcaccctgctctcctgctacattcctttttgctgaaataatgaaaataataatcaataaaaactgagggaactcagaggccggtgccagtgcaggtccttggtgtgctgtgtgccggtcccctgggcccactgttgtttctctat

SEQ ID NO: 2892 - DNA, 2342 bp, Homo sapiens
gatataaaaatcctaaataaaatacaagcaaataaacttcaggaatatattttttgaagtgtgaccaggtagttttatccaacaaatataaagaaagatgctcaaatataaaaataatagagaaatactacatgactttttcaatagggatgaggaccaagaaatgaaataagaacagatttagaaaaaacagaaaatggggagaaaaaaaaacagaaaatggggagagaaaaatatgcttctcacaataaggtaaggtcatttcacagctatgggctgagtttattataagcccattcctggactcatttcattttcatttatgcacacattgcgttgagctgcattgtttgaaacacagcttcaggatcaggccaagcaaccaaagacgcatttgaaatgcatttcccattttctaaggcccaggccccctgacagcccgagtcacttagtactgacctgttttcaactagcattaatgttttaagaaagtttgcaaatttgtgctgggccaggggttggacaagtttgaataagtcaaatcttgtctatctatcatgcacactgcccttttacttcccttcatggccctagcaagcatcttccaacaaccctactcccctctcccagcaaacatgagggccccagctctcacttcaacatagaagagtagatgtcagcacctactgcaacagcgactcatggatgctgacaaccccactgttgactccaatctctggtggctaggagcctgcctagctggcagctcagagatctcagggtgcatccaccagggaaggattgggagaaaaatcggacaatgcctgcagggcctgtggacagacagccagacagaaaggcctccggaggagcagacacaagggtgaggagaggagatgtggcaccaggagtcaccaatgggaagcccagcttgctgcctaaagggaagctggacaaactgctctctggaggctactgaatacccccaggagaccgtgatgctagcttctccttttccctgctcgagacctccaggcaatgccagagaggcctttctgggtcaggggtgggcaaatggatacaggggcaacccccagatcatcctcctacctctgctgagctctcagggtgctccagggagtcagcagggctcacggtggggtgaagcttatcacctactctcctctgctctgccacccatttgctgtagaccaagtatcaattactgtctctgtgccacatttccctcatgggtaagataaacttggtcctcccaggagctctttcaacagtaccactatgaccctcccattttcccccaatcatgccttgtccttctcagcatcctcaccaacagtcagacatacgcagcttctaattccaatccaaccagagcacccatgtggccttgtagctagtctcctacctgcactggcctctacctccatatctgcaaaatgagcatgacaatacggtcctttgcagggctgccaagacgagggggaaatggcagccactcactgagcagaagctactgctgggactcggtgaccactgaccattctggcgtacagccacattgcttagcaggacagctctggctgcctgagatgccttgcctcctttcaccagcactaaaatccactccatctgatatggttaggctttgtgtccccacccaaatctcatctcgaattgtagttcccattatccccacccgttgtgggagggacctggtgggaggtaatttaatcatgggggcggttcccctcatgctgttcttgtgatagtgaatgagttctcacaagatctgatggttttataaggggcttttccctcttctgctcagcacttcttgctgctgacatttgaagaacgagtttgcttccccttccaccatgattataagtttcctgaggcctccccagccatgctgaactgccagtcaattaaacctctttcctttataaattacccagtcttaggtatgtctttattagcagcatgagcacagattaacacggcactcttgacagcaaatctcaagccctgcctccaccctggggcttgataactcccataggactcaatggggaatcagcctccacacctgtggtgaactagttgcttctgtggggtggctcctgtcttagataccttctcccaagcctctcataccgcaggcatgcaatagacagcagggaagagctgttgagtgaaatggacacactgtgtgaataacactcttggccacccacactagcatgtgatgtattgtatggcattccttgtctttgatgctggtttttccttcccttgatggaatctcagtgtcattttcc

SEQ ID NO: 2893 - DNA, 30388 bp, Homo sapiens
gtcagcaggcgacgctgggaggctggggtaggcccagagcgaggacgggcccggactgggtagtggggatgtaccagggccgggtgcggcgggagacggcccgggaggcggaaggtcgcggacctgcccgacagaagagtagatgaggggagaccgaggacgcccgggtccggggagcttacgaggaggccaggatcgcgggattgacatacgtggtgtcagaagtgagacctgaagaaaagttcactattgaaaggaatcagctatgcttggaaccagtttgcagagtactcacttgaactctttgagctctccacttccacagcttgccttttctggcttggtgagtcttctctcaggttgagcctccctccttcaggtagaagcttttttactttatttgggatctggtgtggataaggcaatcttaataaaagatcttgtgtaccttctgggactataaaaggtttttttgtgtgtgtcttttctggtataaagataagcatctttctgaattgaggactcttggtttctacagaatttacattctgtctgtgaggcatgtcttccctggtttgcatgcctagtttaatatttcatttgttctgcacaactgggttaaaatgttggcaaaaactcttatcttgatctatttttatttggtttgactctttcttcttgcttgtttctgaaaatcttccaagagccgaaacaaactttttttttttttttttttttttttttgagatggagtctcactctttcgcccaggctagagtgcagtggccaatctcggctcactgcaagctccgccccctgggttcacaccactctcctgcctcagcctcccgagtagctgggactacaggcacctgccaccgcacctggctaattttttttttgtatttttagtagagacggggtttcaccatattggccaggattgtctcgatctcctgacctcatgatctgcctgcctcggcctcccaaagtgctgggattacaggcgtgagccaccgcgcccggccaaaccaaaacaaacattcttggcggtgggtgcaggacagctaattaaacatcactagagtggttgcctcagctaaaacaatagtctaaactcctgatattccctgaaaggatttgtagagtattctttgctctcaagaaattaataagaaatggaatgatcttttcaaacattaaggcaggcaaggttttctgggactctcaggctggtcttgagcctcaagcaatactcccacctcagcctcccaatgtgctagaattataggcgtaagtcatcatgcctggccccatttcttaaggtaattttgtttgaagcttttcagatttatatctaagaagttcaacttttgctgtacttcactgtatgagatgtgcagagcatacatcatggcctctgttatttctctccttgaaaaggtatatctttttgcttggctggagtgataactctgtccttcaactgtttcatcaactcctataacattttttctctggttccaactctgctgttgtggcctgacgctgacatgtttgtcttgaaggtgtacaaaagcaatgtttttctacagagtaacttgattctctagtcttggcttttcttgatgtgtctgaattgttccatgtaaccaggaaactccccatgctttttctgagatccagctatttttctattcaatgtactagtttttttgtttatattcctttataatgtagcgtacattcaagatgctggtcacattcttcctgtgtctacttaattcaaataccgttttcatcaagtttaacttccaggttatgtaaacaggcttcccctaaggagaagcaattacactgtaggaaatttttcttttcttttttggtaactgggctttaaagagacaaaacaaagatcttagtttagtttagctttttgagatggggtcttgctctgtcgaccaggctggttttgaactcctggccttaaatgatccttccatttcagcaagactttacattttatcaagataattcatatattatctttattgggtttcaattagctggataactgagcttttaaagggttaggtttctacatccatgtaactttctgtattgcttttggtctttttattattattttgctgtgattctgttttaatcgaatgttttgaaccttttgacattattggccaatttccccaggatcagaatcctaagtctttttggcccaaaattaacattgggatttctagttggacccctgggaagcctcaaagaatatgtctctcatcttatagagatagtaaatgattcggcttatttggcaaattgcataggaggcgttgtgaaatgacaaatgatactagatattctttcagttacattatgggtatattattagtataaatgttccaaaaattatataaacataaaaatttaatatgttattagtcataattttgattattgtgttgaaacttttaagttatatttatatggatatgttattaatatgagtattataaagattatataaaatttggtcagatgcggtggctcacacctgtaatctcagcactttgggaggctgaggtgggcagatcacctgaggtcaggagtttgagataagcctggccaacatgatgaaaccccatctctattaaaaatatgaaaattggccgggtgcggtggctcacgcctgtaatcccagcactttgggaggcctaggcgggcagatcacgaggtcaagagatagagaccattctggccaatatggtgaaaccccatctatactaaaaatacaacaaaaaaattagccgggtgtggtggcaggcacctgtagtcccagctactcaggaggctgaggcaggagaatggcgtgaagccgggaggtggagcttgcagtgagccgagatcgcgccactgcactctggcctgggcgatagagcgagactctgcctcaaaaaaaaaataaatgaaaatgaaaattagccgagtgtggtggctggtgcctgtaatcccagctacttgggaggctgagacaggagaatcgcttaaacctaggaggcagaggttgtagtgagcagagatcgtgccattgcactccagcctgggtgacgagagtgaaactccatctcaaaaaataataaaataaaataaaatgtataggctgggagtggtggctcatgcctgtaatcccagcactttgggaggccaaggcgggcagatcacctgaggttgggagtttgagaccagcctggccaacatgaaactccatctctactaaaaatacaaaaattaaccaagcatggtggtgcgtgcctgtaatcccagctactcgggaggctgaggcaagagaatcgcttgaacccaggtggaggaggtggcagtgagccaagatcactccattacactccagcctgggcgacaagaacgaaactgtttcaaaaaaaaaaaaaatttataaaagtctaatggtcctgatatgacactgtcagtcatgatactgggttttcttttcttttcttttcttttcttttcttctttgagatgcagcctcgccctgtcacccaggctggagtgcgatggcgcgatctcggctcactgcaaactctgcctcctgggttcaaacgattctcctgcctcagcctccggagtagctgggattacaggtgtgcgccaacatgcccagctaatttttgtatttttagtagagacagggtttcaccatgttggccaggcaggtctggaacccctgacctcagatgatctgcctgccttgtcctcccaaattgctgggatcacaggcatgagccaccactccctgcctaacaagtactcttgaacacagatttctgataactttaagatcaatgaactaaataaaaatttccagaactctaataaagaaacggatgggtttggccaagtgtgttggctcacgcttgtaatcccaggactttgggaggccaaggcaggcagattgctggagcccaggagcttgagaccagcctgggtaacatggcaaaacctcgtctctcaaaaaaatacaaaaaattagctaggtatgatggtgtgagtttctagtaccagctacttggaaggctgaggtgggagaatcacctgagcctgtgaagttgaggctgcagtgagccatgattccaccactgcactcgagcctgggtgttagagtgaaaacctgtctcaaagaataaaagaagaaaagaaactgatgggttttatgaatcaagcaaaaagcaaaacaagacatcaattacatgaaatttaagtagttgataaatacaatgtttttatggcttttatttaagacgttgttggctctttactaaaatgttttgtttttcagatttaaggaattcttctctcataagctatctatagttgacagcaatttctgttttttttaattatactttaagttatagggtacacatgcacaacgtgcaggtttgttacatatgtatacatgtgccatgttggtgtgctgcacccattaactcgtcatttacattaggtatatctcctaatgctatccctcccccctccccccaccccacgacaagccccagtgtgtgatgttccccaccctgtgtccaagtgttctcactgttcaattcctacctatgagtgagaacatgcagtggttggttttctatccttgcgatagtttgctcagaatgatagtttccagcttcatccatgtccctacaaaggacgtgaactcatccttttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttataatctttgggtgtatacccagtaatgggatggctaggtcaaatggtatttctagtgtggaattgtcacactgtcttccacaatggttgaactagtttacagtcccaccaacagtgtaaaagtgatcctatttctgcacatcctctccagcacctgttatttcctgactttttaatgatcaccattctaactggtatgagatggtatctcattgtggttttgatttgcatttctctgatggcctatgatgatgagcatttttttatgtgtctgttggctgcataaatgtcttcttttgagaagtgtctgttcataccctttgcccactttttgatggggttgtttgattttttcttgtaaatttgtttaagttctttgtagattctggatattagccttttgtcagatgggtagattgtaaaaattttctcccattctgtaggttgccttttcactctgatggtagtttcttttgctatgcagaagctctttagtttaattagatcccatttgtcaattttgccttttgttgccattgcttttggtgttttagtcatgaagtccttgactttgtctgtggcctgaattgtattgcctaggttttcttctagggtttttatggttttaggtctaacatttaagcctttaatccatcttgaattaatttttgtataaggtgtaaggaagggatccagtttcagctttctacatatggctagccagttttcccagcatcatttattaaatagggaatccttaccccatttcttgtttttgtcaggtttgtcaaagatcagatggttgtagatgtgtggtgttatttctgagggctctgttcgttccactggtctatatctctgttttggtaccagtaccatgccgttttggttcctgtagccttgtagtatagtttgaagtcaggtagtgtgatgcctccagctttgttcttttggcttaggattgacttggcaatgcgggctcttttttggttccatatgaactttaaagtaatttttcccacttctgtgaagaaaatcattggtagcttgatggggatggcattgaatctataaattaccttgggcagtatggccattttcatgatattgattcttcctacccatgagcatggaatattcttccatttgtttgtgtcctcttatttttttgagcagtggtttgtagttctccttgaagaggtccttcacatcccttgtaagttggattcctaggtattttattctctttgaagcagttgtgaatgggagttcactcatgatttggctctctgtttgtctgttattgctgtataggaatgcttgtgatttttgcacattggatcctgagactttgctgaagttgtttatcagcttaaggagattttgggctgagacaatggggttttctaaatatacaatcatgtcatctgcaaacagggacaatttgccttcctctttttctaattgaataccctttatttctttctcctgcctgattgccctggccagaacttccgacactatgttgaataggagtggtgagagagggcatccctgtcttgtggcagttttcaaagggaatgcttccagtttttgccccttcagtatgatattggctgtgggtttgtcataaataactcttattattttgagatacgttccatcaatacctagtttattgagagtttttagcatgaagggctattgaattttgttgaaggccttttctgcatctattgagataatcatgtgttttttgtctttggttctgtttatatgatggattacatttattgatttgggtatgttgaaccagccttgcatcccagggatgaagtccacttgatcatggtggataagctttgtgatgtgctgctgaattcgttttgccagtattttattgaggatttttgcatcaatgttcatcagggatattggtctaaaattatctttttttgttgtgtctctgccctgctttggtatcaggatgatgctggcctcataaaatgagttagggaggattccctctttttctattgattggaatagtttcagaaggaatggtaccagctcctctttgtacctctgatagaatttggctgtgaatccatctggtcctggacttattttggttggtgggctattaattattgcctcaatttcagagcctgttattggtctattcagagattcaacttcttcctggtttagtcttgtgagggtgtatgtgtccaggaatttatccatgtcttctagatttcctaatttatttgcatagaggtgtttatagtattctttgatggtagtttgtatttctgtgggatcagtggtggtatcccctttatcattttttattgtgagttgacagcaatttcataaagtgtcctttttgaacaaagatggaagcatttgctttttctccctacttgattccttcaaaagttggaaactatttgtgagtattcttatttttatttttactttattttattattattattattattattttggagatggagtctcactctgttatctaggctggtgtgcagtggcaccatctcggctcactaccatctctgcctcctgggttcaagtgattatcccgactcagcttcctgagtagctgagattacagacacggaccatcatgcccagctaatgtttgtatttttagtagagacggggtttcaccacattcatcaggctagtcttgaactcatgacctcaggtgatccacctgcctcagcctcccaaagtgctgggactgcagacgtgagccaccacacccagtgtttttttttttttttgagatggagtctcggtctgtctctggagtgcagtggtgcgatctcagctcactgcaacctctacctcccaggttcaagtgattctcctgccgcagcctaccaagtagccggtattatatacatgcgccaccatgcctggctaatttttgtatttttagtagagacaggtttcacaatgtaggccaggctgtctcaaactcccaacctcaggcgatctgccctccttggcctcccaaagttctgggattacaggtgtgagccactgcacccagctgtattcttatttttatttaaataagttcaataaaaatctgctctctatataaggaggatacaattggaacactggttttactaccaaggctttgactgaaatgtcttaaaaatgtacatgaaatgcctggcttcaagaattcccagccttatagtgagtgaataaaaacagtcacttcccagcaggcccaagaacattataagtaaaatctaaagtctcctttgtttgccttcctcgccttaagaaatttttaaattggccaggcgccgtggctcacgcctgtaatcccagcacttggggaggccgaggcgggtggatcacgaggtcaggagatcgagaccatccaggctaacacggtgaaatcccgtctctactaaaaatgcaaaagattagccaggcatggtggcaggcgcctgtcatcccagctactcaggaggctgaggcaggagaatggcgtgaacccaggaggcggagcttgcagtaagccaagatcgcaccactgtactccagcctgggtaacacagtgggactccatctcaaaaaaaaaaaaagaaaagaaatttttaaatctgagattcatgtatgctcaatatagagataaaaatttatgtttctaaagagaaactataatacatcttttgttatgtagtagccctgtgccttacttccaagttcttgttatctgcctgtagactggagtaggtcctgaagcctcctactttctccaatatttggctgcagctttcaccctcaaaatgaaagctgctctattcctaaagtcctataagctaacattagattaattttaaggaacaagcctcatgcttggtgtgtgtgccacgcaaaaagttcaccaaactgcccaatgtcatgaccaaagacatccaaattacaaacccagagaagttaatgttttcacactgtaaacagcttttcccaagatgttggaacaaggctccatgtcacaatgagaattttatcctccttaatgctaccttgtttacttcgcaggataatggtgtaacagaaactttgccatcaataccttcttgctggtaacttaacaaactctaacctaaaaaaatcctttaggagccattgattaaatttttaaaaagtctgtgctattgctaatactacatgctgtatctaagtaaattatctgggaaaattgagacccatgtacacaaaataaacaatcaagccacgtagttacaacagatctcacctaattctctctggtctttgatttattcagctgtttgtcttaaaaataattatttctaattgttatgagtaagtaataatgtatatatttgtggggtacttgtgatgttttgatacagacacaaaatgtgtaatgaccaaattagtgtaatcaaggtaaccatcagctcaagcatttgtcatttatttgtgttaagaatagtccaatttggctgggtgtggtggctcacgcctgtaatccgagcactttgagaggctgaggcaggcgtatcacaaggtcaagagatggagaccatcctggccaacatggtgaaaccgtgtctctactaaaaatacaaatattagttgggtgtagtggcacatgcctgtaatcccagctactcgggaggctgaggcaggagaataacttgaacgcgggaggtggaggttgcagtgagctgagatcacatcactgcactccagcctggtgacagagtgagactctgtctcaaaaaagaatagaaaagaatagtccaattccactgttttagttattttgaaatatacaataaattgttgttaactatagtcatccgattttggttccaaatactgatcttattcattacatacaactgtattttagtgccattagccatccccactttatccctgcctcctcactacccttccaagcctctggcaaccaccattccactctttatcaccatgagattgattttttttagcttccacagatgagtgagaacatgtgatatttgtctttctgtgcccagcttatttcacttaacatgatgtcttccagttccatcaatgttgttgcaaatgacaatattttgttcttttttgtggctgaatagtattctactgtatgtatatgcaacacattttctttatccatttgtagtagtcagtcttctctagagggacagaactaataaaatatatatatatatatataaaggggagtttattaagtattaacttacatgatcacagcgttccacaataggctctctgcaagctgaggagcaaggagagccagtccaagtcccaaaactgaagaacttggagtccagtgttcaagggcaggaagcatccagcacgggagaaagatgtaggctgggaggctaggccagtctctccttttcatgtttttcttcctggttcatatttgctggcagctgattagactgtgcccaccagattaagggtgaatctgctttccctagcccactgactcaaatgttaatctcttttggcaacaccctcgcagatacacccaggatcaatattttgtatccttcaatctgaaaagttgatgctcagtattaaccatcacaagtctactcctagtcaacttgaactgatacacatctcctgagatcacacatagtcttcaaataaagacaataataaggtcacaattacgcctaacacaatacaactatccttcgtacaacgggaaacgtaccaatccccaaatactattacataaagttaacaatatttaaatgctgatatgaagtcaataaatcttatgtcacatgataaaggaaaaggaaataaaataaagatattttcttagtacaagtttatacatgcacaaacatgttttcagcaaaagaagaaggaaatactcatgacaattacagtccctatttctgcacctagtcacttcgtcgtagctggtattgatgactaccttcttctactagccattctgtgttccctttgccttcagcaagcacctcagcaggttgtgggttttttcctggtggagtgacccaaaccttcattcctgaggggtctgggccatttgtagtcctgcctggattgggctgttgtagttttccattgaccttaatcacaggacatggtaatactaagagatgtcctaatggatctcctgtattccatgcattctcttccttacctccattgtgaagtagtagactgatttcatcttgatagtctgggtcaatcaccacagccaaaactttaactcccttcttagcctgttgacttaaaggtaggaggagcgcaaagtgtccaggtggcaatcttaacttccagtttaatggaatcgttgttgtgtctcctggtggcagtgtttcttcctctggaactaagacctctaggccagcagaacataatgttccaggagcaggaagcaaaaattttgctagtggatcactaggggtgatggtgaatggtgccacttccactctcaccccttgattcctggacccatgaatcctggctatgggagaaacagtaccatatattggatgctgattcagagcatacatggtcttctggagaactttgccccagccctgcaaagtattgtcacctagttggcattgtaattgtgacttcaaaaggccattccaccgttctatcaatccagctgcttcaggatgatggggaacatggtaaaaccagtgaattccattgagcatgagcccactggttcccttctttagccgtaaagtgagtgccttggtcagaggcaatgttgtgtgaaataccatgacagcggataaggcattccatgagtccacagatggtagtcttggcagaagcattgtgtgcaggataggcaaacccatatccggagaaagtgtctattccagtgaggacaaacctctgccttttccatgatgaaagaagtccagtataatcaacctgccaccaggtagcttgctgatcaccccgaggaatggtgccacatagagggctcagtgttggtctccgctgctggcaaattgggcactcagcagtggccttagctaggtcagccttggtgagtggaagtccatgttgctgagcccaggtgtaacctccatccctgccaccatggccactttgttcatgggcccattgggtgatgacaggggtggctgggaaaagaggctgagtggtgtccacagaacaggttaccctatccacttgattattaaaattctcctctggcctagtgcagtggttcatgcctgaaatcccagcactttgggaggccgaggcgggtggatcacctaaggtcaggagttcgagagcagcctgaccaacaaggtgaaaccccgtcactactaaaaacacaaaaattaaccgggcgtggtggcaggcgcctgtagtcccagctactcgggaggctgagacaggagaattgcttgaacccaggaggcagaggttgcagtgagctgagattgcaccactgcactccagcctgggcgaccgagcgagactctgtctcaaaaaaaaaaaaattatcctctgctgaggtcacctgttggtgagtactcacacaggatacaaatatcttcacgatttttgcccactcagagaggtccatccgcatacctcttccccaagtttctttgtcatcaattttccaatcaacacttcttccaagtccctgaccagccaaaccattggctacagcccatgaatcagtatataattggacatctggcaatttctccttccatgcaaagtgcacaaccaggtgcactgctcgaagttatgcccactgggaagatatgcctttaccgttgtccttcagggatgtcctacaaaggggctggagtgctgcagctgtccactttcaggtggtgcctgcatattgtgcagaaccatctgtgagccaggcactagtcttctcctcctctgtcaactgatcatagggaactcctcatgaggccattggtgcaggctgggggcgagaaggcagggtggcaggagtggagaccataggcatttgagccacttcctcatgtaacttacttgtgccttcaggacctgctcgagccctatctcgtatataccacttctgtttgatgatggaatgctgctggttgcacgacccagtttataactagatgggtcagaaagcacccagttcatgataggcagttcaggtcacagggtgagttgatgacttataatcaaacgttcaatttgcaccaaagcccagtaacaggccaagagctgtctctcaaaaggagagtggttatctgaagaagatggtagggccttgctccaaaatcctagaggccttcactgtgattcacctatgggggcctgcgaaacgctccaaacagcatccctatctgacaccgacccctcaagcaccattggatctgctgggtcatatggcccaagtggcagagcagcttgcacagcagcctggacctgtgtgctgagaaggccttgcagagccttctcctgttctggatcccactcaaactggcagcctttcaggtcactcgataaatgggccagagtaatacacccaaatgagtaatgtgttgcctccaaaatccaaatagacccactagccgttgtgcctctttcttggttgtaggaggggccaaatgcagcaacttgtccgtcaccttagaaggaatatcttgacaggccccacaccactgtacccctagaaattttactgaggtagaagttccctgaattttacttggatttatttcccatcctctggtatgcaaatgtctcactaataagtccagtgtgtttgctacttcttgctcactggatccaatcagcatactgtcatcaatgtaatggactagggtgatattttgcaaaagcaaaaagtgatcaagatctctttgaatcaaagctggagcattgatgtacccctgaggtaggacagtaaaggtatattgctggccttgccagctaaaggcaaattgcttctggtgggccttttggacagggattaagaaaaaggcatttgccaagtcaatgcctgcataccaggtactaggaggtgtgttaatttgctcaagcaatgaaaccacatctggtacagcagctgcaattggagtcaccacttggttaaacttatgataattcactgtcattctccaagatccatctgtcttctgcacaggccagatgggagagttgaacagggatgtggtggaaatcaccacccctccatctttcaagtccttgatggtggcactaatctccgcaatccctccaggggaaagatactgtttttgatttactatttctgtaggtagaggcagctctaatggcttccatttggccttcccgcttaatagccctcaccctaccagtgaggcagccaatgtgggagttctgccagctcctaagtatatctatgccaatgatgcattctggcactggggaaatgaccacaggatgagtccaggggcccactggacccactgtaagtcagacctgagctaaaactccattaattacctgacctccataagcccctgctttaactggaggaccacaatgatgttttgggtcccctggaatcaacgtcagctcagagccagtgtccagtattcccccaaatgtctgatcatttccctttccctgatgcacagttaccctggtaaaaggccaaaggtctctttgtggaaggatgggagaaagattcactgcataaattgttggtaatgggctggacacagtggctcacatctgtaatcccagcaatttgggaggcagaggcgggcggatcacctgatgtcaggagttcaagaccagcctggccaacatggtgaaaccccgcttctactaaaaatacaaaaattaaccaggcctagtggcacacgcctgtaatcccagctactcaggaggctgaggcagaagaatcgcttgaacctgggaggcggagtttgcagtgagccgagatcatgccattgcactccagcctgggtgacagagcaaaactctatcgcaaaaaaaaaaaaaaaaacattgttggtaaagtagtggagaccttcctcaaagggacctggcctcccctttattcaaggagctctgggttgtgaattggctcaagtctggaaattgattgaggagccgtgattctctgtttttataattcaaatcagtgttttgtccattcaacctagacatttcctgctagtgtaaatttagtaggaatggagtaggcttcctatcaatttcacttctaggagcaccgtgattaattagccaatgccagagctctacacaagtcaaactattctgattgctgttttgcctctgctgtccattatggtagctatgcccaccttgtctttgacagttgagtgccaccacttggcccctgtgacctcagaattcagttatttccattgtatttattttttatttttatttttatttctgagacagagtcttggtttatcgcccaggctggagtgcagtggctcaatcctggctcactacaacctccacctcccaggttcaagcaattctcctgtctcagcttcccagtagctaggattacaggcacccgccaccacgcctggctaatttttgtgtttttagtagagatggggtttcaccatgttagccaggctggtcttgaactcttgacctcaggtgatccacccaccttggcctcccaaagtgctgggattacaggcatgagccaaactgcctgacctatttccattgtatttaaattttgtagttgagtgactgtggttgccactcttagatctgacatacagagaagaggaatgacagggctcttcaaagatacaggtgctgccctcagaaatctatttagcaaggcattggtcaaggctatatcttctggatcctcccagctgggatgagtaggtctaaagtcactaatgcactccaccatcccaatctccctaagccatttgatcccttcctctacattaaaccaagggaaatcaggcattttagcacactcacagtggaccatattttaatacatatttctgctaaccaagcaagtaaacaattagaaccttttttaactccccaagctgcaacattaaaagcagagtccttacttagtgggccaaatcaataaattcagcctgatccaattctatgtttcttccacaattatcccatatccttagtatccattccactgcctgttctccgggtttctgtttctataaattagagaactcaaacagctcctttcgagtgtagtgcacctcctcatgggtcacactctcaacctcacatctaggggcccactaggactttagtctcattataggtcttgaagcaaacagaggtgttgggggtagctcctgaagagaatcaacattatcttgcctggcagctgcctcaggggaggccatcgctattgcctcaggcagtgcagggtttatctccttagacaaaggtggaaaggctgatggcagcatgggtcgaggagaggatgctgctactactggggatggggaagctgttccttctggcaaaaaacgttcatcagagtttacaaactcagtgtccccgacttcatcagggtcctcccacaaatccacattccaagtttcagggtcccagtcttttcccatgaatgccctcactttaacagtagacacctggcaaagctgtacatgtatctttcattgggggtcagccactcacatgttaagagcttgtatctgtttttccacaatttcagttttctctacaggagatacgactctcactcagggcaatcttagcagatttgaggctcagtatctgtttctgaagccaggagacagaatccctgagtttatcattttctttcatcactttgtccattgaacttagaagcaaccaaccagcttcattatgttccttggttctccacatatggtcaaagatattatgtatagagtcactaaactctttgcctctcatgagtggtgaatcaggtgtgccaaatgcatttattttgtataactctctaaacagttcacaccaaggactatcagtgttctccatactattagaagtagagtccttagcatttttgggtctaatcatattaagcagccaaatccagaaaccccaaaaatgaaagaactccatccttaacattctgttcctctagaaccactcctggtaccaaaatctgtattagtcagggttctctagagggacagaatagaagatacacacacacacacacacacacacacacacacacacacacacacacacgggagtttattaagtattaactcacacgattacaaggaatcacaataggctgtctgcaagcagaggagcaaggagagacagtccgagcccccacaaatgaagaacttggagtccaatgttcgtgggcaggaagcaaccagcatggaagaaagatgtaggctgggaggctatccttttcacgtttttctgcctgctttacattcgttggcagctgattatattgggcccaccaggttaagggtgaatctgccttcctcagtccactgactcaaatgttagtatcttttgacaacaccctcacagccacacccaagatcaatactttgtatccttcgatccaatcaagttaacactcagtactaaccattataccattcatccattgatggaaaagcagttgatttcaacctgatttggggtatctaattattagggtacttgatataataaatttttaaatgtatcaggaagctaaagaacgagtcatgaataaacaaaaaatattcattataccatatggataccatagcatatttcatccattctaaaatgtggatgaaatatggggaaaaagtaggggaacctctacttctcaacttaacatctgaaactgggatcagttgtataacacttgttagtaattgcctctgcatgtgcatcataacttgcagaatggccgtcgcccacttggcagaaatttcttgagtccataacagaatgcccttaagaaatacctcatcaccaacattcttgatggtcagatgttgatatttgttaaggtctttaaagagtctgagattttaccctcctcgcaagctaacaagctacctgttaaattgtgtggatctaagcatggggtggatgctggcagaaaacatgagactccaggggttagagaaaaaaggctgcatttttcaagtcaaaagcaataggcagaatgttcaggtgatgttcatgaggtttcccaagcctcccaattcccacagggacaacacaggtggcctagatggacaaattgggttgtgttacaggagaaaaaagttgagctgggagatttatcatttttacagtgagtggcaaataggctggctcactgttgggacattacctcagcaaacaccaccctaagaaatagctaaggaaggagtggtcagggccttgcattcttggcataccctgcaagggcgtggggcactcaaggtcatggtgtagtctttcccatcaatattgtgttagaaaacagacatcagtatctgaattcaaaaatggtttagaagaattagtctatcaatataaaattatttttaatataccttaactaatttatttagtttctgttttctttttatgaatgtacaacaataatatgataaaaatctatcttaataatctaaagaactctttcaataaatgtaaaataaaaattctttttttttttttttttttgagatggagtctcactctgttgccaggctggagtgcagtggcacgattttggctcactgcaacctctgcctctcaggttcaagcgattctcccgactcagcctcctgagtagctgggactataggcacttgccaccacgcccagctaattttttgtattttttgtagagacggggtttcaccaggttggccaggatggtctccatctcttgacttcgtgatccacccgcctcggcctcccaaagtgctgggattacaggcgtgagccaccgcgcccggccaaaataaaaattctaaatgacgagaatgagaattcattgtcagtttaagtttaattggcaacattttttctttcttttcttttcttttcttttctttttttttttttttgagatggagtctcactctgtcacccagggtggagtgcagtggcacaatcttgactcactgcaacctctgcctcccacgttcaagcgattctcctgtctcagcctccggagtagctgggactacaggcgcccactaccacgcccggctaatttttgtatttttagtaaaggcggggtttcaccatgttggtccgactggtctcaaactcctgaactcatgatccgtctgcctcagcctcccaaggttctgggattacaggcgtgagccaccgtgcccggcctacattttttctttcttggtaattcataaactgatggtgtcttaaactgatgatgtcttgcaattgatgacatttgagactagattaaatatttaatgtttctcattattatgtatgcgatttatctcactgtaatttctaatttttattgttggaatgtggcaatacagtttagtcaatttaccttgcagttttgctagttctcttattctattattttatcaaattgtttttggtagttcacttggtttttcaaaatatgcaatcatgttgccttcatatggaaatattgtttacatttttacttgaccagcctgggtaacgtggtgaaaccccatcttaaatacaaaaaaaaaaaaaaaaaaattaaccagacatggtggcatgtgcctgtagtgccagctactcaggaagctgaggtgagaggatcacttgagcctgggaggttgaggctacaataagccctgattgcaccactgcactccagcctgggtgacagagtgagacactgtaaacaaacaaacaaacaaacaaacaaacaaataccagcatctgcattattgtgttcactggaaatggtgtggttgtatagactctagccctttctcttcagtatatgaattaacagaacaaatacactggcaaaaatagtaactgtgataaaatgtgaaaacaatgtataatttgatttgcaaaattctataacttgtaaaagatggtgttgccatagtctggatattaaatcttgtttttaaacacatggaatttaggaattaatgtgaatttaaatcactccctataagtgatataatcatataattatgtccttttgtctccatttaggtgacctagtacattaataattttaaaattatatcaaattatctttcattatacaatatgtatcttaatctgctcagcaaacaattggtaagtctccaattacttgtagactacttgttagactgggaaactgatacaaaggtaaacaagacacagtgtttcccctttaaaaaaaaagtcataggccaggtgtggtgggtcccctctgtaatcccaacactttgggaggccgaggcaggtggatcaggaggtcagtggccggttcctgccttaactgatgacattaccttgtgacattccttctcctggacaatgaatatcagaagctccccaccgagcaccttgtaacccccgcccctgccagcaagagaacaaccccctttaactgtaattttccactacctacccaaatcctataaaactgcctcacccttgtctatctccctttgctgactccttttttggactcagtccgcctgcacccaggcgattaaaaagctttattgctcacacaaagcctgtttgatggtctctctccacatggacgtgtgtgacaggagttcaaaaccagcctagccaacatgttgaaatcccattgctactaaaaatacaaaaattagccaggcatggtggtgggcacctgtaatcccagctactcaggaggctgagacaggagaattgcttgaacctgggaggcagaggttgcagtgagccaagatcatgccactgcactccaggctgggcaacaaagagtgaaactcagtctcaaaaaaaaaaaaaaagttgtatgtttaaatgcttgagcatttaaatattagacattaagtgattcataataattcagtcaaatagtgtttagttttttatttctacattttaatagtaaaatgtatatgtacagaagtatatataaaatatgtatgtaaagttaataaaatatggagtaaacatcatgaaaataccaccgaggtcaagaaagagaagattgctagctttctctttctcagagaagattgctagcttgtcgtgctccttggaggtaagcatttagacttttttttttttttttgacacaatctcactctgtcaccaaggctggaatgcagtggtgtcatcatagctcattgcagccttgacctccctggctcaagtgatcctcccacctcagcctcccaagttgctgggataccaccaggtggctaattttttttttttttaaataaaggtagggcccaggctatgttgcccaggctagtctcaaactgctaggctcaagtgagcctcctgctgtggcctcccaaattgctgggattacagacatgagccactgtacctggcccattagaccaaattttatgatatcttttgtttctctatggtttttgccaattatgtatacatatctaaacaatatggggcagggttattattattatttttgctctgtttgaaatgtgagtaaatggagtcgtagtgcagatactctttttgttacttaattatttcacttaacatattgttgcttatcatgccatggttgtccattgcatgaatacaccacagtttattatttattcatctaattatggaaatttttattgtttccagtttggggctagtatgagtgaagctgctctgaacgttattgtgcaagtttttctgtggacgtaggtttttatttctcttgagtaactatcgaggagcaaatcactagggatttctgagttacatgaatacatggttaactttaaaagaaactgccaaaccgttttttttcctttttttttttttttgagatggagttccactcttgttgcccaagctggagtgcaatggcgtgatctcagctcactgcaatttccaccttcctggttcaagcgattctcctgcctcagcctcccaagtagctgggattacaggcacacaccaccactcctggctaattttttttatattattagtaaagacagggtttcatcatgttgaccaggctggtcttgaactcctgaccacaggtgatccgcccacttcgacctcctgaagtgctgggattacaggcgtgagccactgtgtcagacctaaaccgttttccaaattggctgtactattattttgtattcaaactaacaacatatgagttccagttactccacatccttgccaatgctagaaatggccaatctttttaatttgagtaacttgtggatgtgtagtcacacatcttattatactttcaatttgcctttctctactgagtaacaatgttgaccattttctcagtgcttattgccatccatgtatcttcttggacaaagtagccaaatcttttgcccatttttttttggaagggtaggggctgtctccttattgaattgtgagattattataaatatattatgtattattattatttttgagactgagtctagctcttttgcccaggctggagtgcagtggagtgatctccactcactgcagcgattctcctgcctcagcctcctgagtagctgggactacaggcgcccaccaccgcgcccagccaatttttgtattcttagtagagacagggtttcaccatgttggccgggctgtgcttggactcctgacctcaagtgatctgcccacctcagccttccaaagtgctgaaattatagatgtgaaccacagtgcccggccagtattatatatattttagatacaactactttatatctatagtttgtaaatattttattccagtttgtagtttgccttttcagtttctttcgaagagcggatgtttttcattttgacaaaatccaatttagcaactttttcctgattaaagtttttgtgttctgagaaatctgcctggctgggtgcagtggctcatgcctgtaatcccagcactttgggaggccgaggtgggtggatcatctgaggtcaggggttcgagaccagcctggtcaacatggtgaaaccctgtctctactaataatacaaaaaaattagccgtgcatggtggcgcatgcctgtaatcccagctactcgggaggctgaagcaggagaatcgcttgaacccagaaggtggaggttgcagtgagctgagaccacgccactgctctccattctgggtgatagatcgagactctgtctccaaaaaaaaaaaaaagaaagaaagaaagaaggctaggctccgtgcctcacacctgtaatcccagcactttggaaggccgaggcagatgatcacctgaggtcaggagtttgagaccagcttgatgaatgtggtgaaaccctgtctctactaaaaaatacaaaattagctgggtgtggtggcgcatgcctgtaatcccagctacttgggaggctaaggctggagaatcgcttgaacccaggaggcggaggttgtggtgagccaagattgtgccattgcactccagcctgggcaagaagagcaaaattccgtctcaaaaaaaaaaaagaaagaaagaaagaaatctgctccaacctgaggtcaaaaggatttttctccaccattttcccattttctttcagacattttgtagcataagctcttatatttaggtctatgatgcatatcaaattaattttcacatatggtgtgaggtaagtgttgaggctaatttttttccatttggatactcaattgttccagcaccatttgttgataagactattctctcccacagtgaattagcttcgcatctttgctgaaaattgattgtccgtatatgtatatatctaatctgtatttattctattccatttatatttatatccttacatcaatacattatcattattactgtagctttataataaaatattgaaattcacggtatatgttcttcaattttattctttttctaaaattttttttggctattctagtacttctcatttccatttaaatttttaaatctgcttgtaaattctaattttaggacatttgttggaaatttgattgggcttgcattgaatcagaacatcaatttgatgagaatcaatgttaataaactcagtgtttcaactcataaacacagtatatatatatattttgagatggagtcttgctctgtctccaggctggagtgcagtggcacaatctcagctcactacaatctccacctcctaggttcaagcaattcccctgcctcgcactcctgagctcaaacaatccttcaccttagcctcccaaagtgctggggttacaggcataaacaactgtacctggccttcatgctactttattttttacgaatatatatatatatatacatttcttgagacagagttttgctcctgttgcccaggctggagtgcaatggcatgatctcggctcactgcaacctctgcctcccgggttcaagtgattctcctgcctcagcctcctgaatagttgggattacaggcacgtgccaccatgcctggctaattttgtatttttagtagagatggggtttcaccatgttggccagcctggtctcaaactcctgacctcaggtgttctgcccacctcagcctcccaatgtgctgggattacaggagggagccatcatgcctagcccttgatgccactttaaatcattattttataaatttttattaattgttggtggtacatggaattataattgatttttgtacattgaccttatatcctgcaacgttgctaaactttgtcctagtagttctgcttactggttatagtattttctgtatattctataggattttctacatagacaatcatgtctgtcaatgaagacacatttactggccgggcgcagtggctcacgcctgtaatcccagcactttgggaggccgaggcagccagatcatgaggtcaggagttcgagaccatcctggctaacatggtgaaatgctgtctctactcaaaatacaaaaagctagcagggcatggtggcacacgcctgtagtcccagctactcgggaggctgagtcaggagaatcgcttgaacccagaaggcaaaggttgcagtgagctgagatcatgccgctgcactccatcctgggtgacagagcgatactctgtctcaaaaaaaaaaaaaaaaaaaagacatttacttaagcttttctaaaccatatgtcttacatttcttgtttgccatattgtactggtcaggaccttcaataccgtattgaatagaagtggtgaacagagacattcctttttagcatatttgagacatttactctttcaccatgtgctgagaccagcttgatcggggagaccctaacccagcggcgctagaggaattaaagacacacacacacagaaatatagaggtgtgaagtgggaaatcaggggtctcacagccttcagagctgagagccttgaacagagatttacccacatattttttaacagcaagccagtcattagcattgtttctatagatattaaattaactaaaagtatcccttatgggaaacgaaggaatgggccagattaaaggaataggttgggctagttaactgcagcaggagcatgtccttaaggcacagatcgctcatgctatagtttgtggcttaagaatgcctttaagtggttttccgccctgggcaggccaggtgttccttgccttcattctggtaaacccacaaccttccagggtgggtgttatggccatcatgaacatgtcacagtgctgcagagattttgtttatggccagttttggggccagtttatggccagattttgggggccttgttcccaacaaccatgaagtttgattttagctgaatgttttccataggtgtcatttatcaggctaagttcccttttattcctaggttgccgagagcttgattatgatgtgtccatggtggttttgtctattctgctctgggttcattgagtttcctggatctgtaagcttatagttttcatcaaagcacagtaagtgaatggtatgcaatgcaggtggactgaggtgcctactatatctgatgtgcatagctgagatcacatgtatgcccagcatccaattctttaggaaagcatttctttcctattccatatggtttgcatgaccactatgccccaagactagtccatgactcaagctggactcgttgatcagagcccttcctaggacttctctgttaactgtatctccaggttagagctaacaggatgtaacactgcccatactctcccaggagtcacaggtagacaaattgcaagagcagagtgacatgaaaagagaggaactgagctagagaaggccctgaaaatattgaggctggggatgtagtcaggtggaagttgcctatacatggacattttagttttgagggccaataaattattcttttgctaaaactaacatgagacttttgttatttttatttttgctcaactaaaatgcagtgcttataatgccacactaggaatctgtaatttcttgaggaaaaaggtaggagtatatttagagttacattttttttttttgagacagagtcttgctctgtcacccaagctggagtgcagtggtgtgatcttggctcagtgcaacctctgcctcccaggttcaagcaattcttctgactcagcctcccgagtagctgggattacaggtgcccaccaccatgcctggctaatttttgtgttttttagtacagatggggtttcaccattttggtcaggctggtctcgaactcctgacctaacgattcacccccccttggcctcccaaagtgctgggattacaggcatgagccaccatacctggctacattttttaaaggaatataaaactacttcttgaccactgttcaccagtattcacaataaacaatatacaattggaataacactctgactactacaaaattatttttcctggcttctggtgaaccagtaaaatgaatatagaaaagagtgtaagggatgagcagggataaagaaaaaacatccagatcaatagtttaagataaagctttgttcttccaggtcctaaactgcaaccatctctaaccatctgattaggtttccatgaaccaagcctcagatcgtccatgaatcatgaccattgagtcaacatagcacagggatttcaactttttgtaaagaaaatgttcacgaggtgaatctttacatgttcattttagtcttgtttaaaacacaccaggctttgtctagtttcctcttctgggtggggaggttgttggcagtgataaaatttttcctttcaggaattctgtaaataaaccgttatgtttatgactacatgtatagattctgattaggtgctgtattagtccatactcacactgctgataaagacatacctgagatggggcaatttacaaaagaaagaggtttaatggacttgcagttccaagtggctggggaggcctcacaatcgtggtggaaggcaaggaggagcaagtcacatcatacgacgatggcagcaggcaaagagagagcttgttcaggggagctcctctttataaaatcatcacctctcatgagacttattcactatcacaagaacagtacaggaaagacttgcccctatgattcaattacctcacgctgggtccctctcacaacacatgggaattcaagacaagatttgggtggggaaacagccaaatcatatcattccacccctggctcctcctaaatcttatgtcctcacatttcaaaaccaatcttgccttcccaacagtcccccaaagtcttgactcatttcagcattaactcaaaagtccacagtccaaagtcttgtctgagacaaggtaagtcccttccagctatgagcctgtaaaatcaaaagcaagttagttacttcctagatacaatgggggtacaagcattgggtaaatacagattccaaatgggagaaattggccaaaacaaagggactacaggccccatccaagtcaaaatccagcagggcaatcaaatctttttttttttttttttttttgagacagagtctcactctgcctagaatgcaatgggcgatctcggctcagtgcaacctccacctgccaggttcaagcaattctactgcctcagcctcacaagcagctgggattagaggcacatgccaccagacccagctaattttttgtatttttagtagggacggggtttcaccatgctggccaggctggtctcaaactcctgacctcaagtgatccacccacctctgcctcccaaagtgctgggattacaggcatgagccactgcgccaggctgggcagtcaaatcttaaagctccaaaatgatctcctttgacttcatgtctcacatctgggtaacactgatgcaagaggtgagttcccatggtcttggacagcttcacctgtggttctgcagggtagagcttccctcccggctgccttcatgagctggcattgagtgtctgcggctttaccaggtgcacggtgcaagctgtcagtggatctaccattctgaggtctggaggacagtggccctcttctcacagctccactaggcagtgctccagtagggactctatgtgggggctgcagctccacatttcccttctgcactgccctagcagaggttctccatgacagccccgcccctgcagcaaacttctgcctgggcatccaggcatttccatacaacttctgaaatctagccgaaggtttccaaacctcaattattgacttctgtgcacccgcaggctcaacaccatgtggaagctaccaaggcttggggattgtaccctctgaagccacagcccaagctgtactttggccccttttcatcatgagtggagcggccaggacacagggcaccaagtccctagactacatacagcatgagaaccctgggctgggaccatgaaaccattttttcctcctaggcctctgggcctgtgatgggtggggctgccgtgaagacctctaacatgccctggagacatgtgattaacattcatctcctggttacttatccaaatttctgcagccagcttgaatttctcctcagaaaatgtgggaaagttaaaagctacttagagacttgttgaatggctttgcccaaaatgctgatagcgatatggacaataaggtccaggctgacctagtctcagatgtaaatgaggaacttgttgggaattggagcaaagatgacaaagataactcttgttatgttttagtgaggagactggtggcattttgcccctgctctagaaatttgtggaaccttgaacttgagagagatgatttagggtatctgtcttcttctaagccctccaaactgtcccaaactctgtgtgttacccagttccaaaggtgcttccacattttcagatatattttcagcaatgccccactctactggtaccaatttactatattagtcaattttcatgttgctgatagacataccctggctcacacctgtaatcccagcactttgggaggcaaaggtgggtggatcacaaggtcaggagttcgagaccagccaggctaatatggtgaaactgccccccgcccccgtctctgctacaaaaattagcctggcatgctggtgaggacttgtagtcccaactactcaggaggctgaggcaggataattgcttgaacccaggaggcggagggtgcagtgagccaagatcatgctctgggcgacagaatacccgagactgggtaatttatacaggaaagagggtttaatggacttacagttacacgtggctggggaggcctcttaatcatggtggaaagcaaggaagaacaagtcatgccttacctgaatggcagcaggcatagaaagagtttgtgcaggggaactcctctttataaaaccatcggatctcaggagattaatttactatcttaacagcacaggaaagacttgcccccatgattcaattacctcccactgggtccctcccacaacacatgagaattcaagatgagatttgggtggggacatagccaaaccatatcaggtgcttttaaaatatccaatttggctgggcatgctggctcatgcctgtaatcccagcactttgggaggccaaggcaggaggatcacttgaggtcaacagttcaacaccagcctggccaacatggtgaaaccccgtctctactaaaaatacaaaaatcggccaggtgtggtggtgcatgcctgtagtccccgctactcaggaggctgaggcaggagaatcgcttgaacc

SEQ ID NO: 2894 - DNA, 3548 bp, Homo sapiens
tttgtagagatggggggtctcaccttgttccctaggctggtcttgaacccctgggccccagcaatcctcctgcctcagcctcccaaagtggtgggattacagatgtgagccaccaagcctggtcggcttgttttaaacaacttaatgttattgaaaatatgatgccaccctgatattgagataaattttaagggaagaatcacctctttctcattacttgaatactgtgttaatttttgcatattaagtcaatttcctcctttaatggcaattggttgatccatggtcatgttaaataattttgcatatttaattaactcgggtcttgatttgtctccggtcctgtttattactgatgtcaccgtctgtgtgtgtcttgtgatgtggagactttgcaagctgttttccacggagtccaagccccacagccctgctgtggcactgccttcatcagtgacgcgttcttggcggagaggatctagttgtagtttgtgcttcctggctgtcaagggccttgccttcccttctacaggaaacagctgagaaatcgctggtgtgctgtagccttaaataacagcacctgccactcagttgtgttgtctttcatgagttttccaagtgctctcctgccttggggcatgtgggaaggaaggtattatcatttccgttttacaaagatcccccgagagactgcaagtctcttggattttgctgctgacaccaggacaggaggtcacatcctctgaccctccatcttatgttctttccagcagccccagaaccagccatggaaaccaggggcagggcctctgtgctttagttccctgatctgtaaaataagggatcataatagtacctattttgtagggtcactatgaagtttagatgagctgccacatgcctgggacagtgcctggcacacaaccatgcaagctctcaggagggtagtgccccgtacctccaatcttgttatgtgggggacagacagatcatctggcttgggcgccccaccctgccatgcagataaatccatgcccagataacggtcatgtgggatgggaaggtggggctctagcgtgtgccttcttgctgtcctgtgctaggcatcttggggtccggcctcctgaacttgtgccctttcctttgccagagtgagttgcccaagaggctgagggtgggcatgaggctgcttacaaagctgagctgatgatagtttgcagggcacagcacccttcactcagggatgctggcatactctgtgggcttcttaacaggcaacaagttctgccagcccattgtacagtccccggctggctgcagtgtctgggcattctgcttctcagccttgccccactcactactttctcagtgagtgtcagtgagtaaacacgcacgcaaaagaataaaaccatcaacaagagaaagtgtggtgtgtaagggaaagggagtcattcattcattcattcattcagccagtgttgactacagtgtgccaagtcctgttctagctgctggggtgcagtggcgatcagggcaggccctgccctcatggagcttacagacaagaccatgacacaggtgcatgctatgaaaatgagtgagtgggacatactgggcctccccaaagttggtggggaagagagagaaggtaaaacccaaaataggttctgtgactggccagcacctcaggggaggcctttcgaggggcaagggtggagattttcatggctaagtcctgttgtctaggggggattgcccttacagggggtctgcatgacattagtcatgaatccaaggtcctgtggtggcatcagggctggcaccaaccacagcttgctgccgatgtccctcccatgctctgggtacctgtcatatttgacacctctgttgcagaggtgacagctagaaaagcatccattgcctttggggtgggggttcccatttgttgtctcatgggaaggaagggatgctttggaaaggctgtggaaacccctttgggctctgggtggataacatgagtggggccattggaaggggtaaagaatgctgagtcatgtctaaatgacagcacttcctgggcactcctacatgacttgcaataccccacaggcagggcccttcatctcagcctgtctaacagactgtggatttggattttcattcaaccattaaatttttaaaaaattctgtgaagctaatagtcaaagggttagtagtctcatttattcaccagatatttttcagcaacaacttatgtacctggcttttttctaggagttggggatatagcaggtgaacagaagagacaataaatcttgccctcatagtctagccttatgatagcagaagtctttctttaaagaaagatccctggaatctttaaatattaactcctggagttcacgtaggcatcgtgacagaggcacagggacagtggggttagctgggatgtccagggacagaaggaaacagaagcagtgtcactggtgaccagtcagatgggtggacgtccagcaccctcatgatgtggcagaagtcagggaagaacgatattctgtttaaaaagttgagcttataaatagccatattggaacatgtttattatgttgaggaggtaacttatacttgactggtcttctaatagagcagcaaatgtcattgagtattttctttgtgcctgggtacatggtgcccatggaaagatgtgttctttgccccagggacgacgatagttgagtaattagcaaataaaacaagggcaagtctattgagagccactttctatggcagggcctgagatcactatggaaataactcagtaagagcagtcagagaaggcttcctggaggaggtgtctccatgctagtcagaaagaagtggggaacgtgttctcagggagttagtaacaggggagcatggcttgtgctcatgggacagagtgactgctctgtcacagtggggttggcaatgaggggctagaggttagagggcaggggacagtggagaccagtggggggcttgacacactctgcagctgtgagccattgaaggttttgcagcagagcagtaccctggtgctggttgtacttagggtgtcagcgaggtggagcgagctgggagggcaggtatagcaagtgatgctggagagaacagctgaatgtggctctagagaaacaggctcctgcctggcaagtcacagggttgtgaataaatcactcatgctttctgagcctcagttcacctcatctacaaaatgaaaataagatttcaaatcctatttcatagattctttgtgagtcttaactttaagaatatatgtgacaatgctttaggaaaaaaaaaagtaaagtgtaaattcaagaaaaatctcagctgttggtgtcaggatccccttctcacattggcttcctgtacctatgagatagcaaaaagtaggggagaaatctcatattcctgtgagtacatgacattatcgaaacaccagaggaccagggaggatggtcagtgagctcacaagcattgatgtctgccatttgcatttaatcctc

SEQ ID NO: 2895 - DNA, 4097 bp, Homo sapiens
gctgtctgcggcagggccgccatcgggccgcggccggttagtcggcgtaagagcaggcggggcccgagctggacctgaggagcagaggcggctgggcagtcctgcgggtgcctccctctagccgcatgagcgcgggaccgtgcactccgggagagccggggccgcgcggccttgttccccgcgaaccctcgaggggaagtgccggggccgcggcagcagggccagggccccgggggtctcccgcaggccaccctggacagtgatgagcaggtccgctggacctgcgcgtccgttagtcggagcggctccataggggacctggatggcgtgaagttaagagtcacgcatcgaggatggacttgaggggatctggagtagaggatgggagggcattgagaaaatagggccagagatgagggactctaagtgggcgtggaaacgcaggaaagattaattcaagatctgtttaggccgttaaataggaattggggcatgagggacaggaaggaagcaaggattagacaagtgactgggaagatgttagtgcctttatctgggtaagagggaagacgggagggggaaagatgatgggtttagctttggacatgttgagttgtctgtgagacagtcacaagtgtaaacatccaccaatggttggtgtcccgccaaccattaagaaaagtcagttgagaaagtggtagaaatgagcaaaaatcctcacgaagccatcctaccgtcactttttttgttgttttttgtttttttggcataatagtgtctacctttaattgagccttgaactatgccaggcagtgttctaggtatttttcgtgtgttcactaatttaatcttgatgattaacccagtctggtaggtatttatgtatgaggaatccaagatacagaaaggcatcttgcccaagttcacacgagtagtggctggagccaaaattcggtttcaagcatgctttgccaagaggttgaattttaattggcttttcatgggctttctctattttgtgtcctgttggggtccagaataacttggcttttccagcacagcaaatctgcaaatttctggactcattctctctcattcttccctataaacgcagctcatttcttgccaaatgcagccaatagcaaagggcccaccaacatttaagaagcaaatggatgcacaggagcatgagaacagtcaaaagaggaggaaaggaaagggaattgagaaggaatgtcaaaaaagtcaagaagacacataatagtgtaaagtgtggctgagaggcaatccgaagtctactgtgcgtaacaattaggaggcactgataaactagcgagagaagtctcagtgatgggagaggcatggaagttagaatgcaaagatgggatatgaaaaaatgaagaatgcagtcaactcttaaaacggttgagaaaggaggaattaaaaaggcgtataagattacaggcaagctgggcgcggtgcttcacccctgtaatcctagcactttgaaaggctgaggtgggtggatcacctaaggtcaagggttcgagaccagcctggccaacatggcaaaactccgtctctactaaaaatacaaaaagtagccgactgtggtggtgcatgcttgtaatcccagctactggggaggctgaggcaagagaatcacttgaacctgggaggtggaggttacacagtgaagctgaaaccatgccactgcactccagcctgggagtcagagtgagactccgtctcaaaaaaaaaaaaaaaaaaaaagattaagagcaaatagagactgaacatgttcataggctaaagggagttagccaacaggacgtgcaaggaagaggagccaaagtcctggaggagacgataggggatgaagttaagagtaaaggtggctagggaagttgataggcatggggagaattcattctctaaatctgtttggaaggctgtaaggataggagcccaaggacaatggacaaagtgacgattcatcccaagcactccttgggccagttaggcagcaataaggtttgtgtttccaggtgaacatagtgagtgtagtggtggagtcagacaagatagtgtccaacatggctggtgataccccgaaagaattgagtacaaacatacagaagcccaggtgctgaggtagcccagctgaaaacagtttagggtacaacacgcagcagcagctaccaccattccaagtatactggtcacacatgcaacagatgacctaccaagatgtctctaatacaaacacaagtgccccatagtggccagacatttgaggaatggcatctccatgaagatagtgagaggtgacagcgtgctggcagccctggcagccctcgctcgctctcggcgcctcctctgcctgggctcccactttggtggcacttgaggagcccttcagcccaccgctgcactgtgggagcccctttctgggctggccaaggctggagccggctccctcagcttgcagcgaggtgtggagggagaggcgcgagcgggaaccagggctgcgcggggcgcttctgggccagctggagttccgggtgggcgtgggcttggcgggccccgcactcggagcggcctgccagccggccccgccggccccgggcaatgaggggcttagcacccgggccagcggctgcggagggtgtactgggtcccccagcagtgccagcccacctgcgctgcgctggatttctcgccgggccttagctgcctccccgtggggcagggctcgggacctgcagcctgccatgcctgaacctcctcacttccatgggctcctgcgcagcctgagcctcccagacgagcgctgctccctactccagggcacccagtaccatccaccgcccaagggctgcggagtgcaggcgcagggcaagcgggactggcaggcagctccacctgcagccgcagtgggggatccactgggtgaagccagctggactcctgagtctggtggggacttggagaacctttgtgtctagctcagggattgtaaacgcaccaatcagcgccctgtcaaaacagaccactcggctctctgtaaaaaggaccaatcagcaggatgtgggtagggccagataagagaataaaagcaggctgcccgagccagcagtggcaacccgctcgggtcccttccacgctgtcaaagctttgttctttcactctttgcaataaatcttgctgctgctcgctctttgggtccacactgcctttatgagctgtaacactcaccacgaaggtctgcagcttcactcctgaagccagcgagaccacgaacccaccgggaggaacgaacaactccagacgcaccgccttaagagctgtagcactcaccgcgaaggtccgcagcttcactcctgagccagccagaccacaaaccccaccagaaggaagaaactccaaacacatccatacatcagaaggaacaaactctggacacgccgcctttaagaactgtaacactcaccgcgagggtccgcggcttcattcttgaagtcagtgagaccaagaacccaccaattccggacacaatagcacgtgcaccaaatagaattctcacctaagggaaaaagtttatagagctatcagagtaggtctccaatagagcaaggtcttgagacaaatgggtattttatttaaaaaaaaaaataggctgtcatgaaacaagaacaaacagtgaaaagagatactagacattaataattgaagtttaaaaactcaacatgagttgtcaggtgttggggaaggaaaagatgcataggcagagaacagaatttttagggcaatgaactattttgtatactataatggtggatacatgtaatatatttgtcaaaattcacagaagatacaacaccaagaatgaatcctaatgtaaactatggactatgggtgatgatgtgtcaatgaagtttaatcagttgttaacaaaagtaccacagtggatgttgatagtggaggaggttgcgtacatgtgcacaggcaggggatatatggtaactgctcaattttcaagtgaacctaaaactcctctaataaataaggtttattgttttttttagaacccccca

SEQ ID NO: 2896 - DNA, 624 bp, Homo sapiens
ctattagctcttagtaagattacacatgcaagcatccctgccccggtgagtcaccctctaaatcaccacgatcaaaaggaacaagtatcaagcacgcagcaacgcagctcaaaacgcttagcctagccacacccccacgggagacagcagtgataaacctttagcaataaacgaaagtttaactaagctatactaaccctagggttcgtcaagttcgtgccagccaccgcggtcacacgattaacccaagtcaatagaaaccggcgtaaagagtgttttagatcaattcccctcaataaagctaaaattcacctgagttgtaaaaaactccagttgatacaaaataaactacgaaagtggctttaacgcatctgaacacacaatagctaagacccaaactgggattagataccccactatgcttagccctaaacttcaacagttaaattaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgacgaaggctgcaa

SEQ ID NO: 2897 - DNA, 7960 bp, Homo sapiens
accgaagaccaggatgttcttgccggacggcagcttggacctggcgcgggtggacacttcgctcagaatggaggacctgtggcgacaatggcaagagtggtcagccccgggccgggctgggatggcccggctcgcgtcggcccctcagtgtgtccgacggtccggcccagaggccgcgccccccacggcccggcccgaccgcccgcggcctcaccataggctctggccttcctcctcctcactggtcaggtcgccggcggccgccaccgcgggcccgttgggacctagcagcagcttcttctccacccccaccggcgccatcttgccaactgcagccacaaagagggccctcccccgggcccgccgaggacccgcgaggacccgggccgggccgccccccgctcgccgtccctcgcgccgcgccgcccgccgaccttgccgcggcgactgcgccgcccaacgtgtcctctagatgaggaacctgaagctcaaaaaatttaagaaacccacccaaggacccaaggctagaagataacattcggtacttctaatttattccccaaccttggaccattatatcatgaacttggcctaaccctactcaagccctgcattgaaagactagccttaaggaagaccccagaatcctcataaatatcctgcatttccccctcctcctccgaagactaaagactgtgaagtagtgctcttgaccgcagtgcataatacacttggctttgctttattaacatgctttttaaaatgatgttttcagggagccagcatttcacaccagaagaggagcccttaatttccttgggggccagctggcaggtgcagagcggggagaaaaataaaaggaaaggggatggaaaagggaaagagcggagagtaaccgaaggaaaaacatacattccattatcaagcttaattttaggtgtggcctctacttgagggctcttgccattctctatggaaacaggctaacaagacatttctaaatatcacaaggaagtggaatgtggcagaaaagcaccacctaagtaggtttcagatgagtaggattgtgatcctgatgccaaaaaatctggcggcatgaattacgggataaaacaaatgggcatatcatctgccaaactggatgtaaggtttaaacaagacgagagtgaaaacccactgagttcctcccttggaaatctgggaaaatcaggcaaagtgccagaagtcctaaaagggcaagcagtgctgaattttcacaggacagaagatggagatgaaaattacaggccagtgagcttaatcagcactaagtgaaattttgtgattaaacactaaaggaaaagagaataccagatttacacagtatctttcttttttgcaggagtaccaggtaggcggatgctgcagatacagcaaatgcagatttcaacagggcatttgacaattcacatcttagatgcgaaagtgaaatcaatgctggatgatagcactgaggcttattaaagactagcccagaggtggctgatgaagaggagggaccagcagatgaggctgctaggggcctgcccaaacctcctgccctggccagccaattcagggtgccatcagtgacttggataagaatacagcagcagtcatggaagttgtggatgacctgaagcaggaagggttgccttatctactgcatgacaaactgagcagagactaaatctaacaagttgaaatttagcaggaactattaaagtcctgtggaagagtttaacaaaaaagcataggaaggccaggtacggtggctcacacctgtaatcccggcactttgggaggccgaggctggcggatcacttgaggtcaggagttccagaccagcctgtccaacatggccaaaccccgtctctactaaaaatacaaaaaaaaaaaaaaaaaattagccaggaatggtggcatccgcctgtaatcccagctgcctgggaggctgaagcacgataattgcttgaacccaggagacagaggctgcagggagttgagatcacaccactgcactctagcctgggcgacagagtaagactgtcaaataaagtaaaatttaatttaaaaatgcataggaataggataggaaattatttgaaataaaaatgataatctaaacgtcattactgtattaactataatctaagagttggtcatgtagaatgccaagaaacatcttagggtagaacccataaaacctcactgatgctaacaaagaagctagccccccatgccagtcaggctggatttcttagggtgacatttctggacacattttgcaaagacagaggtatccagtggtcagtgactaaactcataaggggacaagacatcgttctgctgcaacatgaagtaactagggctcatcagtatgaaggataaagatacagagggagaagaagggaaagtgtagacatttctgaaaagctaaagcaaataaacatacaccaaaaagaagtgaacctgactatatgatgtgggagtattcaaagcaactgcataattagtctttagaagaagaaactttttttttttcctctaggatactacaataaacaatagaagaggaaacttttttaagagatagggtcttgctcttgtccaggccagagtacagtgaaacactcataactaactacaacctcgaactcctgggctcaagcgatcctcccacttcagcctctcaagtagttaggaccacaggggcatgccaccacatccagctaatttttaaatttttttgtaaagataggggtctcactatgttgcccaggctggtctcaaactccttgcctcaagtgatcctcccacattggcctcccaaagtgctaggattacaaatatgggccaccaccacagccaaggaaacattttaattaacaaaatgtcaaatattgatttagtgtatgggaaccttagttaaatagcttggggaactattctttctgaattctggggagggacttttgtaccatataaaaatactaaaatccaaatgtcccacatagtatttattgcaatataatgtcaaataacatttaaaggctaattcttttctctgtgtcctttaagcttaaggaaaaataaaagcatattcctaaacaaatgtttgatcttatgaaggaattttcttactaatctgtacactgatgatatatttgctttataaatcattgtaatttgatgagtttcagcatcacaaaaactgtttaatgaaaactgtatcctcatttccacattccttctcatgagagtttagaaaaatactttaaatgtatctttcaaggcactgtattttaagaatccaaactaaaaactgacagtcttctttcaatcaagaagctgcacacgtggggtgtttggtcagcttgtggtatttgtgagcaaggtccacagccttccgtccttgctgaaaggggaaagaccacaaaattgaattccagtgatttcccattttcttaactccattgaaaaggtaatttacttcttcttcagtaaagtttttgcgaattcttcttttttctataattagaattgtagaatatattagtatttgctgaacaaaggtcctgagatgcaaataagtgcttatttggatatgcttaacttatacctaaggatataaactacagagtgagaaatgccagggcttctcatcatgtggaaacccacttcaattttaaaaacctgagtgcctaatattaagctagttgctatcactgtgacttcttcagtaattataacttaattgacagtagtaatacaacatctttcagtcaagaaacaaaagtttataaacatttgattgttaattcaacattcctgtgaggacagttaacaaacatcttaccggccaggcacggtgacttatgcctataatcccagcactttgggaggctgaggaaggtggattacttgaggtcagaagttcgagaccagcctggtcaacgtggcaataatctctctccaccaaaaatacaaaaagtagccaggcatggtggcacgtgactgtagtcccagcttctcgggaggctgaggcacaagaattgcttaaactcgggaggcagaggttgcagtgagctgacagcacaccactgcactccagcctgggcgacagagcaagactctgtctcaaaatatataaataaataaaaataaaaaacagcttacgtatcttagagatacagtcttcccaaagggctccataacttgatagaatagaaaagaatatcaacacttgttaaatattaggtttgataatatttttaagaataagggtcttttgaaatttgcttttaaaaacacatggtcagctagatcaaaactcaaaatataggctgcacaatgaggaaggaagtttttaactatttggtttttaagggatactttctataaagaaagaatatacagctggtatctgtaaacaaatattttctggtgatgattactaggaaatagttttctttaagctttttcattcattattatctcatcttatcaatgtgggtagatgctggtgaggagaagttttctgtatttccagttgaggctgttatttactttcgtagtactgggtgcagttgtcctgggtcacccttagaaaaccttgcccttgcaggccaagacagccatttgtttaccttttctaagagccacagttcagaccttttaaaacagatgaaaaaatcttcccagcagaaggttatcagtgtaaatgtctgattattacttaatagtattatttagaatgtaagctccatgagggcagcaattttgatctattttattcaccattgtatccccagtgcttagaatagtatctgacacacagtaggtagtcaataaatacttgttgagagaaaaaatttattggtaaaactatctcaaagcttatcaatgaaattattctttcattttgggtgtactggaaaactgtggctatccaagaaataggtttcaacttcccttgctaaatgatttgaacccataataatcaggactagattggttactataactttcaggatattgagccctggagttgatcatgtaaagccccacttttccattgtggctgccatctccctgacttttatacttaatatctgtgcccaaatcttcaaagattcctacagcagagtactgagcagcctggaagaaggaagcagctctctacaccccaagctccccgctctgtgacttctttagtgctccttgtaatattaggtattagggaagagcaagggaaaatgggcaagagggcttaattctaaggactcttttatttttcaagccctctcaaaacaccaatccatcctgaaatagagacttggggaaatctgtaaatgcttaggacagtggttccttctcagaagaatgggctcacatttgagtataaagtataattaaatgaacggtggtgagtatcctaaaaaaaggttaagtttatcaagggggaaaaaatggcaacataccaaatattcctggccggcttgtgaaagagatgtaagaatcactactttctcaaggttcctttctaaattctaaaaagtaggccagattatttggttttagctaaagcaagtcttacctacaaaaaaaaggcatgtttttctgagctcaatgtcacttaacagtatataggactgctgtatataatcattgtataaccattattatgcacatttcatgaagttctgcaaattattttaatatgcaaatagattacagcatatttttcattgttacgtacttgctttgaagacatgttgctgaaaaacacctattattaatttgatgccaagcccttgtcaagaacaagatctccaagtgcatgatgtttctatgaaaaaacacccattttctaacaattactatagaaaacattacttcagaaagtgggctcatctgtagtggtactatacttaattataatttgcatgcagaacttttaatctagaaaaagactcagatataaaaatcaaatttgaaatttccttgaaagttttggcagtgaaaatagccaaataaatatatgtggcaaaatgcttcctgaatgtatcacgtccaaatgtctaaataacagagtggctctataggtgttactaattaatatatccaacctattttagtctgcaggtattaactccgtacgaataaaagaaaatgatgatgttatttaagtttctgatacatcggaaatggtgatcaatgtgaaatgttaaccctatagttaaataaaaattcccataaattaactaattgtttaagaggcatttttatttcttaagcagagttttaaagtttatactatttgtctcttcaatttttattgtttcaagcactatagttatgaacaaaaacctgcaaagtctctctgaagcacttgtgcataataattttgttcttaaaatagaaatgtgaggatagaacaagggcttctggagaatggctttttgaatctaagttctgccacttaccaagtattaataattatgccttacaataggagcaaattaatatctaacttacaatattgctataggaattaaaggaaataatatctatacaacacctaacacctagcaggtgcttaataaatgttagtttcctcctgctccttcccctgctggcaggcagtgagtgagcaagcaacatgaagggaagaggaaagtctcttttattagaaggtctgaccctcatcagaggcaaggtttatcatttaagatccattaataataagactgagaacaaccactcagctgttctttctcagaaatatatgaaatttaagttcatttaaaaattaaatatattcagccaggtgcaatggctcatgcctgaaatcccagcactttgggaggccaaggtgggtggatcacttgaggtcaggagtttgagaccagcctggccaacatggtgaaaccccatctctactaaaaatacaaaaaccagcagggtgtggtggcacatgtctgtaatcccagctacttaggaggctgaggcaggagaatcacttgaacctgggaggcggaggctgcagtgagccgagattgctccactgcactccatcctgggtaacagagccagaccctgtctcaagaaaaaaaaaattaaattaaatatattcacttattcctccaggggtagtagattcattactgagtcgttgtcttctacgtggggtcagcagaatttctgaaaaatatggaaaacatttagcacatttagcgtatcaatctgagtaatagcatatcaattccattagtatatttcctttattcccccgtctagtgggaatacttagatagattaggaagaatttttaaaccaacagtctaagactactccctgggtacatcttcaattacttgttgcttagagacagattttctttttaagattattttatcctctagtttttaatatatttaatgctttagataatagttcagaaggtatagccataattacaattttaaagctgctgaattaattacttttgttacagataagtgatttccttagttcacttttatatctgtcttcagcttccacaatgactttgtgacgatcacattggtatgggcaagagtgcaagagcttgctaaagtttcggctattcagggatttttctactgctatgcaacctaaaagaaaacaaattaaagttatgtgtagatgtcacaaaatatctagtaacaaatctatgatagcaaatatctatatgatggtaactgaagtaaaatcaggaactataaacacctcaagaagctcaaaatcatatgagggagtaaagacaacaaatacaacagagtgaaataagtgctgggagggaggtatgaacagttacggtgctttagaaaaagagcatctaggccggccacggtggctcatgcctgtaatcccagcactttgggaggccaaggtgggt

SEQ ID NO: 2898 - DNA, 4004 bp, Homo sapiens
atatcccatgtacttatatgctctgtggaacatgttcttgtaaaattaacatatactctattacctccttattaatgggaaattctgagggactgccttcatccatcacaataagctgggcccctcagcgttccccgccccaagctgacaaggcaagttctgaggtccacagggagccaggagggaaggccgtctcttttcatccatgcaatgcctacactatgcagaaaagggaggacctcaagaccaagaagcgattatgttgcagcccttcttctgtgaacacgctcaaaaacacacgaatgttcccgctaaatcagtgactccatcaaccttgatccacaggccttggctgtggcagagggactgcaggaagccacgtggctgagaacccaccttcttattaccatgttgggcagtttctaggagtgcttcctggtttcagattttcttccctttcaaagcagggtgggggtggtgtaaagcccttgctcgggctaggagccagatacgtggcagcttaattttccccattatgcaggacaaataccaagaagaattcccaggtgtgtctgcagccgtgaaaatgtgacatgagtcacagtgtcttcggaggaaatgaaagaccacaggacggggacatggcatcatgaaaaaagatgctttgtgattttcaacatatggtgacacttttcctaatttagagggggaagctgggttttgagttttcttttatcctccctctttgttaaaagcaagagaaagaagatttaaagaacatctgtgtattcaaatgatagaaatagaattatacactttcaaaaacaagttctagtatttttgtctctttcaaagatttccgaagcctatagatttctctcgtgtttgtgagagcatttcctctgagaccttagacatagtgttgaagttgaaatggtttttgtctttttcccctttctgttaacccagcccccacttcattctgttaatctcctttaattggacttaagataagactgagtatgttcaatatttttattgaattgagttttatgtttccagtctggatttatagactgttaaatagaatgttttacgtttctctctctcgcaaagaaaataacaaatacgtgtgggacagagccatcagtcaattatatcagtggattgttggcaactcacagggggaaaaaaaagagcattttcactctactcttaggggaaagcaattatatttaagagcagtagaaagccaaaactagcctggaacttcaaaacgcctttcttgactgaccaagaaaaggtacagtgactacaatgacaaaccagcccccagctcttttagaaatctaccctgcctcatgctaaagagaaagtaagtgatgtttcagcctcggcgaccaggcaggaatagaaaaatacattgacagtagttggatagaccttaaaattaagtaaaaatttcttaatatacaagatctcagttttcccacaaacctcctttctgtccagaaatttccatgccatttactgcctgatcatgtcaggaatgacgttcttccttgttcttgattttccttcctggaatgttttaatcctgcctctccagaacacttttccctacttcttctaggccctactcacagcaatgtagctgacacatagcattagcgtgcaaaacctcaaatcctttctgacttggaacttcacccaggaaagacctctagcaaaagtgctggccattgtgtcacaggacaaacccctttcaaagaacaaagccatcatcatctcaaaagccacagtcaccacctggaccttccgtcctgaggaaaggaatctccaccgaatctagggggaagacccccccaccagtctgtgcaaaagatgaagaattgagtatgcacctacctgtgcccttccatttccacctcttcccaccttccccgtttctttttccgttcatttttttttccactttaaaaacatccaactttgccttggggatgagcagaatgaaatgtcacttacctataaaaagagacagaagagaaagccatgcatcacattacacacaagttctttgaaatcaaggccagcttccgactttgaaactgtaacaatgagtgaatattattttttcatcctacctttctatatttaatgaaactcaggagttcgcaagtagcctatccccagggcccagtctcccttcgtgattttccttttgtttctttgcctcctccgtccctcttcaccaccctagccccacaccctctgtccccgcttcatggatgaaaggtcaggaaggaataaggggggaggggtgcacagacccagagatcaaggccagccctcagatgtgggcagcaaggtttcgaggcatgaggagccgcttttcacctcttttctcacaggccacagagatgggacccagggtcagtgccggctggtgcctctcgggaggagggaggaaggtcagctccctgcagggtgattttccacctggtggcttctgggctctttcaaatgactctgctctgagtcttcctcctctctccctccctcaccctcaccccctccgccctcctggtttgggtgtgaatgaattcacccaaggtctccatccccctcttcatcctgcagcatctgtctttcagacctgcttctacagaaaacctcattattgcagcaccctgaggccaacaaccacctgaatgggtcattgtgttcagtcccctgcctcaatacatgatgcaaactggcccacccgagtcctacgggacactttgagaaccctgagatactgagtccccgccttgcccggctcctggccgcagaggctccctgtcttcatgcaacaagctccttgtggccgactgattcggttctgtcggctgtaaggaagccaggctctgagcattctacttgcaagaacagcccctcacccaccacgctatgtagcggatccttcacgtgctcacatattggaaaattggcttcagggtcctgccagtgtcttcttcttcttatgcctgaataactcatttccttttagactcttcttaaaggtttcagttttccatctttcctcctccaagctcctctgagaccctccgtggaggacagctcagagctaagccctggagagaaaagcagccacgtgtcccccgattctgttgctgcatcccccaaagagatttccaaccaagatgctctgccagaaatggaattacggtcaaatattgcatcccgatcacattggtatgttaaagacttggagagggttcgaggtaaagatctatgctgaaacttttcctaacggtatttgactcagaaatgtttcttgctatatataaactaaaacaccgtacttcagaaggatgactactttttctctcattatgaatgtaaaactaaatacaattgagttggtattatcacaagcagtggccagaggaccttgaagtcgatggcccggccaccatgcccagctaattttttgtatttttattagagacagggttttgccatgctgtccaggctgttctctaactcctgacctctggtgatccgcccacctcggcctcccaaagtgctggaattacaggcgtgagccaccgcgtccggccgcttacaccttttaaagcttctgattctgctgtctctgctctgtggctttgcatctgggcaagtttctccgcagaccaggaacctctaagtcgggggaggaaagagaggtcgctgaatcagagcaaggcatgccgtcctcgtctgcatcctctattactcttgaataagagagaatgcgaggacaaacgggcatcagcatagtgacgtgtccatgtaggttcacgaatgtaagagctgcaccacgtgggtgtggaatgttaacagttggggaggctggggcagtgggaaaaggggtctatgggaatgctctgtattttccccttattttactggaacctaaaactgctccaaaaataaagtttatgaatgaaaac

SEQ ID NO: 2899 - DNA, 4004 bp, Homo sapiens; identical to SEQ ID NO: 2898

SEQ ID NO: 2900 - DNA, 806 bp, Homo sapiens
tttcgctgcacaaagccgctcacagtacatctctgaagttaacgcgctcagattttaacttttcaacctgtgccgtgccacaaactgggtcactgaaaaccgcggaagtttattcccccccgaccagggggggctgcgccctcagggagctgagcggtccccgtgaggccccttcgctgcctgcacagttcagctgtgccgtccctagcgcggcagtccctggacctggtgtgcagaggaatcgtggtaagaaatgtgcacacatcatccaggcagacggtcccgtgagtctgtccaacagaaaagaggaaggcgaggcggagtcctgaaggcgaggcttgcagaggcgggagaaccaggcagaaggccacgggcctgccgagctcccagcagcgacgggggcggcgccctcaacacgccggcgccctaggaaggccgagtctgtgttcgcgctgcctgcggtgtgtggcagctgcgcgctccttacctgtggggcagagttggccggagccactgcctgaagaaactcggctctgtcctccgttccggggagcggaatgcggccagtggatatctttgtaaagaagatgctgaatgtggatgtagaaaagatgcagaccctgaggctgaagagggaggaagctggaaactccgtgcgggtaactgaatgctaaggctgcttcctggcctccagcggtgtctgaggaaagggtaagtgaagggacttggagactggagacctcacacgcgccacggacatttgagctggtaggtggatgtcttcagagattagacagagacagagc

SEQ ID NO: 2901 - DNA, 5103 bp, Homo sapiens
cgcggtagccgggaccaagagctggctcagatcagggtctggaacggggacgggccgtgcctgggcctggtccccacctttggggccaaagcctgggtgcgggccttgcggatgctgcggaggacaagcggctgctgacaccgtgcggactccgccccagcagacccgtgccccagggacagtccctcccgcgcgcgcccagcgctcaatgccgtccccggccgcctagttcagcagctggctgggggcgggacggggtcgagttgcggggccgcgtccagacacggctgtgcgggcgacagctgcatcccctccccgcgccgcccctcgctcccggccccgtacccgccccagcctcccggccttacccgccacgggcctcggttggaaccgcgcgctggagtatccgtccctgaggccgcggccgagcgggaaggagcgggcgggcggcggcgcggaccctcagccggagcgcggagccgcggcgcctgggttttgcgcgaggcctccgccctgggattggggcgggcagtcgcggaggcgcatccctggtgagccggtgggaggggaaaaggatgtcgcgtcccccatccttgcggcctcccgtcctccgtcaccagccccctccgtctcctgcatcacaaggccccgtccccgcggtcccccgcgacccccgcacccggctccgctccacccgccgtgcttcctgcccctccacaccctcgtccccacccgggcccatccccctgtgagccctggtgccctgggatgagggccgaggtcctgagcggagagggtgcttgtaccagccccatggtggctcgagcccaccccgcggcccctcccgtggcaggtgcggtttctccaccggttgtcagctgcggggccgggcggagacctcctcaacctccggccttgtttcagggaggatggggtcgacccttgcgatccccagaggccccccatggctccttctgggctggctgtcttcctcctgtgggttctgatgccacctgggccgacggcgtcttctcagcccagggcggccgcgcctccggtgagtttcagctgagggcgcgcggccagctccgagcctggctccgggtgcagcaccggcctgggacctctgctgtcccgtgtaggggtgccctgcaaatatgtgatgaataagtgaagaaatacgttttatcttctaacttgccggatgttagaaggaaaccaagcttatgcttctcatttatagctaccgttaaggattggacagaagcttagctttttgggtgagacggacaacagtgtttttagaacctttggcaaggaagagctggaaagaacatgtatttgaaagtgactgacaggtcttctggccctagggggccacctgagcaggtgcacccagcttccctccaagacagaaaataaattaacaaggagagcaggaagggccccggcagactccagacgggagggggtgctgcccatcaggcagaaggagcttggaagggaggggccgtggccatgggacgtggaggtgggagcgggggtcatcataggtctgcacactcgggttgagtcccccttccccatcacacacaggacagccagcagtgagctgcttaccccaaggagtcaagggggttcttgggcaacccctggtgctggagccggcagtggacagcaccgcagccagaccttgcttatttttggctcatgaggaacatctgtgaccgttccctcccctggccctgggaggggatgtgtgacctccactcaagacagccatgcggctcctccggctgcgggcggggagggcatgtttcccagcacaggcccaggactgccagctgagaggctgggaggggcccctcacccctagactttgcatgtgaagccaagcgtggagcctcacagggaatctgagatgggagccagtgagatgggggcaggacccagaggggagaagaggtcctggggatgctgtggatctggatccagcgtgcgggagctgaggttccggagtgaaacactgcctttcatggaagcacgtcttcctgtcacccatcggcttcattttaaaggatgaaaatgtatcagacattcaaggagagctgcatcacataaaagaaagaccaggcaaagaaacggaaaataaatggattgagaaatgtgaatgactccaatcattccaatcattggaatgaatggattggataaaactccaatccatagactcagattagggagatatatttatataataagaacaggaaactgtgaagatgaaataagacaaaaaagacacttttgagattaaaaaattactgcaaaaaaaaaaaaaaaaaacaacagaaggatggaattgtatatttaaggaaatgtttctggcaaaaaggcagcaaatatgaaagaaaaggggatagacccaggggatccattttgggctctaacatctaacagttgttccaaggccgagaacacagaatgggaaaaggaagggggaggcggtgctccagctgattttatgattccagaagccttctatcttaagatgtataggatgtatcttagggtgtataagagaagcgcaagagaaacatttaggctgttttatgtttgagtagagacatgaaagttttagataaagcagcagcacaatgagtccagcggcacatcagaaagcaaatcaccatgatcaggtcaggttcagggtggttttatgtcataacatatgtcagtgtgctttacctattagtggaccaaaggcaaaaaatacggttttctacagagaaagacaaagcatttgatttcaatcaacattcgtttgtggtgaaacatgttgagaaaactcatcatagaagtgaaatgttttctttgataaaggctaatctcagaagacatacgtagtggagagcttttaaatgtatttttaaaaatacgaaccaatgagaagattgcctactttcaccgcttctgtttaacacagcattggcagagctgccaccaagaagaacacagcacgttgaaggcacggtggctcctgaagctgcagccctgagacctgattgtaccatggaaggtggggtggctcctgcagctgtagccctgagacctgattccaccacaagtgctgcagctggcagaggccacaggacataggcatagctggtgaaacctgcaactgagggtgtcgggggctcctgggagagcctccgtccccgctaaggagaggggctgcgtagaacctgtgtgctattgtcctttccccctttttcctgctgggagtgggacttggtgccgagggtggctcctgacatcggaagaccccaggatgctgggtcagcggctaggcgggtggagggtggggttgtccccggcacacggcggtgctgctctgccactctgcactgctgggtgtctcacatctcatccctgtattaagcaggtactccctagacttgcagccagatgtataccttagatttaaaagatggtagaatttctctaccagaacaaaaaatagctttaaaaaatataagataaaaagccattcatagtctggcacgatggctcatgcctgtaatcctagcactttgggaggccgagtcgggcagatcacctgaggccaggagttcgagaccagactggtcaaaatggtgaaaccccgtctctactaaaattacaaaaattagctagtcatggtggtacatgcctgtaatcccagctacacgggaggctgaggcacgagaatcacttgaacccaggaggtggaggttgcagtgagctgagattgagattgcgccactgcactccagcctgggtgacagagcaagactccttctccaaaaaaaaaaaaaaaaaaaaaagccattcaccacagtccgcaatgtaaaagacctctgtggagaacatcaaaaagttattaaagaatataaaagaaaatctgcataaatggaggatgcacaggatattgtgaaggtgaccgtttgccacaaattgatccataaatttaatgaaattacaataaaaatctttgcataatttttaaaagactgttatgaactgaacagtgtctccctcaaattcatgcattgaattcccaacccctaatactgcaggggtgggtgcatttggaaataggaccttaaagaggtgactaaggttaaatgaggtgaggtgagcttgatgtcgttaacaagaggaactcaggacccagacacccactgtgggatggctctgtgaagacatagggagaagatggtgtctacaagccaagaagagaggatgcagaagaaaccaaccctgccaaactgtgagaaaacaaatttttgttgtttaagccaccctgtctgtggcactttgttatgatagtaacaaaatagcacagaacccaaaagtttctaaagtctatatggaaaaataaatgcctaaaatagctattaataaaataattttgaaaaagaagatcaaagaagagtaactcaccatgtcatattaagacgttgtagaaagccatagtaataaaacaaccaagtctttgcaaggattagacagagaccaacacgagaacaaggataccattaagaagctcatgtaggaacctgtccatgtctacaggaataaaagaagattgagaattttggaagagactgggaaactaaaaggacaaaaaggaaagtctagaatcaaaaaatacattttaaaacacagaagattagacatggctagagagagaattagtaacatggaagatcaaaatatccagaaaaaaaaaaaggaggcagagggtacactataaaaaggcctgacatgccatgtaatagaagcaatggaagaagataatgaggtaggtgtaatatttaaggaaataatcaccaatcagttccaaaaactgatgaaagaaattaaatcatgaattctagaggcattacaaactccaagtgcaataaatacaaaaaaaagcatacctaggtaagacagctttaaaccaaacaacttccagaagcaggggaaactcaaattacctgcaaaagagtaaaagtaagactggcagctggcttctcaacagaaagaggcagtgggtgacaaagcagaaatgcagtttgt

SEQ ID NO: 2902 - DNA, 10068 bp, Homo sapiens
gttctggggactctgcccagggtcgcggggcagggacgctgagcttagcccgcacttctgctcccacgcgacccagaggtcgcctgagggcagggccggggaccgcgacctgccaagtcgtagggatggcctgagcaggcttggccgccctagagcggggtgtcgggttgcccacgcatccagatcaacactagcgtggagggagcattcctgaagctctgacctgagccagggcccgagtacatgtttccgccctcccacttactagcttatgaccttgggaaagtccggttgcttcactggagcttgtttcctcggccataaaattaagaggttgggctagagaatctccacagtcccaaacagatgtgaaattcttttcctttctagaactctcccttcttttacctagaaaacaaaaacctccttgacaccaggtaccgatgccacgttttgtgggagaaccacctcctctcttaaaatataaagcctccccgggagttccgcagaaatccgtaaaaatgtaatatgtggcgcggtacacaaatggaaagctgctcctaaacagcgctcagaactttgtacctctttatagtacagatcagactccgctgcaaacccaggcaacattagactccccgcttaactcccggaaggcagagagcttggcttgtttatccagcatccctacagtggcccagcccttctagcaggaggggttgggggggtggtatagtgatagtccttggttcagggggtagatgcatgatccagacacccacagccagctaaaagttatcaagctgatgcaatcagaattttgctggggctgggcttggtgactcacgcctgtaatcccggcactttgggaggcagaggtggcggatcacctgaggtcaggagttcgagaccagcctggccaacagggcgaaactccgacactactggcttggtctgcaaatggagagctccctcaagagtgccctttccagagagaagccctcacctctgccctgtgtgatgtctcagaagccactaccagatagccacggtttctgcagtcaaagacgtgctggaggggacagaggtgggcctctggagccagaccccctggggctgactcctgcttccactttagtcggcccttgaacaacaggggtttggactgcatgagtctacttacatgtggatttttttcaacaaaagttacactaaatttgcctgcctctcctgcctccccttcaacttctgctacccttgaaacaacaagatcaacccctcttcttcctccacctcctcctcttcctcagcctactcaatatggagacaaggctgaagacctttacaatgatccacttcaacttagttaagattctgttatgattttcttttcttttttttttttttgagacagttttgctctgtcccccaggctggagtgcagtgatgctgtcatagctcactgcagccttgaactgctggtctcaagcaatcctcctgccccagcctccagagtagctcggatttcaggtgtgcactgccttgcctggctaatttttttttttttttgagacagagtcttgctcagttgtccaggctggagtgcagtggcgcgatctcggctcactgcaagttctgcctcctgggttcacgccattctcctgcctcagcctaccgagtagctgggactacaggtgcccgccaccacgcccggctaattttttttgtattttcagtagagacagggttgcaccatgttagccaggatggtctcgatctcctgaccttgtgatccacttgcctcggcctcccaaagtgctgggattacaggcgtgagccaccatgcctggcttgcctagctaatttttaatttttttggtagagacagggtctcactatgttgctcaggctggtctcaaactcctgggctcaagcactcctcccacttcagcctcccgaagtgctgggattacagacgtgagccactgcgcccggccatgattttcttaataacattttattttctgtagcttactttgttgtaagaatacagtatataggctgggcgcggtggctcatgcctgcaatcccagctctttgggaggctgagacaggcagatcatgaggtctggagttccagaccagcctggacaacatagtgaaaccctgtctgtactaaaaatacaaaaattagccgggtgtggtagcatgcgcctgtagtctcagctactcgggagactgagacgggagaatcgcttgaaccctggaggcagaggttgcagtgagccgaggccacaccattgcactccagcctgggtgacggagactccgtctccaaaaaaaaaaaaaaaaagtccgggcgtggtgacttacgactgtaatcccagcactttgggaggccaaggcaggtggatcatgaggtcaggagttcaagaccagcctggccaagatggtgacacctcgtctctactaaaaatacaaaaattatctgggcgtggtggtgggcgcccataatcccagctactcaggaggttgaggcaggagaattgcttgaacctgggaggcggaggttgcaatgagcctagatcacgccaccacactccagcctgggcgacagagtgagactccgtctaaaaaaaaaagaaaaatatactatctaatacatatagcatacaaaatatatgttcatggactgttgatgttatctgtaaggcttcccatcaacaataagctattagtggttaagcttttggggagtcaaaaattatatgcagattttctactgcatggcggggcagcattcctaatccctgtggtattcaagggttaactgtatttcttggtgaccttggacaaattgttgaacttctctgtaccgtggtgtccgaagtaaagtagtccattcaggcacagtgctaggacaccacctggcctatagcatgtgctcggtcaaagttaactctactgtaattcctgcttgggttgttctggggatacctaatttctccccaccagccacttccccaagaatagtgagtgtgagggtccttacagacagggagatgagagcgtcactcctctttatgaccgtcaaagctctgcaggtgctcgcccttcgggtctctccagcctcacctggtacccctctcccccttgcttgctttctgcagccatggtggccttttattcctcagacccgttttctttcctgtcccaggaagggcctttgcaggtgctcttcccacagcctgaaagttcctcgggtagctggctcttcctcaccctccaggcctccaggcctcagttcaaatgcctctccctgggagaggctggtcctgaccaccaccgcctcctgcctaaacacagcagattctctctcccctctagaatccaaacaccaggggagcaagagtagagttggtttcattcaccccgggctctccaagcatagcaaacgctctggaagcacgtgatgagtggctgggtgacgaagagctacgacccgagacatggtacccacatgggtacccaccctatgggtagacacgagcctggtgtcaggaggaactgggtttgaatccttcaacaactgtgtggcctttcctctctctgagcgtcgatgtccttattcgtagagtggatgatcataccttccttgcagagccattgcacagatagtgacataggcacacacaatacagtcctggctcacgctcaggagacagtggctgtcaagtcaggagcccgtcctgcagcagcctagccatctggaaggatcactcctcgacatgccgtcaatgcctggcacttggtaagaatgagtttctcacatttctctgaagggatggggtggggggcaggtagagaagaaggctctgggcacctagggtgggaaggaagaagagagagactggccctgagggtagccagtgcctctttgttcattttctcaccagaataacaggggaaatataccatttagaaagaggcagtgaggattaaatgagctagcatatccagcacatagaaggccctctccccatcctcgtccctgaaagcaaactcctcgatttctcagttttgctctggttcccaggctgtgcatggaggcaaacacagggcccttcactcaggccaagctcaggagagcccaggctgcaccgagtccacactctcggctcatttccctcagtccaccaagaggatgacaccaaggccccctcctgtacccctgcctctgccccagcaagtcctactgagatcctgcctgttatgaaatggggctgtcccattgggtgcagggcagatggcaccatgcctctaggagcctcagcatgtgtttccaaggagacagccgtgtgtgtgtgtgtacacaccaacttgtaccatccagttcttcaaaggaaggtggaaagaagggaatgagggtcaggttgcaaatgggatgtaggtggaagacgcacgacgccaggccatgctgctgtttgcctttcacagaaaaaaccagcacagcatctcacggtttgcagacactttcacatgggataactcacttaatcttggcaacaagctcatggcacagatattcttttccgctttttaaagtctggagatggagagagaggggggcaagtcccaaccagtgggttgtagaattaggatttgtggcctgactctgatcataagccccctgctctcttcccagggccacactgccttgcctagaaaggattctagatcaggagtgcccctacgtggggatgccgcctgcccagcccaaagcaaaggccttgttcagcctttgaggtgtatgttccggcttcacaactccctgaaacggaggcctgagtgaccggagatggcaagaaaatgggaggaggtgtctctaagcatggccagggccccatgggagagggaagtatagggtataaaatgctaatcatatgatttagagacacagtgtctttccagaagctggaagagaaagacgttaagagctggagtgagcagtctggaacagaatcaactcttggaaaagtatccttgggagacaggttgggagtgaagacaggaagagtggttttcaggatttagggcccagggacatagaggggaaactgagtcagggcttggctacagacccacccttttgctggaaatggatttctctgccaaaagagaaattgtttgaactcatggcctagagtgaaggccaccaagaagccattgtcgttggaagccaagggagtctgggagctggtcagctctggtggagaaagtctgtttatccagggacaggaaagaggcaaggtctacacgggctgggctgggaggcccaggggcagcacgagggagagggaccccaagtctgggtttcaaggggcatcaatgaactagaaaacggaatgaggctgggtgcagtggctcacgcctgtaatcccagcactttgggaggctgaggcagctggatcactggaggtcaggagtttgagaccagcctggccaacatggtgaaacctgtctctactaaaaatacaaaaattagccgggcgtggtggcgggtgcctgtaatcctagctactcaggagactgaggcaggagaattgcttgaacacgggaggtggaggttacagtgagctgacgttgcaccactgcactccagcctgggcaacagagtgagacactggctcaaaaaaaaaaaaaaaaaatgccaggcgcagtggtttacacctgtaatcccagcacttcgggaggctgaggcgggcggatcatgaggtcaagagataaagaccatcttggccaacatggtgaaaccccatctgtactaaaaatacaaaaattagcctggcgtggtggcgggcgcctgtagtcccagctactcgggtagctgaggcaggagaattgcttgaacccaggaggcagaggttgcagtgagccgagatagcaccactgcactccagcctggcgatagagcaagactcttatctcaaaaaaaaaaaagggggaaagagaaaataaaagaaagtggagtgagaggctgcacggagcggagagcatggggagagcacacctggagtttctcacactccgcagactttcctgtacacttccctcccactggaggtgagatacgctctgcacatgacctaaatgtgtgccgaagcacagccattgggcaggagaaagaagagaaaatggggagtttgtaaacagtcatccaaagagataactgcccccttccactggacgggagcagcaggaagtccaccaaagcaagggcacgcggacctgagggcatccctgttttctggagcacctggcctctgttgtctttctccaattcacacccagagtcagagcagtggcagatggaagagaagccacttcaacaactacttaagtacatggtccctgatggcaagtaattctgtaatcattctgtgtggtggctataccctcttttcaacaaggtctattgcttttcaggtagacgtttctgtttataaatggtctggagattcgggcagctttgggaaactgattgcagattagggggcagtaatgtgctgcagtcattgtgagtcctgtggctcttcagccctcttcccctcattttatctagcagttggctgctggcatctgtcggtcctgtgggacctcatgcttctcactctcagtgagatgccacatgaagtgacaggaggtgacccaagactggcccacaccccttggacctgcccagccatgctggactaactaattctcggccacagcttgccagtgctcggcaaagctctgcctgaaaccttgggcggtcccctatgtgccaggccctgactttgctcatccacagtgagggagggggacttttcggctattgcagggccccacagaccagctgggagccagagaccggcagctgctgccacacttcaaaggccttgttatcctcatctgaggagcagtgccccgagtcgcccctgagaatcctccctgccccactggcagcctcgcccttcatgtgtgtgctggggggcatcctgggacaccttgggggagccaggagggactgtaccacccttcctgggttcctggaccaaggaggggaccctctaccttagcttttggaaatgtgttcagctctgcccacccacacaggccactcagagatgccaaaaaagtcagctgtggcttgtttgtgggtgtggactccaaatgggggcagatccctccggctgagttgcagagggcttcgctgaggaggtgggcttctcatggtgagcaactggtgtccccagtgctaggaggccacaggagcgccttctgtgacactcttctcagagggtggcctggactgtcccaccatttgacagcatggagtgtggtcggaggggcctgagcccagagctgcgtgcgagagctccggagcccctgccctaagctcccagtacgtccttccccgttcgggcaatgtctccctggggctagaacctgctgaccctcctttcctggcttagcccaagcaaacccacacccagttccagaggggtgaagggaggccgggggctgtgggatctgtctcctggctctggtttgggagtgggctgagagcgtcctgtggaaggaaggagtcctgcggggacaaccagggccacctggtgatgctaggtagcaggtgctggcacagcaggatgagagggaggcctgagaaaggtcccctgagaggacaccccaggtgctcaagtcagactcaggcagcaaaagccagctgggcccctctaaaggcaaggaggagttggagccctggggacctgggggtgacctctgacttctgggaacagaagagatttggagagagatttatcagtattctccgccaaactaatctggccatggggttcccaggcaggacttgggagacacctggtgctggccaccaggtctgcccctcagtccacgccctcctctctcctccctcgcgcgttttgcctgtggtatcctaggaacgcagggcttcgagccttgtggtcctgttacataacagtttccatcccatccatgagttcagccctccggcaagcgggagctgcagcaggcgcaccaaggaaagcctctgcttcagacccaggctcctgctgcccaaatccacagtccctgccgctcctctgccacccccagcgtacagggggagggagcttcaaaagcagtcagcatccagccagattctttcaataggaccccctgtcctgtcctggtcccacatgagcacagcacctgtcagtggccacacactggccatggcttccccaaatccagcaggcctaggagagagtcccagagccggtgtgacacatgcctcctcgaacccctctccgcactctgcaccctgagaccaagggcgcaccactgctgagaccctccctggcttggagatgcctgtcctgccactgtgcctgtggctgccccctcgccccctcgagtacctgggcagccaatcaatgcaggtcacctgtgctcctacctgttctcttctctggccaaggcagagagtgctccagcagggacttgaggacctcaggcatgtccatggcaggggccactgagaaccagtcgcagctcacacagcccagcaggaggtgcttgctccagggagttcagaggcagctggagaggcaggggccgccagccgcaggctagggaggcaggcggggtgggagccttgaggcagccaatggccagcaccagtcccagcccgcccgtccacccccggctcggccacctgccagctccggctgcagccaggccttcccttcccgctgcttggcagggcgggcctggccctgcgccagctgcagcacgtggagctgtcgcgccaatcctctgacagagagcccagcctgttatctaactttggaaagggaagttctcccccaggctgggagccataactggggctgccaggtgagaatggtaagctccacgcccacagcaagcacgcatcagcatggaggtgccctggaggcccaggcacgcagtggaaaccatcccgggctgggacctgaggctccaagagaaaaggaggatgacaggcaaggacagcacctcaggcagccgagcacaagacaccctgtgttggcagatgcagggatgcggtcggacatcatgccttcacctgtgcgcttctgagcctcaagggcttgtggcatgttttgatgctgtgtttatgccatgcacacgtaccctacaaggcacgccagtgtacatatggcatgcataattggagctttataccatctgcacagcctgaagcctgttccccaaaaggaagtgataaaacctaccgcctcaggttctttggtcttcaggggagaggggaaaaggggcaggtgccaggagaccaggcaccactgaaaggggggcagctctgccagcctgcttcaggcttgtcctggatgaggaatccctgcttcccagtcattgtggggacttaaagtgccaattggctatttgctgtagttccctctcataccctcccaccaggacgctggcccctgtggtccttgggttacttgaatgggtgaagcaaaggttctggatgtcaacctctacgtcagaccaacatcacgtcaaagccagacttgccgggggatgccaggttctcgattctgccgtacattgctgtgggatcttgagcaagcgtggcagcaactctgggtctcagttcccgaaccaccgaatgcagtgacctctaaggtgccgttcagctctagttctatggctctgaagctccagatgggctgcaataaacatttggttttctgcgtggtagctgatttttttttttttttttgaaacagggtctttgttgctcaggctgaagtgcagtggtgggatcacggctcactgcctcatccttacaagtagctgggaccataggtgcatgccgccacactggactttttttttataaagacactgttgcccaagctggtctcaagtcctgtgttcaagccatcccccggtcttggcctccccaaagtcttgggattatgggtgtgaacactgccc

SEQ ID NO: 2903 - DNA, 1792 bp, Homo sapiens
agtctgtctgacacggtcggctgtgcgtgggtcccggtgtctgtctccgcgtgcacctgcatatctgctcatcttgtctccctctgtgcctgtgtctgacgcgttcctgtcattatccctgtctacatgactccgcggggctgtctctgtctgtgtgtctgcctagctcctgtctcggtcttttgtctgggtctgcctctgcatcactagcgtgatcacgtgtgtctccgcacatgcccttctgtgtttgccttcatgttactgaacagagtcggggcgacactggcgcaggcccaccctcctgactccttgctacactcctctcgatcctgacgtctcgctggatcagtgatcattctgtctgagtcaagaatttggaggtctgtctgccttcaatcaagttctgtcccatccctcgacatccctgcttatcctcagagctccctgtggctcccactgtggtgataactgctagcattttgtgaatatttgttacatgccaggcactgtattaagtattttacaagcatttcttttactcctccccaaaacctgacataggaggtactctgattacccccattttacagatgaggaaattgaggcccagagaggctaggtgacttggccaaagtcattctgcaagtgaagaatgaaagagctaggcttctttccagagccacattcttaccactcttatgtactgcctctgtcctactctccctcccttggttttatcctcacaggccatctcctgggtcaaccttcctttcagctctacccatgttaccatccccaatgtctcacgtcctctagaggataaagtaggaggctgtgcagcaaatctcagaagtcataggttcttcataatgaagctcattcagttaacattattcaacacaaatccaccatgcaccccaatgtgcaaaacatcaagcaaaatagtgagagacacatagaagaaaacagtcccactcgagaaaccccatatgtaatgaggaagaacaacacagagagaacttaagcccctggcttagggattatcttcccttttctcctacaaaggaatgggaaataaagcagggcctcaggcagagaactgacagaaggagagagggaagcagaagagtaagacttaggtatgggggcaaatgctatagtgcagtggggagagaatgggactgaaagagatctggaaggaaaggtgaaatgccaagactgctgtggctggcagtgatctccactatctccccaaataaattctgaacaccctccaaaagccagggtgttcaacaactcctatagggacaaagctgtttccctaccaagaaaaaattcctccagggtagctcatatccacttttcagcttgcaaactccctcttcatttcaataagcaactgagttgtagcactagggagatagtggggaaaagattttttggtagtagtggagaggctggtgaagtacagggctgaaccatttataggagatagaagggaggtccataaaccaggagggctgaaccactcaagcaccacatggtggggtgcttagaattggactggaccattctgaagagtgggcatgatccagatcataccgagcatctccaaccatgtggtgcagagttagactgctgaggagagagggtcactcagacaggacttaccagatggagtttggtgtgccctgtctcattggaaccaccaccccagcagtggggtacaacagaccacagtgggtggggtgggcagtgctacggggctggcatgttgccctggggggaacct

SEQ ID NO: 2904 - DNA, 2260 bp, Homo sapiens
gctgtacactgctgggggccccactttccaatgtttacttctgagattggaagaagaagacaagaaacacctcctcaccccctaccctctgcctccacgcccgcgactcagcccaggtgacccaaacggcagagtcaacttggcgcaaccggagcgtccccatcgcgccggccacccccagcccccttcgcccctcgcttggccccacaatgcgccgttgtgccgcgcctgccgtcaggccggggatttggagcagggatggggggaatattcgtcagatatttaaaacagagccgagagaacaaagcaggcctttgtgcagcagggcggcccgggagctgggagccgccggcccccaagcactgtgctgggccaggagagtgcgcatgcgcgcggcgacctgtgcgctcgggttctgtgccggcttttaccccagctgaataacctggtggtcacaagaaagcaaagggatttttatgtgacatcatcttggcaagaagctcccttaccaaccttgacctccaggtctccatggcaactgctgctgggacatcattggcaccagattgtgtcccttaaaggccacactgcagcaagggcagataaacaatttcatggcaacagtcacgtagcaatctcattcttaaatgtgggctggttagttaggatgatgtaagtggttttttccactctcttccgcattctgactccagaattctgggcctaggacatagtcaaagaatgtaccttggggtatgaggtaagaaaacaggctggggtgggacttgaagaagtaccttcttctagacacagggacagattctttttcctttcccagttgagagttcattttctgtctcggttcaacaaaggcatgttatctttatataaaggaagctgtaatagacagtctccaagatggcagcctttagttctttccctcctcagattcatgagctgcttctcacctcttaaatctggtctacctatagtgacttgcttgaccaacagaatatgctaggagcaacattctggaacttccaaggcttggttgtaagaagctttgcaatatctgcctggatctcttagaaccttcaatatgggacacttgctctagaaatcagccaccatcctgtgagaagtccaagccacagagtgaggccagaaatagttgctgcagtcaagagccccagctgagctctcagccaacattcagcatcactgccagccatgtgagtgagtgatggtgaccttggatgtccagctcagtagaaccttcagatgatttcagccctagccgttccaactgcaagacatcctgagtgagctgagcccagtcaacagagatgtgagagataaaaatgcattgttttgagacactaagttttagagtgtctgttgtgtagcagtaggtagttcaagaggaatgaaatgctagatggggtatggaagataggagaggacctcctgatagctcagctactttgaaaggctttatttatcaggattttttgcccctgcatcccaccaacaccatccctgctttctgagctgtgcctggcacactgcaccacacaaaccttgcactgctcactaactgtgccatgtatataagcctcctcagcccgatggtggacaccttgaagatagggacctatatgatttgattcctaccctccttagcactgacagatttgtcaagctgttccagtggataaatacgggggataactgctggaacagcatcttgaggtgtttatatggcttggcttctgatctttgacatttgataactgatgaacatgctatttgggcccacccaggagccagccacaccatgggggagtctgaacctcacccacactgtggccactcaggggaaggagaccagggccaagaacgcagttgctaacctcctgcttagatttgcttcttgcggggcagccctggaaacccaaagaagagctaaaactgtgtggatgagagaaaaccttcagaacccattcatagagataccaggagcagctgagaacccattgtaggaaggacacatgttcaagacctcccccatctgcccatctagggacatggatgtttaacatgctagggtcagaagtgggaacataggtcagcttgagtagaacctggtgcctgtgcaggaaccctgccttctgtgggcccagctactcgggaggccaaagagggaggatggcttgggtctgggaggtcgaggctgcagtgagctatgtttgcaccactg

SEQ ID NO: 2905 - DNA, 12606 bp, Homo sapiens
gctggtaatggtcacactaggtggcgtccgcgtgaggtggaggtgtcagcggctcctgtctgcagcttcctggggtcctggcggcgctcttctcctgagccagaatccagcaggaaggacagaatgggcgctagagtgtgaaaagagggcgaactcacgtggatgtgactctccgggtcgctcttccctgtcacccagctcctcctgccggtttcctgtgggcatcgcctgcattgcttttatcccggggacggattaggggggtccagaggaggacttgctggcacaaataacccaatggaggctttcgagcacggctggctggggtttgcgatccaacggccttttgctgacctgaaagtcaacgcaaagctcatcttcattctagagaaaaagaagcctcatatctgagatcaggaccccgctttctccttgacattccacagcaaaacgtgaacagctgaacaaacacacagtccggtttcccgagaccaaagggtcaggggaaacccccgctgaaaacgtgcatcagtggaacaactactctcttccaggtcccaccgagggcaaagaggagaaatagaatccctcacaagaaatccacaacttctagaaatccgcagcacacacagaacacacttacctctcacagctctacggacacttcacaccccacagtgggaccgtctgattgcatttgcattttgggacatgtagtccagaaagcttaaatgatgcgagaaaaaccacaagtcccacaatcctccgcgtctcgcaattgacagccccagatcatccaggaacgccccctgtcggctctttctggtcagaggttcccccgttaatataaaagcttttaatcatggatttttttctttgttttcaatttctgtgggcacttagtaggtgtatatatttatagtgtacataagattttttttcttttttcttttttttttttaagacggagttgttgttttttttttttgaaaaaactccagtctggagtgcagtggcacgatctcggctcactgcaacctccctctcccgggttcaaccgattctcctgcctcagcctcccgagtagctgggattatttttgtatttttagtagagacgggggtttcgccatgttggccaggctcgtcttgaactcctaacctcaggtgatccgcacgccttgacctcccaaagtgctgggattataggcgtgagccactgcgcccggccatcttttctcttattttttgtctttttttcttttctctgtgcctgtctatgctttacccacatgagatgttttgatacaaacatgcaatgtgaaatgagcacgtcattaatcatggatctagatttgacttttttttaaagtttttgtatttttagtagagacagagtttcaccatgttggccaggctggtctcgaactcccgacctcaggtgatccgccaacctcggccccccaaaatgctgggattacaggcctgagccactgttcccggcctagatttgactcattctaaacatcagagtttgtgatccttttcattcacaacgacagtatcaagttatttgctattggtaaaataccttgaacttgtgaagaaatgtgtttatacatatctgaaaaagtgatagtttgttgttgttgttgttgttgtttgtttgtttgtttttgagacggagtctcgctctgttgcccaggctggagtgcaatggtgccatttcggctcactgcaacctccgcctcccgggttcaagcaattctcctgcctcagcctcctgagtagcagggattatgggcgcatgccactacgcccggttaatttttttatttttagtagagacaaggtttcaccatgttagccaggatggtcttgatctcctgacctcgtgatctgcccaccctagcctcccaaagtactgggattacaggcgtaagccactgtgcccagccaaaagtgatgtttttacagttaatatgaagccaaatatattatacctggactaatgtacttaacctgcttggcttctccaattttatttatcatattttttttattaagttaatcaaacaaggcctgcgtctcactcccagggattctgatctacaaatttcctaattgttcctaatgtgtagacaaccagaactgccgctctgcagcatcacctaaatcaataaatgtataagtgtctttggacataaaggtgggcggccagcagggaccttgaagaccacctaaggactcccttcccccattttaagatgaattgggctgagtgcagtggttcccacctgtaataccaacactttgggaggccaaggcaggaggatcacttgagcccaaaagttcaagaccagcttgggcaacatagtgagacccactcactacaaaaaataaacaaaattagcggggtgtggtggtgtgtgcctgtagtcccagctactcaagaggctcaggtgggaggatcactttgagcccaggagatcgaggctgcagtgagccataattgtgcgactgcacttcagcctgggtgacaaagtgagatcccatctcttcaaaaaataataataataaataaagatgaactgaagtgcagagaagtaatgtggaagcttgagaaagagtttttaggtttttggttctatcattgtatctttggaggtaatattggcaaaatgaccatttagtagtttgcccatttctgctttttttttttcttttttttgagacagggtctcgttctgtcacccaggctggagtgcagttgtgacatcacagctcactgcagtttctacttcccaggcccaagggatcctccaacctcatcctctcgagtagctgagatcacaggcatccaccaccacgcccagctaaattttgttattttttatttttgtcgagacacggtctcactatgttgctcaggctggtctcaaactcctgaactcaaggaaagctcttgctttggcctcccaaagtgctgggattacaggtgtgagccaccatgccgggcctgcttatttcgacttggcagcatcgtttcatgaagcccctgactctgtgacaacatacagctctccagaaagatgctttgaagacaaaacagaatagagcacacagccctccatgtctcttccaagtcactatattcattaaaagataaatgactctggtcattgccttttcctgcacaagataatgtctgatggggttagtgatgatacctctgtaatccataaccagatatactcttgcacccaaactttgatatgattgtgctttaatgtaactttgaagcaagtttaatgtgattttgcaggcgccgtacactcaccacttgtatatgagtggctgaaattctgtgttggaccagtctgatggaactgctcccacactatagccctcggtctgtaatcctcagtaagacttgtaagtaaaactaactttaattttttttttttttttttgagagagtctagctctgttgcccaggctggagtgcagtggcgcgatcttcactcactgaagcctctgccttcccggctgaagtgattctgctgcctcggcctccggagtagctaggattacaggcgctcgccactgcgcccggctaatttttgtatttttagtagagatggggtttcgtcatgttggccaggctggttttgaactcgtgacctcaggtgacccacctgcctcagtctcctaaaatgctaggattacaggagtgagccactgcaccccgccacttttattattattattattgtatttatttatttatttatttatttttgagacggagtctcgctctgtcgcccaggctggagtgtagtggagagatctcggcccactacaagctccgcctcccgggttcacgcgattctcctgcctcagcctccggactacaggcgcccgccaccacacccggctaattttttgtattttttttttagtagagacggggtttcaccgtgttagccaggatggtctctatctcttgacctcgtgatccgcccgcctcagcctcccaaagtactgggattacaggcgtgagccaccgcgcccggctatttatttatttatttatttatttatttatttattttttgagacggaatattgctctgtgcccaggctggagtgcagtggcacgatctcagatcactgcaacctccgcctcccgggttcaagtgattctcctgcctcagcctcccgagtagctgggattacgggtgcccgccaccatgcccggctaatttttgtatttttagtagagacggggtttcaccatgcttgtcagcatggtctcgaactcctgacctcgcgatccgcccgcctcagcctcccaaagtgctggaattacaggcatgagccactgcgccctgccactttaattatttaaaagcttatttttttattttggggacatggtctcactctttcacccaggcgggagttcagaggcacgatcactgcgcactacagcctcaacctcttggactcaaaccatcctcccacctcagcctcctgagtagctgggactacaggtgggccaccaagcccagctaatttttgtatttttttgtagagacggggtttcaccatgttgcccaggctggtctcgaactcctgggctctaggctttccaaagtgttgtgattacgggcgtgagctactgcgcctggccgattctttttaacttagtacacagggagtagtagctccagcaacagcgaaagtcagtagctgtaggatctactaggcggggaaactcatatgacagccccctccttttttttttttttttttttttttttgagatggagtttcactcttgttgaccaggctggagtgcaatggcgccatcttggctcaccgcaacctccgcctcccgggttcaagtgattctcctgcctcagcctccccagtatctgggattacaggtgtgagccactgcgcccggccaccccctttttttttcaaggctgcagtgagccatgatcctgtgactgcactccagccactgacagccctttctgcattagttaacctgaccacatctgctgaaagaaagcaccagaagctagactgaaattttcgttgtcaaaaaaattataatcccccccaaaatttaaaaattataatccagcacattttctgcacacattttctgggtatttgatcataacttttaaaaatgtgagaacagtgacattctccttccccattcaccaattttactatgaaaaagttcaaacctaggttattttttcagttctccaagtggaatgatcatcactaatagagattggttgggaattctattgtgcttctaggcccccaaaaatctcatgctctgaggaaaagttagctgagttttcaatttttctcatagtgctggaaaatcatccctggacggtgaagtcatccaagtcttttttgttttgttttgttttttctttctttctttctttcttttttaatttttgtatgctttgtttctatttctttttttttttgtcatccaagtcagctggtgaaacacacaatttcacttgatagctactgagagagtgtaatgggccacccattctagaattctcaagggctaggaagttcctttgataccctcatgggattaggattagggctttagtctttttctctctctctttttttttttttttttttttttttgattacaggcgtgagccaccacaccaagccccattatttatttattttattttatgtatgtatgtatgtatgtatgtatgtatttatttattttgagacggagtctcgctctatcgcccaggctggagtgcagtggcgcaatctaggctcactgcaacctccgcctaccgggttcaagtgattctcctatgtcagcctcccaagtagctgggattataggcgcccgccaccatgcccagctaatttttgtatttttagtagagacgaggtttcaccatcttggccaggctggtcttgaactcctgaccttgtgatccacccgcctcggcctcccaaagtgctgggattacaggcgtgagccaccgtgcctggcctagtgtttttctcacaactccaccccatccagaattaatgactaaatccttgactggatgatcaaagtaaaagaatctaaattcaccacattgctagtcttttctttttatccaggctgtgaattaaataagaaatctgctgcagtggctcatgcctgtaatccctccccttggggaggccgaggcgggcggatcacttgagcccaggagctggagaccagcatgggcaacatggtgaaaccctgtatctacaaaaaatacagaaaaattagctgggcatggtggtgtgtgcctgtagtcccagctacctgggaggctgaggtgggaagatcgcttgagcccaggagatttaggctgcactgagccgtgattgcacccctgcgctccaacctaagcgactgagaacatgtctcaaaaaaaaaaaaacaaaaaaaaaaacacaaaacaagttagaaataatcacataacacatcagcatcaaacaggccttttaaaatgtcgtttttgaccatcctggctaacacggtgaaaccccatctctactaaaaatagaaaaaattagccggccgtggtggcgggcgcctgtagtcccagctactcgggaggctgaggcaggagaatggcgtgaacccggaaggcggagctcgcagtgagccgagattgcgccactgcactccagcctgggcgacagagcgagactccgtctcaaaaaaaaaaaatgtcatttttgtatatggatgatgagtacatgaatgttcactgaggaattctttgaacttttcgtgtttacaattttttatgataaaatgttgggggaaatgttactttctttttttttttttttttttttttttttgagacggagtctcgctttgtcacccaggctggattacagtggcatgatctcagctcatggcaacctctacctcccaggttcaagcgatcctcctgcctcagcccccctagtagctgggattacaggcaagcgccaccacgccccgttaatttttgtattttgtatttttgtaattttgtatttttgtattttgtatttacagggatgtcgccatgttaccaggctgatcttgaactcctgacctcaggtgatccacctgccttggcctcccaaagcgttgggattacacgctcgagccaccacacctagaccagatgtaggtttctaatagctttctacatcctgaaggaaaacaggcagtgagggtgaaagttgcttcaaattttagaaactgtgaacattctgtggaaataaatccttattatttgagcctctttttgaattaaggtgtccaaacccttttgaattaacatatgatccagcaattttacttctaggtatgtacaccaaagaatagaaaacaggggccaggcgcggtggctcacacctgtaatcccagcactttgggaggccgaggcaggcagatcacttgaggtcaggagttcaagaccagcctgaccaacatggagaaaccccgtctctactaaaaaaaaaaaaaaaaaaaaaattatctatatatatatttatacatatatatatataaaattagccaggcatggtggcgcatacctgtcatcccagctacttgggaggctgaggcaggagaatcacctgaacccaggaggcagaggttgtggtgagctgagattgcgcctttgcagtccagactgcgcaacaagagcgaaactcagtctcaaaaaaaaaaaaaaggaaaacagaaacttaagctgatatttgcacaccaatagcagcattattcccatagacaaaaggtggaaaccagcaatgaccatctaaaaataaatggataggccgggcgccgtggctcagcactttgggaggctgaggcaggaggatcacttgaggtcaggagcttgagaccagcctggccaacatggtgaaaccctgtctctactaaaaatacaaaaattagccaggattggtggcacgcacctgtaatcccagttagttactcgggaggctgagacaggagaactgcttgaaccccagaggcggaggttgcatgggctgagattgagtctatgtactccagcttgggcaacagagcgagactccccctcaaaaaaaaaaaaaaaaaggataaacagttggtccgggcggcagctcatgcctatagtcccagcactttgggaggccaagatgggaggatcacttgggcccaggagttcgagaccagcctgggcaacatggtgagatcctgtctgtacgaaaaatacagaaagtatccagctgaagtgggaggaggatcacttgaggcctggaagcagaggttgaagtgagctgagatcgcgccactgcattccagcctgggcgacagagccaaaagctgtctcaaaaaagaatgaatgggaccgggcgcggtggctcacggctgtaatcccagcactttgggaaaccaaggcgggtggatcacctgaggccaggagttcaagaccagcctgaccaacatggtgaaaccccgtgtctactaaaaataatcccagctcctcgggaggctgaggcaggagaatcgcttgaacctgggaggcggaggttgatctcgccattgcgctccagcctgggcaacaaaagcaaaacttcgtctcaaaaaaaaaaatagacaagaataaatgggctgggtgaagtggctcacacctgtaattccagcactttgggaggccgaggcaggcagatcacgtgaggtcaggagtttgagaccagcctggccaacatggtgaaatcctgtctctactaaaaatacaaagagtggtggcatgcatctgtaatcccagctacttgagagatggaggcaggagaatcgcttgaatccgggaggcagtggttgcaatgagccgagatcatgccactgcactccagcctgggcaacaagagcaaaaactccatctcaaaaaaaaaaaaagataacatctcatacagtgaaatattattcagccataaaattaatgaattcctgatatatactacaacatggatgaaccttaaaaacattattctgaatgaaataagactgacctcaaggacaaatattgtatgattccatttatatatatataaagtactcacaaagtcatagagatagaaagtagaaaagaggttgccacgggggctggaggagaagggaacagggagtaagggtttaatgggtacagagtctcagtttccacccttgggcatgaaagataaagttctggaggtaagtagtgatgatggttacacaacaatgtgaacatattctatgccagtgaatttacacttaaggttaaaatggtaaattttatgtatactttggcataatttaaaaaaaagtttgaaaaagaaaaaagacaaaacaataatcgtctttggagaagtctgttacactgaatctggagccaagtgaacagaaccctgattttgatcccttttctctcaaaagcccttcgcagtctctgaattaagtctattagcatgttcctcccatagtgctttgcttcatatcaacaaaaacctagctaagtgaaatcagcaacgatatgcagaaaccacctacgcaggtcacaaacatctttctatgattgtataattttcaagcaagcaataagtgaagatttttccataggccctaaactcacctttgcgaaataggaagctggtttattgggagtgatgagcagggggcgtaacaaattagctttgcgcagtggcagtatcgtagccaatgaggtctatccgaggcgcgattattgctaattgaaaacttttcccaataccccgccgtgacgacttgcaatatagtcggcactggcaatttttgacagtctctacggagactgaattttcttgcagttgaacaacagaggctttttttgtgtgtgtgggggtgcttggttttgggaggttgaagagtacttgttcgcaaactctctaaatgagagatggggaagtgtcttaccagctgattcgcgagagcacctgcaagtttacctgttttagtgatttgcgtttatgaaagttggagttgctgattttgtgatctctacttttaaggtaaaagcagggcggtgttgacttttcttgccagttggctgtcctgttttctttctcgcactgttttctttttgagacgaagtctgtcgctcaggctggagtgcactggcgtgatctcggctcgctgcaaactttgccgaacccctgtttagcgatttccgtttgtgaaagttggagttgctgattttgtgatctctacttttaaggtaaatgcagggcggtgttgacttttcttgccagctggctgtcctgttttctttctctcgcactgttgttttctttttgagacgaagtctgtcgctcaggctggagtgcactggcgcgatctcggctcgctgcaaactgccgcccgggttcaagcgattctcgtgcctcagcctcccgactagctgggattacaggcgcctgcccaccgcaccccgctgatttttttgtatttttagtagcgaccccgtttcaccatcttgtccaggctggtcttgaactcctgacctcgtgatccacccgcctcggcctcccagagtgctgggattacaggcgtgagccaccgcgcccagccgtgttctccattcagattttgtcacagtgacgtcctaaaattattcccaactccccccaccctgctgtttccgcaccctcgagcacagctagtcgtccgtctgcgccctccaggctcgctttcccactgctcactctcctcgctcaaaattcaagtctcaaccgagtcatctctgtgacgtcacgttgatttgcataagattccccagcgtcccaagcgaatattcttatggttttcaaaacctgaatgtttgacacgggatgttccaacaacaagaaacctcctatgcagatgggccttaaatacggctggtggagtgggaacacgtcgtatacacggacacacgggcaggcactcaccctcaatgtaatggtagtcatcatccgtgggggagcggggcgcgaacagaacctttccagctttgcgcagtggcagtatcgtagccaatgaggtttatccgaggcgcgattattgctaattgaaaacttttcccaataccccgccatgacgacttgaaatatagtcggcattggcaatttttgacagtctctacggagactgaatttttaaaagtctaaagaaaagggttttaggaagttgtattatagcaggttgtgtcttatgtttggtttgataagttatgagctgttcctatgatagttttttggttgttgttcaggagtattccgtgattgaatgtccggggttctgtgcgggtactgtgagttgttttccaaaatgtatgacactatgttgggaactgggttctaactaagacagttatcgttaatcttttttatccaaatgcagccagcgagtgagctactccacttcctttgtcactgaaggtcacagattcccttaaagggaaggggaactctaaaactaacacattaatacatccaaagtcttcctttttttttttttttttttttttgagacggagttttcgctgtttcccaggctggggtacagtggcgcgatctcggctgactgcaacctccacattccgggttcaagcgattctctgtctcagcctccggagtagctgggattacgggagcccaacatcacgcccggctcatttttgtatttttagtggagacggggtttcgccttcttggccaggctggtttcaaactcctgacctcaggtgatccgcctacctcggccttccgaagtgctgggattacaggtgtgaaccaccgcgttttcttccttttaaagcgaccaagagggaaaaaggcacagaagattgctcaggtcctactgtggagtcctcggcagagctggggcttatcaggttctcttgcccctagtgtggtacttgttcccactacaccagcctcttccagtcttacctttttacgaagacctgggctgtccatggacagaggtcctcaggagtcacaactctgggcatggcggatccagctggacctgcttaggacaccgcccataaaagactcctccagcctgtagcaaaaagaggtggcaaaaagggtggcaacagtacctacaaggtcaaagacggtgctgggaaaaacagctccagtggcaaattaaactcagtccccagttcaaggacctcacagactggagacgtggaggcgaaggtagcagtgagctgaaattgcgccactgcactccagcctgggtgacagtgagactctgtctcaaaaaaaaagaaaaaagaaagaagaagaagccgggagcggtggcccacgcctgtcatcccagcactttgggaggccagggcgggcagatcacgaggtcaggagttcaagaccagcctggccaacatggtgaaaccctatctctactaaaaatacaaaaaaaaaaaaaaaaaaaaaaaattagccagccatggtcgtgggcgcctgtaatcccagctactcgggaggc

SEQ ID NO: 2906 - DNA, 2035 bp, Homo sapiens
tggaaaatgggcatctctccttcccatgttaagctttaacctctgtaatctgcctgtatctataggtgggcatctcactccaccaaaggagcccagcctctctttgtccctctatccatgcaacagtcttctctgtgcatttccccaagctgggccctcttctactctccatttaggcctgttgataactccattacccgcccatcactgctgttcctccagggccagcactcgggcgaggcaggggagctgccttcggtacataatttgaaggggcactccctcttgggcacatgccggccctgagtgcctcccttgcctcactctgatcctggccccataatgtcctcagtggaaggtgatgggggccggtgctgtggggagagtagaaagaggggttggcatgactaaaaataccagtatgtgtattaagtattttgagaatgaaatgccaaggagtgcctactatatgccagctctaggaatggagtagacagtggacacaagaaggacttacgccctgagcacaggtgccaatggtgacaagactggcaagacgtgagggcatgaatggttcattcaggcagctgctgcagatgtggtcacctggtgccatctgctgctcccttttccacttttctatgtcctccttccaccccaagtcccggatcactcgctgttttctggctagctcttggcatctccatctgagcctaaagttgcccactggcaccaatagattctgtttgacctgctgtgcccatgctcatctttgtcggggcttggcttggcagcgagcgaggctggcatggggtgctgaagtggggtctcagtgaggggtgacagcgtgctggcagtcctcacagccctcgctcgctctcggcgcctcctctgcctgggctcccactttggcggcacttgaggagcccttcagcccaccgctgcactgtggggagcccctttctgggctggccaaggccagagcaggctccctcagcttgcagggaggtgtggagcgagaggcgcgagcgggaaccggggctgcatgcagcgcttgcgggccagctggagttccgggtgggcatgggcttggcgggcctgcactcggagcagccggccggcccttccggccccgggcagtgagggacttggcacccgggccagcggctgcagagggtgtactgggtcccccagcagtgccggcccacctgcgctgtgcttgatttctcgctgggccttagctgccttcccgcggggcagggctcgggacctgcagcccgcggtgcctgagcctcccacccgctccatgggctcctgtggggcccgagcctccccgacgagtaccaccccctgctccagggcgcccagtcccatcgaccacccaagggctgaggagtgcgagcgcacggcgcgggactggcaggcagctccacctgcagccccggtgcgggatccactaggtgaagccagctgggctcctgagtctgatggggacgtggagagtccttatgtcctgctcagggattgtaaacacaccaatcagcaccctgtgtttagctcaaggtttgtgagtgcaccagtcgacactctgtatctagctgctctggtggggcctcggagaacctttatatctagctcagggattgtaaatacacccatcggcactgtgtatctagctcaaggtttataaacacaccaatcaacaccctgtgtctagctcagggtttgtgagtgcaccaatcaacactctgtatctagctgctctggtggggccttggagaacctgtgtgtcgaaactctgtatctaactaatctgatggggacgtggagaacctttgtatctagctcagggattgtaaacgcaccaatcaacgacctgtcaaaacaggccactcggctctaccaataagcaggatgtgggtggggccagataagagaataaaagcaggctgcccgagccagcattggcaactcgctcgggtccccttccacgctgtgggagctttgttctttgcaataaatcttgctactgctc

SEQ ID NO: 2907 - DNA, 4196 bp, Homo sapiens
ggcctccctccgcctctagctgaccacatttctggggccggtctcatttgcttacgctaaagtggacctatgaggtcaaagggcattacaggctttttggcagatgcagctgaaggacctctggaaggactgtgccaacgcatgcaccagcctgcgtggtcccccatccctgtggctggtgatcctggggtgacaccctgatccagactctgtctttatcccgtaacagaggagagggcacgtcactgccacaggcgcctttcctcccatgccacagcaagatgcagacaagccaccctccccagacacacccactgcacgctgcagcagggcccagggagttgaatgttcagtccaggcctcacccccgtggttcagtgggatgcagggggccacacggaaatgccagaggcagccttcaataagcaaaagtcaataaggcccccaaaggcctggatgcttcaagtccaagcactcggggatggcggagggaaggtgccgccctcatcacaggctgggcatggcttcccaggggggatgccagggagaggctccagatgttcggagcctcagcgtgcccaatgctactaggtcagacctggctttcacctccacagtccttaagagctggttcaagactggggtatgaatgaaccttacctccgacccactgagcagagcgtaccacgtcctacctgagcctgctgcctgagcctcatgccccaatgagcagagtgtgccgggggcttgtgggggctcaggaagatgggtcctatccaagactgccgcctgagtctcacgctgcagcccagagctaggacggcaccacggcccctcttgaagaacccagggtcaccaaggtctgcttggacaatgggctggctgccacgccccgaccccgcccgtgccccccgggcctccccagccctgccactcaccatatgcttcctgcaggtcagcgggacgaggccgtggcagcgcttatggaccagcagtttgcagttgatgcacctgtagccttgcctcgcgaggccccatatcctctcgctgcactgaccgcagtacgctctctgcaggtgggaacagagcgtcaggcccaggccacactgaggggccagcggagaggacaggcagggccttccacacctataccttctcaaaagaggacactgagccgggcaacaggtggccccggcaccttgtcccttccgggcgccaggcttgcccaagcttgagagcctcctcttgggtctatcccaaggttgggggaaccagtggccccaaggagaggcctggaaccctgctctgcatgaggggacacaggggaggtgccatcgggcaggggtgacgaggtgctgcttcaggcaaggccccgtggcttgcaggggctggggggctgcagctcctgctgcgctctgcgtagagcagcctggggtcccgtctagggctaagcagagtgtgtgggggtaccccctgcctgaccttcattcaaacagaacctcctcctgacagcctcagagaaggggaactcggactcatgaacatcttgaactgctacatggcagcctgcaattatcttagtattctttgttcagtatttttcaagattttaaatgatccttctttattcttcatggttctgaacaattccaaaatgatggtaattatcagcttgtttggcgatgttttcatgaacgtttaaatgttacaaaaggcatgagaatgaatgttgtcgggacctgcttggacattttctgccttgcctaagtgcccaaagtgttcctgggagtaaaggggtgcatctgcactgtcaccatgtgcccagagcctccaattcagattctttccagacacagccctttcatatgcttttccctcttttaccatttttcacaaatttccttcctattacagagctcacctcacacctgagttaagacgaggaaatataggccgggcgtggtggctcacgcctgtaatcccagcacttggggaggccgaggcgggtggatcaggaggtcaggagattgagaccatcctggctaacacggtgaaaccccgtctctactacaaaatacaaaaaattagccaggtgtggtggcgggcacctgtagtcccaggtactcgggaggctgaggcaggagaatggcgtgaaccccggaggcggagcttgcagtgagccgagattgcgtcactgcactccagcctgggcgacagagtgagactccatctcaaaaaaaaaaaaaaaaaaaaagaagaggaaatacagtgtactgtgaaccgcctgcactgaattcacgtgaggaaacgggactgaagagaaaatacagcactgagttcacgtgaggaaccgggaccctcagcacatgtgggcatcaggtgcggctgagcaaagggggtccagaccctctacgggactctcctgctcatcagaagagcctgctcgggacgtcagggcccggggaccctccccccgcccacacagcccacttgtttgggtggggccggatgaccagcacctaggacagtgcccagcacacagtgggcatcgggtaagaaaacacacatgcatcatcgctttcaacttcgtcacaggaaaaaggagccgactccacatcctctgcacatgctacctacatcagcccagccatgacagagccacaccaggaccgtgggctctattcgaaggagggatgggtgagagggggcatcccacccaagacctctgattccgggccaatctagcttaatgccggcattgggagttttgccccagtcggcacctgctggatgtgtggaccctggattgaaaggaggcgcttcggctgctggatgtgtggaccctggattgaaaggaggcgcttcggctgctagatgcctggaccctggattgaaaggagggcgcttcggctgctggatgtgtggaccctggattgaaaggaggcgcttcggctgctggatgcctggaccctagagtgaaaggaggcgcttcggctgctggatgtgtggaccctggattgaaaggaggcgcttcggctgctggatgtgtggaccctggagtgaaaggaggcgcttcggctgctggatgtgtggaccctggagtgaaaggaggcgcttcggctgctggatgtgtggaccctggagagaaaggaggcgcttcggctgttggatgtgtggaccctggagtgaaaggaggcgcttcggctgctggatgtgtggaccctggattgaaaggaggcgcttcggctgctggatgtgtggaccctggagtgaaaagaggcgcttcggctgctggatgtgtggaccctggagtgaaaggaggcgcttcggctgctggatgtgtggaccctggagtgaaaggaggcgcttcggctgctggatgcctggaccctggagtgaaaggaggcactttggctgtgcagacctgctccattctcctccgcgtccacagcgcagaagaacaccagcttccatttctaaaaccattatttaaaagtcaagttcttttggtataatgtgcctaatgtgtttggctttctctaggtcaccatttaacatcttactctgcaacactacggtcctagttaagaccaaattcacagccaccaggtatctttacaaattaaccaagattggccaggcgcagtggctcatgcctgtaatcccagcactttgggaggccaaggcgggcggatcacttgcggtcaggagttcgagatcagcctgaccaacatggagaaaccccatctccactaaaagtacaaaaattagctgggcgtggtggcgcacatctgtaatcccagctactcgggaggctgaagcaggagaatcacttgaacccaggaggcagaggttgcagtgagtcaagatcacgccactgcactccagcctgggcaacagagtgagactgtgtctcaaaaaaaaaaaaaaaaaagaaaaagaaaaacaaacaaacaaacaaaaaacaaattgaccaaggttcctttccgtggggagccacccttacctggggtcaggccaggacatctgctgacaagggcagtgtgaatctgccaagggttggcacccaccacagagacctcacgtgtgtgctttgtaagtgaggctgcccaagctctgtcaaaagctcttgtttcaaatctatatttgaatagtaacatttcaggaaatgtgacattaaaaaaataaaacctaaa

SEQ ID NO: 2908 - DNA, 1920 bp, Homo sapiens
ttaggctcaacacattccacccttagcataatcgtggttttagcctttgtattagtccgttttcacgctgctgataaagacatacccaagactgggcaatttacaaaagaaagaggtttattggacttttagttccacgtggctggggaggcctcacaattatggtggaaagtgaaaagtacgtctcacatggtggcaaacaagagagcttttgcaggcacactcccttttttaaaaccatcggatctcgtgagacttattcacaataatgagaacagcacaggagagacgtgcccccatgattcaattacttcctgccgggtccctcccacaacatgtgggaattcaagaggagatctgggtggggacacagccaaaccgcatcagccttcttttggaaaactgactttgtctgcccaccacagccactctgcttccaatcatagcacctctttccctgggcatacagggaatccttgcccttctcatactgtgtcacttttgtaaggctgatgcttaccacacttcttacacaaggttctttgggttttaggcacattgaccatctccgcagcagagctgccctgtctatacgatgaaaacaggaaactgcatctgcaaccctcacctcgtgtcactcacacataactggatttttctattttttcaaaaatcattgggatgttgacaggggttgcactgaatctgtagaatactttggtagtactgacatctcacctaaattaagtcttccaatccatgaacatgagaaatctttccagttgtttatatattctttaatttctttcagtaatattttgtagttttcagtttacaaatcttctctttggttaagacaactcctaagtattttactctttttgatgctattgtaaatggaattactggccaggtgcggtggctcacacctgtaatcccagcactttgggaggccgaggcaggtggatcacgaggtcaggagttcaagaccaaactggccaacatggtgaaactctgtcgctactaaaaatacaaaaattagctcggcatagtggcatgagccgataatcccagctactcgagaggctgaggcaggagaatcgctcaaacccaggaggcagaggttgcagtgagccgagatcgtgccactgcactccagcctgggcgatagagcgagactctgtctcaaaaaattccagatcagaactctaggagaaaatgaatttcccaccacctgtctatcaatcaaatacttactgaatgactatcatattgccaacactatgctaggcactaaagatacaaagatcaaaatactgaatccctaccttcaaagagctcatcatctaaggtggtaacatgcaacacatggggcattagggaatatgtactgtgctccaggtcagggttaaggtagtaaggaagacatcaggaaaggaagcagtaaccactgagttgaatcttaaaggatgaataggaggtagaggttataatgtgttgggcactgtgctaagtgttcaagctacaaagattaatcagaggaagtctctgcacatagttctgtaagggaaaaagccacataaaaaaacattttcaaaacaatgagattaaaagttttaagacagacatgttataaaaatagaggagaacaagctcagtagggaaggggaatagagcaaaggaaaagctacacaaagaaactcatgtctgaactgaatcatgaaggataagcagatattcaataggtgggcaacgcagggaggagggcattctaggcagggagaatagtatgagcattggaacaaaggtaccaagtgtgacttgagagagcccaatgtgattaggaacttgcatgtggcttagtttcactgaaatgtaggctatgaaacaaaaaagaggttagaagggaaataaagtaag

SEQ ID NO: 2909 - DNA, 1866 bp, Homo sapiens
tttccgaaatagaccccaatattctgcctttaccccggaggatgcagatgtaccttctctcaggccgatgacctcaggcctccacggtccctggagctctaggaaaggcgagcgcgatctcgcgcccacacccagtgctctgggtcataagcctggatctggaaaaacaaacgccctttgagaagacggggactcgccaggatacccctctctcccctcatccagcctccagcccacccaattcctccccacctcctccacctccccaggccccactcacctcctccaactcctctggggaaacccaagccctgcagctcatggaacagaagaagtggaaccgacgtttctggaacaggactatctgagagcggttcttcctggccctcgggttcatgcaacggcgtaactggaaccgacgcttacggaccaagggaagtggaagatgttttgtttggagtcctcgtcgtcctcctccatgtcattggccaggtagctgaggacaggaatcaggttgctgctcaggggcaccaccaggagagacctccggctgaggtcagcttcccagagaggaagagtaaagaggacaaataggtgaaagaataaatgaaaggctggaatcccacttcccccgctgtcccagggcattggatattgacggataggaggcagcaaaccactcacagagccaggaagaaatgaaggcgttggtattgccaggaggggaagccggctcggctgaaatacgctatgaccatagcaaggagatactgatggagagaaaggaacacagagagggagaggtcacatcttggaagaggaagattgtggagagggggaatgagggtctggggaggggctgcccatcagagaagggacctcagtgttggggtgactgtactcatttggaaattgcgggatggaggggtattcgaaggtcggatgcaaatccgagaagccagaggaagggttttgggtgatgctcccaggatggtgggctccgatgggatctttggagggggtgtgtctaggttggctggtgtcaggagggtcttttgtgtgccaggcagagaactgtcccgaagagctgagagtagaggggccaggagcttcagggctgcggccagactgtggcccagagctcagatcccaaaggacccataggagaggcaggggccactcattcactctgcaagagaccagcagaatcctgagggagatgctgacaaatcataaaaagaccaagaatagccgggagtggcggctcaagcctgtgatcccagtactttttgagaggtggagacaggaggatcatgtgagcccaacagttcgagaacaacctgggcaacatagtgagaccctgtttccacaaacatttcaaaaattagttgagcatggtggcatgtgcctagtcccagctcctcaggaggctgaggaaagaagattgcttgagcccaggaattagaggctgcaatgagctatgatcatgccactgcactccatcctggggagcagagctagattctgtctcacaaaaaaaaaatttgtgggtgccaagactcaagaccatgggagctggtcgggcacagtggctgacgtctataatctcagcactttgggaggccaaggtgggtggattgcctgaggtcaggtgttcaggaccaacctggccaacatggcaaaaccccgtttctactaaaaacacaaaaattagccaggcgtggtggttcatgtctgtaatcccagctgcttggaggctgaggcaggagaatcgcttgaacccaggaggcatcggctgcagtgagtgaagatcgagacactgccctccagcctgggcaacagagcaagactctgtctcacacacac

SEQ ID NO: 2910 - DNA, 1455 bp, Homo sapiens
acgatccggtggtagatctgggatatggtccaagtccagactcttccctgtcacccttgactgttagatgagatagtggatctgagggcctttgaaccatggagttagtaggacttgctgactggtcatggtttaaggagacgagaaaggtctggagcgcctctcagccatccagtttggcaatgggagtgaagtgaacagaagggtcctctggctggagagcagagttcctgcctagagcagcagccaagctgcagcccatccacccactaacccatgtttcacaggctgcccggtgccctggagaaactggccccaaggtctgaccctgccctgcaggagctatgggtctgactgggagatggccttgatcacaactttctaattctgcatgttatgagtgactccattgccctagacccagaattccctggccacctccctgcagggctgtgaagcccatgacaggcctcaccttttctctgctggagcacctgctgtcacagaggcgacagctcctgctgggcttgcctgtgtattttttataagttcttctcaagtgtcacttgtcttgccaggtagatctgcagctccctgagggcagggaccatgaggtgagtgacctccatggagggtctgatgagtcttttcaaacaggtagtcacttaaacaaaaaagagaggaacttggatggtgatggctctgctgagtgaaacggcctcatccttgaacctgaagagtcctgccctgttcaggggagaaggcctcaagtgagcacttctcagatctcagattccccaggcattttgtgtcacctgacctcaggccttagtttctgtccccagcatggtcaagctcaggttctgtggtgtgtgtttagctgctttgcagggacagtggccacaccatgacgcatttctctgtggccccagtaaaattggccaaaaaggaactatacctgctggaggtggtagccgagtgctctcaggctccccagctctaggagccacctacttgatgtcagaactttggagaactggattagcatggcaggtgagtgcggaaaatggagagtcgtggggcgaaatgatttcccaagctctctgcaagcctctcggcttatcagggtaaaagtgggcatcctgctgtggccagaggacccggctcacccatcctccaacacggagtgttccctgctcagtggagctatccctggtgacaactgcagccctgtggcaaccacttccttgttcttccttcttccatgccacgctttgttctgtgccaggcccgatgttttatttctgtattttatgccctctactcagccccccactgaagctgcctgccattaagacagacgttgatctgccatcttcagtgcctaggaaatgcctcacgcatagtgtgtggtccatacttattggttgaataaaatgatacaccatgcctgca

SEQ ID NO: 2911 - DNA, 1013 bp, Homo sapiens
tctcgctgagggggcggggcctgcggcctggtgcttcctcgggcgcacgccgggtcggtgagcagagtctgcggcggagctgggctcccggccctccccaggcccaggctgcctcagttgccccaccatcttgccagggccccgtaaggacccctccagcagcgcccctgtcacccgcacacctctccctattgctcttctgagtgacactcgcccgaggccccacagaggggccaagccagaccctatgcgcagggctgctcctccagcctgttttgcccacgcgagctcccgcaccagcggcaccgtcccctctgggctcagcactctgcaggccctggggctctgcctagagcaggtgcggtctggccagtccagcggagagaggagctgaaggaggccaggatgtccagggccaggtgcggggccagagctggtcacagcgtggcagcggaggccctcgaagccctggtcccctgcctcacggtgaccagcaagcccgagggctccacaggcagaaggcggacccaggagggcagggaagccccgggtgaggaagcggagaggcccgggcctgcgcgctggagtgccaggggccaccctgtccgggcaggtgcggtcctcagggccgcctccaccccgcactgggctgccagcctgtccttcgcgcactcccaccggacccgtccgtccaccggcctcggccttctgatccgctccgcccgccccgctcttgccccttagagtcacagcgatctatctgagctacggcaccgggcacaggcggagctggaggactcggggccttcccatggggcggggggccggggacgggggaaggcaccggtgggccctggaaccagctcccctgggatcctccgcgcaggtcccctccctctcactccagagtcctgaggcctcctactgtgagggaggagaacagccggattctcctcctgaatctgggggggcgggggcttgaccaggacccaggatcagcctggagagaactg

SEQ ID NO: 2912 - DNA, 14033 bp, Homo sapiens
agaccttcctcgacaccccacgttatgtgggtttccgcaagaccttccgccattgcctgggctttgaaagcgctttaggaacgatacggaaacggaggcttagaagtggaaactttacagatatggaaactgagacttagaaaaatgacccgtcaaaggtatgagaagtggcagcactaaggctctagtttgctacgaatatgatcctgataattaaatctctgagtttctctatcaatatcttcaaaaactagagtagtgatacctatctcacaaaggtgttgagtagactaaaagaaaaggtatacgaagcccggatactgactgagcatgttcactgtgtgtccaggctctgagtagaaggtgagctgtgtgtgaaacaagctacctgctgacaataaaacaagtcaggctgtggggctgatagctgcagaagaattatgggcatcagaatatatttttaaaatataaacatttgatcccgtcattccacagatggaacgctgcatttatataacttgtttagtcatctaccagtttcatttgtctttcttgcactgtcctggagggcctcacagctacattcggaggccacaaggcaaatgtacagtgtgcttcaattggaacaggagttgctgtgacttctcccttcggagcaatcactgttgcccactcatatggacatactgaaggaaattcttggaacgagggtgtagtagagagggagcaggggaaagaacgaagggaagattgaaagaagatggagccacaaaggagccatagcctcctcacacctcagtcttgttttatctctgccagccattgttgtggtggctactaacataatatatgttaatcttcttacaaattattttactaatatcttacttgatatattgaactttaattatctttctcctcattgctcttactccatctatgtatttatttattatttttattttttatttttttgagacagagtctcgctctgtcgcccaggctggagtgcggtggcgcaatctcggctcactgcaacctccgccacccgggttcaagtgattctcatgccccagcgtccggagtagctgggattacagcgtgcgccaacatgcccagctaatttttgtaattttagtagagataggatttcactgtattggcaaggctggtctcaaactcctgtgctcaggtgatctccctgtctcagcctcccaaagtgctgggattacaggcgtgaaccaccgcgccgtgccgtccatctattttaaaatcaggtggctaagcagtcctgtttaactgtagaaggatcacagaatttgagagctggacgatacttcagagatgtatcatccaggaactcaatctatcatgagaaaacaaatccagaaaagttatgtaatttgtcccagatcaaatgatgaatctactgcaccctcattctctaaattgcctctcctaatcctcttaccgactgattcaacccagaaagtctgggcatatttaaataaaatttgtgagtaaggctgaggtctcagcaaatctgttatgcccttagtttacagtccagggatacctgtatacctgcaggttgtgttagaggactttgaacatctgccaaggaaaagccctgattaaagataatgatgattcagagtgaatagcttttcccaggagtttgcaacagtaaaaaggctaggaaacaagaagtgaactctaggaaaaagatgatcctggctttaagatctcttgtgaagcttactattcttctgtctccaaaatatttccaagaaacatattcagtgataaactttactggaagacacatgcattagaaaatatattgtttaaaatgctcccatgcttaggctaaaaagtgatagaagctcaaatatttgtttgtgttttaaatgtatttatcattgtataatgctacataaatttaacaaaagactttttgatcatgaattgatgattctaaaaataaccagtttgtcaataaggagtctagacttcaagccccttgaggtcaagaaccaagtttttctataatctaatttctaagaagagcttcaggtacagtggtgatgttcaataatgtttgtcaataaaataagtaactaatctcaaattttacaataccaggactagtatataatattcctaaatactggtctgccacttgggctaaaaggttagaattatgaataaaagtctgatttttttttcctgaaggatcattttcaatgcattttttaaaagcaactacctatatttaatgatatctacatttttgtatgccttggtattaacagtaatttggatcaatcttcaacaaaatatgaaagatatcagcttgaaggcatgagaaagctaaaaagttaatgaggaattaccaggccatgatctggggaatgatggaggtcaattccgtagagggctgctgagaggatgagcaggaatgggggacagagatttgagttcagggcatactaagagagaaagagatgaactctgttgaaggccccttgctttggactaggaattcaaagagctccatcataaaagtaaaaggtctgtagctcagtttcagatcatctcaaccttgaaactggattaggataattcctttgagctcatgcccacaagcacttggcagaagcaaactaaaatcctttctggagtgaaactatatcattctaggcctcaaataatttctacagataattttgaaatcacagtgcctcgtacacaatttttaaaaatcagttacctaaggaaattagaaaaatatagcagaaacaacagagaacaaaaacagacccaacaggggtcaggtaatgaaattatcaggtacagatttaaaaataacaatgcctactatgttcaaataaatcaaacacaagattaaatatgtgggcagacaactagaaacttgaaaaaagagccagatgaaaattttggaacaaaaaaatttactaactgaaaataaagactcaatgatgggtttaagagcatattaggcacagataaagatagaattagtgaactagaaggtaagtcagaagaaactattcagaatgaagcacaaaaaggaaaaaagatggaaaatatagaacacatagaagatagagttaggaagtttaatatgaacataaatgacattccaaaaggaagggaaaaggtattcagcttaaataatatttgaaccaatgaatctccatcaggatatttttttaatccacacagctgatatatagacacatcatgaaaaacttgctaaaatctgaagacaagaagaaaaatctttaagagcagccagagaaaagagaggacttaaaaaaaagaaaattagacttgcagttgactttttaacagaaatagctgaagccagaaaatgatggaatgacaactttaaagggatgaaacaaatattttttaagaatgaaagtaaaattaaggaatttccaaaggaacaaaacagtattcacagtggcattccataggcaggaagtaaatgatcccagttatatcatagatatggtaggaaataaagatcaagaaaaatgataaatatataggtaaatctaaatgaatattgatactgactatataagactataatagtcttgtcttctgtatttaaaaatatacagtaggctaagtgcggtggttcacggctgtaatcccagcactttgggaggctgaggcaggaggacttgagcccaggagttagagacaagcctgggcaacatagtgagaccccatctgtacataaaattaaaaaattagccaggcacgatggcacattcctgtagtggaaagcctgggaagctgaggtgggaagattgcttgagccccgtaagccatcattgcaccactgcactgcactctagcctgagcaacagagaccctcttaagacacacacacacacacacacacacacacacacgaaataatggtatatgtcaggagaaggtaaatggaatcaagtgttctaaaatcagtgcattttctagaagtatggaaaaagtgatagttaatattagactctggtaagtcaagaatacatcttatgagctttagaataatcattgagaaaatagtaagaaactgtattagtcaggattcttcagagaaacagaagtggaggcttagtagcctaaaagctgtaaggtagaacaacaggctagagacaaagaagagttgcagtttgagtccaaaagcagtcggctagcagaattccttcttgcccatgggagataaatctttgttctattaaggcattggataagatctacccaccttatggaaggtaatctgctttattaaagtctacagatttaaatgttaatctcatccaaaaaacaccttcacagaaacatttagaatagtgtttgaccaaacatttggccaccagtggcactggcaagttgattcataaaataagccaggacactatgcaatttccaatctaatttgagcatgtgaggaaataaaaaataatctaaatgcaagatagaagagaaataagaacatatgatagagcaaatagaaagttgttataagatggtagacataaacccaaatatatcactaattacactaaatgaaaacagatcataatttaatgacaaagattgtttttgttgcctattgttatataacaaactaccccaaaatttagtagcttaggcccagcacggtgcctcacacctgtaatcccagcactttgggaggctgagcaggtgaatcacttgaggtcaggagtttgagaccagcctagctaacatggtgaaaccccatctctaataaaaatgcaaaaaaattagccaaacgtggttgtacccacctgtagtcccagctactcaggaggatgaggcacaagaatcacttgaaccaggaggtggaggttgcagtgagcccagatggtgccactgtactccagcctgggcaacatagcaagaccctatctccaaaaaaaaaaatgtagtagcttaaaatcaaaaccattttattatttttccagattctgtgggtcagaaatttcaacagggcataatggagaaggctctctcttctctgggtgatgtccgctggggctgaaatgttctagatagcttcttcactcacatgtctagcacctagctaggatggctccaatggccgggggttagaacagcttgactgatatcatatgtgtggggccttggttctcacaattgattgggttctttggtttttctacaagtagttctaggacttctgttccacatggccaatccatgtagcctctacagaaagatagccgacttcttacatgcaagctcagagttcccaagaagattaggtttagaactaacacactgtcacttctgttacattctatcagataaaggaaataacaggcctagagtcaagaggaggaaactacataagggtgtaaatactaggaagtaggatgaacctggggccaccaattgatgtaaccaactaccacagattgtcactgggcaaaaataaccacacgctctttacaaggggcataatctagaacataaaaatacagaaagtttgaaagtaaaaaatagaaaaaaagtaaaccatgcaaaattaccaaaaggaagctggaatagctaaattaagtagatactaagacaaaaagtactggggccgggcacgttggctcacgcctgtaatcccagcactttgggaggccgaggcgggcggatcacgaggtcaggagatcgagaccatcctggctaacacggtgaaaccccatctctactaaaaaatacaaaaaaaattagccaggtgtggtggcaggcacctgtaatcccagctgctcgggaggctgaggcaggagaatggcatgaacccaggagttggagcttgcagtgagccgagatcacgccactgtactccagcctgggcaacagagtgagactccgtctcaaaaaaaaaaaaaaagacgaaaagtactgctggagtgaaagggagactcttcataataatgaagacttaatttgccaggaagataaaaatattctaaatttgtattcctccaataacataacctcaaaatatataaagcaaaaattacagaactacgaggaataaaaaatccagaattttaggaggagatgttaacatattcagttactgataaaacaggcagacaaaaaattcagtgactatgggtctgaacaatgctattagcaaagttaagtataaggacatatggaatacttttctacagtcctttacacatgaagaaattcattagtttatgttatttctgctttggctcatgaagctggtaaggatatcagaggatcctgagccttcaggctgcttagaatctatccctattttacagatagactgtgtacctttacctcattcattaaataaacatattaactactgactatgttccaggccctgcacttagtacagagatgaaaatagtagttaaaactacagacaagcaaatcagaaaatataattgcagtatacaagtgcagtgatagagctttacataagtagtaatgggaatcaagtcctaactcagccctgggagatgtctgaacaaagattgaagagagaagaatatagagtagaggtaggaatgggagtggtagaaggaggggtggaaccatatctagcaaagcctagtggggaaagagcatgattattcaagtcagagaactgccagtcatttggaatgtctggaatacaaaaggttgctcaagttagggattatctggttgcaagaaacagaaactcatgccagctggctaaagtaggagaaatgaatataaaaataggcagggattatgtgagacacaactgtgggaagcacagccaacattaacaagaactctcccctttctctctctcaccatctagtcttggcttttctttgtgtgtctgtttcactctctgctcacttataggcttacatgtggcccattatggctgtcccagatacgggccttggctctccacctctgctaccaacccactttgtctaactttcctgcttagcaacccacagttattacctaacacagcctcagggtcccacttccaaattcccaggagccgtaatcagagtgatgcagcttctacatgcttgtatatcaggggtcagcaaactatggccctgggggccaaatctagcctgccttccacttttgtaaataaagttttaattgaacatagccacacacattcattaacatactatttatggctgctttggcactacaaagacagagttgtgcaactgagacagaaaaccaatggaccgtaaggctgaaaacatttactatggcgacctttacagaaaaagtttgctggccaggcacggtggctcacgcctgtaatcccagtactttgggaggcctaggcgagtggatcacctgaggtcagcagttcaagaccagcgtggccaacatggtgaaaccccgtctctactaaaaatacaaaaactacccgggcatggtggtgcgaacctgtaaatcccagctacttgggaggctgaggcaggagaatcgcttgaacccgggaggcagaggttgcagtgagccgagatcacgccactgcgctccagcctgtgcaacagagtgagactctgtctcaaaaaaaaaaaaagtttgctgactttgcagtaaacaggtcatgtggaggtatagagctgtataaagatttacagggcatcagctctggtaatggaagctctgaaagtggataacccctttgtgtcttcaaaaaaaaggataatggtggggaaagaaactgtggctgtggaagtattttgagaaaggaacgggttgcaaactaacacaggaaagaaaataatcagtctcaagtgtatgctaaatgttttacacaacgggtgaaagggtaaaagactgtaacttcttactctggagaaattcattaagatgctaaatttaggagcgcgtgtcacctgttgtcacctgtaactgcctttaaataactcacttgtggcaaatttcccagaccctccaagcatagctcttgctgagatgaactggctgaggcataatatttgctgactgtacaaagatttttaaatgcatgtccagaaggttaaatattgtttaccttccagagagagagagagagagagagagaaggtactgagagaaagagacgggtaaatagaaagaggcagatagactgagacttgctcagggaggagaaaataaaatctagaatttaccattttggtaaatttaagatcattgtggggaaatctttgttaagaaacactttttctgggtgagtagaaaaaatattagattttttaaaaccctaagattcatggccaggtgcggtggctcatgcctgtaatcccaacactttgggaggccgaggcaggtgggtcacttgagggcaggagttcgagaccagcctggccaacatggtgaaaccccgtctctactaaaaatacgaaaaattagctaggtgtggtggcgaacacctgtagtcccagctactcaggaggctgaggcaagagaatcgcttgaacccgagaggcagaggttgcagtgagccgagactgcactactgcacttcagcctgggtgacagagcaatactctgtctcaaacaaaacaaaacaaacccctaagcttcagatccttactactccaagtgtggcccaagcacactcagcggtgttggcatcaccaggaagtttattagaaatgccaaatcccggctgggtgtggtaactcatgcctgtaatcccaaagctttgggaggccaaagcgggtggatcatctgaggtcaggagttcgagatcagcctgaccaacatagtgaaaccctgtctctactaaaaatacaaaaattatctgagtatggtagtggcacgctcctgtaatcccagagattagagaggctgaggcaggagaatcactccaacccgggaggcggaggttgcagtgagctgagatcatgccactgcactccagcctgggcaacacagtgagaccctgtctcaaaaaaaaaaaaagaaaagaaaaagaaatgcaaaatccctggccccattctagacccagtgaataagaacctgcattttaaaaatcccataaatgattctgttaagaaaaagttattcaatgacacttgttaaagcatggtaaggcagactttattcagaaccatcatgataggtatagggaccactgcaatgagattttacagtggggatgagagactgggctcaactcagaatacagcaggacaagtgggaatttatagccaaggagcaggtaggggccagtggatgaaaaattactaagagcaaacatcggcagtaaggaggattctggctaaactaacctaagaaggtttcttctgctatagacatcctctataatcagacatcctctggaggatggcagaggatgaagaatccagtcagatactaaaggtgggggaggttcttgctaaactgacgtagcagagttctttgctaaaaatggactttacaagacagtgtacaaatatgctggaagaaggtttggtcgagcagagaatttttgtcaattctaattacattaaagtaagagaagcaatgaattagtacagtagttttcagatggtttaaaatggaacagttgttttgtttcatattctttgaatgaaatctttcataaagcccaattcataaaatagatcaaagtagacctgttctgattgaagatgggaggatactggaaggcagggaagggctggaaaacccaggtatgtttattcgatgttcctccaagaacacagtttgaaaaccactgatctaacagaatgagcagaagtaatagaatcctcaggcccagggtctgttaaactaccaggctgttttccagctccacctcattgagaactactacaatgaatccatgttagggatgagacatgtcctgttttgaaagagtacacatttttaaaaacttgggaatcactgatatagatcacatttttcaactcagaaataaagcggccaggtgctgtggctcacacctgtaatcccagcactttgggaggccaagacaagcagatcacttgaggtcaagagtttgagaccagcccggccaacatggtgaaacaccctctctactaaaaatacaaaaaattagctgggcatggtggcttatgcctgtaatcccagctacatgggaggctgaggcaggagaattgttttagcctgggagacagaggttgcagtgagctgggattgcgacactgcactccagcctgggcaacagagcaagacttcgtctcaaaataaataaataaagcatctagggctcagaaggtgaccatttaaacttcattaaaacacagctacatttaaagctatactaattgctaacaaaagaaacaaacctaatattcaataaatcttagggacggggacctgccaagatggcaaaataggaacagctctggtctgcatctcccagcgggaccaatgcagaaggtggatgatttctgcatttccaactaaagtaccctgttcatctcactgggactggttagacagtgggtgcaacccatggagggcgagcagaagcagggtagggcatcgcctcacctgagaagtgcaagggctggaacctccctcccctagccaaggaaagccaagagggactgtgctatcccgccgagatactatgcttttcccacggtttttgcaacctgcagaccaggagattcccttgtgtgcctacaccaccagggccctgggtttcaagcacaaaactgggcagctgtttgggcagacaccaagctagctgcaggagttttttttttttttttttttggaccccagtggtgcttggaaccccagcgagagaaccattcactcctctggaaaggggcctgaagccagggagccaagtggtcttgttcagcgggtcccactcccacggagcccagcaaactaagaacctctggctcaaaattgttgctgccagaacagcagtctgaagtcaaccagggacaatcaagcttggtgggaggagaggcatccgccattactgaggcttgagtaggtggttttcccctcacactgttaaggaagccacccagaagtttggactaggcagaactcactgcagcgcagaaaaacggctgtggccagattgcctctctagattcctcctcactgggcagggcatctctgaaagaaaggcagcagcctgagtcgggcttatagataaaactcccatctcagtgtgacagagcagctgggggaaggggcagctgtgagcacagcttcagcagacttaaacgttcctgcctgctggctctgcagagagcagcagatctcccagcacagtgctcgagctctgctaagggacagtctgcctcctcaagtgggtccttgacccccatgcctcctgactgggagacacttcccagcaggggtggacaggcacctcatacaagagagttccagctggcctcaggtgggtgcccctcttggatgaagcttccagaggaaggagcaggcagcaatctttgctgttctacagcctctgctggtgatacccaggcaacagggtctggagtagacttccagcagacctgcagaagaggggcctgcctgttaggaggaaaactaagaaacagaaagcaatatcaatatcaacaaaatggatgcccacaaaaaaaccccatccaaaggtcatcagcatcaaagatcaaaggtagataaatccacgaagatgaggaaaaaccagcacaaaaatgctgaagattccaaaaaccagaatggcttttctcctccaaatgatcgcagctactctccagcaaaggcacaaaactggacggagaatgagtttgatgaactgacagaaggaggcctcagaaggtgggtaataacaaactcctctgagctaaaggagcgtgttctaacccaatgcaaggaagctaagaaccttgataaaaggttgcaagaactgctaactagaataaccagtttagagaagaatataaatgacctgatggagctgagaaacacagcacgagaacttcgtgaagcatatacaagtatcaatagctgaatcgatcaagtggaagaaaggatatcagagattgaagatcaacttaatgaaataaagcgtgaagacaagattagagaaaaaagaatgaaaaggaatgaacaaagcctccaagaaatatgggactatgtgaaaagaccaaaagtacgattgattggtgtacctgaaagcgatggggagaatggaatcaagttggaaaacacactttagaatattatccaggagaacttccccaacctagcaaggcaggccaacattcaaattcaggaaatacaaagaataccacaaagatattcctcgagaagagcaaccccaagacacataattgtcagattctccaaggctgaaatgaaggaaaaaatgttaagggcagccagagacaaaggtcaggtacctacaaagggaagcccatcagactaacagcagatctctttgcagaaaccctacaagccagaagagagtgggggccaatattcaacattcttaaagaaaagaattttcaacccagaatttcatatccagccaaactaagcttcacaaatgaaggaaaaataagatccttactgacaagcaaatgctgagggattttgtgaccacgaggcctgccttacaagagctcctgaaggaagcactaaatatggaaaggaaaaaccgggaccagccacaacaaaaacaccaaaacataaagaagaaactgcatcaactaatgtgcaaaataaccagttagcatcatgataacaggatcgaattcacacataacaatattaactttaaacgtaaatgggctaaatgccccaattaaaaaacacagactggcaagttggataaaatatacagcacactccatcagtgtgcaaagacacacataggctcaaaataaagggatggtggaaaatttaccaagcaaatggaaacaaaaaaaaagcagggtttgcaatcctaatctctgataaaacagactttaaaccaacaaagattaaaaaagacaaagaagggcattacataatggtaaaggtatcaatgcaacaagaagagctaactatcctgaatatatatgcacccaatacaggagcagccagattcataaagcaagttcttagagacctacgaagagacttagaaccccactgtcaatattaggcagatcaatgagacaaaaaattgacaagggtattcagaacttgaactcagctctggaccaagtggacctagtagacatctacagaactctccaccccaaatcaacagaatatacattcttctcagcagcacatagcacttattctaaaattgaccacataattggtagtaaaacactcctcagcaaatgcaaaagaatggaaatcataaaaaacagtctctcagaccacaatgcaatcaaattagaactcaggattaaggaactcattgaaaaccacacaactacatggaaactgaagatcctactcctgaatgactactgggtaaataacaaaataaaggcagaaataaataagttatttgaaaccaatgagaacaaagacataacataccagaatctctgggacacacttaaagcagtatttagaggaaaatttatagcactaaatgcacacatcagaaagcaggcaagatctaaaatcaacaccctacatcacaattaaaagaactagagaaggccaggcgcagtggctcacgcttgtaatcccagcactttgggaggccaaggcgggtggatcacctgaggtcaggagttcaagaccaacctgaccaacatggagaaaccctgtctgtactaaaaatacaaaattagccaggcatggtggtgcatgcctctaatcccagctgcttgggaggctgaggcaggagaattgcttgaacctgggaggcagaggttgcagtgagccaagatcgcaccactgcactgcagctgaggaacaagagcaatact

SEQ ID NO: 2913 - DNA, 1105 bp, Homo sapiens
aaatatatattcatccaatgcaggagcacccagattcataagtaaagttcttagagacctacaaagtatgtttcacagtaatagtgggagatttccacactccaatgacagtattagacagatgattgaggcaaaaaaatgaacaaagatattcaggacctgaactcaacattggatcaaatggatctgatagacctttacagaactctgcactcaaaaacaacagaatatgcattcctcacatcatcatatgccacatactctaaaatcaaccacataattggacataaagcaatcctcagcaaatgcaaaacaactgaaatcataccaaatacatactgagatcacagtgcagtaaaaatagaagactaagaaaattgctgaaaatcatgcaattacatggaaatcaatcaacatgctcctgaatgactttttaataaataatgaaattaaggcagaaatcaagaagctctttgaaaataatgagaacaaagttacaacatactagagcctctggacacagctaagacaatgttaggagggaaatttatagcactaaatcccacatcaaaaagttaggaagaactcaaattaataacctaacatcacaactgaaagaactagagaagcaagacaaaaccccaaagctagaggaagacaagaaataactgaaaatctgagctgaactgaaagaaaccgagacatgaaaaaaagaaattcaaaagatctatgaattccggtttctccacagacactacccaaagcagtgcttcactacagtggcagacagacctgaaaattttcatctgaagcagcagagtgaactgcagaggcaggtcaccaaccagtgtggaggctaaaagcgggcctctttggggattccaggtggaagtgttggacatctgtagtattcctggtctcgaatcatcctgatattcttcattttgttattcacattggactaggcaggaacaaagatcaccacaactggctccccttcaactatgttagatggcaacttgccttcagtatggtgaaacacatcaaatttctcttgcctgacacagcataggaagatgctgaacggccacacagtgatccattg

SEQ ID NO: 2914 - DNA, 12710 bp, Homo sapiens
agtgcatcccgccctaagccagcggggcgacctcaccttcagagacctcatctgcggggctcccacctggctggatcccgcgcccgggggtccgggcgccgtctggagctgagcaggcagatgtgcgggcgccgagggtggggcgagggctgggggcgggcagagggaggggaaggacgggctcgagcgggacctcccagggaaactgagtcagtctggctgtgaccaggggcgggcccagcagaggacccacacagatggagggcgtggcggcacaggacgccctggggtcgcggcctggaggggtccgcgggggctaagccgagctgggacgggtgggggccgctggcagcccgcggctcgctctctccgtccagtctctgtctcccgctgtctctcatcagccccgcccaccctgcgctggccacgcccctcgggcccgggcctggctgacttggagtcagtgggtgccccccgcacgccgggacaccctacagccttctggggaaggcggcgcccttgggacccccaggccaccggtggcagggatgcaatggcccgcgtaggggtggcaggggcgcttcctcgggagcctcagcccctccagccgcccagcgccctgccaggcctcttcccggcgctcccgccgccaggcccgcattattcaccatctgggcagcacccaaggcctggagggggcggggcaggtccaggcggatcggctcccgggggtcgcccagactccagggctccaaattcactgggtgcgctggaacgcggcacacagtagtagtatgccctgcttaatacatacaggacatatttgaggccccttccaggggtggggtgggaggacagagggatggggggtgcaccagacgacacagccagactgagaaaggtggtcccagagcagatgttcccgtcggatgctgaagaacaagcctgccggctgggccactccgacctgggctgtggcacccgtgtggccctcggccctcctggcctgagaaaggggagtgagaaggagccactgtcctgatatgggcaaaactcggggtcactggtctcatgctccaaggccccgtgagcaggccaggtggggggatccctgggggaagcccctcacccttctccaacccccagccttcggggagcccctgccctccaggccctgtgctcagaggtggggggaggacggctcagtgacttttggttcccacgaccttgacagagacagggacctcgacgcatcctccatacccgctgcggggaaatggaccccaccagccagcacggggtgagttgggggccagtccctgcagagtgtgggtgtccacagagggtctcttctgcagtggcggatcgggcgccagcagggtcccggcctcagtgctgcctgtgcgggcgagggtggcctgtgggcagggctggagctgccccacagccgcgggctctgcctcacgcccagtgggtgccccgtgatgtggcagggctggccttgagtttcctgcttctcacgagcctggcaccgccaagcccaggcccctctggcccatctccacaacaccctgtgtggccgccacttggggcaggccctgtgggccccacccagcctggctgaggggcggtggagagtgtccgcctggacggtgaggtcagctggcggctgctggccaccctcgtgctcgaaagatgcccctagcgccccctccgttgcatcaggaccctaggccagcctgtcccagtgtctcctcagctcaccatggcaggctcaatggtgaccccccttttatataggaggaaactgaggcctggcgaaagaaagatgcggcctgaggtgggacgtgaacccgcggccctgcagcccagacagcggccccggagtgaccaccagcttcaccgaagcccctttactgtgcccccgaggacacctgcctgccgttccccagggccgtcaccgccgatagcggtagcgcttgaagtgaaaccacagctggaagatgccgttggcaaactggcagcggaagccgtggcggtgcgagtattcccactcgcggttgacgatcttgaaagcgatgtcctcgtagggcggccccgcgtggaagcgcaggatggcgaaatccttgttgtcggcgcaggcctccaggaagtactcgggcgtggagcgcttgtcgatgaggtcggggtagaagatgttgaacttgtatccctgcacgatcttgggcggtgggttgtcaaagtcgtagtgcgtctggttgtacttgttccactcgaagcccgtgtgcacgcggttgaagaagcgcggcttgcgtggccggtacttgtcggcccacaggtaggccttgccggtgagtggcatctccacgctgaactgcgcctcgtcctggcccatgccctccttggcccgccggaagaagatgtcctcggcgctctcgctggcgtctcccgtgacctggagctgctggcgcgagagctgcaggcgctgcaggtcctcatccggttccagcacgtgcgcgtccagtggcagctcgtgcgccgtgagcagccgcgggctgtacctgccggcgtcgtagtcgtccaggctctgctggatcaggtcctcctccatgagcaccgcctcgccctcgccctcgccctcaccgtccccgtcgccgtcgccctctgtcggggtcgcgccgtccacctcggcctccgcggggccgccctccgaggagggcccgggcggggtgggcgccgcgtcctcaggctccaggctgggaggagagagcgttggaggcgcggaggctgcccacggcccctccatcctgctccgcgtctgcatcggcgtccccggggtgccggccgggcctacctgcggctgggggactggggctcctgcttgaggatggggaacagcggctcgctctccacgccctgctcctgcttcagtttgtacagcttctgccgcagcacgtcctggtggcgctcacgcagcctgggacgcagagccggggtcacccgcatggaggcgaaggggctccgcgccccacccccaccgagattctcacgccccttattgctgcaaggaccctgagaaggtggcgagcagccacggctctggctgggacctttgcccaggcttggtcagttcagggtcaaggcttatgggagagaggacgagaggacgcaggtaccctggtgaaccatcccatggcagggagaggtgggtctctgtctcacgctgcagtctcagtgtcttgtggctggggctggccaggagaaggggcccagcaggacaccagccaacaagcatgataaatttagagacatttacaaattagcagaggagacatgtatttacacagcggtgccaaaaacactccagaaatctgtacacagccagaggccgggaggcagcagcgctgggagggcgcaggcctgggcgcaaggcagtggggacaggcaggccgcctgggggcttcctgtgatgccatggctgctggagcgcgccaggtactcgttaaagggcggaagctcctggggagccctgtgagaccaacagggctgactccaggtgagggcactggagcatcctggggccttcccgctagggcacgggactacgcgccccccggccccccttcgtcactcacaggctggccccggccagtcggcactttcctgcccctctccaccccacatggtcccaggaggaggcgagacccaccccacccaggactcaggagggggcgaaacccatcccacccggacggcaccaaccctggtacccgcacctagtgctcaccgggcccgtgccatgtgggcacgaagctgctgcaggaggctctcccagtagcccatgtccaggttggggccaccagcgcggattttgccctcgatgccctggaagatgacctgcagctggttgtatgtcttccccttgaacaccgactgcacatcagagctgacggaggcgttgaccccctcgcggcgctcacctgcagcggggtgggggcatgggggggcggttccacatttcctacgtgctcctccaccccatcagggcctcctcccctgccatgggggggtccccctcccctcctcttcccccacaggggtcccatccagtcccgccacctccctggtctcaggttgtccccaccctggccacagcggaggggagggggtgggcggaggttgggagccacgttaagatgcagttgctgaggccttgacctggaggcccaggcccccagcgtgggggaggccaggactggccctgagaatgcccctccccaggtgagtctgatatgtgggtctgggaaccctagttgtgggcccggcccaccaacctggcccaactctgccctggccttgggcagtccatgagggggttggggggtgtgctcggtagccaggctctctggaattcagatcttctctgccagcctgggctgtgtgactgtgggcaagtggcctgccctttctgggccttagtttccctctgtgaagcctagcaaagaaggccaccctgctggcccctggggaagtcctgggcccgccccaggacaaacagctccccaccgccgccccccatcctacatggagtctgtctggcatctaccactggcccaggggcccgaggctcaagtccctcctcgatagacggggaggctgctgagggcgggagtggggtgctgggaggctggagcctagcctgactccgcgtgctctgccccacaccacgtggcatcccggcggcctcagtgctgctctcaggccacttccacccaccccgctgggtctggcctcacctcgcaaccctgccccttgctgcccatgccgaacccctgccacctctgggcctttgcacgcactgtgcttcctgccagctacccatccttctctgtcccattcgcttcctgaattcctcgcatcctccatgctcagtgagaacatcccttccgccaggaagccctccctgaccatccagcgatggcagcttcccgaggcgggcaatggggctggctgctgctgttccctgtgccatgctgggcccacagggagcttggtgcatagctgctggtgacacactgggcgggggtgaccagtgcaggcaccctgctcgagacctgccttctccagtccccgctggcggacagagggtcaagaggcccacacctacaccacaggggactggatagagtctagacggacccgagtcccctccagccaatcacctgggaccctggaatcggcacccagagctgcagcccctttgctgggcgctaagtggcactggaatccgtggcagccccagccaagcacagcgcggccgtgcccagacaggcggggctaccacgaacactgaaacccaagcagaagagcccagccgcgaggctcccaggaagccaggccaggtgccgccaggtcagcgtctatagaaagccgggtctggacatgctgctgcatgtctggatgcctcccgaatgcccacaagggggcccgggggtttagggggtcccagcagctgctagaggctgggggtgcaggccaagggccctggggctgcgtgggggaaaggccaggccctacacagggtgggaggctaatgaagctgagctgggatgacacccgttttctactgcacaacctcctgtagggttagaacttcctagaaaaagctaggtgcaccaaaatctcacaagtcaccactaaagaacttattcatgtaaacggccgggcacgatggctcacgcctgtaatcccagcacttttggaggctgaggtgggtggatcacgaggtcaggagatcaagaccatcttggccaacatcgtgaaaccctgtctctactaaaatacaaaaaattagccaggtgtggtggtaggtgcctgtaatcccagctacttgggaggctgaggcaggggaattgcttgaacccaggaggcagaggttgcagtgacctgagaacacaccactgcactccagcctggcaagagagcaagacaccgtctcaaaaaacaaaaaaacttattcatgtaaccaaacaccacctgttccccaataacctacagaaataataaaaaaactttaattttgtaaaaattaaaaagaaaaagcatgcagtcactcatgcctttaatcctagcccttctggaggtgaggcaggaggattgcttgaggccaggagttcaagactagcctgggcaacacagtgagaccccatctctacaaaaaattttcagaagtggctgggcacagtggctcacttctgtaatcccagcactttgggaggctgaggtgggaggatcatgaggtcaagagattgagaccatcctggccaacatggtgaaaccctgtctccttaaaaatacaaaaattagctgggcgtgatggcgcgcgtctgtaatcccagctacttgggcagctgaggcaggagaatcgcttgaatctgggaggcagaggtcacagtgagcagagatcgcaccactgcactccagcctggtgacagagtgagactccttctcaaaaaataaaatagctgggtgtgatggtgagcgcctgtagtcccagcttctagggaggctgaggtgggaggatcacctgaacccaggaagtcgaggctacagtgagccttgatcgcgccactcaactctcgcctgggcgacagagcgagaccttgtctctgaaaaatgaaaagtaaaaggaaaaccccaattaatttaagaagatccaggacaggggctctgtgggtctccagggggacagcaaagtcaagacccctcggttccctactcctggaaaccatgttgaaaggagaatcagaaacaaactccctcggaagacaccaaagccacctggggtccccaactgtaacgcgtgaggggaaaggagggctgagcgacgtggtggaggcagaaggccatggaagggatgggagaggccggggcctagggcagtggggcacgctggaaacgcctcccaggcttataggagaggccgggcccagggcaacgctggaaacgcctcccagtcttacaggagagggcggggcctagggcaacgctggaaacgcctcccaggcttcctgcagccggtgggtagggtctgcggcttctgaaggaaaatgtactgcacccagaagtctttgcccagccccgctgccaccagcaggagcacaccaagacccttaacggacacacctctgatgctggagaactgccctgcctctctgaggttacgggagaatgtgccccacggaggagaccactggagggacaggatggctgagtgaactccacctccggggaacacaaagctccactgaaaaagaggaaagccacaggctctttcctaggaaggacctgccacagaccacgctgagggctgcaaatgacactgacccagcctcctgggatcctcggccaccatgatggcacccaaggcctgagagggagggcaggggaaggaccgggtctatcgacagggatgcgtggcccatgagagccaggcactgttacagcagccgctggggcgtggattttggcggggagggggcagggctgctgtggttggcttttagaccggggggggggggggtctcatctagggcaattctgcccccaggggactctgggcaacgtctggggacatctgcggttgtcaggactaggggtgctcctgaccctgggtggaggccagggacgttgctcagcacccagcagtgtccaggacggccccaccctagggaacggcccagcccgcatgtccgcagtgctcagggtagacgctttagagcatccccggtgaccatgtgtgtgcaaccacacggaggggggggaaacgtgattttaaaagcccatcaggttggaggggcacgaactgacgcacgggacaggtagcgccctgaagctgggctgcacggccttcaggccaggtggagcgagacttgctgtcaaacaggcagagccactgagagcactgaaacctgagcggaaagccccgtggctcccataaggccggcaccgccgagtcagcgttaacgggacgctgggtctggacgctgctggccctgcaccccagacagaggcccgccccactcatccctcccagggcctactgcccgctgctgccccctggtggctcggcccagaaggggaggccccagttggggaaaccgaggcctgcagagagcaccaggccccacagcaagtctgaggcttctgggtgaacactgtagcccccgcagctcccctggagcccaggcccatgcccgccgttacctggccccttgcccgaggcctccagcttgcggagcttggagatctcgtcctcggtgatggtggtcatgtcccgccagaagtcggcgttcttgccctgctccagctccatgtagacctgggggcagggggcaggggtcaggacacgggtgtggctggggtgggggtgagggtgcaggtcagaggagcatcgggtggggctgggtacctggatatcctccagcaggtcctccatgtcggccacggtgaggccgttgaggaacgtgtagggctcatgcatctccacggccagatcgtcatcctcagcgctgatgtacttggccagcaggtcgatgggcttggcccgcccgtcccggatgcggatcttggaactgtggggagcaggggaaggtggcatcagagcctgggctgtgccctccatgctaaagaccctgcccttggggtgaccacaccagtgggagccgaggaggggcctgacccgttgggggtggtcagggaaggcttcctggaggaggaggaggaggaggcataaggtagagtgagccgggtcagccaaagggcgcaggccagcagtgcagacaaagtgcaagcagcgtggacccggaggtgggccaggtgggaggggcttcctggagggcctctgggatgtgcccaggatggcggcttctatgtgggctgtgatggggaagagtggaggagctgaagcagaggcaggctgggggaccagagtagtcactgccttgcaaccacctcctcccccaggcagaccactcggggcagagagccgggtttctgttctgggcctgcaggggggtacgcgttgcaggcgggccctggtccaacccaagggaacccgtcaccagggaggcccgagctgggaggagcctgatgtcacccgccacggggcccaaggcaagcagggacaccccggagcctcagcttgtctgtaaaccaggcggatgggggtgccaccctcctgggtggagtgtgggagggacaactgcagtcagtgcaggactggcgtccagcatgcgtggggtgccgttcacctgggcccgtctcctctgcaccctgcccagcaggggagggcaggagacagaagccttgccgcccgggaaggggtcaggaagggaaggtcccaggaagtgccgtgtgggaccctgaagggtgggagagcagtggcttccagagtgacagccagtgcccggccctggctccaagtctgggtcggagggagggggaggccccagcgcaccgcagcttggcctgctggaggtggaagttgtcctcctgctcctcccatgtcttgaagtgctctgcctccttctcgcgctgcagcatctccagctcctgctcgcgcatggccttctcccgctcccgctccagccgcagctgcttcacctgcaggcacaggaggctgagggcagcggggaccgtgcggtctgcagggctgcggggggaggggctgtgatgatgggggcccagccttcacccagctgccctgggcacagggattggtccggagatgcctgggctggtggacagaccttgggaagggagagggccctcctgcccgagactcagcagctcagatcagctggggccctctcggccaccctgaagggagcatgtgggagtgaaggcccgaggccagcagagccgagaggtggagggaaacagtttcctggggccatggtctgagcccctggatccagccttacctgaagccagcccccaggacttcccacttaagcccctcaagtcctgccaaagggggcgggcctccaggccctggaaagggagggccctgcccagtgggctggcagggtgcctaccttctgcagctccagccggttgtcctcctggatcctcttgttccgctccttcagctccttctcctccaggtggctgatccccttcttctccagggcctggaagcaccaggcacacctgccctgagcacagacccgccccctcgcccccctcctcagctccttcgtccaagagattgaccagggcccttgttttgcagagagaggtgacctgccagcactgcacgtcttccaccccctccttaacactcctgaaacccagtgcatccaattcagtgcagacatggagcccccactgggagtgagatgtatgcaaagggtaagaaggggctaccccaactctcaacaggagggcctcactcggggccgccccaactcccaacaggagggccttgctcggggccaccccagcccccaacagaagagccttgctcggggcctgctgactcgctttacccgggagtctgagtgcttcggacgtgaaggccacgccctcagcaagtcagggtcccccactgcacgtgggacagggcaggaacagtgagtgggggcagcagcagctctgaaagcaaacctgtggggtcatggggccccgcccacacagcggggcacaggggtggccactgatgggcttgtcccagcctggagaccctcaaagctggcttcttccagcagctgtctgagagcctggcgcggagcccccacttcccgaccaccttcctcaggctcccggtgccccgtcgccatgagggggttccaggaacccctgccgcccagaacttgcctccagggacacaggctgcctggctggggaccacccccagacacccgggccactctgtggtctatccaacccagcctggggccgcttccacaggcgtcaacgatgaccacatcttcctcctccatggctgcccgcccagagctcacggtggtgcccagcacaccgcaggtgcacagcacatggtggcgatgaagtgccaggcagcagtgtgtgcctcaataaagaactctggggggtctggggagcaaggggccaggaaggggtctctcaagaggggatgtgtcagttgaggcctgacggaagagaacagccggggaaggggcagagcatgtccaggcaggggcgcggcagtgtgagggccccgaggcggaaggagctcgttgtgttctcagacgacatcgggcagaagccacctggagaccccacagctcccaactgcgcaaccggcgagcaggtgcagtcggcccagcccacacgttgcctgctccaccccctccacaagtggatgctgcttcagatgagctgtgtcccccacaggcacatccccgtctgaacccctgcagctgtaatcatgaccccatgtgaaatgaggtcttggccaggtatggtggctgacacctgtaatcccagcatattgggaggccaaggcgggcagatcacttgaggtcaggagttcgagaccagcctgaccaacatggttaaactctgtctactaaaaatacaaaaattagctgagtgtggtggcacccgcctgtaattccagctacttgggaggctggggcaggggaatcacttgaacccaggaagcggaggttgcagtgagccgagattgcgcctttgcattctagtctgggcaacagagtgagactccatctcaaaaaaaaaaaaaaaaaaaaagtgatgaggtcttgcagacgtaggtaagatgaggtcatcctggaggtggcgggccctcatccaatgcctggtgtcctcatgggaagaggaacatttacacacagacacacagagcagaaggccgtatggagacagagacgggaaggcagaccgccacacaacacaggaacaggccgggttctgcggctgcaagccagggagggcccaggaatcaccggccatgactggagctgggagaggcaggaggggcctcccctcggcccccagagggagtggggtcctgcccacacctgcccacgccttgattttggacttctggactccagaacgaagagatgataagttctgttgtcttatgccactggtgtgactggtggctaaatggcaggcgcagaacgaaagaaccagctcagacgacagagcgcctggaactgtggaaccctgtcctgggtacatgatgccaagagctggctctctagataggtttcaggttgggctggtgttcggggcaaagaatggctgaagcttacaccgcaagagacacagttaatggcaagaaaatgacggtgggctgggcgcagtggctcatgcctgtaatcccagaactctgggaggccgaggtgggaaaatcacttgagcttaggagttcgagaccagcctggccaacatagtgagactccatctttacaaaaaaataaaaaattagccgggcatggtggtggtgcctgtagtcccagcaagtcaaaacgctgaggtaggaggatcgcttgaggccaggaggtcaaggctgcagttagccacgatcacgccactgcactccagcctgggtgacagagcgagaccctgagtcaaaaaagaaagctggccgggcgtggtggctcacgcctgtaatcccagcactttgggaggccaaggcgggtggatcacaaggtcag

SEQ ID NO: 2915 - DNA, 1179 bp, Homo sapiens
ctttaagaaggtctgtgatccattcctcctcactgggcgggacctcccaaccagggcctccagccacccccaccagtgttctcgggctggcagagatttgaattctccctggcatggaggtctggaggtcctgcttagtgagggacctccctaccgtggcttccagccaccctcgccagtgttctggggctgacagatatttgaattatctttgggatgcggttcttggggtcccttccagtgagggacctcccaaccggggcctccagccacccccaccagtgttctggggctgacagagatttgaattctctctggcatggaggtctcggggtctggcccagtgggggacctcccaactggggcctccagccacccccaccagtgttctggggctgacagagatttgagttctccctggcatggaggcctggaggtccagcccaatgagggtcctttcagctggggcctccagccacccacaccggtgttctcaggctgacagagatttgaattcctggaatgagttcccacgcgcaagagcaaggagccatctttgctgtttgtgcaacttagtcgttacagcccgcgggctctggagaatccatacctaccggggcagaagggatatatcatcagcacagcacagctactctacaaaatcttagaaggcagattcttttaccaggttcctgatccattcctccttactgggcaggacctcgacaactccttcccggggagaatgtaaatctctgtcagctcgagaacaccggtggggtggtggaggccccaggtgggaggtcccacccagagaggaggaaagaatcagggatctgtgtaaagaatctgcctggccactatttggtagagcagttgtgatgtgctgggggatcccttccacccccagtcatttgggactctccaaagctggccccatcctctcccccaggccccagttggaaggactcccactgggcaggaactccagaactccctcccagggagaattcaaattcctctcagccccagacaccagtggggtagctggaggccctggttgggaggaacagattgggaatccccttaaagattctgtctggggccggccacggtggctcatgcctgtaatccccatacttcgggaggcccagcagggtggatcacttgaggtcagga

SEQ ID NO: 2916 - DNA, 510 bp, Homo sapiens
cccctcaactaccaccacctccagtcagtctcgcctccggctatccgctgctccaccctctggcccggtatcctgcctgtccgctgccaccaaggagagcccggacggagcagcgaggaggggagcagccgggagttggggcttcccccctgcccatccctggccgctggcccgggaccgaagccacttgagcgagcagagagtcgtcaccttgtcttctttgccttcagggagctgctaagaaggacaaataagatagcagagtgaaagagcttttgtctccttagaaggaaggctgagaaactaaagagtgaccagtggttggactcttggcggcgcttaccctgaacctgagtgttaggggagagggaatctgccgttgcggtttctggagctgctcataagcaagaattccctatcctgatcaaggctttaagcctaaaagaaagcagaaataggtcaagggcagcccaggtgcccaatttctctctctcttcacaaggcaccacc

SEQ ID NO: 2917 - DNA, 2049 bp, Homo sapiens
tctcacttctgacctctggacacgtgctgcagctgtggctgaggccaagaaatgtgaggggcctccatccactgcattgagtagtgaccccgacgtggggttcaatgtggaggggggaggggctgctgcggcagctgcaggagccgaccttgttcttctcatgccggcatccctgcttgcagctgtcaaggggacaggaatcatcgaggtgacctgggctgagtcccgggagtgggaagagttggccggaaggggatctgaggaggagaacaggggtcctggtggtctgtgcttcttcccagacacgggagctgtagcggggacctctgctgcagatgctaggggggccactaggcccaggcagtcttgggacttgggtctgtcctgctgtgcatccatagtgggtgctttagaaacgggaggcccacccgaagcccctgttgcaagtgaggacaaagtgtgggaaggccgtgagggtctgcagtccgagatggccttgtcctcaacgtgcagtgcactgttgatgcgctggaatgccttctctttttccaggtgcaggtcttcagccgtgacccggtaccccagctctaagggaggtggcagcatcaaaggctcccctcgcctgcgtggcagcaggggaatcttgcgtctacggggcctagagtcctgggatctgggggagccacccgttggggcgattgtctgccctggtgctgtatctgcccccttttcacaccgtgtgtgacccgaagagacagcctgaggcctgtcctcactcactgtctttgagtaactgagggtcagctggcagcgggatgaggctggccccctcctctgctttagccccggcaagcctcccgtggagctgtaggagctggagatggcatttcgtttggtgctcgagctcgtccaggatgtctgggatgtgtggttatatctgatttctgagctctgggcgtggaggtctgtctgcagaggcccgggcctgggcacaaagggagaggggcctccattgtcccgcaggggccaaaatgcagaccgtgcatccccggtgacctcggggaccgttctctgatcatcaggattttcttggactctggggtccttgtgctgctcaggcatccctgccccgctctccttgagggccctcaacactatcttccctggacacaagtctggggacagccgggtgttgtggaccccaaaggggtgactacctgctcctgggccccacagagtccttgtgctcagtgtagtggctgagctgggggatgccctggaactcagagcacacagcactggcttactgtggtacctgtgcagtgaagttgaagacagaatcaccaggatggaacacaggtcttgcaggatcacggaaaaccttcttagagttgtcttgacaccactgatgtcgagtgtgcgggtgtttgtaggatggcctgccactcagtccaggggcaggagcaacggggagatcccacaagcaaagtgaactgggggatgggctgaaggggctccaggcaactgagccctactcgcaggtcctcggccttggcccaaacaggaatgaggggcacagagtgcccgggtaaccgctcctgggagcagtggggaactgtcggatacttgaactctcaagagctgggctctgagcgtcctcgtccagctgccaacttggccaaaggctaagccagcagattgttctgttgccgggcaacgcgacttctaaacctgagggagtgggcatgtgagcacataatggcaccagtgacagagcgaccataatggatgaataagcgcagccaggtacccgcgcaaggcacctgctggcaatggcaggaggcggacgtggggggtcgtgcagtaggtactggagggagagacgtgggcacaaaggtcgcgggaggaacaggtgcccacaatggctgcatatttgcccgtggatcactgaagattcctgctctcctgctgaggtggagactgcagtgagctgagatcgcaccattgcactccagcctgggcaacgagtgcaaaactcagtctccagat

SEQ ID NO: 2918 - DNA, 694 bp, Homo sapiens
agcttacaacggtcgcgggacccacagggacgcggcccgagtggctctgctccggcgtcccgtccgcacggatctcccccgggacgcgggcggaccagggagcactcaccggcagtccttgagccatatcgcgatcttctcgttgggcacgtttcctgggggtagagagaggggacagcacgttaccacccaggagcactacgacggcggagtcaccctggaccctcccaagtaggaaaatctaccacggcaaatgcagcctaagcgacacgtctcagtgtcccttggcagggaaatcggatggcacccagttgtctgtgttgacgctgggggcgcctcgttcagcgcgcgcgtttgaaggtcggaagtgtcccctctcccctcggcctaccgtgcccgaggctctcccagaactcgtggcaggcgcccagggcgcacgagactctccccagcccaccagcctccccccggagcccggccgggagcaccgacctcttccccccgctgccggcagctgcgcgccggggaggtcctcctcctcgtcctcctcctcgtcctgcgtcgtcgcttctgtggacagatcctccgtctccgacgcttgccaggagctgcggcacttggcccaggccttcctcctgcgactcgccacttgccactccagttcctcctccgcctccgccgacgacgacagggg

SEQ ID NO: 2919 - DNA, 7328 bp, Homo sapiens
atcccgactaagtggccgtcctgggagttatagtgccactagccggcctcggctgttccctgtccgaggctcttgtcatttccgcttatttcctccacgggtgccgatttcatgtgtgtgttcccgagtgcctgagccggctcccgaaatgagtactcgtggtttccgcgtgggaaccaacctcgagcgccagtggcccgccctctccgggctgaggtggctgctgaggctggggctgctcctgaggcttcagggccgcccgctgcacggctttctaccttcccaggttagccgcggtcaacttctgccaggcggagcgagaaatcgcattttgtcagttttaacaaaacagaaatgtgtaaaaatttgtgtaaaatcttacgatcgagaccaaatggacaagctggctttttttgaagaaagtaatacgactgaattactagcatcattgctgtaacactcaccgtgaaggtctgaagctttactctggaagccagtgagaccaggaacccaccgggaggaatgaacgactccagacacaccgccttaagatctgtgacactcaccgcgaaggtctgcagcttcattcctgatccagcgagaccatgaacccaccagaaggaaaaaactccggacacatccgaacgtctagaagaaacaaactccagacacaccgcctgtaagaactgtaacggtcaccgcgagggtccgcggtttcattcttgaagtcagtgagaccaagaacccaccatttctggacacactaccatgccagagatccaggggctgcagcatgctgaaagaaaacagaagcctgtggagtgagccaagatcaaccaggaaataaaccctttcccttgcgatgtctctccagcgccctctactgacaaacctgctttagtgccagtttgtagagaattgtctttgctgatctctttattatgatgaaaattctctggatggaagggtcatcagctgccgtctcctttgctactctgctagatatccttacaatttggtttagaattttagtaccactaacattttttggtgcatattttggaaataaagaaaaggtaaactcttaaaatactgcttttggccactgagcgatgactgaaataatacctcagtgtatatattacacatgaaatacaaaaagtcccactggagaaaactacagagaataatcattttggaataaaagatactttaaaaaattaagtaaaggacagtaacactttcaaagacattaatgcatttcctacattatcaattgtttatactgccttttacctctgatgaaccaaattaaaaggacatattgtagaaaggctgacatcagccaactcaggaaactaatagggttatacagtgggataaggaagtcaagatgtagtccaaggaatggggctattcggtttacagatttgaagttagcctattccacatatcggagaaaggtataggataccaaaaagtctcaatgaggccacacagccaaaaaactcttcaaggatatagcatgagattgcagaggaaatgttggaaaagacaaaatgggaggtggagttccacagagagcagcaaaaagaaaattttctgaaaactattgacacattcttagacaaattctaagagagaacttttggacattttagattattttgcattagaatagtcactggtaaatctttccagtctctcccttggaaattataaaaaaggataaatatcctcattgattgtttagctgtgtgtcacttagtatggtgccactggtcgcatgtggctgttgagcacctgaaatgtggctgtcggaattgagatgggctctatgtggaaaatacacaccagattttgaacacttagaacaacgacaaagataacgtaaaatatttgctcaataattttatattaacacaagtataaatcataatatttggacatgttagaataaataaaatatgatgttaaaattaattccatctgtttctttttacttttttaaggggggctactaaaaaatttagaactacacatgtggcttgcattatacttccattgcacagcactggcctagcccctgcccacatgactgctttttgttattttctttatactattgttgttttctcaaagctgcctttgagaaaaatgctcctgtaaatattccatgccctcttcagattcaagattctgttttgtgataatatctgtatagatgtttttcagtttcatttcattctgattctcacttcatttatttccgagcagattagttgtccagttcagacaaaccagatcccctgtcagattcctccatagaacttctttacaaaaccacttcttggcatcataattggtggcattttccccttcggctgtatttttattcaactctttttcattctgaacagtatttggtgagtattacatcttcataatcttaaaagtgttagtttttagtaaattaacattcctatagtttaaggaggttaaattctgatatgataatacttcatttacctccctttatccagtaaataacaatctgacctagaagaatttcctagagaaccgagacttaattcatgactttaaaaatatttatttttaatttttgtgggtacacagtaggtgtatatatttatggggtacatgagatgttttgatacaggcatgcagtgcataataatcacatctatggagaacgaggtatccatcccctcaagcatttatcctttgtgtttcaaacaatacaattatactcttttagttattttaaaatgtacaattaaattattattgactgtagtcaccctgttgaattcacaatttttaaaaggcacgttttgatggaaatatttataaagatttacttttttggctgggcgcagtggttcacacctataattccagcactttgggaggctgaagcaggtggatcacttgaggtggggcgttcgagaccagcctggccaacatggtgaaaccccatctctactaaaaatacaaaaattagccggacgtggtggtgactgtctgtaatcccagctactagacaggctgaggcatgagaatcacttgaacccgggaggtggaggttgcagtgagctgagatcgtgccactgcactccagcttgggcgacagagtgagactccatctcaaaaaacaaacaaacaaaacaaaacaaaaaaaaaaacaagctgcaaagtagatgatactaaccatattttccagatgttcttgatgggaaagtagttttaaaatggaaactgaaaggtttttcagacaattaactttcatttcagtgaaaagcaatgtgcttgttttttattttacttttgttttttatttttttgagacagggtctcactctgtcacccaggctggagtgcagtggtgcgatgtcggttcactgcaacctccacctgcctcccaggttcaagcaattctcgtgtctcagcctcttgagtagctgggactacaggcgtgcaccactatgcccagctaatttttgtattttcggtagagacagggtttcaacatgttggccaggctggtcttgaagcaatgtatttgttgcatacaactttgtataaatttattatctagggagatgcttctcaatactcatccctcactctcatactcaggtatatattttacatgacatttttaggtggcgtattgatcggttcatcaatttctttttatttccaaaaggctttttaaaatggatgttgtggctgggtgtggtggctcatgcctttaatcccagcattttgggagtctgaggcagggggaatcacttgaggccaggagttcaaggccagccttgggcaacatagcaagatcctgtctctacaaatgaaataaaataaaataaaaaattagccaagcatggtggcacgtgcttggctaaaaaattagccaagcatggtagcctgtaagttccagctacttgagaggctaaggcaggaggatcacttgaactcaggaggttgagactgcagtgagctgtgattgcaccaccgcactctagcctgggtgatggagtgagaccctgtctctaaagtattagttaattaattggaatgggcattgatcatcccaacttagctcaggtctataataaccaagagagttaactgcattctttcaaagtttcacctagatgtaatccacacacagatttttttaaaaggcacatttgaaagtatatttaatagaattatgtgtgctgtgctataaagacatatttggaaaaggtgaatgtcaacaggctttctaaggcaaaagtggtatttgaatctggttttctgttttatgatgtcgttgttggtatttatggcatttgcagccttcaatttctaaagagaatgtttttaaatatgtatggagaaaattatggtgatattgatgagtctcaagtgagaactaacttatatgaccagagaaacatgggtaagtagcagcactggttctgactagagaagatacggccaaactctgaaactgcataggtaagggactattttttggtacttaaaggataagtggagatttggaatacagagttgaatgtttaggggaaaaaaagaaaaaaaaaggtttagagaagtgtatgactgtctattgtatagatttggattgatctttctgtgtgtactgttaagttaaagtttatttaaacctcttatttttattttcaggtctcattagctgtactacatgtttggcttccttttcttagtctttataattcttgtgattacttgctcagaagttacagttttgctgtattattttcatttatgtgctgaggtaaagccataagaaactaatgcatttgctatacttgcattattggaattggaagtctgtgtttagaaaagaattgaaataaatgataactgcatgtttctacaacttgggatcagttttatattgtgttttcctattaacacattttgactttgatgtggctgtcaagttaaggctgctttgatggaaaatttaaatagaaagttatttctctttggctggttattgtaattgctgcatgatattcagttaacagaaaaatataagggactgatttaatatttatcaagttcaatgatatttccttttctttttttgagacagggtttcactctgtcgcccaggctggagtgcagtggtgcaatctcggcttattgcaatctctgcctcctgggttcaagcgattctcatgcctcagcctctctagtagctgtagtagctgggattacaggtgaccaccaccacacacagctaatttttgtgtttttagtagagacgaggttttgccatgttgcccagcctggtcttgaactcctgggctcaagtgatccactctccttggcttcccaaacagctgagattacgggcatgagccaccacgcccggctgatgttttctttttaacaattaaattttttctttgcagcttaagccagcattctggtttgttggtttgagatagtggctaaaggtcctttctcttctttcattttattgccttttggttaccacagacacaatagttctttttaccccagtcccattttcccccgatatcattctggataactgagctggtagtgtacattgttctcttaaatcccctaaatccgttttattttggtagttaaatatgactcttcaaagataacagacaatagagggttcagggaatgattcttatatacatgttttcttagacattttcttcttgtgctattggtatagaggtacaaaatataactatatatatacttaaatatacttatgtagtatatttatacttagctggtgtattagttcattttcacactgctgataaagacatacccaaaactgggaacaaaaagaggtttaagtggacttacagttccgcatggctggggaggcctcagaatcacggcgggaggcgaaaggcacttcttacatagcagcaagagaagaatgaggaggaagcaaaagcagaaacccctgataaacccatcagatctcatgagacttattcactatcacgagaatagcatgggaaaaacaggctgccatgattcaattacctccccctgggtccctcccacaactgggagatacaattcaagttgagatttcagtggggacacagccaaatcatatcagctggtcattattagtatggtacattttgccttagagaatctgcagcaatcattaatgaggcatacaacaataagcatataatggatatgtttttattcctaagaaaatgttttagggggtcctgaagactacccacatgtttggtgactcactagaaggactcgtgggactgggcatacagatgcatacatgggtaggctacagaaaggatgcccacaggatcagtgagggaaaaagacaggtggagcctggagaaatccaggcgcagccttcctatgttgttccctcccattagagagcacactgagtatgcttctttctccagcagtgagaaatgcagtaataaatatgcaatgttctgcccagggaagcccgttagagatttcagcatccaaggtttttatggggagtagtcacataggcaccctctgcctagcaactacaaaattccggactccccaaaggaaagcaagtatcgaccataaatcacattgtctgtacagtctaggcatagcaaaccagtctacatcagtcaggaaatgactaaatgccaaattcccagatgcaaaccaagggccaacctggcaagcaggcttttttttttttttttttttttaattgatcattcttgggtgtttctcacagagggggatttggcagggtcataggacaatagtggagggagggtcagcagataaacaagtgaacaaaggtctctggttttcctatgcagaggaccctgcggccttccgcagtgtttgtgtccctgggtagttgagattagggagtggtgatgactcttaacgagcacgctgccttcaagcatctgtttaacaaagcacatcttgcaccacccttaatccatttaaccctgagtggacacagcacatgtttcagagagcacagggttggggttagggtcaccgatcaacaggatcacaaggcagaagaatttttcttagtacagaacaaaatgaaaagtctcccgtgtctacctctttctacacagacatggcaaccatccgatttctcaatcctttccccgcctttcccccctttctattccacaaaaccgccattgtcatcatggccagttctcaatgagctgttgggtacacctcccagacggggtggtggctgggca

SEQ ID NO: 2920 - DNA, 892 bp, Homo sapiens
gcgtggaggggagtggctgcattgtcgggaggcggtacgggtcttgccttggtacccgatggagagggtgtggccaaaggagaggaagaaagcggtcctagtgctggggctgcgtccttccttgggggtgtgacctgagggggtcgcagagcctgcagtcctttcggcttgggctgcgagggatgcgcaggagccctgggtgttccgcgggctgagggcccagaacgggctggggaggagagaggggtggcgctggagctcagggagcgcgaggccggcctctggagacccccaccggcgctgggccgcctcctggcagccgggcttggctcggtggtactgtgctccgaggcgctgctcactgatttccgggggccctctgtcgggggccgtggccgggcactcggagctggccgggggagccccacctcggtgcccgcagcccgggaccgacgggccatggccggggacggggttcctggggtaggcccggaagtgtctggagaaaaagtagaaggccaagggtcaccgatacctctgaggcggctccccttgctgcccaggaaccccactcttctccaggtcacgtacctctccgtgccccagcgctgagggcactccttttgggagcctctgtagcttttcctctggccacagtttcctccgctgagatccggagtcccttctggccaagagggcctggcctggagacagaaggggccacgctcaggcctaggtctttgtttggcttcccaagtctctattttcccatctgtgaaatgggcatgtgccctctctgaggaccaataatggctttcacccaatttgtgcccagtgacctgcaagtgctcccgcgccccaactcgtgtaaaataaaaggttccagactctg

SEQ ID NO: 2921 - DNA, 1238 bp, Homo sapiens
ttgaaaattaaatcaagcctacacataaaggcattttttatatatacacacacacacatactttttatgttatttttggagagaatcttgctctgctgcccaggctggaatgcagtagcatgatcatggctcactgcagccttgaccacccccagggttcaagtgatcgtgccacctcagcctgctgggtagctgggactacagacaggcaccctgcctggctaatttttgcattttttgtggacacagggttttgccatgttgcccaggctggtctcaatctcctcggctcaagtcaacagcctgcctctgcctcccaatgtgttgggattacaggaataaactactatgcccaactcaagattattttttaaatggtttattttcttagtaaattggggtgcacaagtcattaaaagcaaggattaaatttaaagggaaaaatttgttttacttttctacagaaaattaaaaccaaagcacattaaaagtgacaacacggccgggcacagtgactcacacctgtaatcccagcactttgagaggatgaggtgggcggatcacaaggtcaggagatcgagaccatcctggctaacacagtgaaaccccatctctactaaaaataccgaaagttagccaggtgtggtggcacgcacctgttgtcccagctactcaggaggctgaggcaggagaatggcatgaacccaggaggcggagtttgcagtgagccaagatcaggccactgcactccagcctgggcgacagagcgagattctgtctcaaaaaacaaaaaagcaacaacccaagatggaaatgacaaaagttacttaaaatgtgcaacataaaaggtagtcatttaggctgggtgcagtggttcatgcctgtaatcccactttgggaggccaagacaggtgggtcacttgaggacaggagttcgagaccagtcaggccaataccgtgaaacagtctctactaaaaatccaaaaattagccggatgtggtatcatgcacctgtaatcccagatgttcgggaggctgaggcatgagaatcgcttgaatgcaggagcagaggttgcagtaagctgtgatcatgccattgccctccagcctaggcaacagagctagatccttgtcttaaaaaaaaaaaaaaggaaaggagtcatctataattttactacttatacagattacattgagataaatcgcaaaatattaggcaaaactttaaaacaattttt

SEQ ID NO: 2922 - DNA, 1419 bp, Homo sapiens
aggtttgattaccaccacctaagacacggccactttttaaaatatttgtagtttaaattaataacaggctcagtaagaccatcaaaaatacaagtctcaagaggtacctggagagtgaacaaactttcctcaaactgatttcatcccatttgcacctgatgtctgatacacagcagctactcggtaagcattagcttgccttattactcccgcttgggctctggtattccctgggcaggggtgcagtgacctgaggggtgggagatccacatgtgggggaaggaagacacctgcgaacagcaggctatggggcacggggctagtgcagagggtccctggacctggggaagtgatactaatgtgcctgccatgggcttgcccctgggccgagaccctgaaggaaatcgctatttcagccaactgcattgcctgcacagggtcatttcgtctatgccagctacccagcatgcttgaaagccacccccagaaaataatttctcagagcatcatctgggtttaatattccggcggcaggtataagtgacatcattgccttttcagccctgagaggaagagtaattttcttttaggaaaaaagaagtgaactatgattacaggcagatctttgaggtggaggaaggaaagtgaggagttttaagcaatgttttctgctctcattcttggaacagctttccctcttgcccttcctttctcacttagcttatttagtttggtccgttcagggttccgtttcctaagggaggtttggtgggagatctggaagaaagtgctgctgcttctgcatgtagcaaatggtgcccagcaggcagggcccatcccctggaacacagggctacaagccaaccactctgtgcctgtgagtaaaccacaccaaaaatggccagtccagcacttccaggagctgctcaggtcagcaaactctttgaacagctcctttcagacaggtacagtactggagggggacaaagatgaaccagagggtccctgtgccccaagttcacagctggttccgattgttctgtggcatggctcatgagagccacggcatagggaagtggggtgtggctttggagggacaccctcctggcccaggaaaacaggaaagcatagccaatgcctgctgggaggcagcagttagaagtccaggctctagatctcacaaagcagagaccaaatcttcaaaaagcagagaccaaatcctgtctgtcctgcgacctgccagctttgtcaggttggcctgttcaaacaccagatcaaaaacctactttcatctccactgaattttcccccatgttagtagttattttgtgttagcttctatttatccttcttttgatgttttcatacttttaattataattttattagaaagtaataaaaccaaattaccccaaaaaa

SEQ ID NO: 2923 - DNA, 4544 bp, Homo sapiens
agacagggtttcactgtgttagccaggatggtttcgatctcctggcctcgtgatccgcccgcctcagcctcccaaagtgctgggattacaggtgtgagccaccgcgcccggcctgaaatgtgcatttttgttgcatgggcctaatttaaaactggcccaaggggacattttgtacaatcgccgagaaatttgcaatctcagattgagacttaaaattattaaattcagctttgactgaatttttgatgcaaaaaaaaatcacgaaaccttaaatactgaaccaccaaagaagggtgatagacaattaactctggctgttagcctgtgttactgtcattacaacacttaaaaactgtgctagggtaaattaaaccttttgggtttcagtaattaagataccctgagaggaacacaacctcatagatcttggtttcttgtgttgtgtagttaagtggccttacaggctggcttgtgatgatgtcagagaatgggatgtggagcttaactgttcttagcattttgctaggccctatgaggtagaggaggcatttttcccaatatagagtcatgtagcttatatgtggtgtggaaataaatgaagaccaaccaaataagaacaggcaaaagcgatttcatcagagcttgctatagcaaaggagtcagacatcatcacatgttttggcagagactcaaagtcaggcaaaggagtgggaaagctttatggtggaaaaaagggaagacttcaggtgtgactcaattagaacccatgagtggtctaatcagaagtgggacatcctatatggatatttggctttctttcattggtcctaaattggaagcaaggacaaaaattacgtaagctatctgttattattcaagtcctggctgtttggggctgattgttacagggttgttgtttggcttcctggactggttgctaaagataggggtctgatttccttcaagtctgacttatagatagtaggctagttactgtagataatgggttggtttcttgggctggtggctgcagattatgtatcagagtcctatttttatatacggtcttgctattgtccatttgcatattcagtctctctgtgttaaaactgcttgaatctggggcttttttaaaaataatagaggtggggtcttgctatgttggccagagtggtcgcaaactcctggcctcaacagtcctcttgactcagcctcccaaaatgctagtgtgagccaccatgcctggcctgaatccagggcttttttattccacagctatgttctttccactattgaatgctatcagataatatcaaggaattaaataaaatataatcagcttctcccttttctccttcaaacacatcagccaacagcttttttcttttcttttcctttctttttttttttttttttttgagatggagtcttgctctgttgcccaggctggagtgcagtggcacgatctctgctcactgcaacctccgcctcccggattcaagcaattcttctgcctcagcctccctagtagctgggattacaggtgttcaccactatgcccacctaatttttgtattttaagtagagacagggtttcaccatgttggcccagctggtctcaaactcttgacctcaagtcatccacctgctttggcctcccaaattggttggattacaggcatgagccaccaagcccagccaagaaatcatttctaatttaggcacaataggaggttgaatcacatctgatgtaaggcttgtggactacaggcatttaactgctgagtgagcttagttacacgtgcagtatcctccttttcgtacatttctgatgttctctttttgccataaagtatacaatttagtagtattaagtacattcacattgctatgcagccataaccactatccatttccagaacattttcctcatcccaaacaagaactttgtattcattacatgataactcctcattccctcctttctctacccttggcaaacaccattctacttctgtctgactactcatacagtatttgttctttttgtctggcttatttcacttagcataatgttttcaagtttcgtccatttagtagcatgtatcagaatttcgttactttttaaggctgaacaagtactccattgtatgtatatattacattttgtttacctatttatctgttgttgcatatttgagttcttaaagttaattacactaagtattatagttaagaagcaccagtttttcttctaatactatatttggaaaaatggggagacaaaaatagtacaagatagagatgctcaatctgtagcttgtggcgaaaagattcacaaatatacagtaagtaatcagagatggaggtaacctatcaaccagaatgtgacaatgtaaggaactttggaataggcagaaaagaggacttggtgtctctaataaaaagctatgcatttttagtgcacactcttacaggtaatctaaatataactctatcactctatcattgcctttgagctactttacaactctgtaagttgtagataactgatattaatgcaaaataattcttgtataaacatgaaaataaattatattctgtgaaaaaaaagtttggctattgtgaataatgctgctatgaacatgggtgtacaaatatctgttagaatccgtacttttgattatttgtatatatacctgggagaggaattactggaccatatgttaattttttttttcttaccatgagtttgactttttttttttgaaaccgagtctggctctcttgcccaggctggagtgcaatggtgcgatctcggctcactgcaacctctgcctcccgggttcaagcgattctcctgcctcagcctcccgagtagttgggactacaggcgcgcactaccacgcccagctaattttttgtttttttagtagagacagggtttcaccattttggccaggatggtttcgatctcttgaccttgtgatccgcccgccttggcgtcccaaagtgctgggattacaggcgtgagacatcgcgcccggccacctagctaattttaaaatcattttttggccaggcgcgttggcccccctcgccaatcccagcactttgggaggctgaggcaggtggatcatgaggtaaggagtttgagaccaacttggccaacatggtgaaacccagtctctactaaaaatgcaaaaatctcactatgttgcccaagctggtctcgaactcctgagctcaggcaatctgctgcttcagcctcctgaagtgctaggattacaggcatgagccaccgcgcccagcggatgatgtttttgatgtcgtatctaagaactctttgcccaactcaaagtcacaagatattttctcccatgttttcttatagaagtggttttgttttgttttgtttgtttgttcatttgagacagagtgtcaccttgtcgcccaggctagagtgtagtggtgcgatctcggctcactgcaacctccgcctcctgggttcaagcaattcttcgcctcagcctcccgagtagctgggattacaggcacccgccaccatgcccggctaattattgtatttttagtagagatggggtttcaccatgttggccaggctggtcttgaacccctgacctcaagtgatccgcccacctcagcctcccaaagtgctgggattacaggcatgagccactgcacccagccgatttagcaccttaatcaaaaatcaactgaccagcactcacattcctgatttcaaaatttattactccagtctgggtaacctagtgagacctcacctctacaaaaataaaaagataaattagccaagtgtgatggcaagtggctgtaatcctagctattcaggaggctgtgacagtaggatcgctgagcccaggagatcaagactgcagggagctatgatcagtcgtgccactgtattccagcctgggtgatagagcaaggccctgtctctaaaaaaacaaaaacaaacaaacaaaactactgataatctacaggtcacatttggcaggcttccaaattaacctgcctagaaaaggtcttaggattcttggcttacattctgtcccttaataaaaaatcttggcatgcctgtaatcccagcactctgagaggctgaggcaggcagatcacttaagcccaggagtttaagaccagcctgggcaacacggtgaaaccccatctctacacaaaattcaaaaattttgtggttgtggtggtgccatctgtagtcccagctacttggtaggctgaagtgggaggattgcttgagccgggggagttcaaggctgcagtgagccactgcactcctccagcctggggcataacagagcgagaccccgtctcaaaaagacaaaacaaaacaggcagggcacggtggctcacgcctgatcttgcggtgagctgagatcgcgccactgcactccagcctgggcgacagactgagactccatttcaaaaaaaaaaaaaaagaaaaaattacctttttttttttttttgaggcagagttttgctct

SEQ ID NO: 2924 - DNA, 2769 bp, Homo sapiens
aatgcacatttactatagtcagtcaccctggtaccagccgtgaaggacgggcagggacacacacaccacaccccagacacacacacacccccgacacaccacaccccagacaccacatcccagacacacaccacaccacacccccccacacacacctcagacaccacacccccgacccacaccacaccccatacacacccccgacacacaccacaccccacacacccaccacagcccagacacaccacaccccagacacacaccacaccccccagacacacaccacaccccccacacacaccacacccatcacaccccccacacacacacccgacacacaccacgccccccaacacacacaccccacacaccacacccatcacaccccccacacacacacccgacacacaccacgcccccaacacaccacacccgacacacacaccccaacacacaccacaccccagacacacaccacaccccagacacacaccacaccccagacacacaccacaccccacacacaccacaccccacacacaccacaccccacacacaccacaccccacacaccacacacataccacaccccagacaccacacacatcacacccccccacacacacctcagacaccacacccccaacacacaccacaccccagacacacacaccccccacacacacaccccaaacacaccccgacacacaccacaccccccacacacacaccacacccgacacacaccacaccccagacacacaccacaccccagacacatcccacacacatcacaccccacacacacaccccagacacacaccacaccccagacacacacacactacaccccagacacatcccacacacatcacaccccacacacacaccccagacacacaccacaccccacacacacaccccagacacacaccacaccccagacacacaccacaccccagacacacatgccacaccccagacacacacaccccaacacacaccacactccagacacacaccaaccccacacacaccacaccccagacacacacaccgtcacacaccacaccccacacacatgccacagcccaccccacatacgcaccctaccccagacacacaccacaccccacacaccacaccccagatacacaccacaccccccccacacacaccttatacaccccagacataacacacaccccacaccccagacatacacaccacacccccccacacacaccttatacaccccagacataacacacaccccacaccccagacatacacatacccctgacacacaccacaccccaccccagataccacacaccccacaccccgacatacccctgacacagctcaccccagatacacaccctaccccagatacacaccataccccagacacacaacacccccccaacacacaccatcccagtcacatgccacacatcccagacacacaccccacacgccacatcccacacacacacgcccgacacaccgcaccccagacacacaccacacccacacacatgccacaccccacacatacaccccaccccacacacacatcacacccctcacaaccacaccccacacacacaccacaccccacaaactacatagactatgctagccacataccacacaccagacacacacaccacacatgagcatgacgtataccgcacacatgccatgcactgtacccccccacacacatcccagacacacataccacacacactacacagaccacacagcagacataccacacaccagcaccacaccccctcacaccacatgccacacacaccacatgccagcatcacacacacaccatacctccttcatacacaccacacacacaaaccagacacacacctacataccacacaccacacaccagccacacaccacaaacacaccacacacaccacacgccacgcatatatcagatacaccacatacgtacagatacaccacaatatacaccacacgacacatgtaccacaacacacacacacgacataacacgcacacacatcacaaacacaatcatgtccaccacacaacacacacaccatgtgcatgcacacaataaatgcacagcacaaaacatcacatacaccaaatcacacacaccacacacacatcaaacaccatacacacagaccatgcatactcactgcacatgtgcacacataccaacacacaccacacacacacactgtacacacacctaaaaccacccccatacacaccataccaaacacaaccactcacacatgcaccacacacagcacagcatacaacacacatcacacacacaccaatcataccactgttacacacacaccaccacacatactgcacacaccaaagcacatacacaccacatagacacatgcacgctacccacaccacaccaatcacatccacacatacacaaccatacacacacacacacacattgttgacttaggatcgtttcaactcacagtgggtttattgggatgcagccccgtggcaagtggagcagcatgtgtattgacaaggggaggaaagccgtctggagctggtgaagtaaagttagcatgcagccgagctctgctcgtctgaactgatgaacccaagttcctcatggatcactcagaatacagatgggtgaaaaaataaccccaccacccgtgtgccagcacatagcgcatctggcatacaaacgtaaggatcaatagcgatgaatggcgatgggttgtg

SEQ ID NO: 2925 - DNA, 9023 bp, Homo sapiens
gcacagcgcggcgggagcgacacgcggcaggcgagtgcggctgggaaacgacccgcggctcgggggccgcgaggacccggccctggcctggcctctcctcgcgtcccctggcccgcgcccccgctcccggagcgcccggcgggcccagcgcaccccacaaccggcaagcaggtgagaccgacacccaccaccgcgcggcgcccggggcctgggttcggagacccgcgcggcgctcccgcgcccccccggcccgccgcactcactgttgtactgcacccccttggcgaagcgcctctgcaacgcctggttcatggactgcagcccggcggggatgttcttgtcccggcccggggcctggtccgaccccaccagcttcttcagggcggaaaacatcttcccgctcggacgtcccagcccgggcgcggccggcgagctcagcggcggcggggaaggggtgcgactggcaccatgtcccggcggccccggcccccccggaggccggagccggcgcggccagaggccggggtcccggcggcggagcgcagccccgagcggcgactcgggaacctcagccgcggctgctccgctccggcccccgcggcctccggcgcgaccgctctccaggagtcagcgccgccatcttggcgccggctcggcgggacgggaggggtgcgcggctacggggcgccgcgagggccgcgggggcgcggcgcgcgcggtcggcgcatgcgcacgcggttctggcgcgcagttccgggcccgggctgcctccttacgcagaacctcccccgatcctgcgtgtcccgtgctcctctccgagaccccggtcgccccagcgtccgcagcagtcctggaaaaatgtttatttgtgtagcaaagcagggagcggggcggcggggctacttcttctttttcttggccgccttgagcttcccctcgattagccgctgcgcctgcctcttgatctcggcgcgcgaagggacgtagctgtggtccatgtcggggaactggaaggtgtctgcgggcggaggcggcggctcgcacacggggctagcccagctaggcgcagccgcccgacccgcctctcgcccccgccctccaccgacccgggccaggtgccttgccccagggacagccccagcgtgccgggaggactcagcccagcccattcgcagcggctcacgctgccctgcctagcctttcccgcagaacccccagtggaagctccggcccaggccttcaccgcgctcctccctgctccagccctggtgcctctcctccgggcccgtctggcatggcatgcctcctcctttcggagaaattaacaaggtatttcagtggctttagcctccccatggcatcactaagtcacctccatcaattaaagtcctgcaggtacaactgatgcaccctgtagccccgctgtccctccaggatgtcccggtgggatgggagccggcgccaccccgacctgtgttccagccacccgcctgcagcccgggccccagttccggggcctgtaccgatcatatcctcctcccggttctcaaagctgatcctggtgttgtacttctccatcagagtcgaggactccagggtgtccctcacctttgtgtcgccctgcagggcaaagcccccttcagccgtgcagacactctgaacgggagcctgtcagctttgaggggacgtgggctgtgcaggttcctcccagcccggggctacctcctcggtcctggacaccatctgcactctgtcagccaggtacgtgagcttcccctcgcagtacgccagcttgctgttcaaatcgagggtgttggagagcaccacttctctctgtaggccgggaggagggtctcatctcccctctggccctgcccagggacctggtgtgtggcagctcagcctcactcccggtacctgggtcgcaggcaagttaatgcccatcagccggacatagaggttgtcgatgcccatctggatggtcagcagcagctcctggcccttggtcatgttgctgtgcgccagctggagcctctcttcttcctcttttagcatgtctgtcattttcttctcaacggacttgaagctgcagaaggcaatagggacacagcagtgaggggcacaggcccgagagccatggtgggccacccaggagcccagtcctgagttgggtgctgtgccagaatcagggactcagaagctcaggtgtgtgcaagtggagtcccctggcccctctgtgggacacacaggcttgttggcagtgggtatactcccagctcccagcctggctgcagcccggggcctttgtgagactggggtgggtggcccgcagccccggaagcccggggcacctgatggagctaggcttctggcggaacttgagcacggcctcctccagctccagctgcttcaccagggccttcagctgcacccgccactcctcacagtcctccatctgcagctccaggttctcctccgtgttcctctgggccaggaagcggctagtgatgtcctggccagtccgggggagagagaagcaggtgtgggccaggatggtgggcagagggggcttcacagaactggtttcttctgggcccctcctagacgctagtgcactttctctgtgctcattcacaagtgtgatcacagctcactgcagcctcaacctcccagactcaagcgatcctcccacctcagcttcctgagtagctgggaccacaggtgtgcaccaccacacttagcaggggtgaagcgctttgtggatgtcattgcacacgaccctaatggcaggcagagagggtagataaccccatgtagagataaggagatcatcactgaaggacgttgtgtcacttgagtcacttgtctgacagtggacaagcttgtgtcagggcagtggttaggagctcaaggcctaataataataaacgcagatacacagatgggattaagataaaaggatttggggcggccgagggagttgccactttgtgtgtccatttcagagtgcctcagaccccagcccagctcagccaccctcctgccatgctccgggagtgccagggagcattacccagacgtgagaggctcagccaccctcctgccattctctgggagcgccaggggcattacccagacgtgagagcaccgtacagcactcttgaccttctccaccacagcagtcacgcccgactggtattccatttctgctgtggaggtctcttttctcctcactggcagagcagaggggaggggcagtcagcatgcagggatggctcaggggctctgtgtaaggctgtcagacacctctgtacctgcccagctgctggggcggccacccaagacacaggcatccttcagagatgcctgcccccgccccaacctgctccctcctcagcccagccctgcagggacgccccaggcagccccagagcagaggtggacccggagtgagtggcgcagcactgtgagcactgtgggcccggtggtgcttctcagaggcagcttaggggtcaggatgctcatcctctgcagagtcactggggactgggcccttggtgcagggcccttgggtgctggggccagcatctctgaggccacatttggctacaggctctcagcctctggagggagaggcagggacctgtccttcccttcaccctggcgaccacatgtcacacctggcctcagggtgacttgatccgttggcctgaatcagtgccagcctctccttgggaccctggctgggggcaggtggggagctgagcgcttacatttcagggtctccgtgctcatcaggttcgaggggaagtccaagtccatctggccctgatgggaggtgggggcggggaagggatgagacatccttggcagggagtgggccctgagtggtggccctgagcctgtgtccacccagctgtcatggggatgggcagccagccaggccctggcctggggcttacccggcggtacttctcgctggtctccttcgtgtggatcttgtcgatcagcttcttctgctggttgagccggttctcccttgcccggcgctcctcgatgaaggacgcctccctttgcctcatgttcctctggggacatgcgggtgggcacagggttggggagctgtctcaacaaggcccctaatggcagtaaagccagcgggcggttggccatgctcaccttactagactttggaactgcatccccggccaatggccacacccttttcctaaaccacttgtgcccgtggcccctcagctcacggccctccttgcccatgcctcagagcatgtgccagcccagacgctctgctgccctccagccgctggcccccagctgcctcctggccaggtccacctagaactcacggaagtgcattcagcctgcctgaagacagattcatcctcttccccaaaacctggcctcttccagcgtgcccttgggcagctaaaaccgtcatctgctaacccctgctcacgcaccccagacactgctctcaccctcgccactctcgttgccagcgcttagtggggttgcctcttgaggagttctcagctccgttgctcctggccaccccttctccaccccgggtatacccaggtgatcagcgcttctgccctggcaccttccagtccctgcagcctgagtacaccctttctgaagcacagacctggtcacatctttcctccacctcctcccagggctccaggtcagtccttgggcccccagcccagccgcctccgtggactcctggggcctgtgcctctgcagcctccactgccctggccacacgctgctccatgtatcacacccctcccagcccagggccttttcccaagttgtacctcctcctccctagccctggccacacctgacctttgcgggttcaatccctcagcccagctcaagcactgtcttcctggaaagccatctgccaccccacctgtctctgctgagctggctcaggggctgtgtggcatttcttcatggactactggatgagtgccacccacttcaggaggacagggtctgcctgtcccggtccctgctgtatccccagagccttgcagggaccttggcacagactgggtgaataggtgacccccgccctggcccggccagttctctccctctcctctacttcatggctcctgtgctggatgggacctgctctgtccagtgggtgagcagagcaggctggccgggctggccactggatccttctggggattgtaggcagtgtgggcatgggggtctcctgagagaccctggccagaagacacaagagagcccgccctggggggccccagccctgggccctgagctcaccttgaccccatccgaagatccaagagggctggccctggggggcccccagccctgggccctgagctcaccttgaccccatccgaagatccaagagggctggccctggggggccccagccctgggccctgagctcaccttgaccccatccgaagatccaagagggctggccctggggggcccccggccctgggccctgagctcaccttgaccccatccgaagatccaagagggctggccctggggggcccccagccctgggccctgagctcaccttgaccccatccgaagatccaagagggctggccctggggggcccccggccctgggccctgagctcaccttgaccccatccgaagatccaagagggctggccctggggggcccccagccctgggccctgagctcaccttgaccccatccgaagatccaagagggctggccctggggggcccccagccctgggccctgagctcaccttgacctcatccgtgatcatcatggcatcttgggacatgatcttcatatccgacagctctgagcagtagttgaccacgaggttctgcagcttgtccagctcaatggggtatcctgccagcacctgtgttgaatggggttctcttgtggcccctacagagtgggctgcagttgccccgagcttttatcccccgactaagagccctgagaacagtgataggttctcctctgtggccccagccacctcccccactccccgctgggcacaacggtgatgaaaggtgtttcacagggagtggacagtgctggcctggtggactctttcaccacctagggtccaacaacccagagagactgagagagtttgtgatgaaatgctctgcagaaaaggctgactgaaacccggggaggtttggggacagttctgctttgaagtgaaacagaggggctcaagacatgggcttggggtcagagagtcaggattcaaggccaaggcagcttctgaccagctagtttagctgtgtgacattgggaaagttacttaatctctctgtgtccccatttgtaagatgatggctcgttcagaaggttgccatcaggatgaattgagtgtaaaaggaattatttagcccagaaccaggtacatacgtgctcaggatagctttgctatagtggtttgttttttgtaactacaagcatgagccaccatgcccaggccgggaataattgttttttaagtgtgtatgttctaaacagaagaaggcgctaccagaggaacagaaagcacccaggcgaaggaggggcatggacaggggtggggagaggggtgggcccaggaagcatagaggggcagggcttccaggtgagccaataggaccaggggccaaggcaagagggacaagcagaggacggtgctgagagccacctgggctgggaccacagcaggaaaagagctgcgatgcagcctccgtccaccactcctcctaaactgcacttccatgctgtcaccttcccgaagcatggctctccagagctcccctttgcccagtcttagggtgagggtgtttccagctggctccccgccccatccacaggttgctcctcttagcacctcctgtgctctccctatctacagcccatctggagtaggttctgctttgtggcagcccgaggggcggtgctcagcctcccatgaagggggtcttccctcacaatcggactgctggctgcctttggcctcgtctgcagggagcagggcgggtgggctggctgggacggcagcaagccctgcttacaggcccagcggaccctcaaaggtgcaaggactttctgagggtgcaggacctgtctgactctcagaggcccaggcaatgagaaaatgacaggcaagatacaaacaataccaaatcatttaatacgtgcaagaaagtccgaagaattctgatataccccacgatatgcttttttggaatagccaaaaatgaagtttaaaaaaacgttttccacatgcctcggcgtcctgcgtagccggtggtcaggcagagctccctctccctggcgggtgcggggcggctccgccccaggacgctcccgcccctcccagatcccagcccctgacccccgcccttcccgggccgctgggctcactgtcttcagataatccagcaggtccaaatacagcaggtggatgttctggctggtgatgatcttgatcattgtcttctcgatgttgttctccagctggcggatgatctggggcggaccgagggcgcagtgagagggcgtggggaccggccgcccggagggtgtcggggctgggttttctccggagagggtcgtgctctcttagccccgcccctcccgtgagccctccccaggggacccgcaagtcccgccccccggtggccccgcccctcccgtgagtcttgccccagtggactccgccccgccctcccagccccgcctctccacctgcagcagccgcagctcctccttgctggcgtcgggctggctccgcaggctgtccagctccagctgcatgctctccagcttctgcccgcgccgccgcaccaggtggatcagtaggttgtgcatgttcacgcggtcgaagacgtacttgcgcagcttctcccgcaccacctgggtcgggaagggcaccgcccactcgtggttgcgtagggggccgccatggagcccgccagcaggcgggcgggtggaggctcgtggcaaccccacagggaacctggggctgggcacctgctccgtccctcgtcggctccgcaacatctagtgggggggtgctggcaggggtggggagggttgggtctcgaggcccctcctgcctggttacctccatggtgctgcggcagtgcgccagtcgcaaaggcaagtttttcccgcaggccttggagatggtccactggtcatactgcggagcggcggcggctgagctagagcgggccctttgcgcacccgcagccgctggctcctccaggcattctccccagggcctcttgtatcccacgctagcccagtagcgagatccctgcttccacgaggagcagagagccgcgggaccccatcctggccatccaagttcggaggcgacgtggtaggggggtatgcagaggagggcctgggtgtcccctagctggccggagagccagagggggcccctgctgcaggatgtgggctcacagatgccaagccctcgggttgggtggtgggaaacctgcccaccggatgctggggtgactggagcccagggcacaggtcctagcagagcccctcctcacatgccccctggatccagaaagattggggtgggggtggagaggaggtgcccgccctccgagtgtgtgtgtactcagctcctgccctgctcgccaggcagaggggaggggcggcgtttgtgtaccttcttggccaaagcccagtcctgggccccgcggcggatgttgctgcgcaggagggccagcgtggccttgttctggtccatattctctttcaccccttggatctggagtgcccgacactgctctgtgggcaggtggaggggacacagtggctaggattgggccaagggcctggcctggaatcccctgggggaggcttgcatcagggaggccccaggccccagggtccagggggatgccccctccatggccaagatccctcctcccgccctgtcctgggggacaccgctccactgcccagcagca

SEQ ID NO: 2926 - DNA, 562 bp, Homo sapiens
aggtcctggcactctatggccgaggccatctcctgggcctcctgtactgctgggctggaaggtggtggtcatgtacggcgagggcattggcatttctggcaatttctatagaaacaagttaaagtacctggccttcctctgcaagtggatgaacaccaacccttcccgaggcccccaccatccctgggctgccagccttctttttcggcagaccccacggggcatgctaccccacaagaccaagcgaggccagccgccctggaccgcctcatggtgtgtgatgggatcccaccgcccctgacacaaacaagcagatggtgatccctgctgccctcaaggctgagcatctgaagcccacaagaaagtttgcttgcctggggcacctgtctcataaggttgactggaagtaccaggcagtgatagccaccctggaggaaaagaggagggaaaaggccaagatccactaccaaaagaaacagcagcagaaacaggcccaaaagaacggggagaagaaaattgcaagttcacaggggtcctcaagacccatgggcttctggtctga

SEQ ID NO: 2927 - DNA, 1330 bp, Homo sapiens
gcttcccagcttcaacatgctcaacactgttcaaccagccacatcccctcactgccgccccgtgtcccgccccagcctctgtgcaggctggcctggcccggaacgcccgggctccttggccacagaacttagtcctgctcagcctaagagtccagtcctgcctcccagtcagaacgctggccctcctgagctcacagaacacgaggctcccagggctgggggcactggaacaaggcttctccctttgggaatggggtgagttaaatgaggccctaggtccccgggtgcagcaacttcagccctgaccctgtcccaggctgtggggcaagatgtgctggaccctgagtccccggatctgaagaggaccggctatgctcataggacgggctgagctctgcgcgggaaggggctccctcctcccacctcacctctccagagtgtcctgctgtggaaatggaggcagtggtgagggcagagccaaaggcatcaggaaaggctggggtgtggagaaggggaaccacccgcacacctgatgcttaggggagcgtggggtccaaggggcctccgctagcgatctcctgtgattccagccccgggggaagagcggcaggctggcctccccaccgccccgctcccgctgggctcccgggctccctgtggctttccgtcctgtttcctcacgccggcaggagctgccccaccggagcagggcctgggccatgtagctctcacctctcctgccaccggccatgtgaacagggccctggaggtacctgtggaaaatacttgaccagcgtgactgcgagcttgatgtaggagaagcagaagagaaactgcagccacgtggtcactcccactgcagccacgatcatggtgacaaatgcgaagagccacgcgagcaccaggaagccgatggcaggccaggacacgcgctggccaccgcgctgggggcgagaggagggcagagatgtggacccacacagaggccacgccggggctgagcaaggacggccccggatagggcgggcttagagaggggcacggaggctggaccctggccttgaaggagcccctgcaagggcctcctgttcaggctgcttggactctcaagctctgtctgctttgttcctacttggcagaactgggcgcctctcagcactcacttggagacgtggggtcggaactctggtggcctggtgcctctcccagccaggtactgactcgtcccacgacccggcagcagcctgaggatctcaggaatctgtcccctcgccttgcctttccctgaacacgggcccaatgtgggccaccttcactctcgcttcacacc

SEQ ID NO: 2928 - DNA, 440 bp, Homo sapiens
aatcctaagacgccaagaggcaaaaagtcattgtatgcattctttgcgcaaacttgttgggagaaaaggaagcagcgcccagatgctcccatcaacttctcagagttttctaagagacatgcacccaggagacctctttcgacctttcttctgttccgttctaagtttcaccctaaaatcaaagtagaacatgctggcctatccattgatgatgttgcgaaaaaactgggagagatgtggtatgacactgctgcagatgacaagcagccttaagaaaagaaggctgcaaagctgcagaaaaaatacccaaagaatattgctgcatttcaaactaaaaggaaagcctgatgctttcaaaaaagggagtcatcaaggccaaaaaaaagcaagaaaataaagaggaggaagataaagaggaggaggaggaagatgaagaagac

SEQ ID NO: 2929 - DNA, 2471 bp, Homo sapiens
ctctgtctctccctccctctttcactgctccctgaaggcagcgtctaaagaggctgaggctgtcctgtcactgccccgacctctgaggagaagcccgcggctgtcctgtcactgccccgacctctgcggagaagcccgcagttctgatcacggacctcagatggggaagcgcacaggaggcctcgggtggccgggctgtgctgcttctccctagacgggcagagctggcgcataggaggtgcttcacaggtgactaaggaggcaaagacccgaagcctgggggactgcagtgtccggtggatcccagctgcggccatcgggcccatgggtgggagagccaagggaggggctcagctgggcaataggatgggagtgggcgggggacactgctgggaactcccttcactgcatggccaagactgaagcgaacagggcgggagagctgtgtgtcgcctcgggcagtcactcagcctctccgcccgttttcctggtctgtaaaatgggccgaaatgccctccctgcgctgttctttgggcagtttctataaatgcttggcccagcctccccggcacacggttgctacctggatcactgttctgttattttcatccctgcccctgctctttgcttagaccgacttcccctgactccggtgaaatcagcctccacaggcatttcatcagcccttgttcgtccacaacacggctaggcaggtgtgctcagggggtctgaggctttcacagacgttaaatgtatgtccctgcaggaaacaggtttctgtacagccccagagactgtacagaaggctgaggccatctctactaaaaatacaaaaaaattagccgggtgtggtggcagtttttctttgtgacaagatataggtaagatttctgaaagacaggagctagtaacatgttctatttcttctgatagcagttttttcctagtaatttgtcaattgcatttaacgtttcccactgacttttgagacagcctcaagtttttatgtctgaagggttcgtagattctgacattgtaatttgtccctgctctcttttctctgactagtgtaccagggctttctcaagtgtactaatcttctcaaagaatccaatttggttttgttggttgtatctactctacgttttgtgcctcatttccttaatttttccttgtctttgatgtgatgagaaggacttcacctccatgtcctccctccccaaaacctgtgaccccagtctagtcaggagacaaattccaacagaggcacatcctacaaaataaccgaccccaacggtcctcaaaacagcatacgatttggatgtaatactatctgtgacttacatacttctaatcttcatttaaaatatttgagtcccggctgggggcggtggctcacacctgtatcccagcactttgggaggctgaggtgaaaccccatctctaattaaaaaaaaaaaattagccaggcgtggtggcctgcacccataatcccagctactcaggaggctgaggcaggagaatcactagaacctgggaggcagaggttgcagtgagccaagatcatgccattgcactccagcctgggtgacagagcgagactccatctcaaaatatctgagtcctagtaactttctaatttaaacatactttttttcattgacatactgggattatgttcttatctgttatttctcccctacaattttctgtcaacagctttcaactgttggcaatttttatttctaattttcaggacttatatggaaagataccagcctgtccaacatggcaaaacctcatctctattaaaaaatacaaaaattagccaagcatagtagcgtgcacctatagttccatctactcgggaggctgaggtgggagaatcgcttgaatccgggaggcagaggttgcagtgagccgagactgcaccactgtactccagcctgcatgacagagtgagactgccttttaaaaagaacttacatggaaagaaatgccagacttaataacatccttttttttttttttttttttttttttgagttagggtctcattcagccgggagtgcagtggcagagtcacagctcaccatagtctcaccttcccaggctcaagcaatcctcccacctcagccccctaagggattataggcaggttctactgtgcccagctaattttttaaatttttttgtagagatgggggtctcactatgttgcccatgctggtctggaactcttgggttcaagtgatccttccatcttggccttccaaaatgctggaattataggtgtgagccatcacacccagtctccttctttaaaagtcattcaaatatgccatatttaaaactttactatgaaaggaaatcactccactaggcgtggtggctcacgcctttaatcccagcactctgggaggccgaggcaggcagatcacctaaggtaaagagttcaagaccagcctggc

SEQ ID NO: 2930 - DNA, 2705 bp, Homo sapiens
gggagtaggtcagacagggttttcactgtctagatttagctggttagattttcctctaaaatcttaagcagatgctgaatccataaagccaaggagtgctgagggctggagtgggtgggccctccctcccacagccccagggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggctggatagctttaccctagggtggggccagccctgacaccctcatcccctcctcagcccagcagcctctagagcagcgtggtgctctcttgatggccaggaatccagaatctgcccttccccaaccttggtttctccttctgtaaagcagagtgatggctgagaagtcctctctagctgcagaagcctgagcttcccggtgtcagtcagctctgcaacgtgggagccttggaggcgggtggcctggctgtgcttcatatgcccaggagtggagaaggaggctgagaagctggtttcccagctctgatctccacaggcacctcctataaccctcctctcacccaccccgctacggtctgagagatctgaaataacctttcccagtgggcagggttgccagggttgaggggacagcacataccacccccacccaacctgttcgaggggccctgcatggcacgggatgagtccctgccctgtgcagctgcctggcagtggctgggacaaggatcttgcagccagcacagaggcctcttcaaaggcctctccctcttggcactccaggcaaggcaggtgcccgcttccccaacacctccaggcagtgaccctagggcatgccccagcaggtctccgagcagccactgggacccgtctcagcacatcctggcctttgaaagtctgatatcctgagaggagggcaggttttagggccgcagttccagccagcgtccccagcctggcttccctgccatggactcagtagctcgtggggcttcttaccacccaccagccccgctggggtgcggcctggctgtgggcaaaggaggacttgcctggagatttgagagaagattccttctaccagggctgctgaggggccaggcctgcatcaggggctaggctctggctgggcccggaggctgagactaaggctttcgaccctggtgcctccatgtggatgctgcctcagacaaaggcagtgagccttccctgccaaagtgcccatcccatgggctcggcctcactggtcactgttagcccatgaacacgtgtgggcctcggtcacgtggctttgagggcagtctgaccaggctagaccacacgtgccgtgacagggggtgccattcccctcgcaggctctaatgtgcccacatgtagcctggcagtccaaagaccaagaatcaacttgcaaatctgccattaaactgctgtgcgacttcaggcatatcactgccttctctgggcttcagtgtccttttcatacctagaagtctgcggtctgaggctctttgggttcagacacactgttctaggcttctgtaggggaccttgtgatctgccgtgcccctcctccctgttcttttctgtcctccccaccccaccctcagaagctgcttgctctgcccccaggacaggagcttgacggatgaagtgcagccagccacccaggtgccatttccagtctgacttccagaaatgtgcaccatgtcctagagcacagacccattggctggagcctcctgggagggttcaaaccatcagctctatgagaaatgcccagaaaggctttgccgactccatccgtctgtggaggctgcctgcctccggggtgggatgggtggtttctcctccaattcagacccaagaggtagcccccgagggcatgtacctggtgggaagcagctcaggtacccttgggggttgcagggcccttacgcaggtatttctctctctctcctctctggggtgcgtgtgtgcgtgcgcgtgtgcgtgcctatgcttttctctgtgggcacatcaggatgcccctcggagagcatgtgcacgtgtccccacctgagcgagcgtgtgtgtgtgctcctctgcgtcccaggtttggacgtctagggtttggtgtgcctgtcttctgccctccctgagcccacagggtcagtcaatgtatcttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaatccgggttgcattt

SEQ ID NO: 2931 - DNA, 8813 bp, Homo sapiens
gagcgccggctgccctgacgtcagcatggccgcggcccctgactacccagctcccttctatccctcgagcggcaggaatccgtccccacgcccttttcctttaaagggcaacgggccgaaggtggggcgggcggcgcggctcccgcgatccattcaggtcaaaagggagagtgatcaaacaggagagccgaggggacctatattcagagacttaaccggacacctggacagaccattacaacttgggacttttcaggagaatgagggaaatgtagttattgcacctgagcctcactccagctctgaggtcctcttcacttctctttggaagaaaattggatatcttttcctagttgaaagagtagagatctgatttctccaaggatcatcgctttttgacacgggattattagaagcattcattcatctatcaaggagttttgggatacttgccataagccaagccctctgataggtgctggaaacatcaagctctgtgcccaggaagttcatccttggactgcacgcatgaacgagtttgctgtcttcccattggattcagccagtccgcggtcctggaagaagaaatactttcccagacaaataaaagctgaggaatatcatcaacatcagacctgtcttacaaaaaatgctaaagggagttcttcaatccaaaagaaaaagatgttaatgagcaaaaataaatcatctgaaggtgcaaaacttgctggtaattgtaagtacaaagaaaacacagaatattataacactgtaacttacatgctgtggtgtgtaaactactcatatgttaagtaaaaagactaaaatataaatcaattaaaataataattgcaacaacttttcaagacatagacagtacaataagatacaaataggaacaacaaaatgttaaaaagcaggttgacacagttaaggtgtaaaggttttattagttttccctttgcttctttgtttatgcaatcagtgtttagttgtcaacagtttaaaataatggttataagatattgtttgcaaatctcatggtgacctcaaatcaaaaacatacaacagatacatgaaaaataaaaaggaagaaattaaaacataccactggagaaaatcacctttactaacagaaagacaggaaggaaggaaagaaggaagagaagaccacaaaacaaccagaaaactcacaataaaatggcaggattaagtctttatttatcaacaataacattgaatgtaagtggattaaactctctgatcaaaagacatagagtggctaaatgtataacaaaacaagactcaataatctgtggcctacaagaaacacacttcacctataaaaacacatatagattaaaaataaagggatagagaaagatattccatggaaacagaaacgaaaaagaagcaggagtatctatacttgtgtcagacaaaatagatttcaagacaaaaactgttaaaaaagataagaaagctcattatataatgataaagtagtcaattcctcaaggaggcataacaattgtaaatatatatgcatccaacactggaacacccagatatataaagcaaatattattaaagaaagagatagacctcagtataataatacctggacatccagtataataatacatccagtatatatatatgcatccaacactggaacaccccagatcatccagatctaaaatcaagaaataaacattggacttaatcagcattatggatgaaatggacctaaaagatatttatagaacatttcatccaacagctgcaacatatacattcctttcctcagcacataaatccttctcaataatagacaatatgtttggctacaaaataagttgcaaagatttaaaaaatgaaattatattagaatcttttcttactacaatggagtaaaactagaaatcaataaccagagaaattttggaaactatacaaacactttaaataatatgctctggaataaccagtgggtcaataaagaaattaagaaggagatttaaacatttcttgagacaaataataatggtaacaaaacatacaaaaatgtatgggatatagtaaaaatagtactaagaggaatgtttatagctataaacatctacatcagaaaagtagaaaaacttcaagtagacaacctaacaatggatcttaaagaaatagaaaaccaagagcaaaccaaacccaaaattaatggaggaaaacaaataataaatatcaaagcagatataaatgaaattgaaacaaaggaaacaacccgaataatcaacaaaatgaaaagttttttacaaagataataaaaatccacaaaactttagtcagactaattaagaaaaaaagagacaagacccaaataaataaaatcagagattttaaaaaaaggagacacattactacggatactgccaaaattcaaagtatcattagaggctactatgagcaactatatgccaataaattggaaaacctagaagaaattgataaattcttagacacatacagcctaccaagattgactcatgaagatatctaaaacctggacagaccaataacaagtaatgagatcaaacccataatataaaatttctcagcaaaggaaaccacaggatccagtggcttccctgctgaatttttaccaaacatttaaagaagaaataataccaatcctactcaaactattctataaaataatggaggagggaatactttcagactcattctatgaggccagtattatcctgataccaaaaccagacaaagacatatcaaaaaaaaaaaaaaaaaaaaaaaagaagaagaagaaagaaaaagaaaacaaagaaaactatgggccagtattattcctaatgaacattgatgcaaaaatccttacaaaatactagcaaaccaaattcaacaacacattaagaagatcattcatcatgaccaaataagtttaatcccagggatgcaaggatgattcaacatttgcaaaacaatcattgtaataaattatatcaacagaatgaaagaaaaaaacatatgattatttcaattgatgctcaaaaagcatttgataaaattcaacatctcttcataataaaacctaaaaaaactgggtacagaaggaacataccttaacacaagaaaatacatatatgacagacccaaagctagtattatactgaataaggaataactgaaagactttcccctaagatctggaataagataaggatgcccattttcactgctgtttctcaacatagcaccagaagtcctagctagggcaatcagagaagagaaaaaaataaggaacatccaaattagaaaggaggacatcaaattatcattgattgcagatgatatgatctaatatttggaaaaacctaaagattccactaaaaacctattagaactgataaacaaactcataaagttgaggacacaaaaccgacatacaaaaatcagtagcattctatatgccagcagcagacaatctgaaaaagaagtcaagaaagtaatcctggccaggtatggtggctcatgcctgtaatctcagcactttggtaggccgaggcaggaggatcacttgatggaggagtttgagatcagcctggccagcatggtaaaaccccatctctattaaaaatataaaagttgtccaggcatggtggcatgggcctataatcccagatacttgggtggctgagatatgagaatcacttgaacccaggaggtggaggttgcagtgagcagagatcatgccactgcactacagcctgggtgacagggtaagaccctatttcaaagaagaggaagaagaaggaggaggaggaggagggggagaaagaagaggaagaagaagaaggaggaggagaaagaagaggaagaagaagaaaagaagaaggaggaggagaagaaagagaggaagaaggagaagaagaagaggaagaagaagaagtagaagaaggaggaggaggaagaagaagaagaagaaggaagaagaaggaataagaggaagaagaaagaagaaggaggaagaagaggtagaagaagaagaggaagaagagagaagaggaagaagaagaaggaggaggaagaggaagaagaaaaagaacaagaacaagtagaagaagaaaaacaggaactagaaagaagaggaagaaggaggagaagaaaaaggagaaaaggaaggaggaggaggaagaggagaaggaggaggagaaggaggaagaggatgacgaggaggacaagaaggaggtaatcccatttacaatagcaaaaaaagtaggaattaaccaaaaacgtgaaagatgaaagaaattgaaagaggacaccaaaaaaaaaaaaaaaaaaaaaaagaaagatagtcaattttcatggtttggaataatgaaaacatcaaaattgctaaaatgcccatactacctaaagtaatctacagattcaatgtaatccccatgaaaatacccaaaatacccatgacattcttcacagaaatagaaaacaatcctaaaatgtatatggaaccatgaaagacccagaatagccaaagctgtcctgagcaaaagaatgaaactggaggaatcacattacctgacttcaaattatactacaaagctatagtaatcaaaacagcagggtactgacataaaaaacagacatatagaccaatggaacagaatagagaatccagacacaaatccatatatctacagtgaatgcatttttggcagcagtgccaagaatataaactgggggaaggacagtctctttaataaatggtgcgaggaaaactggatatccatatgcagaagaatgaaactaggaccctatctctttccatatacagaaatcaaatcaaaatggattaaagacttaaatctaagatctcaaactatgatactactacaataaaacattggggaaactctccacaacactgggcaggggaaagatttcttgagtaatagaccacaagctacaggcagccgaggcaaaagtggacaaatgggatcacgttaagttaaaaagcttcttcacagcaaaggatacaatcaacaaagtgaagagacaacccacagaatgaaagataatatttacaaactctctaactgacaaaggattaataaccagaatatgtttaatacaaggagctcaaacaactctacaggaaaagaaaaatctaataatctgtttcaaaaataggcaaaagatgtaagtagacatttctcagcagaagacatacaaatggcaaataggtacatgaaaaggtgctcaacatcactgagcatcagagatgtgcaaatcaaaactacaataagatataatcttattccagttgaaattccttttatccaaaagccaggcaataataaatgccgacgagaatgtgcagaaaaggacccgtcatatactatcggtgcgaatataaattagttcaattaatagggagaacagtttgaaggttcctcaaaaaaactaaaaatagagctaccatattattcagcaatcccactgctaggtgggattttcttcccaaaataaaggaaattagtatatcaaagagatgccagcacttccacgtttattgcagcgctattccccaataacgaagatttcaaaggaatttaaatgtccatcggcagatgaataaagaaaatgtggcacaggacataaaaagaataagattccatcttttgcaacaacatgaatgaaactggaggtcaatatattaagtgaaataacccaggcacagaaagacaaacttggcatgttctcacttatttctggagctaaaaattaaaacaactggactcatggatacagagtagaatgacggttatcaaaggctgagcagggtagtaggggggaaatggggatggttaatgtgtacaaaaatgtagttaagtagaatgaataagatctactattgaatagcacaagaggatgactactgtcaacaataatttattgtgcatttaaaagtaactaaacaagtataattggattgtctgtaacacaaagtaaggatgaatgcttgaggtgatggatactccatctaccctgatgtgattattacacattgtctgcctataacaaaagatctcatataccccagaaatatatgcacctactacttactatgtacccaagaacattaaaaataaaagtcagtttagtgtaggaatgcccttgatgaaggaataaaagtattaatcttattaaattttgaaccttgcatattgtactatgtgaagaaatacgaaacccacatgacatatttctgttgcaaaccaagtatgatggctgtcttgagggaaagcactttggcaatagttgaggctgtgagcagaactaattgcttttttcactgaacaccattttcacttgaaagaaatgacaagacaaaccatggttatttagacttgggcattggcagacacttccttttaaataaatgaagtgttcttgttacttcaagagacataactaacagcatttgttgccaatgaaaaattcaagcatcaattgaataacagttttagaattttggaaaaatttgtatctgttgatctgagcttggtggcttgccaatgcttacagaatttcttattcttttttattttcatagaaatatgtacattaacatgtaatgagtttattactgttatttgaaaacaaattaataaatatcctttatgtttcccaactttaattttaaatatagaacatattgaaagatgtttacctcccacaagcaaatggtctttggagtcttctttttttaagtatagaaagatatattaaaaccaatagaggttgagaacagcagttaagagttacctttgtcctttgaataaactcttgaagaggcattttgctaaacaccttctttccatcatttctgaacttctccttcagtggtctgtttctttgtgtgtgtgtgtctctctctgtctttctctctgtatgcctctctctgtctctatcatgagcatttaggtaaagaaaatctctttgagcagttaaattaggggcagtgtttctaaaaaataaaacagtttccactgggctaggagattttcctatattatctgctttatagttccccaaataatttccttctttttttagtaacttaattttatattttcagtgactccacatgcaggactgtaaaataggaaaaaaacagtatcttacacctatatgtcattaagaaggcagaaagaataaatgggaaagaaacagtcaatgaaaatagaacctacatacacaaaatgcaaatgcaagtgccaggggtcattttatttttgtaaagcctgggatgtgtccatttcccctgaaatatctattctgtgttatgccggttacagatgttgccacaattaccgctgacagtgtggctttacagagacttaatgacaagatgattacttgggcagaagagtaactggagcccacatacgtgaaaagaatgacacaggcccacacactgagattctcagcaagtcaatagcgatgaccattacactttctaagtgatattatcagtaatgctgtcaaatcagccaagcacagaatatgttataggaagaaagctctgggggctgttttgatagaaagcgaggtttaggccacttagaaactattccacttggaggaggctatcatttcatttttaccatatgtagaattctgctgtgagttttaagccaccaattccctcttctatctgggtatcatttccttttatgtgatatgataggattggactcctcagtagtgttcaaccaatgcagacttaccagtgaaacctcaataaacaaaacagagagaagcagagatgcctggtttaacgaaaagatgaggaaattgtacatctccctttgggtccctactgagtttctcctggtcagcttctgaaatacggccatggaccctgaggctttggggtatgctgtttgagaatgattagattaagtgctgtttaggtccatgtgcttctaggggctttgtcagaaatctgagtaatttcttttaattagagaactagttggtgtcaagttcagaaatatatatatatgtgtgtgtgtgtgtgtgtgtgtgtgtgcgcgcatgtgtattatgtatatatgtgtttgtatctgtgtgtttgtatttgtgtgtgtgtgtgtgtgtgtgtgtgtgtgtgtgtgtgtgtgtatgtgtatcctattggttctgtttctctgaagaaccctggctaatggctaatacaataagcatatactagatgacctgggtgaccttttataattgaatttgaacacacgatgtctggttatagtgacccagtttgcccaggactttcccagttttagcactgcaagtcccacatttcaggaaattcctcaattctggggcaaaccaggagagaggtcaccctgaattagagccacctagcagacactcaggaggtcatatatagacccctagtgatctgcagaccccagttaaagttacacacataagtttatgtaggaaacagagtcctgctctgaaaatcaagacaactagtttcctattcactggcagtgagatcttgggtaaggcatttaaataaagttgattattatttgcaaaagaatgaataagcgactgtgcatatagagttgcccattttgcctatatttatgttccttgctatggagggtaaagccggttcaacagtaggcattggttgtttagttaagcaaaatcagttgctttcagcttccctattgctaattatatgtcagtagaagtttattttaaatatttaagtt

SEQ ID NO: 2932 - DNA, 1564 bp, Homo sapiens
agactttatttttcatctaaatttaatttatgtcttttttttaaggtcttctatgtaactcttcatcatttcatattttcctctagcttctttattttattttattctattttttgagacagagtctcgctctgttgcccaggctgaagtgcagtggtgagattttggctcactgcaaccttcacctcctgagttcaagtgattcctgtgatactcttctatgcaatagaaagagattatattaattcactcattgagctttcacagtaatataaaccatattaggcttgtcattctgtcagtgatgggtgtaagtttgtggcttttattactcataccatcctctgacaaaggcatcctatttctctttccaatttcacaataaggtgcagaagaaggtctttaccatctgttaaagatgttcagggccgggcatggtggctcacaactgtttcaaaaaaaaaaagcaaaaagaaaagaaaaagaaagaaaaaaagagagactttcttttctatctattattactatcttcttctagactgtagttcactaccagagattatccacttagctgcactcagtttgcacctggcctgtatcaccacttagctctcactccagcctcagttaggtatcagcaagacctcaccaaagattattgtttcattgtatatgtgtgtgtgtttttgtttgtttcaggtaacaactgatgttggaactatgaaaagctcttctctacttttaacaaagcttagtcacaaacagttccccagttgacgagaacaactaaaacaacagaacaattgaaagtccaaatttacaaaaaaaaaaaaaaaaaaaaaattagtcaagcatggtggcacgtgcctgtaatcccagctactcaggaggctgaggcaggagaattgcttgaacccagaaggtggagcgtctttgaaattcacagagaatatgaaaagcaggttgtcctgtacagtatctgcaatcagttacgatacagaaataacttaaacatgtcaagaaagatgaatgcagatactgtgaggaagtgctaaagtacagccaagatcatctcatgctgtacccttaccatctatcggatattatggtgaagggcttgagcataacaccattttcatattatactgggattatggagaatattatgaacagtgagaaaagttatgactcattgcccaattttactgctgctgactgtctaaggcttctcggcataggaagaaaccagtatattgatcttatgaatcagtgtagatcatcaaaaaaattcttcagaaggaaaacagcccatgatcttctaccaataaagccagtggaaattgccatagaggcgtagtgggtggtgcaggctggatatatcacataagatgacatcaagatacgcactttgcctgagaaatgtgcctgagaaatcagcttcatcggcaactgatactgatacaaatagtcaagaagatccagctgactcagccagtgtaagcagcctgagtctgtctacaggacacacgaaacgcatcgcattcctgtttgactccagtcttac

SEQ ID NO: 2933 - DNA, 2432 bp, Homo sapiens
gcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccagtccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctataatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaa

SEQ ID NO: 2934 - DNA, 3346 bp, Homo sapiens
attcgtcaagagcccagggaatggagtgcatagaactgaaaacacctggcggggcgcggcggcacacgcctataatcccagcactttggaaggctgaggcgggaagatcgcttgagtccaggagttcgagaccagcctgggcaacatagcaaggccccgtctttacaaaaaatttaaaaattagcagggtctggttacaggagcctgtagttccagctacttgggaggtgggaagatcgcttgagcccggtaggttgaggctgcactgagctatgatcgcgcccctgcactccgacctggtagacagagccagaccctgtctcaacgaaaggaaagaaatgggccgggcgcggtggctcacgcctgtaatcccagcactttggaaggccgacacgggcggatcacgaggttaggagatcgagaccatcctggctaacacggtgaaaccccgtctctactaaaaatacaaaaaattagccgggcgtggtggcgggcgcctgtagtcccagctactcgggagcctgaggcacgagaatggtgtgaacccgggaggcggagcttttagtgagccgagatcgtgccactgcactccagcctgggcgacagagcaagactccgttcccccccccccaaaaaaaacaaaggaaataaatgaaaacattgaggctagactaactgatgaagagtggtaacggcatgaagaagtcgaaaagaaaggcggataggagctgcattcaatatatgagtgcagttgatggatgctgacagggatactctggagacgaagtctcggccccttcgctagtctctagtcctccatttgctcgctgcagttacatcaacagctctctgtatcggggtagagttgcataaaatacaacttaaattacaatgctaaaataaatatgagcccatgagcggtatcataggcctgattttaaaaaacaaaacctaggagaaggtagaaattccaaaggcgagagacgaatctgccaacctaaatcctgggtgacaaggctggtggatcaccgaggcaagaaagaaccagcgtgagctcaagccacacccctaggctcagacccaacgcttgacattcgccgccgcactttcgccacgcttgccgaagcgcacccggctaactagaggaggcggggctgaaaccataaaagggaactggggcggagcgagctgcgtcgtcgccaaggcaactcgagagctaagtccgggcctcggcggagccggcgctgcgaatggactgatggccgctgaggctgctcctggcgcggttcatcatcggccgccgcactttcgcgactgagacgaaacgacactcacctttacttaatggaaggcttcgcttacatcctgaacttaaaggaactacagaaagggacagaaactgctttctttttaaacaatgcgctgaaaggggcgccgccactcggggtccgaccattcgcctccaacgaggggacagcgaatctgctgtcgtgtgcagtccacagcaaccacaggtggggcaacaggaggagcgcttgggcacgaccacgtgacccagcacgagccaccgcccgccccaaaatgaaatcaaatcctaatctcccaatcccggcatgccggtcactccagcctttccaggagacttgcggccgtgcagcccctacacctttatctggactcctgtcgtacttggcccagctccactggattcagcccttggataaccaccctaccagcccctaaagatgactccatccccgtcggtatagttaattaaagaaaaacaggagtcgaattttcctggggtaactggttctttagcaggaggggagcactggggagtatcttcagggtggctggactttgcagcctctttaataacttccccctgtgcaggttgtatcctttatcaccccaccccgatgccccggtcttcaggaaatggcagcaggcccatatttctgtagggttcagagttctgtgaggtagagcattccttccaatgggatcttagaattcctagagttgcagaattttactgactagacccaggaggtctcaggagtccagacttgcttaaagcttggctcaaaattccaagggagctcataactccatggggcccagagttcctggctcgggaacattgggaggcctgggatacagtgccttagcctcaagcagaaaagtgaacacaatatctttatggcttgaaggtatatgaaataatgtcactacatcggagcagcgcctctgcttgcacacctatgggagtctgcagctgtgacacgtagaagttggccacatccaggtcggtggctccaaagtgggcggccacacgcacaccctcgtgcaacgtgaagctcacctgatgacccaccatggccagcaggctgcggaggtaacgctcccgaagggcggctcgtgcccgctgctcctgggattccagggattcttgagctatgggacactcctggatttcaggaacctctggcctcaagggggctctgcgtccatcaggggcaaagccacggctgaagccatcagggccccggggcagccggagcacaggcacgggaatgttcactggagtttgcattgtcttggctgttgagtgaagaaaaagagcaggaagtcattacatggctcttcctgtctctgcacctgaactgtgagccccttgcaagacaggaccctgcagatagaccaaggatgtgaaccagggctactcagtctggacactattgacatttggggctggataattatctgctatgttgtgggggctgtccaacgcataggtgtagggtttgagcagcatcctagcctctgcctcctattaatagatgccagtagcatcccatcttcaagttgtgacagccaaaaatgtcaccactggtgaacagtgaattggtgaatgtgaattgcatctcaatacagtttttttttaaagtctccatgaattgccaaacgtctcctgatggccccaaatgaaacactgatgcagacaaacaggtcacaaagagggaggaaggaataaagatggctatagaagacatgaacataggctgggcacagtggctcccgcctgtaaacccagaactttgggaggccgaggcaggcggatcacctgaggtcaggagtttgagaccaacctggtcaacacggtgaaaccctgtctgtactaagaaatacaaaaattagccgggtgttggccgggcactgtggctcacgcctgtaattccagcactttgagaggccgaggtgggcggatcacctgaggtcaggagttcgagaccagcctgaccaacatggagagaccctgcctctactaaaaatacaaaat

SEQ ID NO: 2935 - DNA, 627 bp, Homo sapiens
attttccaaaataaaagcagaaactatgcagtacaatgaacacggacaggcatttcacaggagaggaatcggacatggccactaaaaatgtaccagtactggacctggtgcaccagtgtacagagaagccgccgtgtggggcgactctccagatagcagcctgtccccctggtgcccggcactgcctcagcaggtggcacctgctggggttctcactctgcaagatgcctgggggacatacttcccaacttctctgtggcagttttcacttaaaaggaaacttgaatatttaatccgaccctaagtcaaatccttctgtgctagcatgagggcatgtgtgtgtgagtgtgtctatatgtgtgtgtctatgtgtgtctgtgtctgtgtgtgtgtgtctgcatgtctaatatgtgtgtgtctgtgtgtctatgtgggtgtctgtatgtctgtgtgtgtgtgtgtgtctatgtgtgtgtctgtgtgtctacatgtgtgtctgtgtctgtgtgtgtgtgtctgtgtgtatgtctgtgtctgtgtgtatgtctgtatgtctgtgtgtgtgtctgtgtgtctacgtgtgtgtctgtgtgtgtgtctgtgtgtctatgtgtgtctgtgtgtgtc

SEQ ID NO: 2936 - DNA, 2757 bp, Homo sapiens
gaaaccaagccgggagaggcctgggggcctcagccctctgcacccatctcagccctatgccgagtgccacctggacctgtccacccagggccaggaagggcacggacccccaacccatcccacgcagggacaaggccccccatcccctgtccacagtcccccacagagccaaggtctcccaaccctgtccacagcccccacacagactcgaggggcccccatctcctgttctgaacccaacagggtggtcccactgtgggaccacaaccaggtatgactgtgtgagaagcaggctcactaccaggctaccagggagcacaggggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataattaataaataaaacatcaaagaccagccgacctaactccatctaaaatacacaacttctacgcaaaatataaataaaattagaaaacaaactacaatctcagaaaagcactagcaacttagacgacatactaaaggccaaaaataccctcctgacacacagctaataaagaaaaagtcaactattccagttaaaaagaagaaaaggaaactggctgtggtggcttatgcctgtaatcccagtgctttgggaaggccaggagtttgagaccaggatggacagcatagcaagaccccatctctacaaggaaaaaaagaatcagccaggcatggtggtgtggagctgtagttccaactactcggggggctgaggaggaaggatcgcttgagccagggaggtcgaggctgcagtgagctatgattgtgccactgcagtccagcctgggcgacagagcaagacccggtctcgaaagaaaagaaagagaaagcaagaaaagaaagatggctgggcacggtggctcactcctgtaatcccagaactttgggaggccaaggtgggtggatcatgagatcaagagatcgagaccatcctggccaacagggtgaaaccccgtctctactaaaaatgcaaaaattagctgggcgtggtggcgggcaccagtccaggctactcgggaggctgaggcaggagaatggtgtgaacccaggaggcggagcttgcagtgagccgagatggcactgctgcactccagcctgggcaacagagtgagactccatctcaaataataataaaaaataaataaataaataaataaataaaagacatcactcacacctgtaatcccagcacttcgggaggccgaggcaagcagatcacctaaggccaagagttcaagaccagcctgaccaacatggtgaaaccccatctctactaaaaatatttttaaaaattagctgggcgtggtggcgcgcgcctgtaatcccagctactcaggaggctgaggcaggagaatcgcttgaacccgggaggtggaggctgcagtgagccgagatcacaccattgtcctccagcctgggtgacagagccagactccgtctcaaacaaaacaaaacaaaagacatcagctagctggtccaagcacagtggtgttcacaacgaattgatcacagccaggtagaattcttcattctttctccagttccactgctttgcttgaccagccttaaagacacacatacacatttttgtctgggcgcgctggctcacacctgtaatcccaacactttgggaggccaaggcaggcggatcacttgaggtcaggagtttgagaccagcctgaccaacgtggagaaaccccgtctctcctaaaaatacaaaattagccaggcatggtggcacacgcctgtaatcccagctactggagaggctgaggcaggagaatcgcttgaacccgggaggcggaggttgccgtgagctgagatcgcgccactgcactccagcctgggcaacaagagcgaaactctgtctcaaaaaaaaaaaaaaaaagtatatatttttaaaagacattggccgggtgcggtggctcacgcctgtaatcccagcactttgggaggccgaggtgggcagatcacgaggtcaggagatcgagaccatcctggccaacacggtaaaaccccgtctctactaaaaatacaaaaattagctgggcacggtggtgcatgcctgtaaacccagctaccaggtactcgggaggctgaggcaggagaatcgcttgaaccagggagtcggaggttgcggcgagctgagatcatgccactgcactgcggcctggagacaagagcaagactccgtctcaaaaaaaaaaaaaaaaaaaaaaaaaaaagacatcaactaattgcagtgtgtggaccttatttggctcttaattcaaactattaaaccaaaaatgtgaacacaccaggccttcggtggcatgaaggaattgtctgttgtgttaggtgggtctgcagtattgcgatgccctccaaaatgcttgcagataaaagggtggctggaatttggttcaaaacatgggtcagg

SEQ ID NO: 2937 - DNA, 2144 bp, Homo sapiens
aggaagagggggtgcagccaggcagcaccttctctccgtggtgccgggttaaagcacgggaggccggcaggtttgatccacccggattattcgtgctttgaggacagctccccacccccaccccaggtgcgcattggattgagctacgagggttcagttgtcatcctcccatctgacggtcctgggacccgagtccaggcctgaagtggtggggtgggggggtgctgtgtttgctccagccgtgtccagaaaatgccctcccaggtatctctccagtgcacccccggcccccatctgaagacagccgctggctacacacacccctgtccctacacttccagtccaggtcctcacactgccccatccctggccagcacctcactgtacctgcctggaccctttcttcctgttccaacccccatccacccccagccatggcagctgcgtgggggtttctgtatcccagttccaggcagggcccccctcttccgcctggcttccactagactcagagctggggtctgtcttcccacatcccacatcccaacatgtgtgcctgggggcaggagggggaggggttcaaaatggctgccaagatggctgtctcgctgtctcgcgctctctctctcgctgtctctctctcgctctctgtctttctctatatctctctctctctcttcccctctctgcttgcccggctcccttatcctggtagggagtcactgcttagaggaggttggacccagtggggcacacctgagggtgaatgtatattcccggccgttgacctccatgctgtttggggacagaccattggtttctgcttctctctccaacaccccaagggctgccatgtgcctaacctgaccccagaccccactccttcaccctggctcacagcctgaaagctccctgccctccacctgctctccagggcctggccccctgaattgatcaaccccgcggagggtccacacccctcattctcttctccggtctgccccacggcccgggggcaggggattgattctgcgtgggcccctgtcaggccccagctttggggggcaggtgacttctccttcctccctgctccccttccattaatgccaaatttattacttaaaagtaggatgaaaacagggagaataagagaaggtttacaatcttcattatcatatcgagaaaattatccgtgattttcctaactagcaatttgcctgccatgccgttcagaactgacttgcccattaattacagagatgaaaaatcatctggaattcggaaaagggaactaattccatggctggcagcgatcgcacccgtgcacggagccacatacatgtgcgacatacgtgtgcgctcacatgtaggtcccggccctcttgctggtcttgccaccatcttcctacccagcttggtgacctccctcatggccttgctcggtccaccccatgtgtgtgtggcacctgccctgggacacccctgcaggccctctttctctccaaggggcgcccatctcaatccccacttctgggaagcttgcgtaccccgtgatcacccacgctgattcctgctcttgggggtgtagctggcgcccagggttggggaggatggagagctggggaccagcacacctgggctgtggagcctgcagggagggggtggaagggggggacttgaagcccagcttctattcccagcctgcccaggggagccctttctcctggggggcctagtaggaccctgtgggcacgttggggaggagcctacaggcgcctcagctgcacgggagtgtgtttgcatccagcagtttgggcccccggccggtggcgtctccacctgcacgtgaggctgtgtgatgcttgcaggcatctcggtggggagggtggcagcgggtgcccctcaagaggaacaggaggagtgggagcactgccatccccgctggagcatcgtctttgccctccaccccctccttcctccctggcgagacatgtggccagggacacacaaggctctgggttctgtgtgggttcctctcacggatctgatttccacatgccagacacttccccttcttccagcccctccgtggggaggcagggagaggggctcccgaggcgggggttccctgggtctgaaaccct

SEQ ID NO: 2938 - DNA, 412 bp, Homo sapiens
cacgtgcctgtagtcccagctacttaggaggctgaggcaggagaatcgcttgaacccaggtggcggaggttgtagtgagctgagatcgcgccactgcactacagcctggtgagagagcgagaatctgtctcaaaaaaaataaaaaagggcagtagataaaaaaagtacaaacatgagtatcttgataaattctattctcaggctttcaggttcataatcctgttgatagatgacatgtagaaatagaagaatttgtaaatataggaatattcattgatgtttttaggactggattctaagggtggtttttacctctaatatccaaatactgctgcctcaagagaacaatttttgttttcaaaattccatgataaaaaagatgcagtaaccctgtatgtggcattttgtcagg

SEQ ID NO: 2939 - DNA, 3153 bp, Homo sapiens
tcacacagcgccccgccccgccccagtacatttcctttcagggaaagggacagggaagaggctgtcgggaaatggcggccgcggccgggctggggcttcagcgggaggcagcagaggggaagtggtcagcgtggcgaatgacggaagaaactcgcattgtctactggatcaaggacagacagctcaccaaccgtgacagcaccatactggaacttcaaaaagttctgaaaacatgttggttcgtttgttggagtatttttcaacttaaattccttttccttttttttttttttgctcactttttcctctgcagaaaaaccttaaaatgttctaccttttccttgaaacctcctcccactccttagttcacattgacttgtctttaaatgtttttgagaaaataatcagaaatgcacaattagtgcttggtggttctcaaattatttcacgcgtggtagttttgatttttgcttttccagtgaggctgtacctttcatccttaggcaaatatgatggctttcaaaagcagctatggggtgggaactgggagtggctgcaaatgggcatggagcgtcttttagagataacgaaaatgtcccaacttagattgtggtgatagttcgcacaactctataaattactaaaaactattgaatttgcacttgaaaagggggagaactttatgaaatataaattataactcaaagaagctcttaaaatgcctatggaataataagtaaagagtagtggggatatgatctattttgtggggagactagcagcaaagtaagacataaagataaagaaacatacactggcctgaggaagtaacaaagtctctttgagcaaactttggacaggctcctctcagctttcttttcaactacaccttgtccttgggccctgtcctcggcctgcctagcccagttttagcaagagtcctgctgagtaactccctcacccttgatacctgatcaccttgtcctgccttgagcgagaatcctgtttagtcagttgagcaagaatccccctacccttgatatctctctccccttaggaattttctttctactgactccctcactctgctgcttgactgtaaatccacacttgtcctagttgtctttggattgagcttagttctatactgaagtctcttttcctctattataatagtactcaaaatatggctttactgcttttgactagtatctggctctgtttcccattggcggaaggcactctcagacagtgcttctagtagtatatattagcatgacctgccagggtacaattctttttaaaaagaccaccaattggctggatgcagtggctcacgcctgtaatcccagcactctgggaggccgaggcgggtggatcaggtcaggagttcgagacgagcctggccaacatggtgaaacccccatctctactagaaatacaaaaattagctgggcatggtggtgtgcgcctgtaatcccagctacttgggaggctgaggcaggagaatcacttgaatgcaggaggcggaggttgcaatgagccaagattgtgccactgcactccagcttgggtgacagagtgggcctccgtctcaaaaaaaaacaaaaacaaaaaaaagaccaccaatttattgccaggcattgtactgggtgctgaggaaatttgaggaaaaacacctattaagttcctgtcctcaaggagctcatagtacagtggggagccaagtagcaagcaaatagccatgcaagtgtataattgcaatgaggacaagtatcatgaaaaggagggtacatggtgcaatgagagcctataaaataggggtattcgactagtcaaggtggtcaggaattgcttcaaagaagcagttattgagctgagagttaaaggaagaatagtggctaattagattggaggtgagagttggaggagctggtttgaggctatgtgttcagagatggcatggtgagtaaaagagactgaatgaaagtggctggagttcaacaggcagttgggacagcagtgtgttgggtcagggcatgcagggccttacaagccatcttaagccattcagtctatatcctaagagccattggaagccctgtgggatggggagaacgaatcagatttgtctttgaaaatattgccctgggggccaggcacagtggctcatgcctgtaatcccagcactttgggaggctgaggcaggtggatcacctgaggtcgggcattcgagaccagcctggccaaccaacatggtgaaaccccgtctctactaaaaatacaaaaagttagccgggcatggtggtgcatgcttgtaatcccagctactcgggagggtgaggcaggagaatcgcttgaacccgggaggcagaggttgtggtgagctgagatcgcgccattgcacaccagcctgggcaacaagagcaaaactctgtctcaaaaaaaaaaaaaaaaaaaaagaaaggaaaagaaaatattgccctggctacagtgtggataaaggattgggaaggagtcagaatgtatggagagttttattagaagccatttcaacaatctagagtagaggtaatagtagcttgtactacaatagccatggtttacatggaggggattggtatattttagggtttcttaggaggtaaaatctgcaggacttggcaatggattggaattgggagggagggagtgtgatattgtgaagtacacatttagtctttagtttgttttgtgctgctataacaatacccgatagtgggtaatttataaacagaaatttattgccttacagttctggaagataggaagtctaaggttaaggtgtgggcaggtttggtgtctggtgaggccattctctttttccaagatggtccctgcacacactgtgtcctccagaggggaggaaggctagatcatgacatggcagaagacagaaagaagggccaagagatagagcaagaggagaccgatcttgcccttttataatggcattaatcccacctgtgagggtagagccctcatggcttaatcacctcttaaaagtctcacctcttaatactattactgcaaccgcccagtgggttcaccttgcctgctgcctagacagagatttatcaagacaggagagttgaaatgaagaaagagtaattc

SEQ ID NO: 2940 - DNA, 6978 bp, Homo sapiens
actgaattaggtggacagccccagggacagcaggatcctgtgccatgagggcagaggacatcttgtttttctttgcctgtcccctcttgccctccctgggagggacaggccatgctgatttccctgtgcctcctgacagaaccctgagcatcagtcctggtgatctcggagctgaacacacagcctcagagcatttgaggaacagaaaaggcaacgtgactaagcttcctggggcggtgaggtcaggcagggaggtgggtgcgaggtcatggggccgcaggcaaacggccctccctcccagtgccccacatgcaggccctctcccagacgagagtcgaggcagcaggggggtggcggcggggagtgggggagagtgcaggccgagaacactgcttgttagggctgggagctaacagcagaggatattattctgacagggccactgtgacaaagtcctgtatgctgggtggcttgtagctctggaggacaggagtccaagatcaaggtgcctcatgttgggtgagttttggtttcttcttcttttttttgacacagagtctctttgtcaccaggctggagtgcagtggtgcgatctaggctcactgcaacccccgcctctcgggttcaagcgattctcctgcttcagcctccccgagtatctgggattacaggcgcccaccaccacgcccggataattttttgtatttttattagagatggggtttcgccattttggccaggctggtctcgaactcctgacctcaggtgatccgcccgcctcagcctcccaaagtgctaggattacaggcacgagcctctgcgcccggccaagggttggttctttctgaggctgcagaaagactctgttctaggcctccccgtagcttctggcaatctccagcattccttggtgtgcagacacatcacccccacctttgccttcatccccacctgctgttttccctgggtgtctgtggctacatttcaaaaattagctgggcatggtggtacatgcctgtagtcctagctactcgggaggctgaggtgggagaactgcttgagcctgggaggtggaggttgcagtgagcggagatcgctccactgcactccagcttgggtgacagagccagaccctgtctcccaaaaaaacaaaaaacaaacaaacaaacaaaaacaagtggtgagccagttttggtccaagggccagccacagtttgctgatcccttccctttggactttggaatgagatcccaaccttggactttggaatgagacaggcctgcatctggattagcggctgtgtggctttgagcaggttactgaatatctctcggcctcaggtttttcacctgtatggcaatgtgataaaacctatgtcatagagttgctgtatcaaacaagacagagtgtgcacaccccagcccacggcagctactggttaaacatcgatgcctatctcctctgctccaatgcaaagcgccttctgcagccagcaccacttgctctcgtctaacatgcaatgctcgattctgatgtagctcagctgtggatttccaacctacagaggcaagcagctacagaccaggtagcaagggaggaggtggatggtcagcactcactcggctcttcctgggagcccaccaccatcccgagcacttcacacatatgatcttagtcaatcccaggcaggttctactactacccccacactgcagatgaaccaactgagtcacagaggggctgagtagctggcccaaggtcctgcagatgctgtgcatcagagccaggatttgaactcagagcccacagtctcaacccctccaatgtactgcctccatcaaggacgacagaaggtccaatgacgatgaagacaagtgacagtcctttttcttttttctttttttgaaacagaggcttgctgtgtcacccaggctggagtgcagtggcactatctcagctcactgcaacctccagctcccgggttaaagcaattctcctgtctcagcctctcaagtagctgggatttcaggtgtgcaccaccaaacctggctaattttttgtattttagtagagacagggtttcaccatgttggcctggctggtctcgaactcctgacctcaagtgatccacctaccttggcctcccaaagtgctgggattacaggcgtgagccaccgtgcccagctgccattttctaaagtacaaagatgactgttcccagggtgaccccgagtcactgagaaatgctaaactgctcctctgagcttgtgtgggaaggcaggtacatgaggctccaggaaagcctgctgtcccagatgtcaagacagaaccatgatggcaccagcacctagatggggcctcaataggtagctgttgaaggtggtggtgcaaagtgtggcacaacgagggacaaactgcagctaccagacaaggtcatgtgcgaggacctcccccaggaatccaggccaaggaaggtggtctcgcatgcagtggtaagcgtgcccagagctgccagggctgagaagccccggagggccgtggcctgcagctggtttttgctgggtgcccctctcctctccatgacccgacacaattcagtggcccctgcagctgagccgcacatctgaccatctgactgccacccaggccaaggaccatccttgtaaactgggggggcatcagtggagtgacagccccagcccaaacagatacttaagaatagggataatcagaagcacagctggctggacggacttttcaagtccaatcagcaccatgtcctgactattggatgtaccccggggttactggcttttctcgcatcaggaaaattagagccgagaaaagcaattctgagggcagcacgccatcaccctcagtgcagctgccctgttcttcatcacgattccctccagcagggctgggccgggtggagctgccaggcggccctcattccttaagtgagtcctagtcctgctcaggctgagccagcagggtggggagagaaaacagagatgcccctgggggctccgtgtctgcctgagaatgcggccagctgcccgcaggggaggggcgcgttctgtgacggaggaagccccgggaggaggaagagatggggctgatggtgcagacagggctggggtaggggcatgagaccaaatgggagcaggaagcaggccctgcctgcagctccttcttcctctcaagggagagcctcactcctgtctttatattcctcctttcttggctcaggacttcctgctcactactggtttccctgcttccaccctgcaccccaggccagcttccaaagccccagtttgatcccatcactccctgtctaaagcccaccatggctccctagtaccctcaggccagagctggcctcacttgcacctggtgctcaagcccaactcctgctattttctcctctcttctgtttccatctaacctgccagcatgtcctgtggcttctgcagcctggcctgagtgtctatcatatgtcctgctagaagagtccaacggcctgggccccgtatccctacacccctgatctattctcaatgcagcagctagaggactgcttcaaaatgaaatccgatcaagtggcttccccgcatccttccacgtggatcacaaaatccaaactccttacccaggaccgcagagccccgcatgaaagtgcccctcccctcatctcctgctccctctccatccttcactttccagctacaatggcttctgggtccccaacatacgcgaagctcattcctgtcctcagccttctccctgcctggcaggttcctcccctgagctccgggggcctccttcccttcagtcttggataaaaggctcctgttccagagtgaactttttttttttaattgagatggagtcttgccctgtcacctaggctggagtgcagtggcacaatctcggctcactgccacctccacctcctgggttcaagcgattctcctgcctcagcctcctgagtagctgggattacaggtgctcgccaccatgctcggctaatttttagtatctttagtagagacggggtttcaccatgttggccaggctggtctcgaactcctgacctcatgatctgcccaccttggcctcccaaagtgctgggattacaagcgtgagccaccgtgcccggcccagagagaacttctttggcaatcgtgtgcaaagcagccctacactctcttctgcgccttcccatttgaatccttcatagtatgtattaccatctcatctttttactgtctattcacctatttattccttgcttctcctctacgctgcctgggctggaggagactgcccagtttgctctgcccaccaggactcgataccctcagtgcccagccctggcctggcatgcatcggaggtcaattgatatttctggaatgactatctgtgttcctgacacctggcagagtgcctgctaccgtgaatttgattaaattggatagagaaaaatagcagtgaccattcactgcttattgggaacctactgattatgtgggtgagggcaggcacagtgattggtgtccaatggcccccatgtcaacctcagggaaggcagccagtcagagctccaacagagtccctccaccccaacaaacaactgaccctttgacttagatttggaattgagcctcactttcttgaagtgacctcaaattaaggtgacaggttattcccttttggttcttttgagcctcatcaaggagggttgggggcgtcatgctagagacccataccagccgtactcagtggcccacacactcctttcacagccctggctcaggctggcaccaagcaggactgcggaactgcttggaaagcaccaaccaagaaaagcagcaggtcagcactttctgggatttgctgccttaatattaaaatattcatatagagaagtaatatcactgtacacaagtttcctctctgcaaacaaggattaacatctgttcccagagcttggccagtgcaaggcacataacggtgaggtggcgttttgcaaaagcgaggctgttaaactgccagagcccagaagacaagcactcaggacgaggaccgccctgagaactgcaggttctcaaagctgctagtgatgtgttttattactgtactacccactgatgttaataatatcatcgaacgcaggtccatatgcaagcttctccaaacatctccttaatggttttcatggctttttcacccctccgatccaggatcccaaatgagattacatgttgcaatccactctcctggctcctgattgtcctttaatctttaatctagaaggttctctttgccttctgtgggtctttctttccttttttttttttttttttttttgagacagagtctggctctgtcgcccaggctggagtgcagtggcgtgatcttggctcactgcagcctccgcctcctgggttcaagtgattttccggcctcagcctcgtgagtagctgggattacaggcatgtgccaccacgcccagctaatttttgtattcttagtagagatgagggtttcactatgttggccaggctggtcttgaactcttgacctcatgatccgcctgcctcagcctcccaaagtgctgggattacaagcatgggccaccgtgcctggcacttctgtgggtctttcatgacatggaagttttggaagagtccaggtcagctgccctgcctcaatccaacgaacccacaggtaatgtgttctcaaagcatcacatcaggaagcccataatgtccgtctgtccattactggtaacgccttctcattctttcattccatctttgtttgtttatttatttatttttgaggcagggtctcactgtgtcacccaggctggagtgcagtggcatgatctcagctcactgcagccttggcctcctgggcttaagccatcctcctgcctcagcccccagagtgtgggaccacaggtgagtgccaccatgcccagctaatttttaaaaatgttttatagagacaaggtctccctatgttgcccaacctggtctcaaactcctcagctcatgtgattctcccaccttggcctcccaccttggcctcccaccttggcctcccaccttggcctcccaccaaagttctgggattataggcgtgagccaccaggcccagtccctctatgtttattaatcagcattcatctcttctcttcctccccgaccccaccattttttttttttttttgagacagagtcttgctctgtcgcccaggctggagtgcagtggcatgatcttggctcactgcaacctctgcctcctgggttcaagcgattcttctgcttcagcctcctgagtagctgggactacaggtgagcaccaccacgcctggctaatttttgtatttgtagtagagacgaggtttcatcatattggccaggctggtcttgaactcctgacctcgtgatctgcccgccttggcctcccaaagtgctgggattacaggccctcctttcccccttgaatcacccatttcttttattattttattggatgttcaattgtcccatctttgccagcaggagtccctttcagccagtgcctgggtcttttggacccatctgtctttgaatgcattcttgctttctggaaggacaaagggctctagttgcattttactttccactgcctcatgcctggcatcctccacttgtccaaggagacctggctccttctgatggagactggcatcaagaaatagagagatgtgggcactagatacatgcattgctacagggggacatggcttcttgctcttctttctatggttatgacttgtcaattgcatatttataccatcaaaagagcataatgatggccccaactccaatccaccgccttcccccattccatatgagaaggcccttttcccacagagagaaccctggtacctaacagtatatatttacttatttgctct

SEQ ID NO: 2941 - DNA, 1798 bp, Homo sapiens
aaaatacaaaaagagttaaccataagctcagggtctgagttgtgcactgcctatgatccactccacagaagttctgatttcttctctgtgcaatggttctgccggcctttctgccgcccagaggtcctggtgagtgggcatcagagactccttagggctctgtggaggctcagggaggagctttcgcttccctcctgatgctggtgcctccagagctagacaggaagatggaagctgggtggcccgagcaggggtgggggcttggctggccctcctgtcagcttgagctggcttgagcccaggcagggccctgacagcctgggcaggctcagagggagggaggtgggaaccaagagacccggggagggctcccggggccaagacccaggtccctgccctgcacatctgccaagggacttcctcagaagctgctgatgttaggctttggcttcctgctgtggactgaggggatgaactccgacgggaggacattcaggccttggaggaaatgagagcttggctgacaggagggcctggactcacgaagacacttggacacccacaagcacagagacatgggtgtgtgacaactgaccaaggggcatgcaggtatgtatgcgtggtgcacacagacaccctgggcacagcccactggcaccagcgtcaacccctgcgtggtgggctgcatcccacccttcaggcaggccctgtggggcaggtttcagggaggaaggaggctgagtgggcagagtctgaggacgcggccaccatcgctccctggcactacatctgtgtccgggatctaggaggcagtcctccatcactgagccccaagatgactgtcacagcttggtctaaagcaggggccgggcctgagccctggcccctgccctggaggagctcacagagcccccagctggggcatatctggtttccgggggcaggggcgatacccagaggaggaagaagggattctgagagagcccaacaggctccgagcctcaggctggagctgagcttggggcagcaaggaaggaccaggtgcgagggcagaaccatgcggcccgacccctgcagcacggcctgtggcctcccccagctcctgcccgtgcttctgggtcagtctggactttgccacttctgaccaaaagccaccgcaaacccactcaagccaaaagaggaagtgaccgttaggcccaactgggaaggctggcggccaggggcactccaggcagggcgaggggggcggccgggggcgctccaggcggggcgagggagacacccagaactccaggcaggagtcctcgggtgccacctttcctctccacctggccctgcgtgggctctgtcctcagggtggcccgccgtagtccccctccccactctgagtttcctgtcccaaagtcctaaggaagtttccagaactacatctcaccatcttgagtcagccttggctcagtgtccatctcacaggcctggaaggggcaggagtcagcactgtccagaccacagggcctgagtgtggggagggcagccgtctaggaaggtggtggagggttgttaccttgaggcaagagggctgcggggcagaaagacacagcaggtgactgttgtgggaggcccaagagaggcctgggagagggatggcccacaagggctgaccctcccgccacccagggggccttggacaggtttcctcctggcagggtggcccttgtgcatggaacccctacaacgactaaggctggcaggcatgaggtttcctgaaggagaaagagcttgtggggcccagtgtggc

SEQ ID NO: 2942 - DNA, 1889 bp, Homo sapiens
tagctgggactacaggcatgcactgcacatggcttgtgttttgattcagaacaggtagaaattcatctatatgaatttctgtatatcaggtagattaatttctgcctgttctgaatcaaaacaaaaacaagccatggatgggaaggggtataggaaagtgggaggcaacgcccaagttcggaaaggcttgtgtggtggggagaagaaaagaaaaacctgggctgggcgctaagccacacacctgtaattccaaaactttgggaggccgaggtggggggattgctggagcccagaagtgtgagaccagcctgggcaacacagcaaaaccccgtctctaccaaaaaaaaaaaaaaagggaaagaaaaaaacccggaaagccaggtttcctgcattctgcctttctaggcagggccagagtaagctgctgctgggtgggctgcgtgaaagctagtgagtatgcaacaagcctggcccttgggaagcagtaaccacaggtcaaagagcaaagcagtgacaacactgcctgccctcaagactgggccagggcctgggattgggccactgggccaacacctcagtaaggagttttttttatttttttttgagatggagtctccctctgtcgcccaggctgacctcaggtgaaccgcccatctcagcctcccaaagtgccgggattacagccgtgagccaccacacctggcttgggggttagatctttaccttgtcctactttaaaaatcaatgaggccaggcatggtggctcacacgtgtaatcccagcactttgggaggccgagatgggaggattgcttgagtccaggagtttgagaccagcctggccaacatgtggagaccctgttgctacaaatttttttttttttttggttgcgggggatggagtctcactctgtcacccaggctggagtgcagtggtgcaatctcggctcactgcaacctccgcctcttggtttcaagcaattgtcctgcctcagcctcccaaataagaggctgaaaccaccccaggcccaaaaaataaattaaaaattaaaaaaattattggccgggtacagtggctcatacctataatcctagcactctgagaggccgaggtgggtgaatcatctgaggtgaggagttcgagaccagcctggccatcatggtgaaaccccgtctctattaaaaatacaaaaattagccagacgtggttgtgtgtggctgtaatcccagctactcgggaggctgaagcaggataatcacttgaacccaggaggaagaggttgcagtgagacaagattgtgccagtgcactccagcctgggtgacagagtgagactcttgcaaacaaataaaaaagtatttaaataattttttctttttttagacacatggtctcactatgttgcctaggctagtctcgaactcctgggttcaagcgatcctccagccttggtctcccaaagtgctaggattacaggtgtgagcctccacacctggtatacaaaaaataagatgtttaaattagccaggtacagtggtgcatacctatggtcccaactattcaggaggatcacttgagcctgagaggttgaggcctgcagtgagtcatgatcacgccactgcactccagcctgggtgacaaagggagatcctgttccaaaaaagaaaggtaggggaaagggttaggcatggtagttcctgcctgtaatcccagcactttgggaggccaaggcaggtggatcacttgaggtcaggagttcgagaacagcctggccaacatggggaaaccccgtctctactgaaaatacaaaaattagctgggtgtggtggcggttgcctgtaatcccagctacttgggaggctgaagcagagaatcacttgaacccaggag

SEQ ID NO: 2943 - DNA, 10096 bp, Homo sapiens
acttgacgctgcagggcgggcggggtaaagaagggagcgagcccttctcaagcttggaaagtttccagactgctgggccagcctcctccccagagggaaactgaggtccgattgaggtttctccaagaccgcccactcctgctcctgtccccaaacccctttctgcctagggttcctggaagccaaggaaacagaacgaactgttccctgggtgggcgagccactgcagagtacaaagctttcaggccgcctgcctcattagcactaatggctgctcccttccgccctgtgtcgtcaggactgtctatgcctggtctcatcagcacaaggctggggtaaggactgcccttttgtggagatggcaggacatacaggaccctgctgcccctgccttccctcaccccactgcagagctgtttatcacacacgtgtccatctgggaaaggaatgcaggctgaatcagctttgagaggatcgcaaggccccagtgcacaaactgggttggcacaaggcagtggaaaaaagatgaagggggccaggtatggtggctcacacctgtaattccagcattttgagaggccaaggtgggaggatcacaaggccaggggtttaagaccagcctgggtatcatggtgagaccccgttgctacaaaaaataaaaaaatagctgggtgtagtggtgcatgcctgtagtagaggctgaggtgggaggatggcttgagcacagggattcaagagtgcagtgagctatgactgcatcaccacactccaggctgagcgacagagcaagatcctgtctcaaaaagaaaagaagataaagggtggccaggcacggtggctcacgcctgtaatcccagcattttgggaggccaaggtgggcggatcactggaggtcaggagttcaaaccagcttggccaatatggtgaaaccctatctctactaaaaatacaaaagttattcaggcatggtggcacatgcctgtaatcccacctacccgggaggctgaggcaggagaatcacttgtaacacgggaggcagagactgcagtgagcagagatcgcaccactgcactccaacctgggtgacagagtgagactccatcttaaaaaaaaaatgctatttaaaatgaaatgaagcaatccatactcccaacatttatatatactgggacatccaagaaattaaaatcacacctcattatgtctttttctttgagtcagggtctcactctgtcacccaggctgggcctggtcagcacccatgctatggagagctcttcatggtctggtgtggacagagtgggagtggaagatctcctcccacacaggtgctcagtgtcttacctcacctacgggcagcagctgtcttcacctgagtgtgtgcacacaggtgtatcagccccatgggcagtgatggacgagggctgaggcactcacagggcagcccatgccccggtcaggtccagtgggggagatatcaagaaaacccagcgccaaaatgcaatgagctgtgatcgcgctactgcactccagcctgggcgacaaagcaagttgccgtctcaaaaaacaaaaacaaaactaaacaaaaaaaaaaaaacggccaggtgtagtgattcacaccttcttgagcccaggagtggcaacatagtgagactctgtctctaccaaaaaaaaaaaatttaattagctgaatgtggtgatgcacacctgtagtcccagctactcaggagacagggaggaggatagcttcggcccaggagattgaggctgcagtgagccatggtggtggtggctcacgcctataatcccagcactttgggaggctgaggcaggcagatcacttgagcctaggaattcgaggccagcctgggcaacatggcgaaacccagtccccattaaaaaaaaaaaaaaaaaaggccaggtgcggtggctcacgcctgtaatcccagcactttgggaggccgaggtgggcagatcacaaggtcaggagatggagactatcctgcctagcacagcaaaaccccatctctactaaaaatacaaaaaaaaaaaaaatttagccgggcgtcatagcgggcacctgtaatcacagctacttgggaggctgaggcaggagaatggtgtgaacccaggaggcagagcttgcggtgagccgagatcgcgccactgcactccagcctgggtgactgagcgagactctctcaaaaaaaaaaaaaaaagtttcacagccggatgcagtggctcacgcctgtaatcccagcattttgggaggccaaggtgggcagatcatgaggtcaggagttcaagaccagcctggccaacatggtgaagccccatctctactaaaaatacaaaaattagctgggcatggtggcacgcacctatgatcctagatacttgggaggctgaggcaggagatttacttgaactgggacccaggaggcggaggttgcagttagctgagatcgtgccactgcactccagcctggtaacactccagcctggtaacagagtgagactccatctcaaaaaaaaaaaagtttcactatgtgggtaattttacggtaaggaaccagcctgatattcccaggacaatgcttgttggcaaaaggaccttcagaaatatgtggcatgttctgggaggaggatttgggaaaccctgggggaggcagagcctcctaagtgagggtgtgggcccggaacacagggactctgtgcagggaggagaaaggggagagtgtgcatgctcgttccagagaccacatgaggacagagaggggtgctcaaaccctctcccttctcttctttttcctcctgcagtgtactccccttcaagggccctgttcccaccttgtccaggggagagggtggggggtgcagggaaaaactgcaagcacccgtggctctgtcaatcagggttgattttgaaacccctacccagcccattgcccctgccccagagagcacagccatgtgtttcctgtgaatcatctgtaggatttcctaaggcagaggttgcctggagaggcacggtctcctcagtcattcagggagaggagaagatggatgggggttctctcgggctggtgtattgagccctgagctagagaggatctgtgattgttaattttgtgtgtcaacttgactgggccaggaatgcccagatatctggttaaatattatttctaggtgtgcctgtgagggtgtttccagaatcatccaatcctttgagggttggaataaaacaaaaagatagagaaagttggtgccgtggctcatgcctgtaatcccaccactttgggaagccgaggtgggagactgtcttgagcccaggagtttgagaccagcctgggtaacatacagagacccaatctctacaaaaaaatttaaaaatagccagacacagtggtgcacatcagtggtcccagtgactccagaggctgaggtggggaggatcgcttgatcccaggaggttaaagctgtagtgagccatgatcacactactgcattccagcttatgcacatgagaccttgtcttaaaaaaataaaaaattttaaaaaagaaagaaaactggaaacaatccaaatatccatcaacagcaaaatggataataacattatagtgatataattgggccaggcacagtggctcacacctgtaatcctggcactttggaaggccgagacgagtggatcacttgagctcaggagttccagaccagcctgagcaacatgacaaaaccctgtctcttcaaaaattacaaaaattagctagacatggtggcgcaagcctgtagtcccagcttctcgagaggctgaggtgggaggatcacttgaatccaggaggcagaggttgcagtgaaccaagattgcaccactgcactccagcatgggtgacagagtgagaccctatctcaaacaaacaaacaaaagtatgtttatataattgacaactatacagcaatgacaagagaataaactactgctacacactgcaacatgaatgaattgcacagacataaggttgaatgaaagaagcatgctgcagaagagtgaggatggaatgaatccagccctatgacattcagacccaagcaaaattataataaatggtgataaaacacaacagcggttaactctgggagggtgggaaattattgactgaggggggaaatgaggaaaacatgtgaggtgttggaaaggttttgtatcttgatctcagtggtggtcacgcaggtatataagtatgtaaaatttcatcaagctgcacatttaagacttgtgtattttgccaagtgcagtggctcacacctgtaatcccagcactttgggaggccaaagtgggcagatcacctgagatcaggagttcgagaccagcctggccaatatggcaaaacctcgtctccactaaaaataaaaaattagccagatgtggtggtgtgtgcctgtagtcccagctactcaggaggttcaggcaggagaatcacttgaacccaggaggcggaggttgcagtcagccaagattgtgccactgcactccagcctgggtgacagagtaagactccatctcaaaatatatatatatattgtattttttattggatattatgtctcaatgaaaacattttttcttttcctttattagtggctcaaaaaataatggagtgtctggctggacgctgtggctcccgcctgtaatcccagcactttgggaggccgaggcgggtggatcacaaggtcaggtcaggagttcgagaccagcctgaccaacatggtgaaactccatctctactaaaaatacaaaaattagccaggcacggtggcacgtgcctgtaattccagctactcaggaggctgaggcaggagaattgcttgaaccctggaggcggagggttgcggtgagccgagattgcatcactgcactccagcctgggtgacagagcgagactccgtctcaaaaaaaaaaaagaaaaagaaagaaagaaacttccctcatctctgtagctatttgtgtaacttcccctatctgtgtaactactgttaactgtgcagctgtgggcatgtctttaggaaagcatatgtagcttctcttgtctctgtagttgcaggtatgttttaggtaagtctccccatccccctccctgtgcaagttcccacagagctcaccatttgcatgcctgaaaaggggaggaaacattttcctgggagcctgctgattatgcaaagaacaaaggcctctatcctgggccttgctcccttatctgtgcagctgcagcttgatttttccccaggctgctctatctgtgcctgtagctttgatttttcaaaagaattttaccaaggactagccatagctgtctgcccaactgctttattccttttctcctccctcagcatcctataggagaaagtcacctttgtctccaaattccctggtcctggttttgaaaatcctgctggcacctactgctgaaggctgtggctggagaattcagtgagctactctgatctggacagggtctgatggtcctcacttgacctaagctgagctctcccaggctgtgagcatccccaaggtcagcctgtgactctcacagaagttctgacctccagagccttccccctgctgtggcctttggggtagagtaggttacatgggccagcaccatctgccaaagtcagggccagaaacctatccatgggagccagatttggcttttggcttgggctagtattgactttgggcacattctcatcccagaaagaataatttggggtatgggatttcatgttttctttagtacagccttgaaagccacgtgtacagggtgttttcttgctaagatagcagtcgggctatatttgagcagtccagagaagtttaaactacagaggcatctggatattgtcacagtcttgtctgaggtcaatagcttgcaagcggtagagctgagagtcatactggggagtctgaccctgtaatgaccccctggtcactatgctcagaaataatgacacctggagttgtatttttcagcacagattgactttgaataataaatacgtaagaatatttcttcaattacacacacacacacacacacacacacacacacacacacacacacacatacatacacaattatgccatttctcatcttccctgaagcacatggccctttggcctctcttttattttcatacttttttttttttttgagatgaagtctggctctgtcgcccaggtggagtgcagtggcacagtctcagctcactgcaacccctcctgggttcaagcagttctcctgcctcagcctcccaggtagctgggattacaggcgtgtgtcaccacacccagctaatttttgtatttttagtgtagacggggtttcaccacgttggccaggctggtcttgaacttcaggtgacttcaggtgatccacctgcctcggcctctcaaagtggtaggattacagccatgagctaccatgcccggcctgtcatactttttttcggaaacaaaagattagttctgtatttcaacattaacaatgaccacactctgactcaatattggggaagttttgaaaccaacccaatagtcccatagacagcttttttggataaacatagaaatcaacccttctgatcctaaagcttgaaacttacatttgttttatctgagttcccctctcaggaaaggatccccagtcctctcaaaaagtatcaaagaactgaaacccaccagatcatcccatccagacaatgagactcaagggccctcattcatcatgatttgcttccttaccccttgcatttgttttcccacacacaattacatttcttccctgctatataaactcctaattttagtccatcagggagatggatttgagaccgatctcccgtcttctcacctgcatcacccgattaaagccttcttccttggcaataattgtctcagtgattggctttctgtgtggtgagcagcatgacctagaccaaacctgtggtattttaataacagtttgaagagtgtgagtttggcctgaagggagaagccattgatggcaggcagagatgtaggcccaggtttgccagagcttcagacttttttttttttttaagatggaatctcgctctgttgcccaggctggagcacaatggcgtgatcttggctcactgcaacctccacctcctgggttcaggcaattctcctgcctcagtctcccgagtagctgggattacaggcatgtgccaccacacccagctaagagcttcaggtttttaaagaaaagagagaaaacagaagtttttttttttttttttgagacggagtctcactctgtcgcccaggctggagtgcagtggtgcgatctcggctcactgcaagctctgtctcccaggttcacgccattctcctgcctcagcctcccgagtagctgttctacaggcgcccaccaccacacccggctaattttttgaatttttagtagagacagggtttcaccgtgttagccaggatggtctcaatctcctgacctcatgatctgcctgccttgacctcccaaagtgctggggttacaggcgtgagccaagaaaacagaacttttaaatgatgtttacatgtctagcttcaaaaaatgccatgcaggttgtcggtttcccacttccagggtaactggatggaatttctgccttcatggtggttcaagcctgaagtgccttgagaccagaagtaaagagttccttcctcctgcagcactgctaggtttcctggaggagacggtctgtaggtggggttcctaaaggtggagagaagaggaagttacttcctaaagagaaggaagatagggggtaacttcagtgtggcttttgcagagttgttcatgacaggaatcctatcaggccctgaagtttccatcagcacagcccccaaccctcactgtcccacacccttagcttcctggttctagtctcaagggattctgctcacttctgtcctcgctttttttctccctgggaaccaagtaacagctgaagaagtcccaggagtcctcccatgtcctctcagcaacccaggctggagcctactccttggtgttggcaaaggaaaccgtctttgaagggcaactgtttgaaaatgctgcagaaacatgagaaatgttcatgaagtgaccctgtggaggcttccggtcacaggatcatgtgagcgccacgatcaccccaggggtggagcagatgctaagtgttcaccacacccaattctcttcctggacacacaggaagatgacatttccagtgacatgccccacctctaggccctagtcttttttttatttaaaggtctgagtcttgttctgtcacccaggctggagtgcagtgctgtgatcatgactcactgcagcctcaacctcctgtgctcaaacaatcctcccacctcagcctccctaatagctgatgtcatataggcatgagccagtgtgcctggctcaggccctacccttaaaagcatcccacctgattcaccagcccccttctctctctcagtaaacttggaaaccacgcattccagatggtataatttacagcatgatggaaaaagccagctctccatgggaagctggccagtcttcattggagtacatttttattgcatgaagccaatgagacttgatattgtttaactctgtggtttccaaagtgcggtccttttgaagtatccataaagtctacactaggttcacggtaatattaagatgttatttgtcagctgggcacggtggctcacgcctataatctcagcactttgggaggccaaggcaaatggataatgaggtcaggagtttcagaccagcctggccaacatggtgaaacccagtctctactaaaaatacaaaaattacctgggtgtggtgatgcatgcctgtaatcccagctactcaggaggaggctgaggcaggagaattgcttgaatccgggaggcagagattgcagtgagctgaaatctcaccactgcactccagcctgggtgatggagcaagacactgtctcaaaaaaaaaaaaaaagatattatttgtctttcatgagtgtacagtgggattttccagaggctacatgacatgtgtttttttattttgttttttatactgacagaggggtcttgctatgttgcccagactggtcttccaactcctggcctcaagtgatcctcccgccttcacctcccaaagtgctgggattataggtgtgagccactgcgcctggctgtttgtgacatgtgatgttgaaacaggttgagtatagaagcagatatgggaattaaaccagaatattaaaccagacattgaagagatttgcaaaaaatacaaaacaataccactgttttcactttctttttggtttggaaaaatgtagttatttttcattaaaagtatgttgtgttggctgggcacagtggctcatgcctgtaatctcaacgctgggagactgaggtgggaggatcacttgagatcaggagttcgagaccagcctgaccaacataatgaaaccccatctctactaacaatataaaaattagctgggctggctgagcgcggtggctcacgcctgtaatcccagcactttgggaggccaaggcgggcggatcatgaggtcaggagatcgagaccatcctggctaacatggtgaaaccccatctctactaaaaatacaaaaaattagctgggcgaggtggcgggcgcctgtagtcccagctgctcaggaggctgaggcaggagaatggcgtgaacccagcgggcagagcctgcagtgagcagagatcgcgccactgcactccagcctgggcgacagcaagactccgtctcaaaaaaaaaaaaaaaaaataactgggcttggtggcatgcgcctataatcccagctacttgagaggctgaagcagaagaattgcttgcacctgggaggggcaggttgcagtgagccaagatcgcaccactgcactccagcctgggcaacagagcaagacaccttcaccttctcaaaaaaaaaaaaagttgtgttaacatgtaatggtttcatgatatcattttaaataaa

SEQ ID NO: 2944 - DNA, 10113 bp, Homo sapiens
actgaagctcgcgagaggatcctgggggcaggcgcgtcgcggtggcagtgtttcttgggtgtgcggggccgggcgccccgtagcctctggtgagcgaaagagaccggggccgagcgggcgcaggcttgccggggctgcgggctgcgctggcggcggggccgggtggcggtagtggcgggagtgactggcgggaatccccgcggccccggcgcttgggcttactgtgcacttgatgtaaggggaaagtcgctcgtcaactgcttgaagggcagttttgcggtcatatttatacccatttttaatcgcatgcagattaaggggcggcttatgcagaactttctagggaaggagtagtacttttgggtcattgggtcactgccatggaaaggtgcagtaactccggggtgttgccatggcaatggtaaattgacgtgggcacactggtgggtgtgtctgaagggcttgttgttagggtgaactggggactagaaatgggatgcgggcgggaggaaagtagtgtaggtgcaggtggcagtcataagtgtcccataagtctgaatgtctgaatgtctgaactgtgtagatttaaggagcattaaagaggcaaaataatagcaagtgcttgtgtaatgcttagcgtgggccaggcactgttctaaatgcttgtttcatttaatcctgacagcaaccttatgaggtaggtactattattcctattaagaaaaaatgagaggggttaatctgcctaagcgcaaacagcccctaagtggcagagccagcatggaaattcaggccctgaggcttttttcaggctgtgttaccagctcttcctctcaaagacgactttgaagagtaagggagagagagaaggcaaggagcattcaaaaattgggaagacagtttgaatattcatcagagagatccttccagggagatactgaggacgaggactagaaatataaggccagcagaaatcaaggatgtaaaaatctccctagagaagaaaagccagaaaggtaaagaatttgataacttctttaatctaagctcaaaaagtatttcacattcgagaattcacagggagaagaacaaggggccagtttcagaagtcaaaatacaagtcacaacttacgaaaggcttcagagtgtagcccctctggcagccaggtttagagaagccctagcggggaagggaagtgcaaagaggcatcagggaagccaggcaggacccagagcaaggagaaggaagagagtttccacaggtgttgccttcagagacaggagtgcccttgacaaggaaagagggcaacaaaactacccaggagagaaaccctttatctgtaaggagtgtggaaaagcctttggtcagagtgcaagccttatcgtgcaccaaagaattcacacaggggagaaacctttcctatgtaatgaatgcggaaaaggtttcagacagagatcacacctcatacgacatcagaggatccatactggtgagaaaccctatgaatgccaggaatgtgggaataccttcagccagagctcaaatctcatagttcatcagggcatccacactggagagaaatcttttgaatgtggtaagtgtgggaaagccttcagccggagttcaggcctcactgtccctcagaggatccacacgggggagaagccatttgagtgtaatgaatgcggcaaagctttcagttgtagttcataccttattgtgcatcagagaattcacacaggggagaaaccctatcagtgtaatgagtgtgaaagagcctttggccagagctcccatcttattctccatcagacaactcatgcccagaagaaacctcagctggctacttgggttagggcccactgttaatggggcagagttgaatggtcatgttatatgcttgccttcagccaggccagcatctcataaatactaggaagtatgtgagaggtcatggactgttcattgctggaaatctgggtccacaaactcactctgcttgtatggtgttttattcacttgccttgtttttgtacatgtgcctccagtcagatttggagttccaagaggtagatgccaggtcctgtcttccactttgattgacaggaaactgaggagctcttcatttctacaaagttgattaaattttaattcattgagaacttcctcttatcaagaaactcttaatctgataatcttgcaagatctcacctgctttgaagatttgtaatttttccaatgtaactccagcacattaaagcttacttacttttcattgttatttcaaagctttaatgtgctagagttgggaagcttagaaggcccactgtgagcagtactaaaatttagaatgtcacatcctcattcaaatgtaggctgcctttaggagtgaccaaaacagcgaaggatacataggatgatagaatcatgaatcaaaggaaccctaccagaccagaactgcagaccaaagttaacaagatgaagtattaaaccctgtccatagggctaaggagtctgagcctctcagaacagaagtgttctgtcagaaacactgcaatccttgaccattagacatgctagaggggtgtctttaaaaatatccttctctctcatcttcagttgctagctgctcagggatgagatcctagtcttaaggcctgttctcttctctctagaccatagagcttgacttttccttacaaggaaataaaacagatcatgtgtgtgtataaaattaaaaagtaatatcctaatcatctgccacttacacaaaaagaaatttattacctttagactaaaggaaaaatataataggaatgcaatatgtctcggtatgtgcagtcatgtgccacataattatgttttggtcaacaacagaccacatatttgatggtagtctcataaggtaatggagctgagaaattcctatggcctagtgactctgcagctgtcataatgtggtagcacaatgcattactcacatgtttgtggtgatgctggtgtaaagctgaccatgttgccagttatataaaaggatagcacatgcagttatgtacagtgcataatacttgataaataaatgactgtgttactggtttatgtattttactgtgcttttcattgttatttcaaagtgtgctccttccacttattttttcaaagtttactgtaaaacagtatgctgtgtttgaccagcagcagcctcatctatctcatgtttaccacatctcttgactgcatcatttcctcttgtgcttgatttaatctcatgttttgttcatcatgtctcctaagcattcaaaatccatggctaattttgccagtaagaggccatgctgagtaattgacctggaaacaaaattaaaagtgattaaggactgtgaaggtggaaaatcagggatggttattgctcaccagtcaggcatgtcccgttttaccatagctgccatcctaaagaacaagagcaaagtgatagaagctgttaaaggatctgcttcattgaaggcaatgagactaacaaaaatttgagaagggccaatatcagatatggataatatctgatattgacctagattgaagaccagacacacaagcatgtccctcagcaccatgacaatcacagctaaagcaaaaagcttgtttgttacgtagatagaaaaggctggacctgactatattgttgaatttattgctagctctgggtggtttaaatgattcgagaattgttactcattacacaattgtgaaagtgagtgctaagtctacaagtgctgatgtgaaggcagctgaataatttttggaaactctagataagctgattgtgggggaaaattacttgccagagcaaatctttaatatggatcaaggctccctattctggaaaaagatgccggaagggactgtcatccataaagaggccaagtcagtggcaggtttcacggctttgaaggactggctaacaatgtttgggggcgatgttgctggccacaaattaaaaccctttgtgatttgacacagtgagaaccccagggccttcaagcatatcagtaagcacacactgccggtgtactacatgagcaataacaagtcatggatgacccagcttctcttccaatatgccctcctgaattgctatgccagtgaaatggagaagtactgtttggagaataacatacctttcaagattttgcttgttgttgataatgctcctgtacatccttttattggtgatctttgttttaatatcaaactggtgtttctccctctaaacatcaactctttgatccaaccagtggatcaaggagttagagcagtttttaaggctcactacctaaagcggacgttgccccaggctattgctgctattatctgagggagacactgagaagacactaatgcaattctgggaggattacagcatctaagactgcatcaagaaccttgcttaggcttagggtgatgtcaccaatgagtgtatgaatggcatctggaaggagacactcgaggtttgttcatgacttcagaggatttgccatggatgaccaggttgcaaaaatccacaaggctgtggttgagatggcaaacagctttaacctgggtgtgaatgaggatgacattgaggagctcctagcggtggttcctgaggaattgactaatgagttgttggaaatagaacagggacacagctgaagaagaggcaagagaaaacaaaactgcagaaaaccaccatcaagaaaatttgcagtagggagtttagcagaagcttttgcagacctcaagaaactccttaaaaagtttgggccgggcgcggtggctcactcctgtaatcccagcactttgggaggccatggtgggaagatcacgagatcaggagttcaagaccagccagaccgacatggtgaaactccatctctactaaaaatacaaaaaaaaaaaaaaaaaagcctgggtgtggtggcacgcacctgtaatcccagctactagggaggctgaggcaggagaatcacttgaacctgggaggcagaggttgcagtgagccgagatcgtgccactgcactccagcctgggtgacagagcaagactcatctcaaaaaaaaaaaaaaaaaaaaaattgaaaacatggaccccaacaccaaaaggttttcattaatagagaggaatgttcatggtgcattatttgtttactggcaaatctatgatgaaaaaaggaaataccaagcaaaccaccatggacatatttctgaaaagagggacacctccttaagaagagtcccaggcaggtccttcatgggtatttcagaagagggcattgctatcataggagatgacagctctgtgcatgttactgcccgggaagaccttccagtgggacaagatgtgaaggtggaagatgatgatattgatgattctgacctgtgtatgcctaggctaatgtacttgtgtcttagtttttaacaaaaagttgaagtaaataatttaaaagaaaaatgcttataaaaataaaatatttttgtatagcattacagtgtgtgttttaatctaagtgttattacaaaagtcagaaaattttaaaagtttagtaaaaagttaacattaggttaacttattgaagaaagaaatttttaagtaaatttagtttactctaagtgtacagtatttgtaaagtctacagaagtgtacagtagtatcctaggccttcacattcactcgccactcactcactgactcatccagaacaacttccagtcctgcaaactccattcatggtaaatgccctatataagcatactattttttatctttcataccatatttttactgtaccttttctaagttatttttagatatacagataccattttgctacagttgcctacagtattcagtacaataatacactgtacaagtttgtagtctaagagcagtgggctgtaccacatagttagggtgtagtagggtgtatatcatatagcctaggactataccacagagcctaggatgtacttagacttgccatctaggtttgtttgagtacactctatgatattcacgcaacaatgaaatcacctaacaatgcccttttcagaactctccattgttaagcagcacaggactgtattgtaatgctggttgctgcccactgctatgagtttagccctccaattaagtcaggaactggccctctcttgggtgtggatttatagtccccaacactagagggtcaattttagagatttttaacaaactggaaggttgactttcaaaatgtctccagttccttctaggtcaattccagcatgagatatactttatctttcaatcactagtaggcaaaaaaggggtgctaggaatcagtcactggcttgacttctggcaacaaggaaagcctgaggtgaattacagttgcaacatctgtcagctcaaactgcatggcgtccgtcacaaggagttgaaatttcaaagtgtaataatttttttaagtataagaataaaaaatgtccatccaaagtataagaaaatccttcttaccaaatcccccttcttttggcaaacaccagggcccttttccttgttaaaacagcctattttaacaaaggcaaggtgtagggtgtgcacagaagcccagacattcatgaaagcaactgctaatcttgtgtgtttacacaataagcatctgaaatgagctgtgtgactccttggttttggtttgcatgagacttagcatctgtgtgaaactgctagttgtcttgggcagacacctggcgaaggattgcaggcctgaaaatgaagggaagttaattttttactagaacaaaagttctagtaaaaagggttttgctttggacataagggcaaagcagaactaagtggtgaaaggaccaaaacacctctgcctgaatggagacggtggccagggaagtgaccactgcagctgtgcatggctcggtgtgggctacaggcggagtatcagggagacagtaaattgaatggagcgatgtccacccctggtgtgggctgtggtgtccagactcagcagccactcaatgcccacagcccagtcccttctccacttactgcatacctatgggcaaacttcttaaactctctgtgcctcactgtccctgtctataaaatggtgatattaactatctaagggatgcagtgaggattgagtaaaacacattaagaagagcactgcacagagtaagtgcttagtaactactgtataaaataaaacaattattattaacttgctttcctgctctgagacatggcctaacagtaacttatctctagggcaggtcagcaggggataacctgtacagccagagaaactgaaactaccaggtttctctgggggtgggtgttgggggagtccagggactggatgaagttaatgtctgctggaaggtgggaagggccaagggtttactctgccactcattttagaagagctgcgccattcagggaagtggcagaggtagaaattagagagtagagagatccatgtactaccagaggccaagcagctctgggtagagactggtctctgccccacagagttattctttgattctccactccttggcctgcatactggttattcttgtctgcaccccagatccatcatctacctcattgccctggggcagagatccctgtgggtggcatcaccctgggtcccttacttctggcttcctagtgggatgcactggtatgtcagagggaggcatgagaatgggacggggtacttctgtctgctaccatggttctggcagtggctgtgtccctctgtaaccacagctgcatggctccagctacaccatttccttccgtgccctttcaagctaggagtggcagaggctctagttcttgctggtatctggtgtctccccatcccctccccaaacctctgtaaatcaccctttcattaaactctctccttcctgccaggtcccagcagactaataattgctggcaactaggggatctggagagctgcactgtatattttatttactagaccaggctgcatgacattttaagctaagcactgcttagtgatgggggaagcacaaacctgttctttattaacaaaacatccacactgcaaaaggagccagtgctaggaaggttttcagactagctgtaccttacatctcacacagcatgaacattagcaagcacccagagtgtcactggcatgccttccatctatcaagccaagacagtacactgttcccaacatgcttcatgctttccagacaagtccttctcctagacacaactcctctcccatcaggttttgggactcctactcacccttcgaggttggcttgaatgccacttttttcatgatccaccccaaatcaaagcagcatccaccctcgtctgaacttccctgcaattatcctcagctgtcctcccgctcagcatgttctgccttgtggtggtcttacttcccctgctggattgtgttaagagaaggaccaggtctcattccctgtgggccccttagttcacctagcaaggtgccttttacataaaaggtgctcagtaaattgctgaatgaatggacaatgactaaagagcgtctttgacctacttcagctgagcaaggtcacctgtggtaggtaccaaagtctgagaagaaccaactggatttccccacctgcctcccacgtggtctcccttgtctccttttcctcctctttgtccgtctaccctgagttcccatcagcttcattctcccaacacttccctcctccgtctattagtcctcattctgacaatggcttcaaagctctgaaatcacaagtggcagagagaagagagctcaaagcccctcatgtccaactcctgtcctgcacaggtgtggaaaatgatgctcagtggcttgcccagggttaacctggtacacgaagcccagtaccgtgggcagggcttggccttggttggtaccacccacacaccggggcttttgtcctgaaacttctcacctccccatgtgcctgtcaagcctgccactcctagtgactgtacagccagtctctcccctcactggggcccacctggaggcattccttgtttgcttagtcccctccctgggctgtccctcatccacctactgccaacccattctcccagagctggcccactaaagcttcacccatttcccctccctgctgatcttgctatctctgcacacaattcagcactttaatctcagcttgtcacctactgtcctttactcatttgtgtgtttactgtgtatgtatcttgtctctccaaagacaccaggaggcccttacaggagcctaccttagcctgagagctaggttggtgacaagggctcagcttgctctcatgtggattcagtgctggacctgaagccctgacccatcagcactgggctctgaccggggaagttggctggtatttcttccaggcatgctcccaggtaccaggcactaggcaaccatgaggggcccttcaggacatgctctgcctctgactggttgggtcatctcagatgatttgcaaaactctgagttgatttcctcaccctggaaaggtgggagccctggccgaaggcctttccatactgggtgcagcaatagggcttctcccccgtgttgctctaccagtgaaccaggaagcacgagctgcagctgaaggtcttgccaccctatgggcacatgtgtggcttccaccctgtgtgcacgactaggcttggtccctgactgaaggccttgccacatgtgccacagacaaagggcttcttccccatgtgtaccctctggggctaggtcaggtgggagctctgcatgaaggccttgccacactacccacacccacacggcttctcccaggtgtggattatctgatgcacgatgaaagtggagctctggctgaaggccttgccatacacagtatatgcttaagagattcctgctaggggcagccaggctggagttgtggcagacctctttcctgagttccttatagttccggcccctctctcctgggagacctcttttcttttgttggggcctgcctggtgtctggcttgtctctcctcacttgcttgtctgcaggctgttccgaatgcc

SEQ ID NO: 2945 - DNA, 1979 bp, Homo sapiens
tcaaaatctgagagctcagggaggccgtggaaatttggggaagaagaaacagactccctgagcagagctcagggcagcagctccaggcatgcctgctgagcccatcaggccaccgccacctgcaggaagagcctctggcctgaactgctggggatgggctgcagaaagcctgagacatttgggccagcaccttcccaggggcacaggcccccaaggcggggacaccacctctgctctgccaggcctgcctccagggctctgaggagaagctgacttcacggccgcggtgccagtgagggctgcatagccaggccttgtctgtagtctgggcggcccgtggcgctgcccttcagcccaactactcattgccgctgcgtctttggcgaggctttcatttccaacctttcttcccatctcagcccttttgttggcccgggtcccaggaggctggtgtcggtgagggcaggcccgctcctctcatcggggtggctgtggcctgtcccccagtccctcaatggccactttctataaacaaggcagcactaatttttgctataagataaaagaggccaggcacgttggctcacacctgtcatcccagcactttgggaggctgaggcgggtggatcacctgagattgggagttcgagaccagcctggccaacatggtgaaaaccccgtctctactaaaaatacaaaaattagctgggcgtggtggcaggtgcctgtaaccctagctactcaggaggctgaggcacgagaaatgcttgaagccagaaggcagagattgcagtgagccaagatcacaacaccgcgctccagtctgcgcgacagagcgagactctgtctcaaaaaaaaaaaaaaaaaagtgcaggtgcacgctggtggggacattaggagcctgtcaagagtgggtctgcctgctggcacttactagacgggaaataccccctaaagagggcttaaaaagcatcttctccctagcacggggcatgctggcacagggtgctgtgtgacagaggcttggccgctgggccccgctgctgagaaggctgctctgcccatgcctggccctgtgggcagtgccagccatggatccctgagaccctgggctggaacctggggccccgtcccagccctacctgcagctcactaaccctctctgggttctgctcagtgtctgaagtgatggaaagaccccagggttggtggctgtagcggcccccaggggtggcagaaccctttgggaggccaagtgttctttcccaaagctgcgcgggtgccatcgcctgccaggccctggctgtggtgacagacgtgggctggggtgaggctgcatctgcttcctctaacagccgtggctgcctgcgggctctggcctccgctctggcagattctgcacattccctgcaggcgcaggggtgggtgggggtgcctgtggcctcggaggtacagccagctgtcctcagctcagatggcccccaagagcccccagctcctgttcactgctcttccagttagtgacccccgtgtcagcatcattgtcagagttcctgggcttgtgggggctggagaagggaaggcgctgaggagggaaagatgagtgcaggttttgttgaaaccacccgacccgcgttttcagggggacgaggccactgccttggcccaaggacctgcaggcttgggggaccccctcgatgtccactgggctgcggatgaaacatcacactgtggtaggaaaggaaggggagcacccccagacgggggggtcctgcagagaccccaaccccttacctacctagttgagacacccatggggagcagccccaacagcatgtcggagtccctaggcttgtggggtcatgctctgttgagggcccttcctctaactggcgagcttgtttacagctgagctcgcctggtcagatgggcccagtggctttatctaataaaggctggacatgtccacttcatgagca

SEQ ID NO: 2946 - DNA, 547 bp, Homo sapiens
tggcatttcgtttggtgctcgagctcgtccaggatgtctgggatgtgtggttatatctgatttctgagctctgggcgtggaggtctgtctgcagaggcccgggcctgggcacaaagggagaggggcctccattgtcccgcaggggccaaaatgcagaccgtgcatccccggtgacctcggggaccgttctctgatcatcaggattttcttggactctggggtccttgtcctgctcaggcatccctgccccgctctccttgagggccctcaacactatcttccctggacacaagtctggggacagccgggtgttgtggaccccaaaggggtgactacctgctcctgggccccacagagtccttgtgctcagtgtagtggctgagctgggggatgccctggaactcggagcacacagcactggcttactgtggtacctgtgcagtgaaattgaagacagaatcaccaggatggaacacaggtcttgcaggatcacggaaaaccttcttagagttgtcttgacaccactgatgtcgagtgtgcgggtgtt

SEQ ID NO: 2947 - DNA, 2366 bp, Homo sapiens
ctgtatctcggctagagccttgggcagtgtgagctggcagggcagatcgctgaaggcggctagagatagaaaaccacccagctctgcatcctgagacaaagaagcctttccctgggctcatatgatagaggtacgttgcctctgggcctcagttttgccatctgtaaaatagggtgaaggtcagactagattgggcatattcagtgtgggatccccctaatgacggcatcagcatcacctgggaaactgcaaattctcctttatgacagtggctctcaaactttaatgtgcattgaaaccatctggaggagaggagcgtttcccacttgagaaccacacagcgggatcagggaggggcgaactatagtccaccggccaaatctggccatggcctgctttttatggcccatgagctaagaatagttttttccatttttcagtagttggggaaaaaaatcaaagaatattttgtgacatatacaaattatatgaaattcaaatctcagtgtccataaataaggtttcgttggcacacagtcactctcagtcatttgcatatcgtctacggctgctttttccgctatgaagacagagtggaggcgcttgctctcctggttacatgctgctgctcacgccctacacctcgcagggatgtggttaaactcggctttgcctcttggcctgcagagcctaaaatatttactatctggcccttcataccagacatttgccgaccctcatctacagagagaagggaaaggaagagaacgggaggggaggggaggggaaaggagggggaaggggagagaaggggtttgtgcaagagctggggtcccttctggggaaaaaatgagctgtcaggggcttttggaatctgagagagtcctgctctgcgctgggccaacatttggaatcttttgcacagttgctttgagggtgatctggaaggcccctctgaccaataaagaccttccctcttgcctgtatgaaaacctaacattccacttctagagcaggggctcttacctgggaagccccccatccagaggccaggcttcgggggttctaggtaagcttttaagcatgcaggtgttttctggggagagtttggtggcgccagtgaccttccctacccctcccaaatcccaagcaccctttttgttcctttggggcacacatttttctctccccacccctcctttcaaaatgtgaaagtccccggaagggggacactgtgcacctacatcttcctacctaggaaaggggtgaggtgatctgatgggactaggcaggctttaggaacgtccaaggagtctgaggagaggtggagggcggcgggggcaggggggcatttagagagaggaaatgggaaagagggcatctttcccagagggctgcaggacctccgagcccacactatctgtactcatccacttctccgcatcagcaagaggcatccaagactcgcagcccacacggctaccctcccaccctcactggtgggcacttccactccccaggccccacgaggcctcccgcctgcagcgttagccaagcaagtctcaactctggccctgggattccaggtattttcccagccagccgcacctcatctaattgctttccagtcagctaatccctggcccacgccctccactccagccaggcaagccacctctgtgtggccagcaggagcttctgagacttcccatggcatgcatccaagcctggggcagcctctcgcctccccttgcccaaaccacatcctctttgcccttccccacacctcaaactctcctctgactaacatttccaaaaaaagtagagcttggtccagtccagaccaaaagcggcagactaattcattccctaccacctccgccccccagactcagcacttcctgactatcaggaaagaacaatcagcaaaaagtggagctgtacctactgttcaatttctagagctaattgttttcagcagggttttggccttaattaaaggataattaattactgaatgtgtgtttgcatttccacaagtgtgtttgcgtttcctaagtctggcttttaaccctgggaaaccagattcagcaaatactttcatgtttcaatacttctgagtaagggagaaggtcttaattacagaaatggtagtcctgtgtaatcaaggggcaatgcaagaatgagctaattgtgccttccacacactcggccacgatttctgtcgagctgctgtgaggagagggtggcagctgcccagccctgcccagcactgtgtccctatccgtggattctcttatccctgtcacgcaactggccacccctgccacagcccttctcttccctttctatgtgtttcttctttc

SEQ ID NO: 2948 - DNA, 2400 bp, Homo sapiens
gagacagagtctcgctctgtctcccaggctggagtgcaatctcagctcactgcaagctccgcctcccgggttcacgccattctcctgcctcagcctcccgagtagctgggactacaggtgcccaccaagcctggctaatctttttttgtatttttagtagagacggggtttcaccgtgttagccaggatggtctcgatctcctgacctcgtgatccacccgcctcggcttcccaaagtgctgggattacaagcgtgagccaccgcgcccggcctactgttccctttttttgtaaaagtataaacaaatatgtatatacatttgtattgccatagtgatataaatttttttaaacttaaaaaatattccaggctgggtgtggtggcacacgcctgtaatcccagcattttgggaggccgaggcaggtggatcacctgaggtcaggagtttgacaccagcctgaccaacatggggaaacctcatgtctattaaatacaaaaataggctgggtgtggtggctcacgcccgtaatcccagcactttgggaggccaaggcaggtggatcacctgaggttaggagttcgagaccagcctggcaaacatggtgaaaccctgtctctattaaaaatataaaaattagccaggcgtggtggtacacgcttgtaatcctagctactcgggaggctggggcaggaaaatcacttgaacctgggaggtggaggttgtagtgagctgagatcacaccattgcactccagcctgggcaacaagagcgaaactctgtctaaaaaaaaaaaaaaattctggctgagcgcagtggctcatgcctgtaatcctagcactatgggatgccaaggcaggtgaatcacctgaggtcaggagttttgagaccagcctggccaacatggtgaaaccctgtctccactaaaaatacaaaaaataagccgggcgtggtggcatgcaccttcaatcccagctacttgggaggctgaggcaggagaactgcttgaatctgggaggcagaggctgcaaggagccgagaatgccactgcactgcagcctgggcaacagagcgagactctgtctaaaacaaaacaaaacgaacaaaaaaaaattccctaaaaatggaaagcaagaaagaaaccagtgaaactagctgagtcctgagttggtacaaccacacacagaagaatcatttcaggcggcctttctctggtagccaccaccaagagttcacacggaggccctgggtactggctcccctccccactgcctctggatctcacccttatgctaggcctgtatgcaagcagagagccaagcagtcaagggaaaataatgtgggaggggagccagggggaaggaaacaggttgctgaagagaaggtgcctcatgacaatcctgtaagttgccaccagtgtgaaggctccggcttggtgagtgtggctccacacatatcaccactcagaggcgcagagagtgtggcactacctagtgagggcagtgaatgattccacaggactcagtctttcagcagaggctggctgctgttctagaagcactttggtctacagactccaaggctagcccctgggacacccagccatgtaactcagccagcccacaggtgggccagagtggtgaggactcagccaggacacatggagtctgctgcccaattcatccagggaaatgaggtcagccctggggttggggaatagggcagacaagctgcactcagacacagggtgcagtgggcaggctggcgcgagggcagaggcggctcgggctcctggctgtggtcattcccatggatattttctgtgccatgacctgtgctgagcactttatgtccatggatactgttacgggctgaactgtgtcccttcaaattcatatgttacaggacctcagaatggtactgtatttggagatagggtctttatagagatgattaaggtaaaatgaggtcaatagggtgggtcctaatctagtatgacaggtgttcttataaggggagattaggacacagacacacacaaaaggatgaccctgtaaggactcagggagaagatggctatcaataagccagggagatgggcacagtggctcaggcctataatcccagcacttttggaggcggaggtgggcagattgcctgagctcaggagtttgagaccagcctgggacaacatagcgaaactccatctctacaaaaaatacaaaaattagctgggcgtggtcgcacacgcctgtcatcccagttacttgggaggggtagcggggaaggtgctgaggtgggaggatagcttgagcccgagaggttgaggctgcagtgagctgagatcacgccactgcactctagcctgagtgacagagcgagaccctgtctcttaaaaaaa

SEQ ID NO: 2949 - DNA, 10075 bp, Homo sapiens
agacgcagccgagtatcttgaggagaaggactttaaagcgttcagggattttagctgccgctgtggagttccgccgctgttcttccgctggagggcgcagtagttccttaagagggaatggtgcggcgaatagctagttttgctcttgttgcccaggctggagtgcaatggcgcgatctcggctcaccgcaacctctgcttcccaggttcaagcgattctcctgcctcagcctcctgagtagctgggattacaggcatgtgccaccaagcccaggtaattttgtatttttagtagagatggggcttctccatgttagtcaggctggtcttgaactcccagtctcaagtgatctgcctgccttggcctcccaaagtgctgggattacaggggtgagccactgcgcccggccaaagtctgggcttttagtgtatctgtcacctgaataatgtgtacattgtacccattaagtaatttctcaaccctcaacccctcccaccattctgaagctccgtcattccacactctatgtataggtgtacacattatttagctcccacttgtaagtgagaatatgtgttatttgactttctgtgtgtgagttgttttacttaagataatggcctccagctccatccacattgctgcaaaagacatgatttcatttgtttttatggctgaatagtatcccgttgagtatatataccacattttctttatccaattatggttgatggatacttaggttgattccatatgtttgatattgtgaatagtgctgagataatcatatgagtgcaggtgtccttttgatataatgatttatgttcccttgggtaggtacccagtagcgggattactggatagaatggtagttatttttagttttttgagaaatctccatactgttttccatagaggttgtagtaatttacattctcaccaatggtttttaacctattggattactgacatttaaataaataatagcatgttaatatccagtgaggcttcagaatattaactgagtattcataggcaaattactcaccctctgtgcctcattttcttcatctatgaaaatggaataatgacagtaccaacttcataagattatgacaattaaataagttcatgtatgtaaaatacatagaacagtatggtacatgcaaatgttacataattacttgttttattagttattagccaaaggtattggtgtgtatatcagaccctggagagggaggaggtttacagtggagagacagaaacactgcaaaagtgcatctgaccatcatttctttcccaactcctccttgctaattccattttcgggcacctcttccttttcccttggcctccccagaaactcaattcccctcaattttgttacacaagcaactgacttctctaccccctattcaaccccaggccttctttgcagagctagctttgtgactgtgccctgctatcctgtgagcattttccccagatccaacccctcaggaccacttcgagctctcttttccttttgcctcccccaatagcttctgggaagagcagggaataagatagagatttatttccccaccaaacagaattttgtcatctctcttagaagaagaagaagcaacaatcaattcttacgttaaatggcaattttaattattttgactcataaacattttaaaaacatattttaaccacagttaaaaatacatattttaaacatatttaaacatatcctccatattatgaaatttcagtggtgcgttacctaggtcttgatgttttaatgagtgaagtctgtgaaaatgaggttctaaatgctaatcagggtttcctaattctgagaaagaagtcaggaaggatgtcgttagctcatctgaccacaaatgtaacactgattctgcctaggagaggaagaaaataaagcaaaacgtgagcagtgctgctttctcagcctcaattaacacgagaacaccatctcctccactctctcccaaggacctgacaagacaggcagaagcccttgttcttgaacaattcagagggttggtaggaaggtctccagggagatactggacctcctgccactaactgcagttgggctctcaagtgattaatggaaaaataaaagatgagactatatttatatcccaaactgtggagtatgccataccagtgacacctgattatacggctaagtgttccaaaattcatcagcctgagactacagaatcaggttacattttctctttttttttttttttttttttgggacagagtcttgttctgtctcccagtctggatggagtgcagtggcgccatcttggctcactgcaacctctgcctcctgggttcaagccattctcttgcctcagcctcccaagtagctgggattacaggcatgagccaccacgtcaggctaatttttatgttttttttttttttttagtagagacagggtttcactgtgttggccaggctggtctcgaactcctgacctcaagcgatccacccacctaggcctcccaaagtgttgggattacaggcgtgagtcactgtccccagccacattttcttttctttttttttgagacggagtcttgctctgtcacccaggctggagtgcagtggtgcaatcttgactcactgcaacctctgcctcccaggttcaagcaattctcctgcctcagcctcccaggtagctgggactacaggcgcgtgccaccacgcccagctaattttttgtatttttagtagagatgaggtttcaccgtattagccaggatggtctcgatctcctgacttcgtgaccacccgccttggcatcccaaagtgcctgcattaaaggcatgagccaccatgcccggccgacattttctttaatatacaaatttcaatgattccaatcgtcttctctggaatatgacaagctaattctttttttttttttttttgagtcaaagtctcgctctgtcacacaggctggagtgcaatggcgcaatcttggctcactacaacctctgcctcccaggttcaagcgattctcctgcttcagcctcctgagtggctgggattacaggcacacaccaccacactcgactaattttttgtatttttagtagagacgggcttttgccatgttgcccaggcgggtctcaaactcctgagctcaggcaatcaacccgcctgggcctcccaaagtgctaggattataggtgtgagccaccgcgcccggcctgagaggctaattcttattattagacttccctttacttaattgtttgtttgtttgtggcaggaatactgggagaaagtcaatatgaccctggcatttgcaggtgtcctccccaagtacatttgccacccttgctgtgctccatagctctcaggtcacctgatgccatctagggactgacttctccctgactgctgttgctttctccccgagatgtggttccccaagcctggacacaggctctaccctttactccccaaagaatacctaaaaccaacaagtaggtgccaggaaaaaaaagcctgacagaagttttgaggatcacagaagggaatgacactaaaattgaggaaaatctaaacacaaggggatgtcccattgctctttgaatctgttagcccacaccctccctagggtaccttctaccagggctggcttcatgggcctgtgacctatgccatcacacaggtccccagtcttagaaggggcttcatgcttagtgttctgctgtcatcatcttgaaattcttaataatttttgaataaaagatatcctgaattttcattctacacttagccctgcaaattatgtaagtgattcatgccttctagtaaccattcttctctttaaccccctacctgcctgtatgtgcagagaccagtcccacatcttgccaacaaaagcgcccatgattatagtcaactcaggcacactattgctccagagatgcaaaaaaccttgctcacgatgaagacttaggagtgacgaaattgtccttcaagtaccataaccacaaggtagtgatacgaacagataaccagcatatatttggggtaatattggcaaaattatccaaatgtggtagattcagatatttggtcccatgtagaccaaaaacgaagcaaataaaattttatttaaagatgtttgttttggttaaagggcttggcctcacttagatggactcaccctatacatgagggtgcttgggggagaggctagagtgtttcatgacacaaaaacattctatttgttttattattattattattattattatttgagatggagtctcgcactgtcgagcccaggctggagtgcagtggtgggatctcggctcactgcaacctccacctcctgggttcaagcgattctcctgcctcagcctcccgagtagatgggattacaggcacccgcccccacgtccggcaaattttttgtatttttagtagagactgggtttcactatgttggtcaggctggtctcgaactcctgacctcaggtagtccacctgcctcggccttccaaagtgctgggattacaggcatgagccatcgtgctgagctgacacgaaaacattctgaagaatttggctatggcactgatctccagcccacctgcactctcatctccacccccaattctccacctcctacacccctccccctactccacctcagccccttagggcgatttaagtaattttccagacctgactctgaagttatcttcccagcaggagtcgcaagggtgagtggtagaggggtgaagaccttcagtgaccagctatagtctgagctgggaagggacaaaggcaagaagaaggaggaaatgggtcactgcccatggctggcagagcaactgctgtgcctgagcttttattctgtgaacaaatctttgctctcttcaccagtgacccacatgaactgtcattcccaactgcaataaagtggggcaagggctgagaagggctgagaagggctgactccacagctgtggagtaagagttccctggcaggagaagaaagactgaaagacacagggctttcatggaggcaaaagaaacaaagaaagtctgagacaaggagattaaaaaacaaaaacaaaaaaacaaacaaaaacctctgaaaagcctaattgcccctaaatgcctcgacaccaaaactttgtcatttttttcttttttgtggctgtcttcccattttatttttaattattttttttttccgagacggagttccgctcttgttgcccaggctggagtacaatggtgcgatcttggctcactgcaacctctgcctcccaggttcagacgattctcctgcctcagtctcccgaaaagctgggattacaggcgtgcgccaccatgcctggctaatttttgcatttttaggagtgacggggtttcaccatgttggtcaggctggtctggaactcctgacctcaggtgatccacccgcccgggcctcccaaagtgctgggattacaagcgtgagctaccacacccagcctgtcttcccattttaaacaccctttatgttccaagtgaggtaaaggtgaggaataaaagggagaatggttgcagagcctcattaagctgggagctaggatcacaggagctagtggagatcttgggtgaatcctactgtttcttgaatgagtcctagaaacgcccgctcatttggctacttcttcctttcctgcacacaggaatttaacaagattcttctacagcctggtgactttgtgatctcttagccttagtcatgtcctctttccctcccaccctagccccagagactcttcctcttttccttggcagttcgagtcccagagtgttatttatcagtcagcagcagagggcgatctggccccggagaatgacccggtcaactcgggccatatgcctgggttgctaatgacttgcagctccatcaacataaagctgaattcttcacaaaggaacactgtcactaagctttttccttttcattcttgaaagctacactgccttagctaaccccttccccctcccgccttcattcctgctctctttcctctcccaacctcttggaagcagcaggaaatgaacaaggtccacagtggagaaaaacaaatcccagggccctgctgaggaaaaccacaggaaaatgaccaagtggcattagcagctgcaggagttttaggtagctgtgtggtgtgcgtgtatgtgtatgtgtgtgtgagagagagagagaatcccacatagcagtacttttcatagtttagcataacataaaaatcacctggcgagcttgttaaaccacagcttcctgggccttacccaggaattcccggggcccaagaatttgcattcttaacactcctaaggtattttaatgatgccagtggaggactgaccacattttgagcagcactgctgtacacaaatgcagtgaaatagaatgtatagatctgagccaggggcttgcttggataacatcctgatatgatggcctcccccagaagagtcaggccagatccttccaattccaggccagaagatttcatagatcagcctacagctgttccctccccttgaaaaagaagcagagaatgtatcaacaagagcattgtttggagagggctgagctcagataataggctggttctccattgactgtttctttcatcccaactggcagaagaatcacagaaggcccctcctttcccctccagcagagatggatgctctacctacttaaaaatcaagaattcttctgaccttggctgtgtccaacaactcatgcccagaggcttctgacctgtcccctccttagcaccctccagatctgagaacctccagagtcacaaaggcctgtggaaagagctggttatcttcaagatacccagaggcgcttgggctgatttaaaggcactactcccttctgtttatgcagcagaagataacaagacagacagaagtgctgctatggtctgaatgttgatgtccccacaaattcatctgttggaatttagtccctgatgtgataccaatcaagagatggggactttaggaattgattaggtcagaaggctacagcccccatgaatgggattagtggccttataaaagaggctggggggcctggcgtggtggctcacgcctgtaatcccagcactttgggagactgaggcaggcagatcactttgggtcaggagttctagaccagcctggcaaacatggtgaaaccacatctctacgaaaaatattaaaaaattagctgggcgtggtggcgcatgcctgtagtcccaggtattcaggaggctgaggcaagagaatcgcttgaatacaggaggcggaggttgcagtgagctgagatcgcgacactgcactccagcctgggcgtcagagcaagactccgtctcaaaaaacagagctggagggagactgtgagacacatttagaaagcatcatttatgaggaaccagccctctttggcagcttgatcttgggacttcccagcctccatatatggtaccaatccttctttagttttagtgtccatatcacagaagggctcatgttgtaaaagaagtcaaaagcagccttgaataatcagaacccttctgccagattgtctaatgtcaatttgttttctagaactactgcttctacatgttcttcctcttcatctggctctggtttggaagcacttatctccatcaagtcatcttctgttaattcctcaggtgtggtgtctattagcttttgaatttatccaagatctgtatcttgaaaccctttatctcccaccttttttgggacatccacaatctctttcatgatttccttgattgcttctgtcatatatcctgataagtcatgcacaacatctggacacagttttctccagcaggaatttattgttttgggcttgatggctttcatagctttttctgtaacaatgatgatgtcttcaatggtgtaatgcttccagactgtcatgatgttcctatcagggttatcttccatactgttgacaatcctttccatagagtatcatgtgtaatgagccttaaaggtccttatgaaccccccatctagaggctgaattagagacatatttgggggcaaatagaccactttgacacctttggtgttgaactcatgaggttctgggtggccaggggcattgtccaatatcaaaagaactttaaaacgcagtcccttactggcaaggtacttgctgacttcagggacaaagcatcagtggaaccaatccagagaaaaggattctcattatccaggccttcttgttccacaactaaaagactggcagctggtatttatcttttccctgcaaagcttgagggttagcagctttacagataagggcagtcttaatctaaacctgactgcatttgtacaaacagtagagttagcctatctcttcctgccttaaatcctggtgctcgcttctcttccttactaataaatgtcctttgggtcatttttttccccagaatcaagcactttcatctgcattaaaaacctattcaggtagatatcccttttcctcaatgattttcataacgtctggaaaatcatctgctgcctcttagttgacagaagctaataattctcttgttatcttgacatttttaaacccaaacctctttctaaaattaccaaacaatcatttgctagcattaaattctctcgctttagatttcaccttctttttgcttcaagttgtcatataatgactttgctttttctggaatcatattagactatatacgtatgaatttcttatagcaataccgcaccaatataaatatattgcaccaaaataaatataaaataaatgcaatataaaagttgcattttcaatacaagatataaaggtagtttgcaaaaagtgcaaggttttcatgactgctggtatagctgcagtgacagtttcacaaatttcctttcctttttttttttttttaatggttcttatgctggattcatttatctcgaaatggcagacaagtacaagctgcaggcctcaatctgtggaaatatcaagcaattcaactttttgttgtaatgatataactattctgtgcttcttgggagcacttccagcatcactaatggcacttcatatggtcccaaggtgttattcaaggtttatggtattgcactaaacatgatgaaaactatgtgagaactgagagatcacttttttttttttttgagacagtgtttcactcttgttgcccaggctggagggcaatgttcacaatctcagctcactgcaacctccgcctcctgcgttcaagcaattctcctgcctcagcctcccgagtagccaggttcaagcgattctcctgcctcagcctcccaagtagctgggattacaggcgtgcaccaccattcccggctgattgttttttgtatctttagtagagatggggtttcaccatgttggccaggctggtcttgaactcctgacctcaattgatctacccacctcagcctcccaaagtgctgggattataggtgtgagccactgtgcccagcctactacagttaattgtatgcagttatgatttaatactgcatctctatatttgtttgcatttatttccactgtgaatggtgcaagtgtttgtaagtgtacttatgtgtaagttttgatttttttttttttttttttttttgagacagagtcttgctctgttacccaggctggagtgcaatggcatgatctcggctcactgcaatctccgccttccgggttcaagcaattctcctgcctcagcctcccaagtagctgggattacaggcatgtgccaccacgcccgactaattttttgtatttttagtagagacagggtttcactatgttgtccaggctggtctcgaactcctgacctcaggtgatccgcctggtggcctcccaaagtgctgggattataggtgtgagccaccatgcctggcctctgataaattttaactttttataatggatttatatatcttttatggcagtaaataataaagtacactagtatc

SEQ ID NO: 2950 - DNA, 2927 bp, Homo sapiens
caaattctagtttttcttggctacaagtcttcaatataacgttttcaattttttccctttcttttttctatttttcctaatttggagtcactgaaagctaagctgtgctttgtgaagccctgtgaactgaagctagacaacttaaacttcagaagaaaataacagcaacctgtttacatatataagctactttcatacctgcctactgatgtatggacttcagagtagtgtggcctatatcgattttctaggatcattattttgtttgttgtttttctcccttcctccacctattttctcttcataggacatgaggattctcaacctgataaaaatgagctttcctaataactcaagacccatctgcctaggaataaaccatcccagctgtgagagaccagacgaaacctgagaccagagactcgttttcttctaaaatgctttctccaaaagatttttaaacagaaaaagggggaaatgtgaaaggaaaagaaaacttgaggcccccaaaatcactaagctaaaaggaaaagtcaagctgggaatggcttagggcaaacctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataacccttccccgaaactcaaccacccttgtaatactgagagaccaccaggctaggaggaggagaggagcctaaattctgctaaggtgtagacaaaaacaattgtgaggcgttattccagaagccacaagatatgcaacttcctcagttacccctgcagataatgttacttttgtagaacctaggattggccttctgagatatcttctcaggattttgcatgtctgatgaccgatggctccaccgggaccagccaacggcttctgtgtccccacccagaagcgactcagagaaagaggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagctacacatcttgaaagagaagctcttcctgtgaggcaagtattgttcctgtacaaaacaggctgccgggtgccgtatgggagcgccgcctccaggtgagccatcctgggttccagtccagcctctattcacttcaggtgggtgttttacctctaaacctcagcattgccatctgcacatagaaccagcctttctggtttccagctgaaaataggttatgactagaaaagtaaagaatgttgaattgggccgggcgcggtggctcacgcctgtaatcccagcactttgggaggccaaggcgggcagatcaccttaggtcagaagatccagaccatcctagctaacacggtgaaaccccgtctctactaaaaatacaaaaaattagccgggcctggtggcgggcgcctgtgatcccagttactcaggaggctgaggcaggagaatgacgtgaacacgggaggtggagcttgcagtgagccgagatcgcaccaccgcactccagcctgggagacagagcgagactccgtctcaaaaaaaaacaaaaaaaaatagtgtagaattgccttttggaagtaccctcccttcctttttacacagacagccggggcttggtgaggaaagcttgcccaggaacccaagggagcgagaacaacagacaagccaggcagccccggctacgatggctcttaccgggcacctgagccttctttagacagggtctctatttgcagagaatgagcggccaattacgaatgaatgtgcttgcctctgcatgcatagcccctcacagtttacacacacattagtcactctgcaggctgcacaggcttctgtcgctcccagatgttcatcgctcctggaaacgattcggtctttcccagcccagcgccaggcagctcctcagatcccaaggcacttggcttcccctggagcacagcgttctctccacggggatggctgggcaggagaaaggactctgaagatgggcctgtccctgcctccagcccagctctgcttcccctcagcaaccttgggcctccgttggggctgggtgggctcagcctcctcctctgccttagagcagtgccttcccacgtggggcgaggtccccccggagttgtcatctgtgatcagggcattttaagcagaagctggagctctccctttggtggactcttgtccgatgctggagaagggcgacctctagtgttggttcatagaagcggcatagcggcttcttcctgcctctgagccctg

SEQ ID NO: 2951 - DNA, 1943 bp, Homo sapiens
ctcttgagagtcatttgctgcccatgttgctggggagattctgcctcagggccaggagtggtttgctcctcccaccccgggcccagggctgctggtgggaggccccagggaggagcaaggactctaatgcttcgtgtggtgggagcctcaggactttcccacgtgcgacaggcacgttcctgggagctcggtgggaggaacccagccacgttgtgtgctgcgcaaggagccggcggcagggaggggaaaacggaaagacgcagaggagggcaggtgacaagaggcccacagagagatggctgggtctgggcagcgggtgggagcaggagggaggcggttatgggagacgtggagcagtggaggccgtcagaagtggggatcacagctgtgacctcatggagagggacaagccccacagctgggctggtgccagctccactacccagggccaacctgtgtggccgtaaaattctcaagcctggagtgtgtagaaggcagcagtgccctggcctggccacccgcgaacccctctgtccaccccatgctgcgtggcacagggcaggcgtggggcctctagctggagccttgagtgggtggatcctcggtggggctttaaggccaacctgtttatgaaaatgcatggggactgactgcagatgcacagacaactcagatgcacagacgcccggacgacgtggacacccagacgatgtggacgcacagacgacatggacgcacagacgatgtggatgcacggacgacgtagacacacggatgactcatccacagatgactcagatgcacggacacccagacgacgcggacgcacagacgacgcggacgcacagatgacgtggacgcacagatgacgtggacgcacggacgacgtggatgcatggacgacgtggacgcacagatgacctggacgcacggacgacgtggacgcacggatgactcagatccccagacgactcagatgcacggacacccagatgacatggatgcacggacgactcagatccacagatgactcaaacgcacagatgactgggatgctcagatgaccgctgctgtgctgccaccccagggctctctgggcgtttcctgtggtttgggcaccaggagcctgggagtcccatgctgcccccagggcactacctcctgggcccagccctgcatccggtggcagggctcaccgtcatcaccccaacagtgcagggtggtctcagggacctcctctcatcattgccaagaactggctccaggatgtttccatgtggccggctagtatggccaaagtggaccctggcgtgctgtccccttggacgcctccaggccctgcccagcacgtggggctcgtccattctgtgcctgaccatgctctgccatgcggggcctagcccagccccccagccctgctgcttctccccaccccacccccgccacctccaccaagccaccagcatcctgcctggccctacggacagcagggtcgtcctgtgtccaaaagcctcctccccctcagccccttcactcgggtctcatggggcccctctgtggcccccagcgcacaaggcacacacccactatggggcctttgcacagctgtgccctccccaggctccagccctcacctcccccaggctatttctcagatgtcccttcagaactagagcccttgggcccccagccccattgacacggaacgggccccctgttgtatctcaggtcactgctgtggttgcagccacaggggcaacacctgttactgccacagcgtccgacctggggccagcgtgcattcaaacgcactgctctgagaggccaggacgtccatgggttgggcgcagggggcggcggtgggaaaaggtgtcaggcaccatgggtcccgacctggagcccacgtgccagctgcagagatgggcactgaaggcttttgagca

SEQ ID NO: 2952 - DNA, 2396 bp, Homo sapiens
acggaaggcctccaggaactaaagcggaggagggggccagcctcatcccactgccagctggcccacagttccccaaacacagtgagtgaggacggacctcaggctgtctcttcgggtcaccgctgtgaaaacaaggcaggtacagcaccagggcagacactcgcccccaggggaggctcccccagatcccaggcctctaggccccacatcaacagtgcactgcacgttgaggacaaggccatctcggactgcagaccctcacggccttcccacactttgtcctcacttgcaacaggggcttcgggtgggcctcccgtttctaaagcacccactatggacgcacagcaggacagacccaagtcccaagactgcctgggcctagtggcccccctagcatctgctgaagaggtcccctctacagctcccgtgtctgggaagaagcacagaccaccaggacccctgttctcctcctcagatccccttcctgccacctcttcccactcccgggactcagcccaggtcacctcgctgattcctgccaccttcacagctgcaagcagggatgccggcatgagaagaacaaggcctggcacctcggctcctgcagctgccgcagcagcccttcccccctccacattgaaccccacgtcggggtcgctactcaatgcagtggatggaggcccctcacatttcttggcctcagccacagctgcagcacgtgcccagaggtcagaagtgagatataaccagagatcccagacctcccggaccagatcctgcctcaaacgaaatgccagctccagctcccacagctctacggaaggcctccaggaagtaaagcggaggagggggccagcctcatcccactgccagctggcccacagttcctcaaacacagtgagtgaggacggacctcaggctgtctcttcgggtcaccgctgtgaaaacaaggcaggtacagcaccagggcagacactcgcccccaggggtggctcccccagatcccaggcctctaggccccgcatcaacagtgcactgcacgttgaggacaaggccatctcggactgcagaccctcacggccttcccacactttgtcctcacttgcaacaggggcttcgggtgggcctcccgtttctaaagcacccactatggatgcacagcagcacagacccaagtcccaagactgcctgggcctactggcccccctagcatctgctgcagaagtcccctctacagctcccgtgtctgggaagaagcacagaccaccaggacccctgttctcctcctcagatccccttcctgccacctcttcccactcacgggactcagcccaggtcacctcgctgattcccgcgcccttcacagctgcaagcagcgatgccggcatgagaagaacaaggcctggcacctcggctcctgcagctgcagcagcagcccctcccccctccacattgaaccccacgtcggggtcactactcaatgcagtggatggaggcccctcacatttcttggcctcagccacagctgcagcacgtgtccagaggtcagaagtgagatataaccagagatcccagacctcccggaccagatcctgcctccaaggaaatgccagctccagctcccacagctctacggaaggcctcccgcaactaaagcggaggagggggccagcctcatcctactgccagctggcccacagttcctcaaacacagtgagtgaggacggacctcaggctgtctcttcgggtcacacccgctgtgagaagaaggcaggtacagcaccagggcagacacttgcccccaggggtggctcccccagatcccaggcctctaggccccgcatcaacactgcactgcacgttgaggacaaggccatctcggactgcagaccctcacggccttcccacactttgtcctcacttgcaacaggggcttcgggtgggcctcccgtttctaaagcacccactatggatgcacagcaggacagacccaagtcccaagactgcctgggcctactggcccccctagcatctgctgcagaggtctcctctacagctcccatgtctgggaagaagcacagaccaccaggacccctgttctcctcctcagatccccttcctgccacctcttcccactccggggactcagcccaggacacctcgctgattcctgcccccttcacacctgcaagcagggatgccggcatcagaagaatgtttcgtgttcgaaattgtttgaggggtttgggtttatttttgttggttttttcttttttttttttgcttacgtgggcatccttcagcttttaataatctgaaaaattgtatttacccattgtcaatgtgtataaattaatctcagtcaattttatacaataaaaggtgaacttttatcc

SEQ ID NO: 2953 - DNA, 20689 bp, Homo sapiens
aggcctgctgggctcccgacgctcgcgggagcagcgggaaaccaggttccgggagtggggcgaggacgcccctgccaagccccttttacgtcccggcggtcgcgaggaggtcccccgggcgcgaagaagacgccagcccaccccagccgccggggagatcgcccaggccgcgctcagccccgcccctggctctgcccccgccgcggagcggaaccctccaagtcgcggcctgaggaggaaggaaaagggggcggcccgggagagccgctgcgaaatcagcaacgggcgggaaccaggttgcctccctgagtcccttctctccccggccggctgccaaccacagccaaggccagagaaacaggcccttctgccgcggccacctgggcgccttggacccgccctccggactcgcccccgcccctgccgcggagtggaacgtttggaaccctgaggggcacaggtaagggggcggccccgccccgcgccctggaacgacctcacggccccgcccacatccccgcccctggccccacctccgccgcagagcggaaccctcagagtcgcggcctcgggggggacgaaaaaggaggcggcccgtgggagtctaggggaacccggcttcgggcggcggacgagttggctttcctgcgtggtagtgtggagccccccgagacgggtgccagtcccactcgaggccggagaaagagggccgcctaccgcggccgcctgggcacccctctgagggccaagattgtagtcccacctctggccccgtctccgccgcctagcggaactggagtagcgggacccagcccggaagaaaaagggggaaggcccggagaggtgccccagcgacacctctggcgcctgtgaccccgcccctagccacttgggcgccgcttcctcgggcaggttcgcagttcatctcccacgggtctacagcttgaaacttggcattcattataatgtttcgtggctgctgataacctacagttcacaatcttcggcctggtattcattgtccaccaaaatctggcccacataggaatttactggacagctagactaatgcaatcaatttccgcaagctcttttccagtctccatgcatttactctatgcttgaccccttcggcccttcttcctcctccttgactaactgaagcctatctttcccttaacggccagctcagctcctctattagccttccccattttctgaatttctgtagccattggtttagtaagagcttaggacttagagtcagttcattttgagttcaaatgtcagttctgtcatttacaagtcgtatgacctttggcatcccgttttacatgtttgaacttaagtgttctcatctgtaaaatggagataatcatagcacctacctcacaggatgacttaagatcaagaggatgaatataaagcatttagcacaagcctggctagtagaaaaatacttaataaatcatagctaatttcgttgtcacttggccacaatgtattgcctcctgttgttatttatgttttcatgtgtggatgaggcatattttcctaattggaatgtacgttattcattgaaacagtcttttggtatctcctactatgcctggtacagtgttgagcatatagttggagctcaattaatgttgctcgcatgagtaaatgaaatcagtcctgcttagctgcgttcccttatgtttggtccttaaccaagtttatattagatattccagaacataaatctatggctttactctgtcactcaactaaagcaccaaaccccacatcagctcacatattacttcatataatactttgttttcttaatattggcttttgaattatgcagtgatccatgtgatgtgcctccatgaagaatttgctgtggtctaggggtgaataaaactagacattgttatcaccactaaatgttttggaatctgaatatgtactcttgctagaattttcatgtattcatctccatctaaaagctgggatcattgcttcttttcattgtggcttttgtttccattgggtccttccttaggagttgattttgcagccatatgggaaataactgatgatctttgctccttatctggcatttccacctagtatagaaacattttcagtttcctgacttcattcttcgctaattctgctgtgcacatttgcaccccttttggtgtataggcaatctacattcttcggctttggtctatgcgattgcatagcaatatataagctatgttcttcaataagctcaaaattctgggataaaaccaagaaggaaggctactccgttttagcttttaaatttttaaagcaaattttagtgattcattttggaccagaaagctgtactatataataaatcagtctcacattttagtatcctcatatccctgaggtgcaaaacctccatatcttggtccccatatccatgaagccattctctggttatcaccaatagaaacttgtctccaagtcatttctcaaatatttgtcaagaatcagatatagtataatgatagggaatgttattgtttctgaagctgattcatgatctccataaaaatgaagacccagaactggaccctggggtagcaccatgtatgatttttctgaccccagccagaggatctgccatcatcctgccacagagacttcagcccaggtagtttccagagagccccatgttaacatccaaggtggaaaccaataaatgtttctcttgtagggttcaggtctttggctctaaagaaaatcactccatctttgacccagaaggtcaattctgaatgaatttgctgaaaatgaccaattcaccaaatttagttatttctatgataatttagttgactggaaatcattttttcgttacattttaaagaatgttgaatttgtctctgctccagcttcctgtagctcgtttgaggctaagagataaagagaggaaacaccagggaacataagatttcttcacagtgaggaatatatttattaaatatatttaaaagaatatattctaaaagaacatatattccatttttgcctgctctgacttcttgatgctgtacctggagactaacatgaaaagaaagcagtatatactggccaggcgcagtggctcacacctgtaatcccagcactttggaaggctgaggctggtggatcacttgaggtcaggagttcaagaccagcctggccaatatggtgaaaccctatctctacaaaaaatacaaaaattagctgggcatggtggcaggtgcctgtaatctcagctactcgagaggctgaggcaggagaattgcttgaacccaggaagtggagagtgcagtgagccaagattgcaccattgcactccagcctgggtgatagagcgagactctgtctcaaaaaaaaaaaaaaaaaaagaaaaaaaaagtatacactgataagaattcttcaaattgaagattatgttcttatgtctacccagtctttcctttttcctttccttcggactccaactagaacagcaaggagcagagacaaagacaaactagtccttaaaatgctgttatggagacaaaatgacaccaaacaagtccactctgtgaattggttatgctgtaaattaatctttgtctaaatggcctttgacaaaccgactgactcctagctgacctccttagacatacccagtatcccaagtgaagctgtttcatcgttttttgtttgtttgttttaaagacaggaggtctttctgtgttgcccaggatggactccaatttcctggctcaagcgatcctcctgcctccgcctcccaagtagctgggactacaggtgcttgcctggcttgcttcaccattttcagtaagaacgatcatgatgctgctcactgaagtcagcagacttcctttgtggggttaatgactgcagtgtgttttgaggaaaaacaaaacaaaacaaaaaaaaactactccaatattttgaggaaatacttctttaaatactggcctctgccctgacactccttgcctcctaatattggcaccacctctgtttccttacaatagagtctcagaacatgggatcaatcttagacccaaaggaggatgcttctcagaaacactctctgtcctgccgtacgtctgtctaaagtaagaaaaatagatgagagaattctgcttaaggaccacagcacagacacagtaggaaaaataagggggtgggacctaaaggatactggacattgtgcatccttttatgtatattttggttatataatctgttttgggggattgatttctgaggtctcacccctctcccaatctagaggatctcacatcttcctttgaatttagtactcggcatctttgtgggagctgaggaccttgaagaagagattgctcagagacctcttaccagggtgaggccagcttcccgtatttggggatcccacatgctaaccagcaatgcagaaatcccaaatcctgttctcacttttcagtagtcctacctgtttgacactgaggaagcagatacttggatgagatctgaattgggtcttgtacattgcctacaggccaaaggcaatgtgttgaagagataatcttgaaagagtaatgggaaaggagacctcagaaactgatctcatgaggcagaacaacccttgctctaatttcatagtcacagggtacctgctgatttccaaaagatgttactgttatgtttgtcttcttaagagatggtgtctcgctctgtcgcctaagctggagtgcaatggcacaatcgtggttcactgcagccccaaacttccaggctcaagcagtcctccatcctcagcctcctgagtagctaggagtacaggcacacaacactatgactaactaatttttaattttttgtagagacaggggtctccctgtgctgcccgggctggtctccaactcctgcactcaagcaatccacctgcgtcagcctcccaaagtgctgggattacaggtgtgagccaccatgcccagccaattgtgtttgtcttaatcagcatgtcctacaccacttccatgccaggccaccagggaaagagactgcagatgttttttctttgtgaaaattaccaaacttaaagatcttaactgcaaatttatttcattgattttaacatttttgattttaacatataaatacaagaaaattaaataaatcagaaaagaaatattgcaaagacaagtcagcactcacagaaatgtgtattattactatggttagtctgagatccaacattcacttgaaatatatgcaagagaaccttagtgaaagacttaactaaaaggggtttgaaatgttcctaataaggatgtacttgaggcactgctcaagcagatgtaggtaggaagcaagatagaccctgtatataactaggagcaatcaaggctcgatacatgtagcaacaatagcagtgtaggacagttccctgttcccaatagctactccccttgtcactgtgcattcttcaagacacatttaaaaaacaattatagctctggctgggccagagtgtaccagtcataacaatcaacaatgtaccatgcagttgccttttaaagaacggcaatatgatttttttccatatatatgtacctttttaagagaaggaatcctagtctactctcctgttcctaaaggctctggggatttgagaagcggcagtgtatgtacctcatctacgttcacaattttcctgacacatggtctggatgacagttcatccctctctgtggccaaggtataaagctaaacatcttggtgcagattctataatctgactactggggatgcggtcaggggatgggtattcatattggatgctgtgtttggctgtacaggtcgtgcacccaagagggtgagtggggctaaaatatggtctctccactctgtttgtcaaaccatgagcccatagggctgtgtctgcccagtgggggcatcttttcctaacttgctcaaaggcactgtatgagctaactgtggcactgtctgcttacattttctcagtctggctgggatcattatttcttgatttcactgaggtttctgtatttcacatcctatatcatctccaaaaggagctttaggatttgcggaacgagcaaggattttctgaattatcacgtgagacaaaacaaccatgattctacaaaggaatacatttacacagtagaaaataaatacaaaaaaatgtagaagtaagatttttgacacatgggtcactagaatttagcttatatacaacaaaggcatgcacaactaaactcaccaacaggctgaagtcaacagttgctttatatgatgttatcaaagataacttagcctctttaaaaggtagctgaaagttcactacctttttttgttttctttataggagtcattcttagtgtattgtttaaaaccaaccttcttataaaatgaaagataagaaaccaaatcagaaatgtctaaaaaccatggtgtaatgtcttggtttcttcttgtaataataatcatcgcccttaattagcttatgcttctccagatgttgccgagaataaaatgagttgattttcatacatctcacattgtgtaaaaggtaaaattggacatttcacactgtcaagcatcatgctttgattttagaagaaaggaatcacatttgctcaataaagtgtaagcttccccgctttgaagtccttctgagagccatacggcctttcccattgcaggaatcttccttctcgttaaacatgtgctgttttccagtgaaatcgtgaaggcacacatctccattctgaacactaaaagagaccccattcctctctgtagaagcatttcctgtataaggaaacacaaagcgggtggcatgaagtatccacagaaagcattaaaaagcaaacaaacttagacattgctttattcttaaagatgtatttgtaaaatatgtttttaaaaacatttgtgatatatgttcatattttatttatttttcattacttccctaaggccactcaaagtaagcataccaaagtggagattgcttcagaaaccagttctctatggcagttttttttttgtttggtttttaatgaaacagtcaaaatctgaagcaaggtaatatattaataaaaggcccacttcctaactctggttggatatgttttgacttcaagtagcagcatatgtataatataagctaaggtaatactttggtctcccaaaaggttaatgttaacagagatccccatatgtacccttaggaagttcttggttccctaggttcctataaaatgaaactttgtaccagagaaaccagagcaaccagctacaacagtcatggcaagaagaaatcatctctcttgtagattaaaccagctcctctgactaaatcaggacaggacaaattcccaagaggaaactaccaattccaacttcagagtccaggccagggagcagctgggcactcaagggtaactgttggtttggacgtgggccttccccaccccaagcaggccctgagttataggggagcacaggtgctggcctcctctagttacttggcaccatccttctgatcattagaccattgggagactatacacaaagctgaataataagcccatttgatagttcatgacatgattatgataacaatgatcataacagtactgggacactttattatctcatttagagccctgcagggtgggtactactgttatccccattttgcagatgaggaaacgaaggtttcagaaattaagtgctctccccaaggtcacacagctcagaagtaatggagttgacgtgtgatgttgcttccaaactgtgatccttgtggtcctgggtaccaaatgagatggctgctggtaccccaccctctaaggcagctcagaactgaactgtgtaatattcatgcaaactaggtgatgaatatggttaacgtagctccatctgtgacacagatcaaatagggcatgtgactgtctgaggcagctgtttggatttaggcatttcggcttgaggacattttggtgcaagaacaatttggtctggcataataaatcattaaacttctagctttttttgttgttgttgagacggagtctcgttctgtcgcccatgctggagtgcagtggtgagatctaggctcactgcaacttctgtctcctgggttcaagcgattctcctgcctcagcttcctgagtagctgggactacaggtgtgtgccaccacgtctggttgattttcacattttttattagagatggagtttttccatgttggccaggctggtcttgaactcctgacctcaggtgatcctcctaacttagcctcccaaagtgctgggattacaggtgtgagccactgcgcccagccctagctttcttttttgaaattgccaattccattcctcatctatcccagatgctggggcaaggactgaggagtcaggaatggttatctgacatgcatattatgtgatattaaacactgagccattttggcagccttaaaatgtacccccatcctcaccgtcaagcatcaaaagtagctgtgtcaaatcagctgtgttaaacaactgtggtaaaatgtgctgtttccatgaaatctgatttcccaaaggatgacaacatgttgatagagctaggcaggtgaggcttcatctctgagctctttcgagaatatggacaaatctggtttatggattcagagccccagatgaccctgctcgctcctttgatgtctctcctttcaatttgctttctcacactaacgtactaaccagctgtgctccccgctgcctcgcctctgtttacctacattgaatcattcctgatagagctatttggtgtagagcccagagcttgctttctggtatcgacagtaaagagctaaggctatacaacagttatttctcatcttttacagcagtgattctcaactgggggcaatcttgctcccttcttctccccgctcccctgggacagttggcagtgtctggggacattttgggttgtcataactgggggcagggtgctactggctctagttgatagagtccagggatcctgctaaatgtcctgcaattccacaaaaaagaattatccagccccaaaatgtcaattgtgcttgaagttgagaaaccttgattttgaggcatcctatggtattttaaaagcctagacaggccgggcacagtggctcacacctgtaatcccagcactttgggaggctgaggcgggaggatcacttgagcccaggagtttgagaccaacctggacaacacagcaagactgcatcttaaaaaaaaaaaaaaattagccagccatggtggcatgctcctacagtcccagctactcgggtggctgaggtgggaggatcacttgagcctgggaggtcgaggctgcagtgaaccgtgatcataccactgaactccagcctgggcaataggagaccttgtcataaaaaaaaagaaaaaaaaaaaaaaaagtctagacacaccagcaggactgcccatcttcaggaaacgggaaaactggtagatgtatgaaccttctcacaaatttatttgagttagtcatgaaaagaactaacatcctaaaacaatgaatacaggcaaattctccatggaaggagaaactataccagcagagcttatgtttttataagaatgcaaaagatatattaagaagcaagagaaggtaaaaatagataaggtaagcttttatgagtaatgaacagcctggtcttatgaaagaaagaaaatgtaacagaagttttagctagaaatgtcagaattaatgagtaaaggaggcatggcagcaataatctgttcagatattggtcacatatatggtcaccaatactggtcacaagtcatcttccagtattttgacatattcatggggatttgggtgctgtcacaagacagccacattgtgggaaagaattaacaaacatgaaaagcaaaaaataggaaggtttaaaagtgttggctgggcgcggtggctcacacctgtaatcccagcactttgggaggccgaggtgggcaaatcacttgtggtcaggagctcgagactagcctggccaacatggtgaaacctgtctctactaaaaatacaaaaattagctgggcatcgtggcggtcacctgtaggtcacctgtaattccagctactcgggaggctgaggcagaattgctggaacccaggaggtggaggttgcagtgagctgagattgcaccattgcactccagcctgggcaacaagagtgagactccatctcaaaaaaaaaaaatgttgaacatgtatattatgatagatgtaataaaaattgctatagtcttatcagctattttaggtactgctctcacagaaatagcacaatactgaagtctttggacaatagttaagtgaggatttaaaatgttaaaatttttaggtcatcatcaattcccactatgaaaaaccaaatcttaaaaaatcgttgttccagtatttgctctataataaatcaatttggattagtaaactttctcttctgtaagggaaccacattttgatccactagtcatatatgtattaatagttactcactttgcttagccaaaatgccaataaaggataaaactattttaaaaaataaacactagcttgagaaatactatattgagacatacataccattcccgcttgcgtgtactgagcaatcattattcactagcagtgtggtggagttagtggagttactgcttgactgtaaggaatttgaagagctggacactccttggtttacagtctgcttctttaaaccattagtagcagttttactccagtctacagcagaataagcattacagaaaaacagggcagtatgttgaagctcaaacgcaagagacagatcacagtgtaacaagtcctaagcaactgatttctcacttcaggatcttatggagaagtcaccttccaccagttggtgtgataacatgtattttcatttggattatttacatttgtccttcaaatgactgtggggttaaaagtaacctatattctcctagaactaaaggccaagctaatttgattatgtctataaatatccatagaattaggtagtgattcagagcctcacactgtcttaacaagaacacaaatagtctgtgttgtaatgactaattgttcttcactccatgaaaatgattgaactatgtgtactgccattttctgaatacagactcccgtgtcgcccagatactgcaaaggtggtattcatgcaaaaggaatgtagcttttcaaacagtacttcatttttctcattttcttaaaaaaaaaaaatgagctatttgctctactacccaaccgggtatatgtgaaaatcacttcaaaataaacaaatgtatgttacaaccaaatgtatgctaaagcttatacacaaagtctggcttactaacaaataaagcaactgacaaccaggacctgtggagaaaggattgagttgagattttaaaaattaccaaggtaaatattaaaaattactttgggaaatgaaaagcataatctcaatagaaaatcaattctaaaaattttactgttgcttcattgaagaggcagccagcccatcaattttattgctcaaaaaattcccagatagaaataattattttttaattcactagatttttttttctccctaatgttcacgatcaatattttctgttgagcaaattccagatttgctggaattcactgatttctagattggatttgctttggatcttaatttatacaatcttttccttgagatttaagaggaagagaaaaagtgaggtaaatctttaccagaattttcagccagccgtaactttccacaacaaagataccgcctccattgcttcctgacattttctttggccacacagtaaaagatgaatatgaaaaatcctaaggagggaaaaaaaacccacaatgaattccaagctaatagctgaatgtcataagctcactttgcacaaaagatattaataattattttggcagctgtgggcaacatgaaattttgcaaattgaataaaaagttcagagtcctaggaaagcttgctgtcaaaaggcatcggggaatgaatgcctttagaaaatctttgtaagattaagaatatttatatgataaaaggaatcataactttgcatttccacaattaaattcactgtctcctcccacatcctgtccttggccttccgtatcttggaattacaagccatccacccaggatcccagcttggacttaggctcctgcctctccctccctccctatttagaatccgtttccaagctctgtcaaatgccatctcctccacacatctttcccttcccactctcctcctctccagcccactgccatgtcctttgcttggatctctctctccccctcaaacccaggcagtacagcaatgcactcacctacctgcctgcctcctcctgacctgccccaggtgctggcatggagagcaagctgaagacctgaaggggccctgggactccacctctcacccactcaggtgcccagtcaaggcaggccagggctccccagccagccccatggctgccactccccaaggcttttgccaataaatatttgctgagtgaatggatgaattctgggttctctgctttctacttaaaaacccccaatctattcactttaaaaccttcattttaagataccaggggccaggcgtggtggtggctcacgcctgtaatctcagcactttaggagggtgaagtgggaggatcacttgaacccgggaggcggaggttgcagtgagccgagatcgctccactgcactccagcctgggtgacagagcgagactccatctcaaaaaacaaacaaacaaaacagttttgcttctagtagggtatatgtgcccaccgtcaagacccatgtctgaatattacacagcttcattcatttgtcaccctggaagtcgaccattggttgcattaggagagaaacagcatgtataagagaggccaaaatcagaagatatatatatattcaaccaccccaaaagccctgtgcattagggttagtttccttgtatagatgaaacaatacattcattccttttatccattcatattctaatgagaagataatctggggaaatgaagaaaaaggcagattcagtttccacattaaacatgtgagggtgggtaccttgctttcatgtcaatgattagtgtaatgtgggcatatatatatgttttttcttttaaagtatctattactttcagtattgccgtggttggcaaataaaacttttcttaagacccttaaaaagaatttgctcatgtttttggttttgtatgtaataccatgcggtgtaacacctggatataccaattgaggaaccgctatattataagtaaaaattaataaccatatataaccaaacaagcatctctgctggcttcctccaaattaaaataagaaccaacaaccaaattcggcatttgaatttaacctcaggttgggatttctctgaaaaccaacaagatgatctattgcctgatagaactagagaaggacaatatgggagcaaaagcaacaggaaagatgaacaaaagccaatgagaaggcaattaaaaggcatccccaaaagaggattcagaataaaaggaaactaagggacagtgaattattgttattgtaatgtaaacctaatagcctgctgggcttttaatgccaaagcacttccattaaaaattaacagcagacacgtctttcataacactgctctaaaagaattagtcattttcctttctaaagagtacaactatcagggttccaagatgcatgggcttcattaaccaatgggaaacctaaagcagatggcgacacacagagcctgctctctttcccgctgagtgtcccagggcagcaacttcttgggattagccttcaagtaagactgctgccacttgggtctgtctgttgccttcccatttctcattgtctccaaatcgctgacctaggaggggagagtggtgagctcccacaggcacagtcatggtatgtgtgcttacagtctgcatgttctacttgaatacaaaagtttttttttttaaaagaaaccaagtgaaggaagaataattgactttttcaaaaagtgttcctggcaggttcccctcaatatggtctctccaaggagacaactatgaataaggagaaaaaaacaccatttcttgaatttagtaagcacctttcctccaaggatctcaaagcactccctctcaataataaatatgtttttcaatgaaaatatcataagccactaaataagctactttgcatatacaagcatacctcatggggtttcacagatagtacttttttttttttttttttttttttacaaattgaaggttgtggcagccctgcgtccagcaagtctctcaaggccatttttccaacagcatgtactcaccttgtgtctctgtatcagcagtttttagcaataaaatatttttaagttaaagtatgtacatttgtttagacatcatgcaattgcacacttaatagactatagtctagtgtaaacacaacttttatatgcactgggaaacaacaatttgtgtgactcactttattgcaatatttgctttattgtagtggtctagaaccaaacccccaacatctctgaggcatgcctgtactcttttagtagctacatttttatattcaactgggatcattcagtttgtatttgatgctgtaaagcttaccttgtaaggtattaaagatggcaaacagatacatgaaggtcacgttaactggtccccaggcaaagaaggcaaagccccaagttattcccagtaaaaatgtaaggccagcgatactcctgaggtcttgaatactggtttttcgctgggctcccagttgcttcttctttttaattcgacagagctgaaccaggaccacaatgaacatgctgacgttcagcaaaaatatcacacagaaatatcccaccaccgtaatgtagaatactgcattgttgttgatccagcagctggagtttgtggagggggggaaacaggggaaaacatattatagtaatgaactagagttcaaaatgatacaatgaatctctaacattttactgaaacattttctaccagtacaagagaaaaaaaatgataaaactgctattctctacaaccatttatagctctagggaaaataatctaagagtttatttgaggacacttggtgatttaaagtattttaaaaatagacctttttttaaacattcaggattttgcccctgtaaatcctagcaactctgttctatgagtctttattaatataactggaatgtcattttatcagaggctaatgaaaatattttcaaaatagttcttcctaattcatttttcttttcagaatagctcctaattcatcacttgaagagtagcatggcatttccagctagcttctctcattacatatgactgtgaaggctgctgtgaagtattgctgggttttattaggatgatagcaggagtcaatatgctgattagatcctccgttttctaggagcattccgttttccagttcacttagcattcccttagggggctttgtactcacaagtcatccggtgaaccattggggaatttcccataggatccaagcccatagttatctggggatatagtcaggatgatggtcacaaccacagctggtacccctggaagatgggaaacattggtcacacctaattttttttttttttttttttgagacggattcttgctctgtcacccaggctggagtgcagtggtgcgatctcggctcactgcaacctccgcctcctgggttcaagtgattctcctgcctcagcctccctagtagctgggattacaggcgcgtgccaccatgcctggctaatttttgttttgtatttttcgtagagacggggtttcaccatgttagccaggatggtctcgatctcctgacctcgtgatctgcccgcctcggtctcccaaagtgctgggattgcaggcgtgagccaccgcacccggctggtcacacctagttctaataaccaaagtgggtgacaagactagagatcacatcctatttacatcttgtagcagagactggctagctgttcaccaggctggtttcttttcctctttggcacatgactggatgctcccagcctcccaggcagctgggtgtgtgtggccacatggctcactttgggcccatgggatacgggcacaagtgatttgctccacttccaggcctgccccatagaaacctcctgtgagatcctctactttctttttgcctgcaaacttagggcaaccttgaggcagagtcttcaatagcttggatccctgaataactgcaagaccagggactcctctgcccctgctaactagactgtaggtgagtgagaaatgatcttctactgagatttcaaggtgaatctgttacagctgccagtgttgcctttaactccccaccccccacccggcccccctctgtcacccaggctagagtgcagtggcacaatctcggctcactgcaacctccgcctccgcctcccgggttcaagcgattcttgtgcctcagcctcccaagtagctgggattacaggtgtgcaccaccacacctggctaatttttgtatttttagtagagacggggtttcaccatgttggctaggctggtctcgaactcctgacctcaggtgatccgcccacctcggcctcccaaagtgctgggattacaggcatgagccactgcacccagcgttgtgcctttaacttatacatgtctggaatgtatatttaagagtcagcaactcctggcaaatctttcattatgaaaccaaaagtcctcaatttgaagactttgagacccagtgaaggatggagggttctgtcctggctgatccagggggtggtgactgctactatgctggctctgttgagagcccacggacacttcccttcagagaaggtaccatgagaagggtcccccaagtttaaaatggcttttggtggggaaagaatcctattcaccactgcacaccatcacccgccagccccatgccaccgccccacactctgcacactgaccagcagacgtcctatctcaaggctctggtaaagaacaaacaattccttgtcacagaccagttgcagtgcctggtaaaatcaaatctaatagttcatttaatgcctttgcgcttgtaccttctggtgaccctgacatatgataattttctaagtgagacactttgttaaaaataaaacattgggggtgggggcctcatacttaagaaaggaatctgactttcagccttctctaaagaagacagaatccgtgcccagtatctggagcgttgacttatgtttctgggacaaacagggaaagggtgttgttctgttgttcttcacaaagacatagtgacataagatagaaggcagggtggcaagggtggtggtgtgctttcaatcttgatgtgtaggaatatttagcctgaaaatagaggcagtctggttggggggatggcagaaggctgcatataaggagacggagagccaggcttgctgttttctagctttgtgaattggggggatatcacatcatcacttggagccagtttcttcacctacatttgggatgactgcctggctcacctcactggcttatcttgcatggggtcacttgtgtgaaaaacaggggattatacacactgttatatattacttgtagattatctaaaggactctctggcagaagaggtatcaacttactgttttctgcctgagcaaaaccactggtaagtgccaccagggagccaactgaacttaatggaaaatcagaactgtagagctttataaaatggttattggctgccttgtaaggtcatgaactccccagtaatagaagtattcaagcagaagttagattatctttagtcaaggataagtcaggtggagttgagggttgaagaggctcctgcattgggtgggaaattgaatgaagaaatcttcaacatatttggggagcctaaggccttgcgacctgccaccaataggctgcacaatctgaaatgtcatgcccacgtggcagtgaagttacaatgggttttatatgtacattctctcactctgcccttcttagcatactgtcatacgtgtctgatatctgggaggtacaaagtagaatgaggctggctgggagctcagggactgagagtttgggctctttaccaccaagctaatgttttcaatatattaccaccccaagctaatgttttcaatatattgagcaccttctgtgccagccccaaattctagttcctggagatacaaagaggattcatggttcaaccttgaggaattccatattcataacaaatccaaagaaataaacaggtgtcctagaaggagacttgacaaagttgctcttcgggcagtgcacatgtaagagtataaagctgttttagaaacttgctgaatgtgatctgcttcatcgtttccacctgctcaaaaatcaaaacactagagaaaaggcagagaaagtccaggcaacatgcaggcaagcttatacataccccaaccgacaatgcagaatttaaggatgtattttcggatgtaagtattaaatactttgacaagggccaggtacatatggaatgcttctaggcccatccatgtgaatgagaccaagagaaaataatgaagaaatacagccactgagatgcagaggccttgcatcttatacagagcaatccacgagtccaggaggaagaccaggttcagcagaagcagagcagcacacagctggatgaggattttggaagggtaatccctccggatctttctaaaaggaaaggatgagaacaagaatgagcattctactctgccaaccctccaacttttttttggtttaagataaggtctggctctgtcacccaggctggagtgcagtagcgtgatctcaggtcactgcaacctctgcctcctgggctcaagcgatcttcccacctcagtctcctgagtggctgggactacaggcgctctctaccacacccttattttttttgtagagacacggtttcgccatgttgcctaggctggcctcaaactcctgggctcaagcaatcctgctgccctggcttcccaaagtgttgggattacaggcatgagttaccacacctagcaccaacccttatgtaagcatatctgtcaggctctttgagttttaagcaatttatttttattctttggtaaatgtctatatgcataaatttcctctgtttgagtatatgtgtatatggggtgggggggagcttaaaaccaacaacaacaaaggaaaaatctaaacagaatcatctgtgataaccataaggagaatttgtgtctgtatttctgtgggaccttttacatgctgactgttgacgcatacttttaaatagtttgtagtagactctactaagcactcgccctatttctcccagactactttcggaagcattggtgctgcttctcatggagtctgctatattcagatcttcaaaatttaaccaagattcccatattattgtatgttattaggtaaaatgagatcatggaaagaagagtttaaactacagctaaatgtaatagcataggagaagccagctaattgatgacatgttcatgtttatgcatgcaaaattagatccgatgaaatcattctgagtaatggctggccttctggttatttagtctcactaataatatttccaaaggctcactagaagatccgtagtcacagctagaccctaactttggcactgaaaataaatttttacatttcctgatcagtgtccaaaatctaaatccaagaacctacatattgtttcgattcgttaatgcaataaaaatgcccatgtccttcttttccattagaatttgttggaattacccccaaaaagcaaccaaagggacctgtctggtaagccaagaaggaaaggctgttttttagaatggcattcttgctgcagagctacactcactgaatatctatttttttcagtaaagcttttacatccttatttctctccatccccacaccagttaatgtatttaatcttttgtgtttgctcagtataatttagaaatgtaatttattaaacatagttcttatgctgtacatggtgctgtggtctatttcagatggtaagtctctgggttttggggcctgcatccctcattcatttcacactttatgtctatcaggtactgggtgtcattctggggcaccaagatgattctgacacaacccctgccttcagggagtccacagactagtgtgaggacacaagcatataaaccaacaagtcccataaagttgatacatggatgctccactagctgggtgtacagggtaaggcaggccgaggaaagggcttagttaataaatgttggcaatggaggtgagtgctgagtcctaaatccaaatttccggttgtggatactcactcaaaagctatgtaggttacaagagtcactgacagaaaaattgatgaaagcccacaaccaatatatgtaatgaacgtcagagccatcatttgagcaggcagcacagatgtcctagataggtcctg

SEQ ID NO: 2954 - DNA, 1018 bp, Homo sapiens
aagtaaggactacccttaggagctgcccgctttgggtctcctctctgctgagctgttctgctactcagtaaaacttctccaccttgctcaccttccagttgtccacgtaacctcattcttcctggacaaaggaccagaattcgggacccacccaacagtgggcatgaaaagggctgcaacactttcctggccaactcaccaaactgtggtggtgacatgctcccatttgctggactgcaggagtgaaaagcagtgacacttctgggggccgagacatcaggatttcccaagccagggctgtaacactatagccttcctgccttctgcctgcattgggcagctgccccatgtgacaggaagtggcagtggagctgggccagcctgggagccgccggctggggtgaggtggtgggactgaacaagctgaaacctgctccccctgctcgccgagccgcgggtggagagaatgagagagcacgcctgacccactccttgaggctctgcagttgctggcgtccccaagtttttaggtgccaccgcatcccccttttccagacaccagcacctgcaccagaaactacgtgtggtacgcctgctccagctgcagcctggcaaggagccggcacctctgccagcacccagagctgcctgccccaccacagctggccggaccctgtgttagctctctcacacacccttcagtgctctgagcctggtttgccctcatcaggcgtgggatccgggttgggcgaactgagtgcagcctgccgggctgagtgggtggaacgagcacagtgggagtgagtgaaactcaagcaggggcgccacaggccacaatggttcccggctggcagagtgacacctgaaggatcccgtgacatttcgattatttctgctcatagcataaactcttatatgattatgatattgtacttatagagctttgaagaggataaaatgaaataaaatgggaaaacactcagtgaaatgcctcatatgtaattaccatgtaacggtt

SEQ ID NO: 2955 - DNA, 587 bp, Homo sapiens
gcatcggcttgccccgcactgtggtgggatgtaaagtgataacagctaaacgacgcatgcacaacatgtcctggtgccttctgcgtgaccccagagcagcaggttctgcacatggcaggtaagagcacagctgccaagaccccaagcctagttctgctgctacaagctgctgcgtgacttaaggagatacttgagagggaccatgcccggctgaagccccgtctcgtgtggaagaatgtcatctccagtgtctgctgcctcctccctgcaaagtctcccacaagcacaggacaaggggtgcttccaccatctcctaggagctgatgacatgtccagaccaggtctcatgcttggtgcctggtgccaggtgagtgatgacgacctccacggcctgcagcttctcattcttgggtgggatggagcacattttataggtgacctcgtcgccttccactgggacatactccccttccacactacgggggcataaataaagcagtcagggctcacaccgggacacagctcccttccccaagacaccagccacccttctggtcacacagccaccaaagcaggcaccatctgac

SEQ ID NO: 2956 - DNA, 904 bp, Homo sapiens
gcctttcctgggagcaggttttgaaagcaatgagggcccgggatgatagaaggggaagcttcacacagcaagaaaagggctctgagatgccaggccagggctggggaaggcaagctgggcactgagtgtgtgacctttcaggtggcatcactcttgagtgctgacccggctcttgcacaatgctgcccataagaagccaggtcgcaaaggtaaagtttaaactcccttttccaggtgcagtcctgagaaaggggttacttttttgttgtgttcattttggtgtagaatggatttagcagcgtggagatgccctttgagcacattctgcttggcgctggtgactgagtggtccggaaagggtcctgaagaagaagctttttttttttctgggtggggggtggtggatgcatattgaggtgcagcaagcgtggtggagagaaagacaggaaaaggccaagggcagtgtggtcaggcccagctggcgcggggcagagagtgaactgcttgaggaggagcatcgccccacctctgatgatgtgttggccggcagggaacgcagaacgctctggcaccttcaacagacttgccccttggggagctctggagacagccacagcagcgcccctggagacccccggctgaagggacagcagcgagaggcctccccacaaggagcctgacagcggctggactgaagactgtgagggagctgagccacagtgcatccaagctgctccaggatctggagtattacggaccacgagagatgcagaaatggagcacaggcggtgagccaaggacacccgaggtacgagctcttgcccttctccttccctgccctctgctgcctggagatacggcagcccagcaccagccccccagctgcttccagtggaaaaatgct

SEQ ID NO: 2957 - DNA, 6547 bp, Homo sapiens
gagcaatgtcctgggaggcctggctgagcttgtgtccaggagcactggacttgtgttaaacactgtccccttggatgggcccagaagtcaaacctgtccattagattttttttttttttcctttgggagagctggtatgggctggttgtcctccaggagagccctgttctcacccgaggtctgttaatgagctggggacaggtgagcctcacacgttccaacttggctgccttcagcggcatccaggagcagtggtgagctattaatggaaggtgccggctttgtgctaattagaacttcctttcagcttccatctgtgcagacactggagcccctcactggtcagcctcgccgtcccaacccccctcagtttgcaacctagtttttgtcccccccaccccccatgaattagggggtgctatgagtggagctgctttcctctagctctggtcaaatcccggctctttgtgtattgcagaactgtactgggtggtatttctcagggcttctctctcttgttggggtggagatggacctggaagatggagttggaaagggatttgggcaccatggccaccctcctgggtaggctggacttacatcatcgacctgagtttgttttgtgaaagacctctctcctctgccctctggagactgtgacttcagacccttgtcctctccattaccccagtcctgatgtctcccaagtctgatggtacccacccatgtcaactacagctgccatctttgccatctcaggcagcctacaggtgggggctgtgtccttgaccctcttctgaaaaagaaaaacctatttttttccttcacttttgctttttatttctttcacctcaggcccaatggatatatatatatatatatatatatatacatatatatatatacatatatacatatatatatatatatatatatatatattttaatggaggttgtctcttacagaggtttcattgaaaaagaagaaacaatgtcccattaacgtcatttaaagaaaaagcacctctcagaatggaggttgggaaagctagggtttcttgcctgaatatcagttgggatgaaatcccttgtaaggaactcaagagaggagcgtttcctcagaatgctttctttagctcctgagtctccttaggtctccactggggttgtgtgtaaaaataccaagccctccctgacaatgcatctcattctcttctgcttgaattatcctgataatgagagatcacccacttctttgacagtgtagactaggattttaaaaattgggagtgaattattggacagtgtggcacttcaccagcttccctcaaggttctggatctatgctaaagaggggtggaaatgcttctggggtgtccagaagggctgcagaaattcctcgtcactggtcatggggagagcaggactggcttgcctctgtggcctcttctgcctctggaggtgacaattcctgatttgaggcactagggtggaagactcaggactatccaggaccaggttaataaaccggcagtccagattgcagaagggcagcagctgggggctggggacatgcccatgcctgtgggacagagttcttttgcatgctttggcctttacgactctgtatccttgacaagtcacaggcatctctgggtgaaatggggacaatagtacccatacctccaagggttatgtgagaattaagtaaaatatgcaaataaagtgcctggcatacagtaggcactgagcaaacggtagctcttttttccaggctggggcaagggatgcatataaatgtctggatctgaagtttgaaattccacctgctggagacagtgaacaccccagtagataccccaaatcacacagaaggacggatgaccagctgccttcttcccccagggcatgccatacacactgggcctgaagtgggagaatcgggaccccaaaaaaacggcttgtggagcggggttgcacatgggtgtaaagttcccagcttggctgcctggggagggggagcatgtaaatgtctttagagatttgaagggaccaggatctggactgatttgcgttgcccagggggctggggctgggagccaagggggtgctgccgggaggcccaggttagcttggggtatggcatttctaacagttggcgcctgcggaaaatggcctggggttccagctctggaaggttccgaatctcagtattcacgagcggcgctgtccggagcagccagggttgtcccttggtggtctcgggcaggttctccgcgatgcgcttgctgggtcgcaggtgagaacctcacggttctccatttccggagatccagctctgagcaggcagagggtcgctcccgtcgcctgcccctgcggtagccaagcgggtggctggaagcgtggctagctggcaggtaaggagctccaggtgagacggaacacgacccccaacccccttagccggtgccccacccgatttctctcctgcgtcctgggagggcatggttgaggcgccaccggtgcccagcaacctccccaggctgtggttgtgacctgaggacgcgtgtgtccccgccctcaggccaccgctacgcgaccctgagtgcaccttcaagaaggccgggcacgtttctgggcgggcgtggggggtgcctgatatctccgctctattttacagttactcccctgctggtgcctccctccttggcgcgcttcccacctgcgatcggcgccctcttcgcagtcacgaactcgccagcagctagcagcactgactagtaggagggcccgccggaggagaggacatgctctggagtcagaagacagcgaaaagagaagcagaagccccggtggcaagagtctgaaggaaggatgactgtagcctgtggattgtactgcagtaggaaactgtcctagcaaggctccactttgccccagcttcaagctggaaaggaggagaacatgaaacattgcttgaagacaatggccgagacagcaggtcccaccctgcacagccaccagcatctctcccctcagccctgtctcctcttctgcagttgggatctgcacatttaagcctgaaattgtcctgtgaagtgaagtatgatcggacagcctcttttcagcttttatgacaatggagacagaggaattgtggctcttgccaaggtcacaggattggaatacagagccaagccaccccaggacatgcaagagcctcagaagggaaaaaagcccagcaggaagggagaacaagtagcctctgtcctgaagttgtaacagccaggggccaggatggaggaggaggaccccataatctgcccatctgggacttggcaggggacctgggaaaatgtaccccaacccatcccttaagggcctttgtctttggcccattggcctagcatctacttcttcaccgtgtctgttcttgtcacacctagtcaggtctgtttgggtctgaggtgcatggaacattctgggtaggcctccagcaaacggaagctcttcaccgtgtttccagcctgggaccaagggcagcatactggcaaagttgccaaagcaagggactccagcctcttaggagttaatgactccctctccccagctgtcctccccttggtgctcctcttcctccctcctcctgctcacagcaggcagggcctagacccgggagccatgctgctgtgctgttgccaggggagcacggaggcagatctgagctatgcagggaaaaggcccagcctgtcaaagtgtctgagatgaaccgccgccgtccctgtgcagctgggctcagacgtgtctcagctcttgttctgtgcctgagaatggcgaaacccagtgaggttcaagggcaaactcgctattcattagtcaggggttcttgacgtcccgtctctcccagggatgagttcccccctcctctttctccccctcctatgacacattcctgggtgcctttggtgaggactgcacaccctcctcctgcctagccccctctccaaaggcccctgaataaactccccccaaggagaccaggcagggcagagacaatggctgcaggaaatcattcaggcgggacatgctggcctgccctccacccagtccccctgtgggccccactcccttctgattcagggcacccttgggcccccagcctatacaggcctggacaggaagaaaccactgggaaccaccctaaggacaacatgctagtccagtgccattcttcgctggctctgtgggtgcctttgtggcctgtaccgactggctggctaattttgtggtttctgtaccatcacatgcctattttaagacactctccagcactgtcggttagggagtgtaaattttgcaatattttctgaaatgtggcaatatcaaaatgtaaaaggcacacatacttggtcacaaacaaatggcactatttactctgtgggcatatttgtaaaagttgccaaagaattatatacaaggatgttcatcagagcatttcttttgaagagtaaagaaatggacatgaacctgtggtccgttcatacggtggaatacctatgcagctgtaaaaatcagtgtggtagatctccgtatatgagttgatgtggaaggttggccagttcacatgataaggtgaatagaataagttacagaacaggctgtagagtatgatcttatttgtagatgtttaaaactgagtcataagtatgcttatatacagatcgtttctggaagtatgtactggaagtctacctctggggagtggggatgggggagtgcactcttctatactgttatattttcttttcatgctcctaaggtacttttattggaagatgtaaagcggttcaatgtaataggcttaacttctgtcaactaagttggcgtgggtgctttaagagggtggtagtgatgttgctggagaaagtatcccacagtcactggtggcttcagccacgggccattttggggcctaataatcacatatcatcatggttgctagtgttaatcgaaaacctactaagtgccaggcttactgtctctgggtcttgcttacgtggatgtcatttttccagttgcaccaaatcgaaagaggttaattggtttgttggagttcctttgtaggtgaagggcagagccaggagcttggctagggacaggggaggtgagtgggggatggtggataggtcttggctcccagtttccttctgggcagacattgcccctctgccctgaggacctgcttgtttgggggaagaggcctttagaggcaccagggtcatgccaggtgttggacatggtgaactgggaagtgctcccatctggccacagcgcagaagtatcaccgtgctgggggatggggaacagggctgtgaatgggcctatttgcataagcagcatgtgtctggagagaaagacatcacagagcagaagagtgcgggtgcccaggagtgcacttgccacccctacttcatccctgaaagagtaaatggcctggaaggtgtctctgagaggtaatgccgcacaccaccctccctgggggcagggtcaggctacacctgccttaggtcgggggctgcagcagcctgagagctctcagtagggcctcagtagcctgggagggagcaggggcagggggcagggaaagaggcgtaatggggctgtccagaggggcctgggaaacctggtccctgaggcctgggcacagctacaatcacttcaaattggctgtggggccagtggactgggaaggaaaaaagcaataagagtgaccaagtgcagaaggctgtcaggtcccaggtcacatgccttagtgcagtgactcctcatcattttatggggtgtgggtgtcgttggtacacccattttacagatgaggacaccgaggcccagaaaagttaagttacatgtcctaagtcacacagcttgtaagtgccagaactgagatcaaaaccaagtctctttgactttaaagtctgtactctgaccccaaagagatcctgtttggccacttataggaggtccctaaagctgcagactccccttgccggcacccacatatagagacattaacccttcccctgcagggtcacctcaaatagtcttttagctgggcttctcctgcaattccacctaatgccatcccctgggttttgcccaaacctgaactgggcagtggggtgagaggaggggtttacagggttacagagcctcatacagataggagcccatggctgctggtcatctgcattcctgcaggattggctgttccttggggtccttggcaggaaaatgaggattgctccgaggcctgctccagtacttcccagaggctggcctggtgtggggctctgggaaggctgaggctggagaagcgtaagtaggagggcagagatggcactcaggtagcttgaatcaccaggacccttccaagccccacaggttctgagggagtactagggccagctctgggagaggtctcttcctatgctgtgaaccccctgcctttcttgcagcctacaacgaataaattttctttgcaaaggct

SEQ ID NO: 2958 - DNA, 1159 bp, Homo sapiens
gccaccgtacccggccatagagcagcctcttccttttcctgttgggtctctgctcaaatgtcatgtcagagaggcagacctctggggcggtctatctgagggaatgcacccatctcccttcctctgaccagttagttaccttgcttattctttcaaagctcttaccaccacctgaagtcatctatctggtttggttattttattgtttagtagcagtctttattttattatcattattattttttgatggagtctcactctgttgcccaggctggagtgcagtagcatgatctcggctcaccagaacctctgcctcccaggttcaagcgattctcctgccttagcttcctgagtagctgggactacaggcacgtgccaccatgcccagctgatttttgtacttttagtagaaacggggtttcactatgttggctggtcttgaactcctgacatcaagtgatccgcccacctcggcctcccaaagtactgggattacaggcatgagccaccacgccaggctggtagcagtctttcctagaatgtggatgccttggaaaacaggggctctgccttgtttccctagaacctagaatggcatctggcacacagcagatgctacatctattgtaaatgaatgaatgaaagaagtgtccttgcagccacactggcagccgtaacatagtggttataaatctagactctggagtctcaagtgcaaatgtcattggcctctcctccagcctcctcaaggggcactcaatgactggaagtgccctgatatgactgtggttggactgacatgactgccagatggtgggacttggtctggagcagagactacttggaatggtagaggcaaaactcaacagcccctggagctgcgcttgtggtggagctggaccctgattttagctggaccttgtttttagagacagggtttccttctgcagtctcaatctcctagccttgattgatcctcctgccttggcctcccaaagtgctgggactacaggtgcatgcaaccacacctggctaattttcttctcttctttcttttcttttttttttttttgatggagtcttgttctgttgcccaggctggagtgcaatggtgccatctcggctcactgcaacctctgcctcccgggttcaatccatt

SEQ ID NO: 2959 - DNA, 16691 bp, Homo sapiens
gtagctctgcacaggacagggtggagaggagcctggagatcaagatgaagggagaaggccggacgatgagaggggagtgaaccctgggcgtaatggttccacaccaagagaagttctgaaggtcaaggtccagaagccaagattcagctgggcaggctgcatctctacaaggcagcctcagatgttcattgtcaaatggatgaactgggaagagagagagagagatgaggggtcgttgtccttccatgtcccttccagcctcagcctcaggagtggccccagtttgctgatatcacaggagatctgctatttgatcattttgcctgccaacttggatgtctgtctcagcaggaaaccatttaaagaaaataaatgaattctcagcacttgacattttctggaggacctgagtcctttccaagtgagctcatatcaagcacagttggtaagacagagacgggaaaatgtgctttctccctgttaagaggacagcctcgctgaagcatcttgggcagggcagtattaagtgacttttccttgttgatgaggggtcctctcacctttgggagagaggtggccctccaccctggaggggctgcaggaagtggaagcaggttccatagctggggggtgttacaagtgagctgaaggagaagtagcatggaattcctcctcattttctctcccgagtccaccctgcctcctccttcccaacagcttgtttattacagcatggtgacttggggcaacgtgattatatgagatggtttttttctcccttctctgtcctccttcctgggcacagtgtatatagtatgagagctactgtaatgaaaggtgcacaggcctttttaggaaagtgattgcaggtgaggccaactcagccaggaaaatctcctgttgcttcctaggatgggtcaggggaaaaggagagggactttaaaacatggatacttcagacctggctgcacactggactcaccaaggggattaaagaaaaacaatgcttgggcctcacctccagagattcagatttaattgatctagggagtggctggggtatcaggatttttaaatctccccaggtgatgctaacatgcagccagatgtaaagatggtaggtttagagggagagaatgcaatggttttcactgttgtactgcagggtgatgatatggggcagggcaggagcctattccagcccctacacctgtggacacttgcgttagaggtgtccacacttctaccttgaagctgcagcactggaatacttcctccacactgctggtgctctggagcctttgactagccagggggccgctgagtaacaaaccttcccactgtctccttccaccatggaccaggggcagccatcacacttcctcatgttttttagtgacattacttatcatttaccttaaagtaaatgataaataaaggtggacctaggggtctctcttgtttttcctttctttctttctttctttctttctttctttctttctttctttctttctttctttctttctttctttctttcttctttctttcttatttttctttcttttctttcttttccttctttccttctttcttttgatggagtctcactctgtcgcccaggctggagtgcagtggcacaatcttggctcactgtaagctccacctcccgggttcatgccattctcctgcctcagcctcccgagtagctgggactacaggcgcccgccaccatgccaggctaattttttgtatttttagtagagatggggtttcaccgtgttagccaggatggtctcgatctcctgacctcgtgattcacccgcctcagcctcccagagtgctgggattacaaattcctttcttttttaagagacagggtcttgctatcactctcttccaggctggagtgcagtggcgagatcatagctcactgcatgctcaaacccctggcctcaagcaatcctcccgcctaggcctcccaaatagctgggactgcaggtgcacaccaccatgcccagcttcctcttattttcataaaagaataatttgtgtgtgcacatctttctttggaatcttggattgatcaaaggaggtatagttattacatgtgtcctacatgctgaagttgaaagacaaaactagagaagaaaaatgcctagtttctgtgggagtgattataacaaaatagctaatatttttgagatactatttatgaagtaatcaattaagccattacaataattctgtgagctaagtaccaatagtatccccatttggctcaccgtaataatacgtaattggctcaatgaaataataatgcgtccagggatctgagatacacacttgagaaaattagtggtgagtcaacataattgccaaattatatgatattattataaagcaaagctttgggtgtaatattaaggcctatgtctctttctgtaaatggttaaactgaggcaccgagcagcctgcttaatcgaaatcagagcacaaaagaggggaggaggtacaatcctctaaaacacatactgtcatcaacctcttcatcttgaaatattcaattaaatgttatccaaacccaaagttactaatgaatttggaaatgagctggctgtgactgtgagtatggaaattggtggagaggagaaactccagagactggggaggagccacaggctgcctggcttcagagttgttaggtagaagagaaagcagacctggaaagaaagatacagggagggaaagaaggaaaagggagataaaaattacagaaccattgaaggaaactgctccacagtttcccctctgcctttgggcaggagaatgtctcaagagcgttcccaagcttcatgtgcacaggaatcagtggggtcctgtgaaagacgacttccattcagcaggtctggggcagggcctggcactctgcatttccaacgctctctcctaagtgatgcctatgctgctgctggcccatggacctccctgtgagcagatgggtccactgggatcctctggggagagggtgattgaaaccccctggaatccttctcccatacctctgacactcagacccatggtctcccacccccgtcattgctacaatggccccggtaactggccagttttgtacttattggagtctgggggagtgtcatgggaaccacgggacaacatgagcaagggagagtgagcaaactggcagctggaaggcaggcaggctaagttacccaaatgacagaaggaagagaaggacaagaaggcagagtctgctcactcactcaagtcaaggtgattaatctctctatgcctcagtttccaccctgcaaaatggggatactattggtacttagctcacagaattattgtaatggcttaattgattacttgataaatagtatctcaaaaatattagctattttgttataatcactcccacagctagatgtcagcccttgcatgaaatcaagcattcggcaaacatctatgcagcgtggactctgctgggccccagctgggtccctgagcagagggtctggattggccatacctcatttatattgagatgaatgaactccttgttctttgtactgagagcctggaacacccctgataggagagaagggggaaaggcatccttttaaagacaattcctttaccaagtttgtttcccagcgaccaaagggccttccagtggagcctgtggggaagctgctccatctggtggtaaacaaggactttcatcaagggcggcgatgggactctcatcaagggcgggctgaaggtgaacttctctgaacggatggaggcatccagtcctgtagcaagccagtggtcacctaagccagtcagccggccagcagctcctggagccaaagcaacgcccctatcttaaccttctggggggtacagggcccttgaaatccataggccccagaaaaaaagcacacgcacgtaaagttttgcatgaatctgaaagttgttagtctcgcccttgtaggaaggtgccgtgggtgctgtcagaggacagagtggcacaggagagcgtgccagcactgagctgggggctgggtctaccgcatggtgtagtgacctgagtgcacctgagcaagtcactgccctcttggggcctcagcctcctcaccttcagaagacgaggtcgagccaatcagccctggcttcacttgagaatctctcgggtagctttaataatacaacccaaagcggggtgggggaccatcactggacacaagaaatggaagagacccaacaaccaaacatggtgactgggtcttgtgtggatcctgagtcaaccaagcaactgtaaaaaggtggcctggaagacttgggcatgaaccgggcactagagaatgttgagggtttgctgagaatttcgttaggtgtgcaaatggtatgaagatgatgctaaaaacaagtctatcagctggagatactcagatgaatggacagagtttctgagatctgctattaaattatttagggggaaaatgtatgtgttgcgggagcacaagggaaaagttagcaagatggtaattgttgaggttgggtgtaaaggtctggaaacacctggcgaatttgcgtaactcccaatgctgtgtgccacccctgagattctaacagaattggtcaactgtgcagcctggtcatcagcatttctttaggcacccctggagattgtaatgtacagcgaagtttgagaagtgctgatgtggagtgcatgggaacctattatgattctttatatctaactggagggttgacattcttacaataaaaagttaaaataatactgcagcaaagctccatccttggtaattctaaaagttctccaggcaaatctaatgtgaggatgccagagtggatggtgttaagcctaaagggtcttcaccctaatattcctctactataagaaaagctgaggcactcccaccccccgttctgggaaggattacacctgggtggtttagaaagggaaagagcaatggagagaagagaaactagcaaatctcattatttctagggtcagctctgaccaccctgtaagtctaataacggattctgtttcaggaggggtctttctagaatgcacctctcactagctaccagtaaccccttagggaaagccggcttcctggcttgatatactagaccctttggggcctgctggtctgtctctgattttctctcatcattccttaatcaacacatactcattgattgtccagaaattacggctctcctggagcttagagtctagaggggctgtgcttcaggcaagtaattagtgttctattaccaaagaagcagagggagctatcatgctgataaccaagggtcacagccctcacctttttattttaatttaatttaattttattatttatttatttatttatttatttatttatttatttatttatatttttgagatggagtctcccactgttgcccaggctggagtgcagtggcaaacctcagctcactgcaacctccacctcccaggttcaaggggttctcctgcctcagcctcccgagtagctgggattacaggtgcataccaccacatttgactaattttttgtatttttagtagagacaaagtttcgctatgagctggtctcgagctcctgacctcacgatccaactgcctcaacctcccaaagtgctgggattacaggcgtgagccactgtgcccagccccctgccttttttttttttttaatcaagtattcatacctcgaagtggcctatggaacatagattagaaaataccaagcaggacaaaatggaaatgcggggccccctgctcctaagttgtgaagactttcaagatggaaacgccagaacattaaaccaagcacgaggcacccttgagggcacgggtcctttggcacctgcacacagggcatgtcctcatagccactccagtactgagttacaggccctggacatgcttcactcagcctcaccttcaaaaccacctttgaggggcaggatggctatgacaataaactgcaaacactgaagcgcacgggcacataatccctctctatttgtggtgtaacaaatcttatttgagataactgggtcaatgtctagggcttacagggcggggaaggggggaggaagggggactgagactctcctgtttctatatgctatgatgggatttgacctgcaattgaacctttcctcaaacacaaggcacaaacctgccccagcccatcatcctcccacagaggcactgtgaatgtataaagaaaggcgatgctaagaaacgtgctgcaggggaggctggcacattctgctccttagctaaccgcacaggcccatgggtccacacacatcagaccatggctctctgtggtctatctttgccattactttaaccaggctgtttctcatgcgctcatggagggtgactgaagatgccaccccgaggtgcaccctcagcctcgctggacacttacggctcgcattctccagccggaccaggcagttgaggaagtcatcgaagtccagctggagctcctcatccgcatacctgagcacaatcagctgcaggaggtggctgctcagctgaaagcctgtggggacaaaggaggagacccaggactcgctgtatccgagccccgaggtgagtctgcacctttgagggagctcccaggcagctgaggagagggctcagaagaggaagccactgtttcactcctcaaagctggggtccccagacccagtgggactgctgcccttggtgtgaatgcagcgtgagagtgtgaatctgtggtgcaggggcgagtgtgcgggggactctcaggcgtgctttctgtgtttaatggcttctgagtttagcgagtttgtgatcttaattttgatgctaacatcacccatagagtctcgctgactttacaggaagctttgtttgggggaacttaacactgggtggtgtctgagccccaagttcattcctacaccagcctcccctcgcgttctatgtctcaggtcacttccagctgtggccctagaaagtttcttggaggggatgctgctgcccacggagaatgatactctgccagggcccattcctacacatccacgatgggggaagaatgacaggctatagccaggaggcttggatctgagccctggcactgctccagccgtggcatatgggttcagttctctgggctttggtttcctcattgtcaaatgaggagtttagacaaagtgaacttccttctggatttgatatttagatttttttttttgagatggagtttcactcttgttgcccaggctggagtgcagtggtgcaatctcggctcagtgcaacttctgccttctgatttcaagtgattcttctgctgcagcctcctgagtagctgggactacaggcacctgccaccacaactggttaattttgtatttttagtagaggcggggtttcatcatgttggccaggctgatctcaaactcctgacctcatgatccacccacctaggcctcccaaagtgctagcattacaggtgtgagccaccacacctggccagtgctttgatttctaattagtgcccttagaagtgatttctttccccctttcatttttgtctacatgttcactttctaggaggtgttcacaggattgttcagaaatccacccagggtctttctgcttcttcctaattccagcagaggagcaggcaggtcagacacagagcacagagtccctggagcctgcacggcagtgctggctgccagccttggccagaatcctgatgtttggggctagaggagggggatgaggggcgattctccccacaccacgtcagggtaggaaagacacagccatgcccctcctctctgagtgctccctttgtcccctgctcagttcctcctcctaccatggaaacagagtcatcatcccctaagaaaatcaggcgccccttctcagcctggcactttgctcatttataaatcatctgattttcttctccctcacataggacccgagatggtcctggctgtgtatacttcatccttttatcaggcctgagcctggacatgtttccagattttgctttccctgggagagaaccactttaaaaggttcaggaggcccctatctgtgaggtgtgcttggtgagaagcgcaggcagcccggcaggcgggaggtctgcagagcgctcgtggaaactacggttgtgtgtgcaggacatgggaccacagagatgccgacagccatccagcaccggacaagagtgggaaatgccacctggagcccagcctttgggtaagggagcagggtataaactatgatgcagtcatccattttggattcagagtctgatgctgataaaacccgggacagggccacaggtggcagagggacgtgcggaccccaaaccatgggtgctgcatgctctgtctcatccacgataacaaccatctgagagcagaaatgagaagtttggaatcactgcagcttgccaccaaagagccatgtgttaagtactgggccagaaaacatggtcagaggctatgaggcctccagagggcaggccaagttcatttttagcagatacatttaaaaagtttctaccaatgttcacagtggtttaaaatgagggccctggtgtcaggaagtgagtcctgggtctgaaccctggtgccaccactccaagggccgtgaccttaagaatcaccaactgggctcagaggcccacctcctgggcagcagagagaagacctgccatctgctcaggttgcccacaggcagtacctggcatgcagtcagccacctgtactccagtcttttctttacctgcagctttcagtgcagtccgtagttcataggtagacatggtgccggacttgtcagcatcaaaccgaaggaaaaggttctaaagggtggagagcagaagccttgagaaggagcgtgcctgaaaggcatcgctgatggcagtaaatgggtgacagccagcccgggggagctaccctctaggggccgcagaggccacagttggactgggccttccaaaagaagtcggtctcccttttgtcttccttttcgtcttgggtggaagcacggtggtactcccgtaagcatcggaatagcatgatgctgttttcccttctcccctgtccgaatacaattcctctagcctatagcctgcagcctgctgcaccattttaaatcccctctgctctaggttcactgggtcccccagaggccaagccctgctccaggttacatacaatccactgcttcagcttgtcccagaacactttgaattcatcaaactccagcttcccattgccgctggtctgtgccatgtgggttaagggagacatgagcagtgtttcaacctgaggctcctcgtgggacctcagctctgggactgcagagggggagggccgatgggctggcctgggtgcacaggtttggggccctggggaagtggttttaatgattaaaccacaaatctctgaagaggggaaacggcagaagtggaatgggggtggtcccggaaagttcacaaaaacagaactctgttcccttggatgggatcccaaagtggcaagaagacccccaagtcccttcaaaagctccccacccccaccactaggcagtcttgtgcatcttgattctgatccaatttcagcatgggggtcccccagctttgggttattttctgtgaagaagactattctgctggctaaggatgtcatgttcttggagagtctgcactattgaagattactctactgtgcttaaagcccaggatccatgtctatttctgctcaaatatttggaaggatacgtccatcagggaaatgatgtttttacaggagatcaggcttagcttcttgaatttgatgtccttttctgaaattgcacatgaaagctgaattcagttgacccgataagataaacctatgtacccatctgctgaaagcccaataatgtggctaaatccagggctgttgggggctgtgatgtggctactctcttatgatgctggtaggagtagaagttaacatgacctttcagaaggaaaattggctaaatgtgaaaaaagcaataaaagtgggaatacgccttcatccatttattctagttctaagaaccccgagcaaagaataacatatgaagatttttgtcatcatattatttatagtggcaaaaatttggaagtgaaataatgaccaatagagaggcatggtcaataccttaggctatgtctatataatgaagtattatacgacccttaggaatcatgtttttgcagcatatttaatggcaggatttaaatttgttggagaaatttgtactcccatactgctgctggtgaaaatgtgaaatagtcactttagaaaacagttggatagtttttaaaaacattaaacatagagttaagcaatcctcttaactaaacatataattaagaggatggttatgccaccatgtaaccatagactgttgcattgtgatggaaccatcctcataactatatacccaggagaagtaaaaacacatgcccacccaaaaaacttgtataggagtgtttacagttgcattattcataatgaccaaaaaccggtaacaacccacgtggccaccaatagatgaatgaataaacagaacagggcccatccatacgatggaatgttgtctggctgtaagaaggaatgagacattgatacatgctacagcatggatggacctggaaaacatcacaccatgtgagaaaagccagtcagaaaggaccacatattgtatgattcctttttttccccctgaaacggagtattgctctgttgcccagcctggagtgcaacggtgtgatcttggttcactgcaaactccacctcccaggtttaagcaattctcctgccacagcttcccgagcagctgggattacaggtgcccacaaccacacctggctgattgtgtgtgtgtgtgtttatttttagtagagatggggtttcaccatgttgaccaggctggtcttgaactcctgacctaggtgatccgcctgtctcggcctcccaaagtgctgggattacaggcgtgagccaccgcacccggcctatgattccttttatataaaatattcagaatatgtaaatagaatctatagagaaagtagatgagtggttgcctggggctgggggaaatgggtacagggttaacactgttaatgggtaaagggtttcttgttggagtgatgaaacattctaacattatatgtctacgcatatgacacacatgtacatacatgcagatacacatatgttaagagtggttatttatggtggtgagatcatttgtgactatctttgtcattaggcttttctgcatttttaagaattttctactataaacctgcatcgtttttggaatcaggaaaacaaacaatgaaagctatttttaaagtctacctacaaatcagccctgggaagcagatctgcggctcggaggagcagggaggggacccaggcagtgtggtcgcttgtccctccataggtgccccaggaccccgatggggttggcacttactcttttgcagcacagcatttaaaacatactcaagttcctctgctgtcacctccatgtcctgttgaagtggagacaattgtttgttatagcccttggcaccttcttttatagtttatttttgttttaaatcagttctgagcttcatttggctccagtgacagaccagccttcaggaccctgctgtgggcagatgtacctatctcctgtgtagctgcagctatgtgtctcatatgtcacatgttttagggacatgccagcccaactaggagagagcctaacttgagagacatcccaacccaggaaagcgcatgaaaagctgggcagggcaaggcagtggtttcccagcttccctgagggtcagaaccaactcctggaattgtcctaagctcctcagatgattcctatgttggaggcagtttgggaaaaccagactgagtcttcctctgtacagtagaaccacctgcagagctttaaaatagtcccgcatctggggcttaccccagggaatcttgaaatcagaggacctgagaatatggtcctatttttaagacctaggagttgatttagaattaagaataagggtgaatttcagaatcatggatctaaggcactccaggaaatctcagcagcccccaccccagaagctggttagaaatggagagtctcagaccttgccctgagactcaggctttttttttttttttttttttttttttgatacagggtcttgctctgtcatccagattggagtattagtggtgtgaccacagctgactgcagcctcaatttcccatgctcaagcaatcctcctacctcagcctcccaagtagctgggactataggcatgcaccaccatgctgggctgattatttttgcagagatgggctctccctatgttgcccaggatgctcttgacctattgatgaggaatctgtgttttttttcccaggatgcccaggtgactttatgcacatgtgtgtttgagtagcactgacatagacctcattttagtcagggttttgcgctagccgtgtgttatgctgtggagtgcttctaacacatgtccgtcctgaagcctctgggcctggggaatgggggtttgggatgtttggtgttggtaagaaagcactgccccagccaggcccccactgaaagaggaggaaagagaaatggagccatgtgcccaagtcatccaactacttggaagaaaagcaggacatgagtcaaggagggctgaactctagaggtactttttggttgttaataaaggtcgactgaaactcctgcaacattcaccgcttcccttccaaactctggatctccatctgacaacttctgcgcacccgcatgaacctctttaactcctctgagcctgtcttgctgggtctgacccagcatgctccagatagcacctggagcagggaggtcaccactgccttcccccctcaccatgctctgtcccgcccagggctgcgctcagccaccttcctgctgtgctttaagcagtcacatgagcccccattttctccatccgatcctgtggtcccctaatctccctgccttgcctgtttattgcagtgcctaatatactaccatcagacagcccctaggtttagatatcacccctccaggtgacccctttcataattcaggaaccccagtttggggaaacacatgaagctaatagagtcattagcaccttgacatgaattagttcatcagctcattgtatttatggctccaagagagcacctctggggcagtttctagaaagacttccctcccctgaccccagcaggtggaggaagagcctggatctgtgtgaggctccatccagtgtccctaaaaaggaagctgagcagtggaaagagctaggatagggtgggggacaggaagttgcaattgaatagggacctccttgaacatgatcccctttactacagcaaacagagtattctaatggcagtgattttcaggcagagttcaaaggagtcacctcttcaaggcttgctctagcctcccaaagaaagcacctggggccaggcgtggtagctcatgactgtaatcccagcactttgggaggctgaggccagaggattgcttgagcctaggagtttgagaccagcctgggcaacatagcaagactctttattatttatttttttaattagctaagcatgatggcatgtgcctatagtcccggctactcaggaagctgaggtgataggatctcttgagcccatgagtttgaggctgcagtgagctaggcttataccactgcactccagccagggtaaaagagtgagactctgtctaaagcaaaacagaactaaaaaacaaagcgtctgggcctattccaagcttctttgggctcactggccccatccacagccgcagactgtgtaagtaaatgttgtaaacagggtggtctttgggccttgaatgatcagtgctggtcttactttgcaacaagctccatcatgcctcaggatgacgttgctgaccaaccccacgactgcaaccctttgctaggaagcaggtccaggccctcagcctggtggggagatggaagtggggcatgtcctacctcaccagcgacttgttcaaacagagcccgaaaccgctgctcctcctctgtctcctggtcaggtggagttggctttggaggctaaaaaacagccaaagaaacttgcacaaaatgatccacaaaaaagaaacatgacaaaaatagcaggaaagaagccaggagcctgtgtgcccagccccatgtcaccctcctgaggcagtgtgcacaagctgcgtcctgtagcgtgaggaacattttctcatgaaggctcttttagaaggtgagactagaaggactttattagctggacctgtggagcccttctgccttacagacgaggaggccaaaggaccttgacccgtgcctaagttaggtcctggccattggattttcatgcttcctgcccttcctctggcttacttcttaccaccctggactggaatgacttacttcatcatctgttttgatagctggtaaaatcgttgaaggcaagagtctgtttctaccactaagctctgggcttggtatatagaaagagctcagtaaatgttttgggtgatttttggtttctttggttttttagcaccattaataagctgtgccccagcatggaacagcaaattccctcctaaaagcagatctctgctgtccctggacgtgtcagactatttccagctatagtatctcagggcctcttgcgagtcctccagcccttggacgagggtaaagccacccccatgtcaccccttccacaccacataacataggggagatgtaatgtgttcccctgagtccacagtaaaaaacatctccctgcctctctggttttcttttcattgattagatttcttaaaatacaattaaaagtctacccacttcagaagcggcagccttctctcaggtggagttggtagtgtgaaagttattgagtcaaaatgaagtcactaatgttaagaaaaccctgacaaatagagctcgggaaggccagaaggttctcatgcttatttgcctgataacaaaaatatcacaaaaggctgcaaaacccacaacctttcacagaggccctcgcaaccatacacaaaaatacttctacctctgcctagcaactgcctgtccaacatcagactggcttcacttttgttattgatctttgtagccaaggataattatttcaaaacaattatgtaatccttctcattttttctttaaaaacctttgtcctcctttacctccccaaataggtgcatagtttactatggcatgcaccttcccattgcagtgctttatccctaaataaatagcttttcttttagagagtgtctctgtgtttgttatttcagttgacagtagcacagaggaagatgacatcgaacagaactttataccaagcacccacctcactcccatgccaggtccttgtggactagaagagcacagactagaacacacacatcttggtctccaggaggttagaatcatagatgcttacttgattgcatgtaaccatccctgaactgcagagttttacatgatgctgtgattagaaggaaggtttccagaaccatcacctgaatcccatactccatagcaacatcagaagactcacctcaggaaggtcaatgtctacatttccatccatatccctgtaggggcagaaaaacacactgcctcaattgtggattaacttcccattgggatctgcagagctgaagagcccagagcctgggaaggttctgtccctttgaatcccttattgttcagtgctgtttacatttcacagagtttgcagaccccatgcattgacacccccacccttagtcactcagaccttgctcagaatgtaaataagagggacagccattgtgttagaccattcttgcatggctatagagaaataacagagactaggtaatttataaagaaaagagatttgattggctcatggttctacaggctttacaggagcacagtgctggcatccgttctgcttctaaggaggcctcaggaaacttacaattattgcagaaggtgaagggggagcaggcaagtcacatggaaaaagcaggagcagggtggtatgggggagttgccaaatacccttaaacaaccagatctcgtgcaaactcactatcgtgaagacagcaccaagccatgagagatccgcccccatgacccaaacacctcccatcaagccccacccctaacactggggattacaattcaacatcagatttggtggggacacatattcaaactctatcattctgctatgggccctcaaatctcatgtccttctcacactgcaaaatataattatgccttcccaataacccccaaagtcttaagtcattccagcattaactcaaaattccaaagtccaaagtctcatctgagataaggcaagtcccatcacctatgagcctgtcaaatcaaaatcaagttccaagatatacaaattccattttatacttccaaaatacaatgggagtataggcattgggtaaacattcccattccaaaaggccaaaagaaaggggctac

SEQ ID NO: 2960 - DNA, 4264 bp, Homo sapiens
aagggatgagacatccttggcagggagtgggccctgagtggtggccctgagcctgtgtccacccagctgtcatggggatgggcagccagccaggccctggcctggggcttacccggcggtacttctcgctggtctccttcgtgtggatcttgtcgatcagcttcttctgctggttgagccggttctcccttgcccggcgctcctcgatgaaggacgcctccctttgcctcatgttcctctggggacatgcgggtgggcacagggttggggagctgtctcaacaaggcccctaatggcagtaaagccagcgggcggttggccatgctcaccttactagactttggaactgcatccccggccaatggccacacccttttcctaaaccacttgtgcccgtggcccctcagctcacggccctccttgcccatgcctcagagcatgtgccagcccagacgctctgctgccctccagccgctggcccccagctgcctcctggccaggtccacctagaactcacggaagtgcattcagcctgcctgaagacagattcatcctcttccccaaaacctggcctcttccagcgtgcccttgggcagctaaaaccgtcatctgctaacccctgctcacgcaccccagacactgctctcaccctcgccactctcgttgccagcgcttagtggggttgcctcttgaggagttctcagctccgttgctcctggccaccccttctccaccccgggtatacccaggtgatcagcgcttctgccctggcaccttccagtccctgcagcctgagtacaccctttctgaagcacagacctggtcacatctttcctccacctcctcccagggctccaggtcagtccttgggcccccagcccagccgcctccgtggactcctggggcctgtgcctctgcagcctccactgccctggccacacgctgctccatgtatcacacccctcccagcccagggccttttcccaagttgtacctcctcctccctagccctggccacacctgacctttgcgggttcaatccctcagcccagctcaagcactgtcttcctggaaagccatctgccaccccacctgtctctgctgagctggctcaggggctgtgtggcatttcttcatggactactggatgagtgccacccacttcaggaggacagggtctgcctgtcccggtccctgctgtatccccagagccttgcagggaccttggcacagactgggtgaataggtgacccccgccctggcccggccagttctctccctctcctctacttcatggctcctgtgctggatgggacctgctctgtccagtgggtgagcagagcaggctggccgggctggccactggatccttctggggattgtaggcagtgtgggcatgggggtctcctgagagaccctggccagaagacacaagagagcccgccctggggggccccagccctgggccctgagctcaccttgaccccatccgaagatccaagagggctggccctggggggcccccagccctgggccctgagctcaccttgaccccatccgaagatccaagagggctggccctggggggccccagccctgggccctgagctcaccttgaccccatccgaagatccaagagggctggccctggggggcccccggccctgggccctgagctcaccttgaccccatccgaagatccaagagggctggccctggggggcccccagccctgggccctgagctcaccttgaccccatccgaagatccaagagggctggccctggggggcccccggccctgggccctgagctcaccttgaccccatccgaagatccaagagggctggccctggggggcccccagccctgggccctgagctcaccttgaccccatccgaagatccaagagggctggccctggggggcccccagccctgggccctgagctcaccttgacctcatccgtgatcatcatggcatcttgggacatgatcttcatatccgacagctctgagcagtagttgaccacgaggttctgcagcttgtccagctcaatggggtatcctgccagcacctgtgttgaatggggttctcttgtggcccctacagagtgggctgcagttgccccgagcttttatcccccgactaagagccctgagaacagtgataggttctcctctgtggccccagccacctcccccactccccgctgggcacaacggtgatgaaaggtgtttcacagggagtggacagtgctggcctggtggactctttcaccacctagggtccaacaacccagagagactgagagagtttgtgatgaaatgctctgcagaaaaggctgactgaaacccggggaggtttggggacagttctgctttgaagtgaaacagaggggctcaagacatgggcttggggtcagagagtcaggattcaaggccaaggcagcttctgaccagctagtttagctgtgtgacattgggaaagttacttaatctctctgtgtccccatttgtaagatgatggctcgttcagaaggttgccatcaggatgaattgagtgtaaaaggaattatttagcccagaaccaggtacatacgtgctcaggatagctttgctatagtggtttgttttttgtaactacaagtataggccaggtgcggtggctcacgcctgtaatcccaacactgggaggccggaggcaggcagatcatgaggtcaggagttagagaccagcctggccaacatagtgaaaccctgtctctactaaaaatacaaaaaaaatcagccgggcgtggtagtgggcgcctgtaattctagctattcgggaggctgaggcaggagaatcgcttgaacccgggaggcggaggttgcagtgagccgagatctcaccactgcacaccagctggggcaacagtgtgaaactccatctcaaaaaacaaaacaaacaaaaacaaaactagaagtgtagaatcttcatttttaaaaatatggatgactatgggaattattgcttgttttttcctttgttctgagactgaatctcactctatcacccaggctggagtgcgatggtacgatctcggcttgcagcaacctctgccttctgggttcaggtgattctcgtgcctcagcctcccgagtagctgggattacaggcatgcaccaccatgccaggctactttttgtatttttagtagagatgaagtttcaccatgttggccaggctggtctagaactcctgacctcaagtgatccgcctgccttggcctcccaaagtgctgggattacaggcatgagccaccatgcccaggccgggaataattgttttttaagtgtgtatgttctaaacagaagaaggcgctaccagaggaacagaaagcacccaggcgaaggaggggcatggacaggggtggggagaggggtgggcccaggaagcatagaggggcagggcttccaggtgagccaataggaccaggggccaaggcaagagggacaagcagaggacggtgctgagagccacctgggctgggaccacagcaggaaaagagctgcgatgcagcctccgtccaccactcctcctaaactgcacttccatgctgtcaccttcccgaagcatggctctccagagctcccctttgcccagtcttagggtgagggtgtttccagctggctccccgccccatccacaggttgctcctcttagcacctcctgtgctctccctatctacagcccatctggagtaggttctgctttgtggcagcccgaggggcggtgctcagcctcccatgaagggggtcttccctcacaatcggactgctggctgcctttggcctcgtctgcagggagcagggcgggtgggctggctgggacggcagcaagccctgcttacaggcccagcggaccctcaaaggtgcaaggactttctgagggtgcaggacctgtctgactctcagaggcccaggcaatgagaaaatgacaggcaagatacaaacaataccaaatcatttaatacgtgcaagaaagtccgaagaattctgatataccccacgatatgcttttttggaatagccaaaaatgaagtttaaaaaaacgttttccacatgcctcggcgtcctgcgtagccggtggtcaggcagagctccctctccctggcgggtgcggggcggctccgccccaggacgctcccgcccctcccagatcccagcccctgacccccgcccttcccgggccgctgggctcactgtcttcagataatccag

SEQ ID NO: 2961 - DNA, 1122 bp, Homo sapiens
acatacaacactcatacaacacacattcatacaacacaacactcatacaacatacaaaacatacaactcacaaatacatgtacaacacactcatacaacacataacactcaaacatacaatgaatgcaactcaacacaacatgcacatacaacacacatacaacccatgccactcacatacaacacaacacgctcatacaacacattcatacaacacatactgtacagattctaagtatgaaatagaaaacagcacatgcacagtttctaaagtatgacaaaagcttttttcaagaaggtcatccaacatccaaactggtaacatgtcctcattttcagctgctgttcagattcaagcatgtttatcatctgctccatgaattacaataatatagcataaacccttttttcattttacacccactttggtgtggggtgctccaaaacaggggccaggagcctcagtcatccctcggaacaaaacacaactcacactcagaggccaggaagggaactcggggggcgacacacactctctcatctgcagagctctgcttcaattactttacatgtaaccgcggctggaacggggttggtgacggtacagacacggcaaactgaggagaaattggcaggtggagaaagatcagccagaatccaaggaaaaatgctgagcattttccacaaatagttcacacaacggacaatagttgggctactgaaagtttattgagaggggtcttgctccaaagaaaaagttctttcccaaggttatcaaagactcacagcagaccccggcccccaacacaccatctgcagagggcctgttagtcaaaaagaagacaagacagaagcaagggggtgcggggggaggagagcaagaggggaccgagaactcggaaccaagtgatgggcagacactgaatgcctgactccagggttatcgcctcagaaaacaagtccgtttaagcccgtggtaacagtgttagcgctttcactgaacctgcactcaacactggagaacctccctgcattatgaagatgagccgaaaaataacattaattcacaatgtagagtgatgattcagccacagaaaataaaactgatataatccactacaa

SEQ ID NO: 2962 - DNA, 2453 bp, Homo sapiens
gcctcatttttcccggctcctatttaagatggagttgctctggttcacacacctctgacatgatcattgcccactgcggcttccacctcccgggttcaagagatcctcctgcctcaccctcccaaggtgctgggactacaggtgtgtgccaccagctcagctaatttttgtattttttgtagagatggtgtttttccatgttgcccaggctggtctcaaactcctgggctcaagcaatccttctgtctcagcctcccaaagtactgggattacaggcatgtcccaccatgcccagactaatatttacttttaatcagactaagatagggttactacttgagttgctatggctccagctgaaagaaagcccgtgcagtcatatcacgcgtaaacatttgctttatgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggcatgtaccaccacgcccgggtaattttgtatttttagtagagacggggggtttctccatgttggtcaggctggtctagaactccagacctcaggtgatacccctgcctcagcctcccaatgtgctgggattacagctgtgaagccaccgcgcccggctgctgtgatagttgagatgtaaaccaaaaataaaattctaagccacccagtccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctataatcccagcactttgggaggccaaggtgggatcacctgaggtcagaagttcaagaccagcctggccagtatggtgaagccatgtctctactaaaaatacaaaattagccggacattgtggtgcacgtctgtcatcccagcaaggcaggcgaatcacttgaacccaggaagcagaggttgcagtgagccaggatcatgccattgcactccagcctggtcaacagagcgagactccgcctcattaaaaaaaaaaaaaaaaaaaaaaa

SEQ ID NO: 2963 - DNA, 2465 bp, Homo sapiens
gagtggtggaggggtccagccctaaaaactggatcttaaaagtcaagaggagtttaactgtaggtcaagtcatggcgtagactgacttctccatccagggaactgaaacccagtctggacaagtcctcaaccagtgcatccccacctcctccctctcccttcccgcggctcagcagcccagcccagccctgaggaaagcgttggcagctggagctgggaatgaggtggcagagccaagaacaacagaggcaccgccttggcgctgtgcagatcctccctggtctgcctataatgcctcttgtcacagtcagaggcaccgcctggccacctggatgctgcgcagaccctctccttatctgactgtaatcctggtcagccccctcctcccagtctgtggtcctgaccctactgggccacatctgcctctctttgctaggcctcagggctagccctggaggttactgtcatcccctgcctttgggtccagctgcccctttacccaggtcactcaggattctctaccctaatcatccctagttttcacgatctctctcctgcatgcaaatgtttctgggaaatgagttgcctcctttctagatttctgacccttctccctgcttgcacttcagtttgctgggaacttttttcaggcctaactcctatttatcctgctgtgaggacaatttcatttggggcaaatcagagcctggccttctcagacttgaaaagggctgggcccctgaacccagagagaaaagaaagcagcactcttctctgtaccaaggatcaggccagactggggggcaacctgcctgagtctgtgctctgtgctaagtggaatcctgaaggctcagggtggccaggagacagaactctcttgccccagctgctcccagcccctctcttctactctcagacttccctgcattccgtagaagtcctgaattcattgctgcccctatgcggagtagcagagatccaggtgtctagccccacctgggtttaatttctacatgcgttccagccaacaaactctctgacccagcagatacaataacactgcccagggtgaggttcttctccaaatgctgaatttggccagagaatctccatggtcccggttaggggtgagggtgggggcttaatcactctcccacacttcccatccccagtcaacctttccctctccagcggctgggctgggtggtcactccttctccctgctagcctcaagaagtaatggaaaggggagggggttctcctctccccaagtcctagacgcctcagttatatacacatctacacccactcacactcttcaccatccaggagccctctcctgcccatctctattccttcaggtgtaagaccagccaccttccttttagccacaccaccatggaacaaagtcccagaatgttgctctcctaagtctctcgagcttgtttcctcctcactccacccctacctatcccacctctgcccccccagcttttctcatcaactttgcaccctcccctcactgagtctccagattcctgggggggccccaagagggttatgaccaaagctcctgcaaagggtcaccctgggcagatctgtagcagattaggtcataattaaaaggccagaggcactgggaaattccttctccttattgatcccagcgggaaattaaagccagttgtttgtgactgagtggctgatgaaggctgcagctcctccccattgcctggttccagggtcctagcccctgctccttgcctctaggcatctccatcctccttggttagtccccttccccaggcccctccactctctcatctcctacccctccacctccccgagtccccttccctagcatcttccctaagaaccctccgtgcctgctgctccctggggtaacagggctgctagaggctgagacctcggcctcagctattcagcaccctgcttagaccccctacccacctccctcagccagggttagggtgctggggctggagctggagctcaggcccagagctgccaaaccgcaaatgctcacatctggaaagaattcctctcccagcccgacttccctttgtcttacttctgtctctttggaaatcatggccagttggctggtggagggagtggggaagtgaggagaggggagtgggcccaggtctccctgcccccaccccagggagccccactgcctggctccagcctccccagcagcctcagccaagccatccagcctgtgctcccctgctctagcatcgaggggccaatcaccccctcctatgactgtccctgcatcctggtgaccatcttttgggtgaggttttaacatctttagtcactcacaaggctaggggggagagtgcactgatccttttgtcgtgcaggaggagggatgcttattgagcaggaggctgggcgcttccagctgggggctcaagagggctggtggcatggag

SEQ ID NO: 2964 - DNA, 4931 bp, Homo sapiens
catgcccctggccctggttctctggccaggctctgggcacgcagcttcctgtgtgacagacgtgttccatgttgaagttaagccatttgatgaggggctcactatacatttgggcaggaaggaagaacgtgctcataaaactggtgctgcccgggaagagggaactttccccaaatcttgtggccacggtctagagcaggagcctgacatttgacggctgggatatcagccccagcctggctctccagccctgggcaaagcatccacttctctgagcttccagtttcctcatctgtcagatgagggtcacataagcagttaatctgtgggctgttttgaagattgagaggtaatacatgcaaaagtcacagaattttgtcttgcatagagtaaatgatcaataaatgtgagcaaaaaaatcaggagaaggaggttagatgagcatgagagactacagagtttacagaaagctctcttagacccaagatcctggccccatctggcttctcccacacatctgttccacacatttccccaaagttccatccctgtcctgacaacacagaccaggaaattcagattcacagaaaaccaataatttaatctaagtcctcttgctggacagtaagccagtaaaatcctaaatggactcaaaagtttatcagatttgatagcgttccttggcttggggcagaggccatccctcctaggtagttcaggcctttatcaccccaggcctacatacttgcgaaagactcgtttcttaacctgtttttctgtgcacagttgccagattggttttggcagaggcagcttctcccttatcaatttcaggtgtttaaaagttggcagcaactcctccgtcctaagcctagaggtaatctgcagtttgtccccaactcagtttcacccctttcccacagtttttgcctgcagaggaggaattataaagagcttttgtgattgagaagaggagggtgttcaatagtcacatatttctgcacagacttgacctttcactgtagctttctccacagcagggtctggtccttggcgcacagcgtgttctgtacgtgctgactcaggggacagaaacacagaggctgcggccgccacgtgatccttagacttctgtaccaagtctgtgagggaagctcttgtgagcaagctaatgtttctttcctgagtagcaggtcagttagcctgttcaagtctagttggctcacagacagttgcagaattctttctgggctctcgggatgggaagggaagggttctcagccccttggcatgacgacgcaagtaacgggtttgaaaggcctcctggggtctgtaagatacctggccccagttatcaagttaaaactcagggccttggatctagtatgtaaatttatttatttttcacaattgcagacaaatttatatattactattatttttgagggagagtcttgttcggttgcccaggctgtagtgcagtggtgtgatcatagctcactgcagcctcagcctcctggtctcaggagatctcccgcctcagcctcctgagtagctgggactacctgggcatgcgccaccacactgggctaattttttaaatttttagttgacatgggggggggggtctcactatgttgcccaggctagtcttgaacttctgcgctcaagtgatcctcccgcctcagcctcccaaagtgctaggattacaggtgtgagccactgcacctggcctaaatttgtattttgtgcaagccagtgatccatttgtttcctgataaaaatgtgatgaagtcagagactgttatagaaccatgagctatggggcaagtctgtagtgaaattaagtaaaggggagggaataattggaatgccgatggccatgtctgagcatcgagatcaaccacaaatcattctcacaagcacatgtcaatttgtgatatattattagatctgaaaaaaaaaaagagatcatgttgtaactgagtagatcagagtgattcgctttgatcagatattccaatcttgccggatcattataaagccaacctgaatttacacaaagattttcttcctactgtgctcaaaacacagatatatattcccccgcctgtgatcctcccagtgacccgatgaggtaggcagagaacaacataatctctgcctcttaaataagctaattgcgcttgaaagtacttttagcactttagaacataaataatattccagggcagagttagctcccctttctttctctgaaattcagaatggtacagtagagctgccaggactactgagtaacacgacagtgtgaaaaacgaaagacaaacagctcaaagtcttgggccagggccgtttttccagcattttctgctttgccctctactttcatatagtttagaatttattttagaatgcacagaatacatttctatatatttgtggtcaccttttccccacatcttggaaatagcagcaatagacaatattgaacacagaaactactgataaatgcaaaaaaggttaattaattaatatagttgtcccaccgtattcctgggggattggttccaggaccccgggtgatcctaaaatccacagatgctcaagtccctgatactaaatggtgcagtatttgcgtataacccctgcacaacctttggtatcctttaaatcatctctatattacttatcatatctaacacaatgtaaggctatgtaaatagttgttatactttattgtttagggaacaatgacaagaaaaaatttctgtatatgttcagtacaggcatattttccccccaagtatttcagatctgcattttgccaaatccacagatgtggagcccccggccagcagggctgaccagcagggccgagtgtcctgcgagtgcctggctcagcacagcataagcactgagtcaaggagctcatgggtttgagggctcattcattcagaagctgagaactttctttggaccaaattgctgctggtgataatgggaggccagcaaagagggtatgagggagagtgaaaatctcaggacagtgaaaatccagcacctcagggggtggggggcaaggggagggagagcattaggataaatacctaatgcatgcggggtttaaaacctagatgacgggttgataggtgcagcaaaccaccatggcacatgtctacctatgtaacaaacctgcactgtctgcacatgtatcccagaacttaaagtaaaattaaaaaaatagaaagaaaagaaaatccagtgcctgcctggcatgatgacaggcagctaagctgagggcagaagaggcggagatcagctccgggctcaggaacatggggagccgggaagacagagggaggagggaaggagctctcccgatgggactagcactcctggaaaacaacattttttttgcattgatgtcgtggctgtttttggaaggattcgaactctgcttggaatggcaaggtctccaccagtactgatgctttaaggttttgctaacgatgacaatgcattatttagataggtgattttccatattaaaaaaaaaaggttcctagattcgaatagcatctaccttacagacatggtcctgagaccctgggagaggtgcagctggccaacacgctgtgtccccacagggaacgagcatggaagggttaagcagcagcgttccctgcccagaagaagcagtgttctgtagcaagtattttaaattcagctgctagagcaggagaggagacagagatggaggcttctgggccagatgctagaatcagtatggttcagtggctgaagaggtcagcaggtgacacaagtgagagggacacaggacgataccactaactggcctgaatgttaaaggagcaatggggttctacacggtgaatggggataattgttaggaagtggcattggggagcatggggattccagaagaaccctttccaatctctccccatagcagttattagccagtcttagcatagaacatcatgtcttctcatgcttttgctgaatgttgttagttgctgggtgttgagtcagtgtggcacgttgaaaggagcacggggttgggatcaggactcctgagttcaagttctgtctgtgcctgtcttggttgcttaatgaccttatgtaaattcctattcttgtcaggtatcagattcctcatttgtaaaaatgggtctaataatgctgccccatgaccattgatgtggagacgatttatgaactgcaaaatctgacacaatctacaactttgtgttgttagttcctcggggacaagaactatttggaaccacaccaaagcattagtgattattagaggcatttcataaacacatttttatcataatgatgttgataccgaaagctagtgcttttgccagaagtgttaataaaaattgttggtagccagttctccaagaccctctcccaaggtgtcatagttcttacgaacattataatatgagactattgattttttttttttttttgagatggattctcgctgtcacccaggctggagtgcagtggcgccatctcggctcactgcaagctccgcctcccaggttcacgccattctcctgcctcagcctcccgagtagctgggactacaagcgcctgccaccattgccggctaattttttgtatttttagtagagacagggtttcaccgtgttagccaggatggtttcgatctcctgacctcgtgatctgctcgtctcggcctcccaaagtgctgggattataggcgtgagccactgcgcccggcgagaatattgattttaatgaggatgtcacccaaatcaagcagatccctaatcataaaaataagcaaagaaatgcaaaaattaacaccctgaaatcttgctttaagcccatctaaaggagtctgctggaaggtatattccacaatg

SEQ ID NO: 2965 - DNA, 11047 bp, Homo sapiens
ggcctgatattcggtggagagccgcagctgcccgccgcggggccccaggcgcagcacgctctcgcgcgtgggccgcagctggcagcacaggaagtccaggtggaagagcggcggcgtgggcggcccggcgcggcgcggcgagtgcgggctggtatcggccgagctcgctttttctggggacagagagtgaggcctggacacccggcgccggcccaggcctggccgcggggagccgaagggcgacgagtccggcgacgaggccgtgtcgctgtcgggggcccggcagaggcgcaggtccggggcggagacgtgcagccgggactgcgccgcggggagtcccccggccggggcaggtggcggcccgtggaacagggattcccgccggcgcgtgtgcgggctctcgggcaggaaggcccagccttcgcggcccgccagggccgagagggtccaaatcccgtctcagatgggagtgctcggcggagcggggctgggcgaggagcgcagaggagtcagaggtgagtgatgctggcgtacaccgggcggtcagccaccgcgccccggtctccggacccactgggagcgcggacccctatttgagcagaaaaagaaagggcggcgcagtctggggggctggggagaaatggagggagcaaagggccagtcagtcacattttcatatacgggcctccgtcaccaagtacacagattctcccactggtactaaagatgccccattcaccttacagttagagggcccatatagtatccaccagaaccctagggtactattaggacaaataggataataaccgcattatagcaaaaggactcagatcccaacccccctgggacactgcgccctaggcgggctcacgccctcctcccccgcccatttcgaagacttgggttttcctctgggatccagtctggcgccccttgggacttcctccctttgccaggctgccccggctcaagcttctctggcctgagccatccctcagtcctagccccacctgcctcctctggctcctccttcccctcctcgagtcgctccaagccagaagaggactcacttctgctcctggcagccaggggacacacctggctgctgacctcaggacaccctgggctggtccaaggagacgcacctcccggggacacagaatcccacccccagtagccctgaccgtccagctcccgcgcctcccagccctaccgcatcccgcgtctgcagggcggggccgggccgttgggtcgcccctcctactctccactccttttctccctcggaaaccaccgagcacaaaggcagcattgattctccgccaccctcagagcggtctccggaaggctccgccaccacgcgctcgcctcacccctgcgcggagccaccaagagcaccgtgttccgaccctctgccctgggatccgagctagcgaccctctccgtcgcgcgcccggagtgctggcctcacctgtgggtcgcttttgggttctggcctcaggccctgaaactttcagagccagaggggagcagctttctctgcagcttgctcccccagcgcagtccttatgggaggagctggcaggggcctccgctgcctacgtcctacctcttttcctggataaacacagctctgtctgcgcggccatcagcccggtcttctgacttcctccagctgaagccaggtttctagcaacaatccattcctgtgcccaggcctcctctgctgaagctgggctgcttaggggtgggggagggctacagagaagagggagacggccatcagtggacagtggccacttctttggtgctcggttccaaccccagccctcacaggtgaagtccatcttctgtaaaaccctcctggttgaaatcctgccttggcccccagtgccctgttctggagccattccaatagctccaaggcagagtgacttgcagtgatcagttgtctgcattattctggctaatagttctctgaattattgtggctaaaggaaaagtggccagactcaggatttctggacttagaaacactgaagataaagctggatccaacagtcaggatcaagctggcctatgtcctccatccctgacagatcttaggaagcacaggccaccacagacaagatgagaccatcagttgcagtctagacacacctaccatccttcagtctctgaaaggaagcaaggctagttcctcccctaggaccactcttctccttcatgcttcagctctggaggccctcactgacaccctcccatctaaattaggggcacctgctgtacactttcatagtacctcatacttttcctttatagcattgattacagtttttccccctctatttatgtggttatttgtttaatgtccacctctcttactagactaagaatcttaaaaacagtgcttggtgcaaagcaggtactcagtcaggatgtatttgatgagtgaagtagtaagcaaaattatacttgaatcaatttgttcatccattcattgaagtgcctaaaatgcaccaggcactgtgctagggggatacatagaatagagagctgtctaaggggagagacagacaataaacatgcaaacaacaataagacaaatcctgaaatgcaggaaaaaagatgaaacaaaccagtgaatgcaatgattattgtgtcatctaatacttgaagattttaacaaagcaagtgtttcttctgtggcgatccctggtggcctccagaccttccattcatgtggcttctgactcagctcagccctggtgttgtttctggggagggtccatgttcttggagtgctgcagtattcattgctttgtcatcagtcagatgggctgggaatctggattctgcgactgactagctgtgtgacctctagcatgtaacttaatctctttggggcttaccttttccatctggaaaacagaaagaataaaactctcagagttggtatgaggattaaagataacacgtgggcatcatttaggctgacatccgctaaaagtgtgagaaaacagaaaacccaactcagtctgacttaacaatatggacacttgacttccataataagaagtccagaagtaggtaggacccagggaacacaactgttttatttttcttcctcttcttttttctctttaggctagtcaagtgaagcaatgggagtggagatggaacaaagaaatctgcaattggttgtgatcaattagttgtaaacactactgcacttggaccaacctcttccttttcctgactgcttaggaaggatggaatgtatttccttccttctgggagtgtttgaatgaagattagactctccttgaccatgaatgaagagcaaccagttttttagtatacagtgatttagactctgggtctagagtgtagatatcatgggcactgtgaaagcacagaaggagaaaaggtttttatgtgagtatatgggagaggaaatagtttattgtcataagctttttggctatggcctccattacatctctagcttttggaaggcactaaattgaggccattcaaatccatgtccacctatcctttgcccgtcacgagactgatggcttaggaagcatgtggtctaggtactagagagggagcctgacccacctacctcaccgctgctgctgaatttgtgcacaactctctgacctggttccatgtcacaaagggtttcattctctctgattccctgaatccccagctctagccgcagatcctggaaccctagcatatgcctgaagctgaatattttacttgccagagtaagagtttttacatagactctgtcatcttctactggccctcctcttaaactgaggcagcggctgctagctactcaccaaacctattttactttctttttctttttttttttttttttttgagacagagtcttgctctgtcgcccagactggagtgcagtggtatgatctcggctcactgcaacctccgcctctcaggttcaagcgattctcccaccgtagcctcctgagtcgatgggattacaggtgtgtgccaccacacccagctaatttttgtattttttggtagagatggaggtttcactatgttggccaggctagtctctaactcctgacctcaaatgatccacccacctcagcctcccaaagtgctgggattacaggcataagccaccgtgcctggccccccattttactttcttctttaacatatagttagaatgaaaacatgttgaagggatgatggcattagaaaattaccactggccactatcacagtaataattgctttaggcaagaatgatcgataaaagctaaaattaatgggcaaaagtatgatgagaaacaggatatttatacaatcgcaaagtgcctcccaataagatacttattaaaaaggtaaaaatggtaattttcagtggagaaatatggcagacaccatagtaaccaactgatcaaagggaacattggcattaatgggacaaatcagcatcacgtttctcttgtcatgaagcactgagaaggccacagcattgcttctgaaatattgcaacaaaaatgaataacttgaatctaatgatgaggaaacattggagaaatccaaaccttggaacacgctacaaaacaactaactcgtactctgagaaacatatcagtggactggattccaaacagtggctcatgcctgtaattttaacactttgggaggccaagtttggtggggctttgtgtctgaattctggccaatggaaccacgtggaggcctggcccagaacatctccctgtggattctctcatctggcaactggatgcctacacgaagggtgattttggagtcatgtgttggagatcacaaagcttttgtcagccaggttcctgaatgactgctagacaccatgggctgaactttatgagctccagcaccacctccagccttcagtgactgtctggagcaggcatccggatggaagagaagggggacaaccatgaacttggtgacccacggtcagcctgatttcccttgtggacacatttatgcccagtgtgcattcctcctgaggtctgttccaagtctggaggcagcagagtagagtggagagaacagtggacttggaatctcacctcccagattagagtcctggatctgactttgattgctggtgctgcctcgggcaagttactttagctgtgtgcatctccatttccccatggatagaacatgggttttgggtagaagtgtctgatagctgtactgtgctttacggttcatgagcacgcacacataggcccataatatcatatctctggtcaccctggcaggtagatattattgccccaggtttcaggtaagaagactaaagaccaggggtcaattgcttgctcagagtcccacagccagcagcagccaggcaggacaccaagtcagagtctagattccggatcttgccctcttccaagtgtaccacattcttctcaaagtggcctctcaggtcttttgtccagaaaattttgagactttgatgagaagcccatatctgcacactggggattaggccagataaccctgtgtgtccttccaggcctggtattgtgaggctgaagcctagtgccccacactcccttcctcaccccttagagaaagatagagactccagggccagcctggtgggtgctgaacctgccctgctgagccaagcccaggaggcagccaaggtcctaccagtgaccttaccctgggggcccctccaggtaggagcctggttggaaaagacagaccgacttcttctgggttggctggaaaaagatgacatactcaaagccttgtccttccacttggatgcacctggtgaagatgcgacagtcacctttgtctggggagagataggcagtgttgcagccggagaagggagggtatggtcaggatgcagcaccatttggttgagtcttgcctctggtacaagattaaggagagaaaaccagaggacaccaggtccacccccagggagccttccctctgggagcagaggcacagttgctgtcctcacagagcctttctgtctagggcagaaacatgcaggaagtgccctggctgagaatggagataggatcagggccagggcaagactttaagagaccataagcattgaaaattgaaaatgtaattactcatgtaactcacatataattcaaaagaataatagtaaacagtaaaataagagcagaaaagtccatcaaagttctgattttttttttccaagacagctaccactactacatccttttttggaagtatcaaattctttgaaaaaaaattatgttggtattcctgctttgtttgtgccataaacccaagggtagtctgtcccctgtaccactccttcatcactaggcaggaagacaacatatatgagtgagagagacagggagatacacatgcgtgcacacacgagtgcacacacacacacaagaaggtggaagctctatcattaggatccattaggatcattaggtgtttcaggagtgctgctccagaccccgcacagcagggatgatgtgcagggcctcagtggaaggggtgtggggtccaagggctttcatggggttggggcggaaggcttgggatgaggcttgatagttagggaggggcagtcagtgagaagtcggggcaggagctgggctggctgtcctccagtggggacatgcttggctgggagcgaaggtgggcccaccagggtgtgctgcttcagatgggaggaggggagctggagacctgagaggacacccgccgcctgttgcctggggctgcagcatcaggggtggagttggacagcaggaagaactcgctgagaactggaaggcggtctgtgaagttgcttctcagtcttagaacacagggaagggcggctggggtgtgtgtactcatggtcctgtccttacctgaggaaactgccagtccagatgggagcttgagtccccggatgtggtctctgttggacttgaaggagggcagcttgatccagccgctagacttagtcttctccagaaattcttggtacaggctcagcatgtccgaacaccagctggcattgggaagagcataatccttcaagtctgtcttctctggcaagaatcttgagaactgggcaggaaaaatcagaatgactagacagcatcctggaggggggctgctgcctgggctcgggacctctaaacagctgttcctgggtgctggggcttctcaatcccttctgccagagtatcgatccaagggaaagggcccatattccttgcaggggggctgcggacccctatgggtgacggggcataaggatgctaaagagcaagggaagggcgggcagggagtggggccagagatgatgggcatgctgctcgatgtggtgccttacccttgttctgcttaaaacatgtgagcagttctttaaagttgacaactgctcatattagcctcactgtacagatggggaaactgagggaatacggccaaggttgccaagcatgtgactgtgagagctggtggtcgcactagatgctgtctcctctgcagggcagggtcacagttgttgaggaccattctagcaacccccacctcaggggctactccagctctgcccactgctgtgggcctgcctgggcagggtggctcctttgaaacacatttgggcccccacagaggtgtggtgccatggctggggcacagactatgtgcccatctgtgtgacgtaaggaagtcctctgtagcgtcacctgctcatacaccagtcacaactgtagacagcatgtgagctgcttgccaatgccacagatggggtcctctgtctggggataccccagctttgctgcagtagtctgagtcccacaggaggaaagtcatttgttggtggccacacaagacacagagccagatgcaggtctcctggtagttttagttttgaatgggggcaacttggtatcccagagcactttctctttgccaaatcaaatagctcctccgaacactgcccacctgccctggccatgggctgggaagaggagatttggggtgctccttaagccctaggctcctgggaaaacactgcccatctggctgagctgggaactcaccatggagtctgtggaggatccaaatgctgaggcagggttgagtctgggcaggatacggggggcctcaagaaggcctctgtggtggccaagtcttgctgccacctggaagcatctccttatcatggccaagtgcaaggatccagccctgcttggatggagggtcttggctgactcccaaggagtgctttcagctgcacttggggccgcttctctcccttctgttgcaggctttctttcagagagctaggcgaggctgggctggtgtgctgcaacacccacagatgctcggcgcctttagctggtctaggagccccacccagtgcttggggagggacagatgctgcttgggcatgaaaaggcagcaggactggcttgagttgcaaaaggagtaaacaagtacataaacaaatagtatggggtatatagagccttggagagctgcctgggggttctgagggagaatccaagaatatttccagaaggataagggaagcctgtcccttgattggagggtgctggtggagtgttcttggtatgtgctctgcagtgtataccggactctgaaaactctggtatgattttgtgactcagaaaaccaactcacaggccgggtgcggtggctcacgcctgtaatcccagcactttgggaggccgaggcggcggattacgaggttaggagatcgagaccatcctggctaacacggtgaaaccccgtctctactaaaaaaaatacaaaaaattagccgggcgtggtggcgggtgccggtagtcccagctacgcagggggctgaggcaggagaatggcgtgaacctgggaggtggagcttgcagtgagctgagatctagccaccgcactccagcctgggcgactgagcgagactccgtctcaaaaaaataaaaataaaaaaataaaaaaaaagaaaaccaactcacagccttagacacctcttttttttttttttttttttttttggtgagacggagtttcaatcttgtcgcccaggctggtgtgcaatggcgtgatctcggctcactgcaacctccgcctcctgggttcaagtgattctcctgcctcagcctcctgagtagctgggattacagacacacaccaccacacccagctaaattttgtatattttttttagtagagatggggttttgccatgttagccaggctggtcttgaactcctgacctcaggtgacctcccaaagtgctgggattacaggcgtgagccaccgcacccggccaacacctcttcttatatcccggacaagggttagcacaggagagtttcacctgctggtctctggctggggataggagttggaggtgggggagggcttgacagggagggcagaaaataatttgggaggaaacagcttggcagggatactctcatgttttgggaaccccgtgcccagggagtggctcatgtcagcaggcagtgctgggagtgaggtgggcgcggcagtgaggctttgttgagtgggaagggacactcagccaacatctgcaaggcagtgggatttggtggtggtgtgtcttctattgaatttaaactgccaattttcaattaaaagtctcagttttaaattgactaaaataaaagcatgttctaaagatcagtcctcgcgcagtggctcaaggctgtaatctcagcattttgggaggccgagtgagaccttgtcttaaaaaaaaaaaaatcagaactgtgcaaaggtggaatcataacagtgatgatgacgataataatagttgtgatgattatgacattttggcaggttccaaaagatgaaactgatttaatgcggaaatttaaaagatttggttcaccctctgtatttggttgccctagaagaagactagaatataaatatttcccctcacctcctgcaaaggtttgaattaaacttcctcaaggactgggggaaccatttttttttgttgttgttattttgtcagagtctcactcttattgcccaggagtgcagtggcaccatctcggctcactgcaacctctgcctcccaggctcaagcaattctcctgcctcagcctcccaagtagctgggattacaggcgcttgctactacgcccggctagtttttatatttttagtagagacggggtttcatcatgttggccaggctggtctcaaactcctggccttggctgatctgcctgcctcagcgtcccaaagtgctgggattacaggcatgaggcaccacgcccagctggaagtttttttggttgattcagcctctgggtctaagcaaagatatttgagttggttgccatccccagataagtgagaatatctggcagcactcattttcagccctgggccgcagccgttgctgtgaggcagaaattaaaaaaagatagtaagtactacattcattcactccaagaaaagtaacagacaaggctataagaaggtcatagtgacctagtctgagaagtaaaagccaaggcccagaatgtggcaaggcaaaggttaaaaagaaaggaagagcaagtttttctctgcctagcaagctcacttcaaagacaattataagataatgctcttcgagaagtcgaaaccaaaggaataggctccagacatcccccgtctggagcaagggtgaaggaaaaaaaaaaaaggacaaatgtctgtctgtatttagccagttcttgttttttctttccacgcagctacaaggccaccagctatgcaaagccacaagttatgccaagtcatcagttatgctatagattatgtgacctgtcattatatgattaactgcctgttttgcttctgtaagcctgcttataaaaatcctgctcagtctttgttcaatgctcagctttttggatgtgaatccactgagccaatgcctaccttaaaataaacatcgtcctgtttttccatatctgtc

SEQ ID NO: 2966 - DNA, 4803 bp, Homo sapiens
ggatggtccagaaatcacttttattttactcaagggctgtgaggcctctaccttaggagtctcagttctggtgagagcagtgttttgggaggcattgtgtgagacacaccagttggagcaaagttcccaaaggccaagggggcctatcacagtcaccttgtgctaccaaagcactgagcagccaagcccctaagcagaacagcaggggagagacccaacaagccagtgtccctagagctctaggccattaccccctgtgctgtgttctgagatgagtctgctctcccactgcttccccagggaaacaatgccctagtgtggtctcacagccttctaggaatcagcggaggacttccattgaaaataatggaaattcacattggcgtactttcgatccttaaaaggaacacacatgaccaggaaagatgcccaaggatggcagctgccttgcagccaagcatgggtcagacacaccaatatggcagcctgatatccagaggccaacccaggccaaggagaaaaacaagaaacacctgcaaagactaaattcccaggtcccagaaggatggacaaatgtttggtgagctcgttggtcccttgtggctcgtgtactaatactctggctacactgaggaggatgaatgcctaaggctgggtgggtcagatgtctccacatcacaaatggaaactacatgctgacaacatttaccctgaaagctttcaagctgagaaagggcttggtttagttgattgggaagcaagcaggcccatatggtcagggaagctgaggaccactcttagacatctgtacaaaatccttctggtctatctggaagagaggttcaatatcaaaggacttggtttctgtctgtattcaataagctcttcactggggacaaagaattgacttgattaaggcaaatgaaccttcttttttcttaaagaatttcattaaggggatctaatggaatctttgccacttgaaagaatttctctctccaacagaggtgagcagttttagtctttgagaaattattcccagagaaaccaatgataggtcagcccagggacccacctgcacccaacagaaatgagcttaacaatccagtatgttctaggtgttgacttcaacagcccagatgagattgactttcccaatcctgccaagaagcctaaaaggtgagtattagtcccatgagctgtccccaaggcctcacgggccctgtgttctcagaggaggctgccctctagggctcagctgacctctgggctgaactagagtcctcccagggcatcgttgtcctggcaggcaacttgttccatcctctgtcccacaaacttccttttctatttccacctgggcctctgcaccaatccctaaataaggcctccccagactagacttcaacaccccatcccttctgaggcctgccccccattccccttatgaaaaaacatggtggggggagctcatgctctttaaagggagcaggaagatgaaggctccactccattgtcaaatggccatgagttagccttttccctatacctgtcatcccaaatgaccagggccctctgcgggagccacacgctccctgtgggaacgatcatgccttccaggtatacaaatgtgccaggctttccccaagcacatccacagttggttgtgttcattgatccccacaacgcagtgagatgggcaaagatatggtattcctcttgggaatactggggctcaagagaagtgaatcgatttgacagagctgcactggaaaccaggtctctgatcgccagttgagtactcttccctttccccctccgcagaagaccttccacatttgagaactcagtacctgagaacagttatgattctttgcaaacaacctgaggattcataacatgcagtaatttacaattttgctgatgcatgaatttgaatatagtgcatgctgcaaagcttgtgtgcaggggacagaatgaagtgagtggtggggaaagggatttcggaagtgaagccagttccccatctcacatgcactcacagtactgatttcccaggaaaaaacctgtggagcatgacctccccaccaccaggactggaggaaggggtggctctaggggactatgggagtaggccagtgtcccagcaaaggggacaaagatgggagaggggctaggggcacaaggctggaacccagtcatctgttcatagctgtgtgggctgatgagggaggccccagtcagcaggaggggaggggagaccttggggccacaggacggggcctggcccatcccagcttccagacctcagcaatcttgtttcctactcctgtcccatggtaaagggccactaccatttcccccacccttcactgcaagtcttaaggaaaagcctgtgttcaggagggagttgccaaggcctcaagaaagatccctcctgagtgccagggattacagattcccaggggactttcctaaggcctcggcctggcccctccagccctgctcacctcggaagctcagctcactgtcactaaccccacagtcctctgcagagctctccttctcctgcttgctgctgccccggctcctcttgacgctcttatagaactgcccccagcggtgccgccctgcatccttcttcaggcgtttctctttggcccttctgttctgaaaccaaacctgccacacaagcacaagggacatactcagggggcgtccaccacaaacccaaagcccccaggaccccctaggcgggcggctggaagcagactgaagcctgaatggagcacaggtctgggagtgcgatgcgccccaccccctctccccaggtgggcctcagaactctgtcttcagttctggcaaaagccctggggtcaagccctgagcccaaccacccgtgagctgatgtcactcaggataccttccacccctgtcccgggcctgggatccccggagggcacaggagtgctggcatctcacctgtacgaccctcatgtccaggcctgtctctgaggacagctgctccctcacgtgccgggcaggcttgggggagttcttgtatgcattctttaatgtctccagctgcttggctgtgatggtggtccggggccgcttagctccagcctctgagtcatctgcaaggaaaaaccactgcttactggcttcggcctatctgcagcagctgcgcctcctcccacaccctcccttccatcctttctgcacctaagcctgcctgctgtaggcaggacagcgcgaggcacaggggacatcagagtggagaggtccccactctcatggcactgactcctgcaccacgggccttcccaagccactgaaaagtgaggacagcagtcctttctctgctcagctccctgcctcaaccctcccctgccagcccagctgcacagaagtctcatcagattgaatgtacccaattccacacgtccctgtcatgacaaacactctgctcacacatcctcatgagttcttgccagagctgtgaaggtgaacagccaggttgaagtcatgttcaaagtcgccccagatgccctcccctctgtctcatcaggagtctcccatttccccacagccatgtcacctttgccctggcgtcgctgggctcacagccaggggtgagcttgcacacccaacagtgtctaagcaggtttctaaactataggtcagaacccactcgtgggctgtaaagtcaccttagtggatcaaaactaaaacaggaaatcagatgaagagaatgggatggaatggcaagatcatttcattaaactttagtttttattgtataaatatgtgtactgagatgaaatgtaaaatgagttttactgtggattgtagtcaaaattttttgagaaaactagtctaaggaatgttctgggcaacacactgactgatcaacacaaagtcctagacagattttgagtgaacaagctcaagttcctgttagttaaagtctggtttgttccattcaaagtcaggtacagagagaggcgcgtgcgtgtgttcggaagcacaggtgaatgtaaaggtttgtttcctctcccagcacttaggcatactgcccttttctccacagtgcccctggaggacacacggaataaagtcagcagctggcctgggcagctctgctctctgtgcttgctcacctgtgtgccccagaaggtgtctctgtgacattcctgacttcctctctgtcttttctcctttctttccattcaagaaaaccctctcttagaaacaatagtagccaacatgtgttagcacctaccatgtgctggtgttgactaaggactttatatgcattcggtcctcacaatctacaaggctctccctggagtcagcagacctggcttcagtgttcttgatgagtgagtgacttgggccagtaactcacttcccccttggaagtccagagggcaacacggcctgccctgatcttgggaggcactagaggaatgaagcagctgtgcagccaggacatgtgtgtacacagtgaggggggacacacccgtgccttcccttctcctcgggctgttttcttctctcacgtggccactgtcatcccggaactactgtggcccaactccctccctgaagccctgaacccgaagggtagggattccggagcccctgccacagagactacactacttagagagtcattccaaaagacaaaggggaacctccaaaatgccttccttttcattctgaggagtctgtcccttctgtgcatatttatagtctacacgggagtgtctgatgcaactttgaattatgcaaatggga

SEQ ID NO: 2967 - DNA, 618 bp, Homo sapiens
atgcccgcctcttcacgggtaggtcaatttcactggttgaaagtaagagacagctgaaccctcgtggagccattcatacaagtccctatttaaggaacaagtgattatgctacctttgcacggttagggtaccgcggccgttaaacatatgtcaccgggcaggcggtgcctctaatactgataatgctagaggtgatgtttttggtaaacaggcggggtaagatttgccgagttccttttactttttttaacctttccttgtgggcatgcctgtgttgggttaacagtgagggtaataatggcttgttggttgattgtagatattgggtaaatttaaagttgaactaagattctatcttggacaaccagctatcaccaggctcgataggtttgtcgcctctacctataaatcttcccactattttgctacatagacgggtgtgctcttttagctgttcttaggtagctcgtctggtttcgggggccttagctttggttctctttgcaaagttatttctagttaattcattatgcaaaaggtacaggggttagtccttgctgtattatgcttggttataatttttcatctttcccttgcggtactatatctattgcgcc

SEQ ID NO: 2968 - DNA, 18382 bp, Homo sapiens
gtgcgtggcgtgtccgctggaccaggggacgggggcgcgccgcaggtgtaggagctttgcgcgcctacctggcggtcgtgggtcgaggaggggtcaagaattgttgtctagcagccctctccccgctgccctgtcctggccgaggcaaaggccgcgtgcgctccgcgtctgccaggctttagggctgcgcggacactgggtgggtggtgggccgaggcgaccggaaggtcctggccgcctttccggtctcctcagcaccctggagcgccgccctcgggtttcggtctcctggatctgcgggtcggtctcggcgggcggattactcctcgcccacaacctcgaggccccggggtcaaccgcgccctccgggccggcaacccagggtttagtcagattcctcctgacccaccgcttctgggaaagaggcgcctcccgtcaggaggatgctgagttcctcatgactggaccagtgagtgtccactccctggtccctggcgagagaggcgggacccccacgccctcctggcgctctttgcagagatgttcctcaggcccaatccgggatttgggatgtctgtgcgtgctgtggagcagagagtttgcaacatgtaagtgccgtgcgtgaggaagagtaaaattaacctatggagcctgctcatttttaatgtggagggcagttccgttcctttctttcgccgcttcgaggtcattttaacactcaaatctaacatataagaaaaaaagccaggcataatcatggccttttatttccctcattaaggattacatcaggtgacataagccattttaacatacatcatgaagaaagtgattagtaatttataaaggcacattaaaataccatataaattacggttttcttgataggatcatgatggtgactttaagaaagtggttgaatgtggatgaaacagtttgctgtggattgtagcacgtgtggcaggatatgtaggcttgttggttggttgttttgagacggagtctccctcttgtcgccgaggctggagtgcagtggtgcgatctcggctcacctcaacctcctccttccagattcaaacgattctcctgcctcagcctcccgagtagctgggattacaggcgcccacaaccatgcccggctaatttttatatttttaatagagaccgggttttgctatgttgaccaggctggtctcaaactcctgacctcaggtgatccgcccgtctcggcctcccaaagtgctgggattacaggtgtgagccactgtgcctggccagtatatgtaggctttctgcattctatgcagttcagttcattcatccaacaaatatttaatgcctgttgtgtgtcagacgttatcctaaagactgaagatgcaaaagggattaagactcaattcctttggccaggcacggtggtttacgcctgtaatcccagcactttgggaggccatagcgggcggatcacctgaggtcaggagttccagaccagcctggccaacatggtgaaaccccggctccactaaaaatacaaaaagttagccgggtgaggcggtgggcacctgtaatcccagctgctcaggaggctccctgttgcagtgagccgagatcacaccactgccctgcagcctggggaacagaacgagacactgtctcagaaaaataaccaaacaaaaaagactcatttccttcttgcaaagctcacaggttgggtagaagagatatgtaaacaagtaattgcactagatatgacaagtacatctttttgaacatacatagatttaagttatctaatacagtttgctttgtaataaaaaccacttatcttagtcccttcattttgaattcaacatttttctatttagtattcacctcacattcttttttagtattttggtagaatcagactcttcaaaacggttaataggatttcagaaattaagtcaattttcagtgccagctagaatggacctttggatttaggacagaggttctccaaatgtgagctggggactgtagacaatctccgaggttctttctgggatccatgaggtcaaaaagttttcatgtgttacttgcttttttcactcttgttctctcagaagtgtacaatgaagttttgtggagactataatgtgctatcaaagcaaatagaattaagctgttttttaagtcagatattagagatttacaaaaatgtaaaacaatgccaatcttatcttttgtttttaaaatatagtaatttttcattaaaatatgatatttatgttaacatgtaatgggcttattgtcaattttaaggaattaatcttttatatataatttatcagttttcatttctaatatggtaaataccaatagttacaatccacatgaaaaaaacttctttgagtcttcaatttttaaacatgccaaggggtcttgatactacaaactttgagaactgccaaggtaggctagttattttcaaattatgtttcatggagccctgaatcctctggtagtgtgtcagaaatctgtgaggatagagaatcagtaggaagttaaagacaaggctctgggttcccacatctccccgtcttctctaatggcagttcaatttttctctgtttatctggttttttgttttttgctttttgttttttttttcttgagacggagtctcgctctgtcatccaggctggaatgcagtggtgcaatcttagctcactgcaacctccacctcccaggttcaaaagattctcctgcttaggcctcccaaatagctgggactacaggtgcgcaccaccacatcacgctaatttttgtgtttttagtagagacagggttttgccatgttggccgggctggtctcaaactcctgacttcaggtgatccacctgccttggcttcccaaagtgctgggattacaggcatgagccatcatgcctggcctgtttatctgctttttgtatcaattaggtggagactctcaaacttcaattcttgactactgtgtacctacaggctcaacaccaagtggaagctgccaaggcttggggcttccaccctctgaagcaatagcccaagctatgcctcagccccttttagttacagctggggcagctgggacacaaggcaccaagttcctagactgcacacagcagagggatcctgggcccggcccacaaaaccattttttcttcctaaacctccaggcctgtgatgggaggagctgccatgaagatctctgacatgcccgttttccccattgtcttggtgattaacattcggatcttccttacttatgcaaatttctacagctagcttgaatttctcctcagaaaatgagattttcttttctgtcatgttgtcaggctgcaaattttccaaacttttatgttctgtttcccttaaaaactgaatgcctttaacagcacccaagtcacctcttgaatgctttgctgcttagaaatttcttctgtcagataccctaaatcatctctctccagttcaaagtttcacaaatctctatggcaggggcaaagtgccgccagcctctttgctaaaacataacaaaagtcacctttgctccagttcccaacaagttcctcatctccatctgagaccacctgattggatttcattgtccatataattatcagcatttttgtcaaagccatttaacaagcctctagggagttctaaactttcctgcattttcctgtcttcttctgagccctccagactgttccaacatctggctgttaacccagttccaaagttgcttccatatttttggatatctttttagcagtgcctcactctactggtaccaatttactgtgttagttctttttcatgctgctgataaagacatacccaagactaggaaatttacaaaagaaagaggtttattggacttacagttccacatggctggggaagcctcataatcatggtggaaggtgaaagtcatgtctcacatggcagcagacaagagaagagagaacttgtgcagggaaactctcatttttaaaaccatcagatctcatgagacttattcactatcacaagaacagcacgggaaagacctgcccccatgattcaattatcatctgccgggtccctctcacaacatgtaggaattatgggacctacaagatgagatttgggtggggacacagagccagtcatagtaaggtattgtttgggtaaaacataagcctttctttcctttcttttttttttttttacagggtctcactttgtcacccaggctggaatgcattggcatgaacacgtctcactgcagcctcaacctcccaggctgaagtgaccctccaactctgctttcacagtagctgtgatatggtttggctgtgtccccacccacatctcatcttaaaacccagtgggaggtaattgaatcatgggggcaagtctttcctgtgctgttcttgtgatagtgaataagtctcatgagatctgatggtttttaaaagagttctggctgggcatggtggtgggcacctgtaatccaaactactagggaggctgaggcagagtgaattgcttgaacctgggagaaggaggttgcagtgagccgagattgcaccgctgcactccagcctgggcaaaattgaagactctgtctccaaaaaaaaaaaaaaggagttcctctgcataagctctctctctttgcctgctgccatccatgtaagatgtgacttgctcttccttgccctatgattgtgagtctttccccagccacgtggaactgtaagtccaaataaacctctttcttttgtaaattgcccagtcttgggtatgtctatcagcagcatggaaatggactaatacagtaaattggtaccagtagagtggggtgttgctgaaaagatacctgaaaatgtgaaagtgactttggaactgggtagcaggcaaacattggaacagtttggagggctcagaagaagacaggaaaatgtaggaaagtttggaacttcctagagacttgttgaatggcattgacaaaaatgctaatagtgatacgaacaataagatccagtctgaggtggtctcagatggagatgaggaacttgttgggaactggagcaaaggtgactcttgttatgttttagcaaagagactggtgacattttgcccctgcccgagagatttgtggaactttgaacttgagggagatgatttagggtatctggtggaagacatttctttttttttttttgtgacggagtcttgcattgtcgcctggggtggagtgcaatggtctgatctcagcttactgggttcaagcaattctgtctcagcctcccgagtagctgggattacaggcgtccgccaccacgcccttctaattttttgtatttttagtagagacggtttcactatgttggccagtggaagacatttctaagcagcaaagcattcaagaggtggcttgggtgttgttaaaggcattctgttttgactgggtgcggtggtgcacacctataatcccagcactttgggaggccgaggagggtggatcaagaggtcaggagttcaagaccagcctggccaatatggtgaaaccctgtctctactggaaatacaaaaattagcttggcatggtggtgtgcgcctgtagtcccagcttctcgggaggctgaggcaggagaatcgcctggacccgggaggtggaggttccattgagccaagatcatgccactgactccagcctgggcaacagactgagactctgtctcaaaaaaaaagaaaaaaaaaaaggcattcagttttataagggaagcagagcataaaagtttgggaaatttgcagcctgacaatgtgatagtaaagaaaatcccattttctgagaggaaattcaagctggctgcaaaaatttgcataagtaccaaggagccgaatgttaatatccaagacaatggggaaaatatctcccagacatgtcagaggtcttcatggcagcccctcccatcaacaggtccagaggcctaggaggaaaaagtggttttgtgggcagcacccagggtccccatgctatgtgcagcctagggacttggtgccgtgcgtctcagctcctccagtggtgactgaaaggggccaacatagagctcgggctgctgcttcatggggtggaagtcccaaatcttggcagcttccatgtggtgttgagcctgcgagtacatagaagtcaagaattggggtttgggaacctccatctagatttcagaagatatatggaaattcctggatgcccaggcagaagtttgctgtaggggtggggccttcatggagaacctctgctagagcagtgcagaagggaaatgtggggtcggagcccccacacagagtccccgctgcggccctgcctgatggagctgtgagaagtggaccaccgttctccagaccccagaatggtagatccaccgacagcttgcaccgtgtgcctggaaaagctgcagacactcaatgccagcctatgaaagcagcctggagggaggctttaccctgcaaagccacagaagtggagctgcccaagaccatgggaatccacctcttgcatcagtgtgacctggatgtgagacatggagtcaaaggatatcattttgaagctttaagatttgactgccctgctggatttcagacttgcatgggtcctgtagcccctttgttttggccaatttctcccatttggaatggctatatttacccaatgcttataccaccattctatctaggaagtaaataacttgcttttgattttacaggctcataggcagaagggatttgccttgtctcagatgagactttggactgcggacttttgagttaatgctgaaatgagttaagacttcggaggactattgggaaggcatgattggttttgaaatgtgaggacatgagatttgggaggggccaggggtggaaggatacggttgggttctgtgtccccacccaagtcttatcttgtagctcccataacccatgtgtcttgggagggacctggtaattcaatcatgtgggctggatgcggttgctcatgcctgtaatcccagcactttgggaggccaagggggagatcacttgcgatcaggagtttgagaccagcctggccaacatggtgaaaccccatctatactaaaaatacaaaaattagccaggcacggtggtgggcacctgtaatcccagctacttgggaggctgaggcatgagaatcacttgaacctggaggcggaggttgcagtgagccgagatcgcaccactgcactccagcctgggcgtcaaagtgaaacttagtcttaaaaaaaaaaaaaaaaagaagaatgggagtgggtctttcctgtgctgtcctcatgatagagaataagtcttacaagatctgatggttttaaaaatgagagttatttctctcttctcttgtctgccaccatgtgagtcatgcctttcaccttccaccatgattgtgaggcctccccagccacgtggaactgtaagtccaataaacctctttctttttttttttttttttttttttttttgagacggagtctcactctgttgcccaggctggagtgcagtggcgcgatctcggctcactgcaagctccgcctcccaggttcacgccattctcctgcctcagcctcccgtgtagcaggcattgtcacaggcgcctgccaccacacccacctaatttttttgtatttttagtagagacggggtttcaccgtgttagccagggtggtatcgatctcctgaccttgtgatccgcccaccttgggctcccaaagtgttgagattacaggcgtaagccactgcacccggcaataaacctctttcttttgtaaattgcccaggtatgtctttatcagcagcatgaaaatggactcatacaatgatccattacctagggtaaaattctcctgaatgtcaaacagagataaactacatttgggttttgggtaagtcccctgtaatgatgaatcaagaatcctcaagtctgtcttgccacccatttaatacgtatttttgttaaggctgaagtttagagttagaatcaggacattttggcctattgagaggttctgaattccaacagaagatgccatgtaaatcagtgaatttgattcttttaaaagcaacttacaaaatttacaagatgtattcaataaagcagtttagctttggtatatcaaaccttataatgaaccatttttcccacttcatcttatgcaatgtttaatattttctatttttgtcaaggatattaaacctacacctggaaacatattaaatgccaacttaaaatgtgagaagtttggcagaactcagacccattcttccaatttccaagctgtttaatcacactgattcagacactctggatagcagctgggattgtagttatctttatgctttgagctctctagttttgtctacacatcttataaaatatcccctcctcattctcctctagctggaacactaacccaatggatgttgtggtgaactttctttgaccaggcagagaagtgcagcattgggtggaccatgcacaaccagtttgagaagcactgctctaggggttgggggagcaacaatagaaagagtgtaggttctgaatacctgaagcatacattttagctctagactgcttatattgttgttacatgaaagagaacttttaatctggtttaaaccactggatctctttattccagcaagtgaatctatatccaactaatatttactcccagtctgttctttctcacccctctttcccttactataaaccttttctatatcaatttatatcattagttgctcagcccacaaaccagatgtcacttttgttttctcttttccttcccattcatagccaggccatcgttgtgacttattggctgtacctccaaaatatatcccagatctgatctcttcttataatttgtactgctacaaccttagtcaaagccactaatatctcttatctgaactccagtggtttactagttttctgcctctcttcttgacacaattcatctttctacatagcagccagagtaagataaaatcataaatcagatcatataacttctaccccctgtaccaatggctatcttttatactcagaataaaatccaaaacctttatttggcttccaagatcctacaagatagagaccttacttctcatcttgtacccatcatttgatcttcagtcccttgaaaatgccaagtctatttccatttcagggcctttgtgcttgttactattgtttcttttctcttggaaaactgcccagatctttccttagctgaattattcagatcccaactcaaatatcatctctttagaaaattctttcagaaccaggtgtggtggtgcacacctgtaatctcagctactcgagtggctgaggctgatggatttcttgagcccagaagtctgaggccagcctgggcaatatagcaagatcctgtcaaaaagaaaaaggtatctcaccatgattatattttaatttcccttcagcaattagaagtccctgaaattaatttaccttatttgttggcatttgttggcattgtgcaagtaatgcttgcacccaggaggcagagtttgcagtgagctgagatcacgccactgcactctagcttgggcaatagggcgagactgagtctcaaaataaataaataaatacataaaataattttagagacagagtcttgctctgttgcccaggctggagtgaagtggtgggatctcggcttactgcaacctctgcctcctgggttcaagcgattctcctgcctcagcctcctgagtagctgggattacaggcgtgcaccaccacgcctggctaaattttgtatttttagtagagatggggttttgccgtgttggtcaggctggtctcgaactcctgacctctgatctgcccacctcggccttccagagtgctgggattacaggcatgagccaccatgggcccacaaagctattttacttagcattttttttcccgaggctaaattgggaactactgacaatactattgacaatactaaatatatttttaaattattttacttatttttgagacagggtctcactgtgtcacccacgctgtagtgcagtgaaccatcaccactcactgcagtctcacccttcctgaactcaggtgatcctcccacctcagcctcctgagtagctgggactacaggcatgcaccaccatgcctggctaatttttaaaattttttgtagagatggagtttcgccatgttgcccaggctggtctcaaacttctgggttcaagtgatgcaagtgtctcagcctcctaaagtgctaggattacaggcgtaagccactatgcccagccttttattttattttattttatttatttattttttgagacagagtcttgttctgttgcccaggctagagtgcagtggtgcaatctcagctcactgcaacctctgcctcccaggttcaagcgattatcatgtctcagcctccctagtagctgggattacaagtgtgcaccacacgcggctaatttttgtattttttgtagaggcagagaggcagggttttattatgttggccaagctggtcttgaactcctggcctcaagtgatctgctcaccccggcctcccaaagtgctgagattacaggtgtgagccaccatgcccaccaacctattttttattttaaaaaattgacagcatactaaatgtttgtaatgcaaatgataaaattgctacaatgaaaacaagaagttgagaattagatgaagagttgattaagggaactatgagtcactgtgttagagcatgtatattatgaaaattatagcagaagtgataaagggtgacaattgttacctatcttcaatcaaaagctctttgaatatctttcttttttttaattttatgaattttttttacagagacagggtctcactatattgcccaggttggtctcgaactcctgggctcaagggatcctcttgccttggcctcacaaagtacctggattacaggcatgagccacagtgcctggccctctttgaatatctttaatgcttttagagattagcatcagagaattattaatactagagggcacaaggaattagccattgccagtggacacctacataggtgtgactatgtgactcagttttaaaaatgtgacacaatgaaaaaattccttggatgttatggaggacgaaaattttgtaagtcctatccattctttaatggagaaactaaaatttacaatattactttatttagcccaagattttcttaagctttgtattttctaattcagctttggcttacagaatcatgcttgaagtttgagactgccagctttcaacaggcagttactagtgaaactctttggaaagatgagaagatgttgacataagtgtaatgtgagacaaagcaaagtaaaatgtaatttttaagaaaatgttgccgggtgtgatggtggctcatgttgctgttggttgctatgggagtgaacgaagggggacgaatgcagaaatgaagacaaagacaaaaagagtatttttggaagaaggggtcaggggactccttgcttctagtgggcaagggccctgagcttctacagcccttcatatttattaggtagaaagagcagggagggagaggtaacagttggtcagctgcttgatttatcacaggtacacataattgcttcctttgtacaacaggcttcagatgttactatagataatcacaaggaacactgcgcttggggcatgactgccctcagcaacccttctggcggcagacacagttgttagttttccaacatcctgctttcatgagaacagttttctgtttgctcatatagccttcagtggtatactgagttggtcacgaccttcattctttcggcctgtaacatctccccatttttgtttttgcattaattgaataaaggtaattgcaggttgtgcagctctcaattgccgtttggtggtccagctgattttgcagactgttaacaaaaaacaaaaatataataacattaatcccatagttacaaaaaagacattgagatgctatttgaagtaggtcccagggttaaggctgtctaaaccttgctggaattctgcccaagcttttaaagagggctgaaacgcttgagtctgcttattcaagttaaggattttactttgtaaatcattaatatcaaaagtaacattgaatgtgaaagctccctgtaaatgggcttttacaaggctcaatggatattcactttggttatataccaaattggtcacacaaatatgagtatgattaaaatgacaacgcattgctgctgcaactgcaaactttgtacttgttcccctagccatagaacagtagtctttaacattgccacctctgtttgtatttcggtgttaattttattttgaagcatccatgcctggtcgactgtgcatgtccagttttccacatattgagctgtttgaatggagctgtgcgttgctgctgaggacaacacaacagaggttattaatgtaactaaggagactataacaaaaattatcatgcctaaggctctatgagcacgatgagtaagcggagtaaaaaggagtttcataagatgtaaagcgggggtggctgcccaaggctaagataaatttacaggaattcataatccaggaacatgacctagaattgttagggtggatatgtcatgtgtttgtattgtgctatgattaaggcaatgatacagttgacaggaatcacaagtcaattgggcatcatctacctggaggtgggttttttttgctgctaagaaaatataaggattaaaaacaaattgtaaattgagtggtaatattttctacaagggtaacattaaaactgtgtttagcacaattactattattggatagtgtcccaatccaaatgctgccattcataaatgggagtgctgctttccatattgactcctgaattggacctctctttccttgataatgccattgaggcaaaggtgagctaaagcatgtgctgtgtcaagcaatttgggcagcagattgagattgaattgcaatgtgatgtagtgggagatgttaaagttttgccaccagttccagcaaagttaatgccatgaggtctgatgctcatgtctcccaaccaaatgaccatggggaccccagtaaataatgtctcccattagcatggactgttgtctagctagggagctaagacacggggtccaaggaggggggttagaattatcaaagggagcccattctatataattaatacaatttgggtgatggggccgggagtgattagtaactacaccagtaatattagtagaactaaggcccaataggtacgtaaattttccatggtaactcaaccatgcctgggattgaattgcaaggcaactgcagttgagcagtgtatcctgggtgatgcataaagaaaggccctccaatggagtggtataattgataccattgttctgagagtctaattgctctgtgtcagggggagttaagggtcccggtgcccatgctccttgatcatgatatatctcaggaggagtgtcaccccggtcatactaccggggggttaggaacataagcccaatatgtttttgcctctgcacagggaaaacatagcacacaggatatcatagctagcatggccataaacatggagtcaggggtttttgcctgaccctgatgctccagcagtttctcatcttcttgtgtggttttcttgatctgtaaaacacaagcataccctcatccccatgtcagtaaatctaccaggcctttccattgtccttcttccagggatttccataatacttttgggtaaactttcctttttccctctaacatttgccagtgtcattctaccggagtcttattatctgtaccaggagttaaaaaatttaaagtaaataatgctaaatgtagtattgtttgaggtggtaactggtctcctatacctcctttttgttttttcagcgcatgttgtaatgtttgatgtgcctgctctataattccttgtcctcgagggttataaggaattcttgttttgtgagtgactgcctataactgtaaacaattttgaaaagcatgactaacttaagcaggtccattgtcagtttttaattgtttagggaccctcatatcggcaaatgacaacagacaatgtcattggacatggccagctgtttcacctgtttgacatgtagcatgcagcatatgagaataagtgtctatagtcatatgaacatagctaagtttgtcaaaggctgctatatgtgtaacatcaatttgccagatttcatttggagctaagcctcgtgggttacatccttctaccggtataacaccagggacatgctgacaagtggggcaggcttgcacaatagctcgagcctggcttcgaggcagatgaaacatacaagtaagggcagaggtgttttgatgcagtaatgcatgagaggcttcagcttgctgaaacacagaaccaatcaatttatctgctctatcattacctagaggtagtggtccaggaagttgtgtgtcagagcgaatatgagaaatttgaaaaggagcagcatgagagcaaacagctcgctgaagtcttagaaacaagttaaacagctctggttctagggtgcttttaatagtagcagtctcaatgcgactggctacatttacaacataggctaaatcacagacaatattaataggagaggaagcagtgagctgtaaaacctgaataactgccattaattctgagcattgagctgaaacaccagggatttttattgttttaatatgcttaggtccataaatagatgctcagactttggaagagccgtcagtgaaataagtctggccacctggaataggcttgtgatgagtaatcacagggaggataaaagggtaaactttataaaattgcaaaactttgtctgatggataatgattatctattattcctttgcttcagccaacatcgtagagcgatgaagctcagttcccacatcctgacaagctttgataaaatttcctaagctttttatacatctcacagatgccaatgcatgtttacagtccgtgtttgcattctcaaaagctagttaaggttagcatttctgtagccatggtaagagaaatctgacacttcactgcctatggtaatcttgcaagaaaatgtgcatagagctcctgtgaccctttcatgatatgtaagagattgtactgggaccctttcctctggaattgtggcccaggtgcgtttaacagccaaggcacactgcttacaagcagcgtctgggagtgctatttgatgttctaggtctgaataggggccactgcctaacagcatcctctgtaatgtctctgtgtccagcagcacgattctatctagcctggtctgcacacagttcttgccaatttaaataccatatcaggtatgcactagcagacaaacaagtgcaagccaaatgctttacatcaaagggtggaaggcgcatagcgccaaatagattctagcagtcctaaagtaaatgggctttgtattccattattaactacactagcttttaattccttcagcaacttaaattctagtggggtgtgttcatgaataaactgctgtggattatgtggatcaggccttacggaaataggaaaagctcaaggtcctaagggttctccagccatagcagtagagtgtaaagttctttgtattggggtctctatttctgctactgaaggaggcggttcagatgtttctgctactagagggggtgacacaggccaattttcatcctcctgctcctgtttattatttttaattggcgctgttgagagaacagaaagattctttcaaattttttgactctgaacatgactcctgctgtctagcagaataagaaatgaataatggcaggatgaactaaactccaaatataaaaaagaaaatagccaaattcttcccccatgttaccctgattcagaaacttcccgttcccagtacctctttagggcactgaccttatattagctgtcagcagactcgtcgcagggtttctcattctcgttcttcttgtcagtgtcagtttctctgctccagcagaccttcactcacgtccctgtcctaggtgccagttgtcgctgttggttgttatgggagtgaacgaagggggatgaatgcagaaacgaagacaaagacaaaaagtatttttggaagaaggggtcagggggctccttctagtgagcaagggccctgagcttctacagcccttcgtatttattaggtagaaagagcagggagggagaggtagcagttggtcagttgcttgatttatcacaggtatacataattgctttctttgtacaacaggcttcagatgttcctatagataatcacaaggaacactgtgcttggggtgtgactgccctcagcaacccttctggcagcagacacagttgttagttttccaacatcctgctttcatgagaacagttttctatttgctcatatagcctccagtggtatactgagttggtcacgaccctcattctttcggcctgtaacaggctcatgcctgtaatgccagcacttttggaggccgaggcaagaggatagcttgagctcaggagttggagaccagcctgggcaacacggtgaaaccccatctctgcaaaaattagcctggtgtggtggggtgcgcctgtagtctcagctgcttgtggggctgaggcgggagaatagcttgagctccaggggtcgaggctgcagtgagccataatggtgctgctgcattccagcctgggtgacaaagtgagactatctcaaaaaaaaaaacggctgttagataaaaatgaagacaaacaacatttgcaaggatataaatcttaacccatttattgggggtataggctctggtgtcagatttccatctgtcctgtattttgtaaccacaaaattgtcctggctggattaattgtaaggaagtccctttaaacacatctagacttccaaagtttgtttacatactaattagttgtcatgaaaagctgcattcaacccagggtctgagatgccttttgtatatgaaaagtgcttctctttctgacactgactgaattacatacataacagattcatttatttaaaaacaatttaagaggctttttctataatgctgaacctgctgtgtggtatttatgtttaattctggtcaaattttcaaaactaataaacactgcaattcaaaaccattaattatcaagcatagaccaagtatctgaggttatgagcacatatttaagaggttagactctggcattccagacattgcaaataatacttttctcatttctaaatttcctagaaacaagtggagatttgtaaaaggaaataatactctttaaaacatttatttttgactcaggatctggctctgttgccctagctagagtgcagtggtgccatcatcacagctcacacaatagcctggaactactgggctcaaaccatcctcccacctcagcctcccaagtagctgggactgcagatgcaggccatcatgtcccgctaagttttattttatttttgtagagacagagtctatgttgctcaggctggtcctgaactcccggcatcaagtgatcctcccacctcccaataaaacatgtactgatggccaggcacttggctcacgcctgtaatcccagcactttgggaggccgaggcgggcagatcatgaggtcaagagatcaagaccattctggccaacatggtgaaaccctgtctctactaaaaatacaaaaattagccaggtgtggtggcacgcgccggtagtctcagctactccggaggccgaggcaggataattgcttgaaccccagaggcggaggttgcagtgagccgagatcgtgccactgcactccagcctggcgacagagcaagactctgtctcaaaaaaaaaaaaaaaaccaaaaaccaaaaaatcaaaaccaaaaccatgtattgatatcaaagtttttttatcctggcagggcacagtggctcacgcctgtaatcccagcactttgggaggctgaggcaggtggatcacgaggtcaggagttcaagaccagcctggccaagatggtgaagacccgtctctactaaaaatacaaaaattagccaggcgcagtggcaggcgcctgtaatcccagctactcgggaggctgaggcaggagaatcgtttgaaaccaggagggtagaggttgcagtgagccaagattgtgccactgtactccagcctgggtgacagagtgatactatgtctcaaa

SEQ ID NO: 2969 - DNA, 1697 bp, Homo sapiens
gcctcctgcaccgcctgcatcttctccttgagcatcttctctgccaaggcccgctgctgtgccaggtcctcctctgccagctgccgcagtcgcgcagcctcttgggccgccacactcagccgcgcggcctcctccgccacctgcttcatcttctcagcctcctcctgcaggaagcgctgcgtattgtccttgtcacgcaagatgagtgcgcggttctcagcctcgatgcgtgccttgagcttgctcagctcctccatctgcacgcgcaccgagaagagctcctcctccacctggctgcgctggcgtgcggcctccgtggcctccgccttcagccgctgcagctcctcgtccagcaggttcttctggtggtcggtctcctccagctgcagccgcagtgttgtcagctcctgctccacctgcgccttctgccgcagcgtctgctcggcgaatttcttatgcttctccatctccgcgtcagctgcctgcttctgccgcagggccgcctgctccgcctgtgcccgccgcgccgcctcttgctcggcctccttgcgcagcttctctgcagccgcctgtgcctgagcccgggcctgtgcctgctcctctgccgactgcttcagccgctcggcctcttccacctgccgccgggactgcgccgcctcacgctccgcctgcacccgggcctcctccgcctcctcagccgcccgccgggccgcctccgcctcgccgcgcagctggtccagcacgctctgctcctgctgcagcgtctgctgtagctcctgctccttctgctgcaccgcgaaggcgtgtgccttctcttccgcctgcagccgcttctgggcggcctcctgggccagctgcagctgccgcgccgactcctgctccgctcgctcccgcaggcgccgcgcctcctccaccttggctttcagccgctcgacttcctccagcgccgccttccgctgccgtgcggcctcctcctcggccgccaggctcttctgcacgcgctcctcagcctcacggcgccgccgctcctcctccgccgccagctgccgctgcctcgcagcctccagctcggcctgctccttgctgcgcagcgtgtcctccgcgttgctgcggatgcgtcccagctccagctccagctccgccttgccagcggccgccttctcgaagctcgccttcagcgccaggatctcctcctccacctgccgccgctgcctcagcgtgtcctccaccagccccttctgccgctccagctcgctgtccgatgccttgcgcagctgggccaggcgctcctcgatgtcagccttgtgttgcgcggcctgctcctccagccgccgccgctggaaggcctcgtcctccgccagccgccgcaggcgctcgttctccgcctccttctccttgagcgcgatctccgcctccgtcttgagccgcgtggcctcgccgatggcggccagcttctccgcaagcacccgctccgcctcggcccgctgccgcgccgcgtcttcctcggccagctgccgctgccgcttggcctcttccgccagggcacgcaggcgggcggcctcctcggccagctcgcggaaccggccggcctcggcctccagcctctgcttggacttctcgctggtggagcgcgactcctcctcagccctcgccttgctggccagcagcacctccatctcggcccgcaccttggccag

SEQ ID NO: 2970 - DNA, 681 bp, Homo sapiens
atgaacgaaaatctgttcacttcattcattgcccccacaatcctaggcctacccgccgcagtactgatcattctatttccccctctattgatccccacctccaaatatctcatcaacaaccgactaattaccacccaacaatgactaatccaactaacctcaaaacaaatgatagccatacacaacactaagggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccctatactagttattatcgaaaccatcagcctactcattcaaccaatagccctggccgtacgcctaaccgctaacattactgcaggccacctactcatgcacctaattggaagcgccacactagcaatatcaactattaaccttccctctacacttatcatcttcacaattctaattctactgactatcctagaaatcgctgtcgccttaatccaagcctacgtttttacacttctagtaagcctctacctgcacgacaacacataa

SEQ ID NO: 2971 - DNA, 731 bp, Homo sapiens
tcctccccgcgagactctcaggctgaggtcggcaagccgtggctcccccacacaccgtgcaataccctgtctgacctgggctcttcccgcctgcatccctcccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggaggaggggtggccacacagtggggagctgggaggtggggggaatggtcccagactcctctcggggcccctatccacacagggcctggtgttctaccccatctggcccctggcccatctcttctgtgccttag

SEQ ID NO: 2972 - DNA, 2002 bp, Homo sapiens
gctgaatagctgagaggcgcacccgggcggccagctgggctcggagtgcagcggggttaggatggacgaggacgtgttgcaccctgaagagcctcatcatcggtgagagtggggtgggcaagtccagcctgctcttgaggttcacagatgatacctttgatccagaacttgcagcaacaatagacaatgcaggaatcacatgaacctgtccatccacagataaagtggtaaagaaactgccgtattagatacatgatggtatactcttcagccataaagcttcgggaaaccctgtcatccgcaaccacgtggagaaacctgtccatccacagatgaagggatcaggaagctctggtatatatactgaagggaaatgctttttggctaccaaaataatgaaattttgttgtttggagcaacacagatgaacctgtccatccacaaatgaagacatcaagaaactctagtatgtacacaaggcaaaacacttcagctatcaaaatcatgacattatgtcacttggagcaacacagttgacccgccaaggcagcctcttcctccatagatggatgaacgctgtggccgctgctcctgcctgggccatgccctgatgctgccaacaccactgctcctctatttataagtcttagtagagttgctgacccagcaataactgaacagctgatatgtacctcacactaagccaggcgcttcatatgtatctaacttgaaaaatgctgagctagttaccttaacaccattaacttttacttaaaagtttgtttttcttttttaatcccagtgagctccaaacaagttttaggaggctccccaaaaccagtgaagactttaactaaaagtagaatttcaaagtattagaaaccaaaccccaaaattaaatgtgaagatcagtgtctgtactgagctggcccatctggtggacacaggatttgcgttatcgactgcaatgttacccaggattcacgatttctagcatctgtcagggttaagaaaattggattgagtaccaaatacagcagagcaaacccggctttgaggcaagggccccatcaagtagtcatgcagtacttttgttagggttctgggtgcaaatcttcctcgtccctcccaccttctcctggcctccttgtaaacccaaaccgccaggtacctcaattttcttcaagaccaggctgttcttaatgttggtaaattggtcaaggaaatgggtgagccactgcttgctctgcacatcgtcctcagagtgctcggtcttcaggcagtacagcagctgcatggctttggcctgcaggagtaagtggcccattcctaggctgtccccaaagatgtgtcctctgaagaagctggtcaggtagagggggtgtccactatggttatagatggggaaggagatgctgcccaggtcgagcgttttgtccacctgccaggtgtacaggagtgggttgggggcaccacgcagagcatcttgtacctcgcgcacacctgctggtactggagctggcttgcgtttccctgtgccacacgcagatcctgcactgtactgtccagtcaactgacttcagcaaagatgtctgggttcagcagcgagttgctgtgtgaggccaccagaatggaggtgatatcggcctcagtgctcatcctggaggtggagaagtggtcagagtcctctgtggtgaaatggccctacaccaaagtgggagacattcagaatcgaggcgaaattggcctcagtgctcctcttggaggcagagaagcagtaggagtcggtggtgaaatggccctgtgtgaatgtggaagaccagcagattggaggtggaattggcctcagtgcttgtcctggaggtggagaagcggtcagagtccttggtggtgaagtggccctgcacaaaacgttgctcccccttggccggtgaaagaataaaagaaagctggccacttgcatttccgtttcagtttatagaatacatgttttggaaatagt

SEQ ID NO: 2973 - DNA, 2002 bp, Homo sapiens; identical to SEQ ID NO: 2972

SEQ ID NO: 2974 - DNA, 741 bp, Homo sapiens
caatgaggggcagagaattatggtcatttttgaaatcagtctacctcagtcaacaaaagcaggttcttttaaaacacttttgaagacagatcaagagaaaggaagatacaggtaaccagtcaagaataaaaaaatgagacatcgtttcagatcttattggtattaaaaataaattaggcatctattttaaatcaacaaatttgaaaatttagacaaaatggatacaacttaaaaattgacatacgaaggaatagaaagtctgaatccataatttaaaactttctgtagtgaaatctctaggctcaggtagcttcaccagtgaattttattcattatttaaggaagaaataacagccatatacaagcctatctggagagtggaaaaaggaggaatacattccaacatgttttgctaccagaataaccttgataccaaaacctgagacgtgtattatgagaaagaaaaattgtgggccagttctatttatgaatggacatttcttaaaaaaaaaaatcaccagaatgccaggaaacaatttgctcaagttgattttgcattaaattggtttaacatttgaagttgaaattgaatttgaaattaaatttgaagttgaagttggttaacatttgcagttgaaatccactgcaataacagaattaaggagaaatgttgttttaatagatagtgaaaaatgataaatttagatatccacttgtagttgggaactcttagcaaactaa

SEQ ID NO: 2975 - DNA, 3263 bp, Homo sapiens
agaaaacatcttgctctgttgctcaggctggagcgcaatggtgccatcgtagcttactgtaaccttgaacgtctgtgctcaagcaatcttcctgcctcagcctcctgagtagctgggactacaggtatgcatcattggagagcagtggcactgtcatagctcactgtggccttgaagttctgggctgaagcaatccttctgcctcagcttcctgagtggctgggactacaggcatgaaccactacattcggctaattttaatttttttttgtagagacagggtcttgttctattgtccaagctggtcttgaattcctgacctcaagcaatcctcctgcctctgcctcccaaagcactgggattattacaggtatgagccaccgcactgggccgtcatgcttactcttcggagagagaagtgaagtatctgaacgcctcagcctgagaatgggtcatttgcaaagtaaataaaggcaatgccaaacgtcagtacaacaagcaaggggtgcattgggattgttgtgaggattcaatgggacagtgtatgcaaaccacctaatacaaggcacatagtaggagcttattatggtgatggggtggcattggccacagggccttgggctcagcctgtccctctgtccctctgatctggatgggtgggtatccagggaagtacccctacttgataggcctcaagccctccctccttgtgtccagatcctttcagcacctgcctccacgtcctgcccctctgccctctctccctggcatgatcctggccttccagtcacatcccaaaatcactttgcctggtttcctttgggaagcaaagcctgtctggggccctccatagacagagaagctgtgaaggagataaatgctgaagaaggggtgaggagacagactcaggggccaatcaaagtcaggaaacaggctgggtgtggtggctcatgcctgtaatcccagcactttgggaggctgagccgcggatgacctgagttcaggagttcgagaccagcctggcacaggagaatcacttgaacccagtgagccgagatcgcttcactgcagtccagcctggtgcagtgagctgagatcatgccactacactccagcctgggtgatagaacgagactctgcccaccaaaaaataaaaagccaggaaacacacatactcacacccctgcatccagactcacaccagagtcacccacacccacatccaggcacacactcacacaagaacacacacccgaagagacagagaggcgctcattcttgacaaacttatacaggattttgcaatctgaaaattcagaataaggctatttgaattccagtatcaatatcagttttgtgtcattctgcaaaatactgttttgttgtgaattgaacagtgaggggctgggacagtgactgggggcatcaccatagtcaatgcttagagcctcaaaaggttgtaatctggctctggggaggagtgaggctgagctgagtctcccacggtctttagaatgtgtcctggcaggaggactgagaacaggctggtcaggactggagtcagctaatggacagacagggaccagagactgttgctgggggaaatgcggctttatgcaagtatctcgggctgggcaggggaatcacccagactgcttacccctcactcctcatgctcattcttttagaactgttccaaggtgtttaggaggtagacttattcacttgggaagtctttctttgttttttgtttttttagagacagaatcttgctctgtcactcagattggagcacagtggtgcaatcatagctcactgcagcctcaaactcctgggctgacatgatcctcccacctcagccttcagattagctgggactacaggtgtggctgattaaaaattttctttttttgtagagacagggtttcactatattgctcagcctggtcttaaacttctgggctcaagtgatctttccatctcggcctcccaaagcactgggattacagatgtgagccaccagcacacccggccatcatttgggaattcttgctggtggttattaaatctgctaatgtccttagtttcttctactaacattcagagcattctagtttctgggagagtaagtagaaaccaccggatatacaattgcattagtcaggattactgttactagttgctgcaactaaatagccttaaatcaccactggtttacacaacacaggcttattccttgctcatgctgcatctccagtgagagccaacaggagtgtctctctgctccatatagtcactcagggccccaggctagaggagacattacagaagacatgttgtctttgagatctctatggaaggaagagaggaatggatgaggcatgctggccttaactgccttgacccctgctcataaccctaaacctagcctgaatcctagccgtagccatcacttaaccctaacttaactctagtcctatccctaaccctacccctaaatcaaatcctaatcctaaaaacagccctagcttcaatcctaactctaccataagccctactctagccctaaacctaatgctaaatctaagtgaggtttgcaaaatgaacccggtgaagctgatactaaactttcctcttttattctgttgcactcaggccaaatgagtcttgaggagttgggaaaagtgaaactccgcctaaaaaaaaaaaagatagatacgctgtttttttctttttttttccacactagagttttatactcttctcacatagttttgttcttttcagtaaaagtaattcattaaatctaaacctagctgtgatggtttcttgtttctttgcaggatgtattttgttttgcttgttaaacaagtaactctacaaatcggaaaacgtgccttgtcagtataccccaggtatggagttttcgttgatcaaatatggtccctggaggtctgtttagggaccaggcagggttttttttctagcactttgtaggagcaaagaaccaaggccagggctgggcgcggtggctcacacttgtaatcccaacacttcaatgggaagaccacttgaagccaggagtttgagaccagactggacaacatagcaagacctcatctctacaaagaaattaaaaataatttgtcagggccaggtgcagtggctcacgcctgtaatcccagtactttgggaggcattcatgcagagctggctgtgtgggagactggagttctattattactcaaagcagtcccctggag

SEQ ID NO: 2976 - DNA, 1813 bp, Homo sapiens
agcctcccaagtagctgggaccacaggtgtgtgccaccacacccagctaattgtttttttttttttttttttttttttgagagatgggggtctccctatattgcccaggctggtctcaaagtttcctcagttgtgcaatgaaggggagggttccatgacctctgaggcagcccggctctcctgtccacgggctgctaccaccttggagggcgcgaggtttgcttccggtgttcggggcctttcccagtcactgcctcaccaggacaccctcacccgtgtcaggctgggaaagggctttcttaaccttgtcatgccttgctgtggcttgtcgttggtgtaatctgtgagggcttttgtagctctgcgtaatcatcagggtgaacgggaggtactagaggacaggccagacagcctggaatgacacaactcagggtgacaccaacaggtcccactggctactttgtcacctccttttcttcactcccccctctggagttactaatttccactttgtgaccctccaaagatgcattccacccaactttcccattgaactagtggggaaatggtactttctgtatccaaatcttagctgaaaccagaattggggttatattgactaaaagatcatttggggccacttcttttcatttgtatttattaggcccctcctaggtggtaatgggccaggtagagtgagagtacagtagaaacccaagacgaaattatccaggaaggtcaaccttcattttacagatggagacacgatagttcagagatgcagaggacctcgcccaaggtcacgcagataccgggccagtcttgggtttggaacatgaggttcctgcctttcagccccgtgatctttcgacagcatcttacacaacttacagaatggtgggggaagcaggaatcgcacctgcaaaacaatgacggaaccctgagggggcagggctcccattgccagtgacttcccacccacagtggctgtcagtgcctttatgttgtttacttaaatgtgcttgtctggaggttgtcattttcttttgagacactgggaattcccataattttttaaaaaagttcagtaaaattgaatttctacatttttgcccaatttttttcctttttattttttatttttttttacagagtctcactctgtagcccaggctggagtgcagtggtgcaacctcctcctcccatgttcaagtgattctcctgcctcagcctcccgagtagctgggactacaggtgcgcgccaccatgcctggccaagttttgtatttttagtagagacggggtttcaccatgttggccaggctggtctcgaactcctgacctcaggcgatccacctgccgcggcttcccaaagtgctggaattacaggcatgagtcaccttgcctgtcccatttttgcccagtttgtgtctcctcggtgtatgagtgtgtgtgttttgtcaggggcactctgttcctataggttggtctgatttgggactctctctgtgtgtgctttgatgggggcacagtgacaggagatggtggaaataaggcgtggagaggctgtattgtgccatcataccttaccaggacactctgtgcctggagggggaaagggagggggccagccatgccaggctgagaaagggctttcttaacccacaagtgtacaggccttgaaggctcatgacttagggtcattgtcacccattcattcagtcaaatctggaaagcattcaaaaaataattaaaaaatcacctctggggaaaagtctggtgtcaggttcagaaaggatttgtttcatatcca

SEQ ID NO: 2977 - DNA, 3025 bp, Homo sapiens
gcttttggtgttttagccatgaagtctttgcctatgcctatgtcctgaatggtattgcctaggttttcttctagggtttttatggttttaggtcttacgtttaagtctttaatccatattgagttaatttttgtataaggtataaggaaggggtccagtttcagttttctgcacatggctagctagttttcccaataccatttattaaatagggaatcctttccccattgcttgttttcgtcaggtttgtcaaagatcaagtggttatagatgtgtggtgttatttctgaggcctctgttctgttccattggtctatatacagaacactttcatcaccccaaaaagaaaccctttagcaatctctccccatttccttccactcttccccccggcctttttttttttttttttttttgaggcagagtctcactctgtcgcccaggctggagtgcagtggcacaatctcggctcactgcaaactctgcctcccgggttcacgccattctcctgcctcagcttcccgagtagctgggactacagatgcctgccaccatgctcagctaatttttttatttttagtggagacggggtttcaccgtgttagccaggatggtcttgatctcctgacctgatgatccgcccacctcagcctctcagagtgctgggattacaggcgtgagccatcgcgcccggcctcttccccaccattaatctactctgtctctatagatttgtctgttctggacattttgtataaatggaaccatacaatatttggtcttttgttacatgcttctttcacttagcttgatatttccagggttcatctatgttgtagcatgtatcaatactttattccttcctattgccaaataatattccattgtggatataccacgttttagttatcctttcattggttgatgggcatttaggttgtttctactttatggctattaggaataatgaataatggctgttataaacatttgtataaaatagactccatcctggaggaatggcatgtgaatacagggtgagaggaattggtgaccgtctgtgcaaacagtccaccacattctgccctttgctctcaacaatttacatccccctcatatgcaaaatatatccacccccttccaccaccactagatgtctcatccaataattacatcagcttgaaatccagaatattatcatctaggtagtctatatgtaggtaaggcctctaacctgccatactggtccatataccctaactttgttcatgctgcttcctttacttcccacctctcattcccactctgccacaacctaccctacacatctctggcgatcaaaagaaaatatctcttcttccttgaagcttttgcttacctatactatacctccagtagaatttaccactcctatttgcttcaactgcaccctatacagacttctttcagagcccttcttcttgctccagattcaatagtgtctaccttatgtacagtccattttagcttttttatgtctgaattcaatcaaccttgctcttagtgtttaggctttcactgtttgttttggtcaagactcttaaggctacaagtgatagaaccttagccttagatattaaccagcaacggaggttcaccagacatctgagtaaagaaagcctccaagataaaagatgatgatccaaacagaaaaaagggattctgagggaacaaacattgcagggagaagaaaaccctcctaccagaaagtgggggaatcctctaatactctttttttttttttttttttttttgacggagtcttgctctgtcatccaggctggagtgcagtggcgcaatctcgggtcactgcaacctccgcctcccaggttcaagtgattctcctgtctcagcctcccgagtagctgggattacaggcatacgccaccaagcccagctaatttttgtatttttagtagaaatgggatttcactgtattggccaggctggtctcaaactcctgacctcaggtgattcaccctcctcggcctcctaaagtgcagggattacaagcatgagtcactgcgcctggcctgctaatattcttaagttatactgaagataaatcttattgaaataagagcagtggtactgtataaaatgaactctggaaacaaaagcacttagcaaagaacaatgtgaaactgatctcaccctaaggattagatccaaaaggtccatttggcagccagatcttgccagagcagaatttaaggcatttgccataggtggaaggttgatgtatgttttggttatctattgttacgtcacaaaccacccccaatcttagaggttccataatttggacagggcttgagcagaaagattgattcatctctgctccttgttggcacctactgaggctggaacgtagataatgataagcaatttgctgggttggatttgtacactttctaccgtccaatatgatccatcaactttcttcttggctttgtattatgtccaaaagggtactcttggattgacttacacttgcaatacagagaaagaagccatttggtttggccagtgctttagaagggagaaaggggtgggagcatgatgtccaactgctgggaggggtcaggaggcacctacatgctagtatttctgtgtgcattccaaaccagtgttgggtttctccacttctactggctttgtttgatcttattgtccttgaagatttgattaacttcaaccctattctgtcagctgtttcagttccaatggaaccttgtaattctggctcattataacaagaaattatctcaaatccaaaaagaaaaaaaaatcacgtctggtatttcagctgacatgattgaaacagcgtagggttggttgtctctgtccctctgcatggtctctcagtgctgctgtcacagcatgagagtttcagagtaggtgggttttttccatgttacaatgcaagaatggaatctgccaggccttcctgcacatgtacccctgaacataaaataaaagcctt

SEQ ID NO: 2978 - DNA, 19996 bp, Homo sapiens
agagctgctgcgagaagaagacccaggagatctggggcagcgagctgtgcgtctgacagcgcaggtccagcagcgtgggccccaggaaggcgatgcacaggccgaagctgaagaagacgctccagtaggtggcctcgggctggctggtgggttctgtgtgttcccgctcctaagggagccaggatctggcccctggaggcagaacagtaaggccctgcggtgtcccctctgcccaggtcttctggtaatgacaggagccatgacatcatttccactggcccaccagggggaccagggctgaaaagactgaggagttggttgaatttacaaatgcagaacccacagagacagggggccaactgtgcagcagtgagggtctggctctgtaacccaggcttgaatgcagtggcatgatgggtgcaatcttgttacctgttactggtctcttcaggttttctttttggctcaatcttgagatggaggctcgttttgttgcccaggctggagtgcagtggctattcacaggcacaatcatcatacactgtagcctagaactcctggcctcaagcgattttcctgtctcagcctacaaagttgctggaactctagaaaatgcagctgaaccaagcctgcctatcttgtctatgagcagctgattctttgaatctaaagaattgatacaggacttgatacatgtggaataacagaaagaacctggaccgtggagtgagacaggcttagacttgagttctggctacacacttggctgtgccaactcaaggcggctaccttgacattataaggctgattttcttcaactgtaaaatgtcgatgtaggattacatgataacacatgcaaagcctctggtagaacactcagggcagcactgctcatgcttcttagttgccttcccctgatctggagtgtcaattaatcttggtttgagttcctcttgcccaccagtgcactttggtcccccattcagtcatgtagcaaggggctattcctccagctgttcttgagtaagcatggcacctcacattcatatagaatggttactaatagtcatccaagttattgagaaaaatattgaccacaatgtaccactctcccactccactttttcctaattaatctttcctttgggactcagctaagttgttcattctgctgggagtgctccacccacccagagctgccccgagtgcctgccttgtgttctctgcatcccctcaccaccttcctttgtgacaagcagctgaggtgtctgtaacccgaatcaatactggatcagctccttgaagatagagattgggtcacacaattatccttatatcttagagcacagcacctgcctggtacatagctggcattcagaaaatattagctacgcaaaaatgtgtttaagtattataaccttgagttgatgaaactctgaggcaagaaatagtatttatagaggatttcatgaaaaatgtacaatttatcgatctcatcagttctcagatttggctatatattaaaatcccctggaaacatagaaaaaatcagaatctctggttggtggagtcctgtgttggtattttgcaaaagttcccaggacttcctaatgtgcagctagggttggaaaccactgctccagaaaatccacattttaccactgaagaactgcctgcatatcctgtaccatttaggccctgcactaaagtgcctttattgaattatacttgggctttgtgtccaatttgactgaacctgggatataactgtgcgactcttgtcaccggagatatggggagatgttgttgtcaatggatcctctttatgaagacacaccagagagatgcctattgggcatcagcaccaaaaaaaggccatgatcctcctgagcaaccagttcatgtttgtcttacggattccaggaatcatttaattaacactattttccaggtttgtagtagctgctgcaaagctcaagatcaaagccatggtgcatctttatcacctacaaagaattttgtggtgtgtgtgttacatattgacttggttctgcattattttttgtctttttctcttcaccctctgatatggtttaggtctgtgtccctacccaaatctcatgtcaaattataattctcaatgttggaggaggggcctggtgggaggtgattggatcatgggggcagacatcccccttgctgttctctcaataatgagtttttatgagatctggtcgtttgaaagtgtgtagcacctcctcctttgctctctttttcctgctggccatgtgaagatgtgcctgcttccccttcgccttccgccatgattgtaagttttctgaggcctctccagaagcagaagcctgtatagcccacagaactatgagtcaattaaacctcttttctttataaattacccagtctcaagtatgtctttatatcagtgtgagaatgtatgaatacaccctcctttccttaactttttctataataaagctttttaattgagataattcacatatcataatattcgcccttttaaagtgtacaatccagtggtttttagtgtatttacaagattgtgtgaccatcactactaattccagaccatttccatcaccccaaaaataaactccacacccattagcagtcacttctcactctctcttcccctcgacttactttctgtctttatggatttgcctgttctagatatttcatatctagatatttcatataaatggaatcatacaatatgtggctttctgtgtctggtttcctgtacttagcataatgttttcaaggttcatccatggtatcagtagtttattccttttttatggctgaatagtattctattgtatggacataccacattttgtttatacattcatcagctgttggacatttgggtttctactttttggctattatgaattatgctgctgagaatattcatgcacaagtttttatgtgaatatgttttagttctcttgggtacatattagaagggtggtttgctgtgtcagatagtaactctgtgtttaactttttgagaccctttcctcatttaaagaaatgtttttgtcttatagtatagtatgtatctctgtaagccactacagattcctctttttggaatgaggtggcatataaataaataaataaaaagtcacaaagcactcccaagccatctgtttaataatctgtgccagaatgttgccaggattctatattgagccgtttggtctataatttccagaaataccttctgtctccttgtaaaaatcggaacattttcccatctccactgtcctcaagtatctaggttgtttttcagtcctacctgcaagggatttcatgactctggtgtcctacctgaatcaggcccccagaactcatctatggccacaaaaggtctgccctccaccttctcatctgtcttgtgacacacttaaaatgttttgtatcaaagtaattcatgcacatggttaaaaataaactagaacagaagagcttacagtcccctacctcatccctcccacccctagtcttgctccccagaggcaactgcttctaactcttttagctctttattctgggagtaacttccatatctctaaataatatgctaatgccactgttccttggcttttcaagtttaaacatcctctattaatttataactatcaaaaatgaggtggggcacggtggctcacgcctgtaatcctagcactttgggagggtgagacaggcggattgcttgagctcaggagttcaagaccagccagaggaacatggtgaaaccctatctgtactaaaatacaaaaaattagctgggtgtgatggcacatgcctgtaatcccagctacttgggaggctgagacaggagaattgcttggacctgggaggcggaggttgcagcctgggtgacaaagccagaccctatctcacacacacaaaacaatgataataataataatttatcaaaaatgaggatttagtttacatatctaatccaaacaaccgtccccccaccctactgtcagtacagttatataactgttcttatttaattcctctaaataaaataaaaataaatctgtcaattacctctgttgctttaagtgactacatctttatttttcatcccactagctgttgatagtagttttgactcactgtttataggataaagatatcatcactcctacctttccctttaggctgcccttcccaacttctgtcttctgaacatttacttttttttttttttttgagacagagtcttgctctgtcacccaggctggagtgcacccaggctggagtgctatggcatggtcttggctcacgacaaacctccgcctcttaggttcaagtgatccttctgccttagtctcccaactagctgggattacaagaatgcacgatcacacccaggtaatttttgtatttttagtagagatagggtttggccatgttggccaagctggtctcgaactcctaacctcaagcgatccacccacctaggcctcccaaagtgctgggattacaggaatgagccaccacgcctggcacatttactttaaatgttcaatgttgacaacatttatgttccaattttctcattagattatgttctaatcttctgtgctttgcttataggtttctaaatgtttaaatccaataaatagtgtttacattttgtgacaatgtaaatattgtttattacagagccacacaatgtcctatgatgaattttcttcttttatttcttctagtttttcataagagtttctaattgcctttcttcttctcgtttcccttctcttttttctctctctctgtctctctctttcttagacagggtctcaccgtgtcacccaggctggactcaagccatctttctaagtagctgggattacagacatgtgccaccatgccaggcttattctttaataatacccttgtcatttcctcaagtctgctctcacctttccagcaaatgagtagaggtgccttatttctcaggacctgttacacagagccctctgcccttccgccacataggtgttggcctggggcttcttcctttcactgatgccctgggcctggcagccctctctccctccctccttctcttcctttcttctgcttgtttcttctttgtttatgctctcattttgctgtaccacatctttaatttctcaaggagtgtgtggtatgtaggttttctgagtccctcatgtctgaaagtatcattgctccaccctcacacttgaatggcaatttggacagatatagaattcttgattgaaaattgctttggtcattgaatattgaaggcatagttctagcctttgctggtgagaactttgagaccagtctgatgcatatatatatgtgtatgtatatatatatgcaaatatatatacacatatatatgcaaatatatacatatatatgcaaatatatatgcatatatatacaaatatatatgcaaatatatacacatataactatatatacatatacatataaatatatatatatatattttttttttgagatggagttttgctcttgttgcccaggctggagtgcaatggtgagatctcaattcaccgcaatgtctgcctcccaggttcaagtgattctcctgcctcagcctcctgagtagctgggactacaggcatgtgccaccatgcacggctaattttgtatttttagtagagacggggtttctccatgttggtcaggctggtctcaaactcctgacctcaggtgatacacccgccttggcctcccaaagtgctgggattaaaggcgtgagccgccacacccagtgtctgatgcctatatttttagaggtactctttcttttttctttcttttgttacctctaaggaaatttttaggtaacctttctttttttctttttttacctctaaggaaatttttaggatctagatatactatcatttagatataaaactaattctcttaccttccaacaccttctaatgacttttttatttctgtgatcctatctttaatttccagtagttcacacttattctctgattactccttttcatagcatcctgtccttgtttagggatgtaacacctctccaatctatctgacaaatgcctgaaatatttaaaatgttcttttgtcttctgtttcctaaattacttctctttcttatggagctctgccctgaccaccaccaccatttatccttgtctctttttcatgctaaggtcatttttcaaatatctgacgatctttgtcttatcatatttaagagtgagccatcctggtcagctggcagatttcatttctcttttctttctttctttctctttctttctttctttctttctccttccttccttccttccttccttccttccttccttccttccttcttttttttggacagtctcatgctggaatgcagtggtgcgatcttggctcattgcaacctctgcctcctgggttcaagcaattctcttgcctcagcctctcaagtagctgggattacaggcgtgcaccaccacacctggctaattttttgtattttttttgtagagatggtgtttcgccatgttggccaggctggtctcgaaccgctgacctcaagtgatctacctgccttggcctcccaaagtgctgggattgcaggcatgagccactgtgcccggctcatgaatggaaattttcaattccctcttaatgtgtgtgttttatctttttcagaatggtcattctcctaacataggagaatgaaacaaattgagagcttcatcatcataattaatatctctccctctgtgaaacagaggctcctgaaatctgagaggctccttccttctctgttgggctcttttttttttttttttttgagatagtgttttgctgtgttgcctgggctggggtgcagtggcgtgaccactgcttactacaccctcgacctccctggctcaggtgatcctccagcctcagtctcctgtgtggctggaaccacaggcaccgcaccaccacacctggctaaattttgtattttttatagagacggagtgtcgccttttttgcccaggctggtcttgaactcctgggcccaagcgatcctcctgccttagccacccaaagtgctgggattacaggtgtgagccaccacgcccagcttgttgggctgcttttgtttctgacttcagatgcagcttcccactcgtccctgtcagagacctttgcttcctcacctccaaatgccaatcatgtctgtgtcctgtcagttctaagtctggcatgttccttgaattcagggctccagcttcttctactgccttagtccagtggttctggcccgtagttcagttccaggcggtttctcctgtacgattgtagcagcctcctagctggtccctgccaaccctcccctaatccagccttaccagctctaaattcagactttattatgtccctcatttacagcaaaagaaggacattttaaagcaattaacatcacttctatggagagctatttggtgatatccaccaaaatgataactgcacctgccctttgacctgcaatttcacttccaggaagttatcctgcatacagagttgtacatgtaaaacatgacgtatgtaccaagttatttattgcagcactgtttataaataaagcaaaagattatagagagggaatggtggcgtgatcacagctcactgcagcttctacctccctgggctcaggtgatcctcccacctcagcctcccaagtagctgggaccgcaggcatgtgccattatgcccagctaattgttgtatattttgtagaaattaggttttgccatgttgcccaggctggtctcgaactcctgagctcaagtgatccacctgccttggcctcccaaagtgctaggattacaggcttgagccaccatgctggcccctatgtttattttatcttatgtaaaaatgcagattcactgagctagatgaatgcataggtgactagtcctctgcccacctctcacatgtgaagggctgatcaaagactcaaaagaatgcaaccatttgcctcttatctacccatgccttttaaaaatttcttcctttcaccaatatccaccctttcttctttaaatattgaagccctcaaaatcatccttggagacaggcacagacctgtcttctggatgtgcatccttaaccttggaaaaataaacctctaaattaattgacacctgcctcacaaaattcttggtttacaaaagcattaaaatattaactagcagtggttgtttataggtagttggcatatgagtgattttaatctttatcctatttctgtttctccctcaattttttttatgataagcatatcaattctaataatcagccaaaaaaataatggatgctgccctcccccacatggtgcacaggaccaagctcagtgtcttcaatgcatttccatcctcctcccctatcatttcccaacctcccccagcacagcaggatcggtggtttctgaacatggccccttggttgttctcccctgtcctgcagaaatgcgacccagcttccactgtgcagcttgtgtgtcacccccttccagatagaatcagcggctcttcctttgtgcctatgtagccaactgtttcccactggcctggattcctggtgggtgtggaccttgtcttcttgtccctttgccacctaggatggcccccgccttgactcagggggcgtgccgagtgctggcaaatgcagctgaatgaccacaagcccttgttggcttcctccaccttctgtgagatggctgggttacgagagtccgagttggccacagtcctctcttcatggtggtgtctcctttctgggcatcactctttccggggtgttctgccagacatgctgcagtgcttgttccccactggggggggggccctcgacttagcagcatccttcagacagagctgcatcttccaaaccaaggatggttaccgaccaacccccagaggtctagctggaggaacaggggctctcgggacggctggttggcctcaggagaggggcaagaggagggctttttctcacatcccgtcaggaatcttggagaaaatggggctgggagcccaagtaacacatttgtcctgacacttccactccctcctaggaaccttccaagtcttcttgcctgcatctgtccaaaagaaaattgggcaggaggggaggagacaggagcaggggagtgactgaagcagggcccaaccccaatctatctcctttcctctcagaggatttgagatggttccttgccttttagcagattcatggagaagagcatagctggcagagaatcccattccttcccagtttctcagcgtgcaaagatcccttaattcacagactgcctgcacccatctcttacccaagccctgccccccagtccacatggaagttgaacctaaaggaaatgttttttgtttgtttgtttgttttttgagacagagtcttgctctgtcgccaggctgcagtgcagtggcgccatctcggctcactgcaacttctgactccctggttcaagggattctcctgccgcagcctcccgaatagttgggattacaggcacgcgccaccacgcacagctaatttttgtatttttagtagagacggggtttcaccacattggccaggatggtcttgaacttctgatctcaggtgatctgcccaccttggcctcccaaagtgctgggattacaggcgtgagccactgtacctggctggtctcttttttttttttttttttgagatggagtcttgctgtgtcacccaggctaaagtgcagtggcacgatcttggctcactacaacctccacctcctgggttcaagcgattctcatgcctcagcctcctgagtatctgggattacagatgtgcaccaccacgctcggctaatttttgtacttttagtagagacggggtttcaccatgttggccaggctggccttgaactgaccctcaagtgatccacctgtcttggcctcccaaagtgctgggattataggcgtgagccaccatgcctcactgaacctaaaggaaatggaagagaagagcaggccgtgtgcagtggctcacacctgtaatcccagcactgtgggaggccgaggcaggaggattccttgagcccaggagttagagagtagcccgagcaacatatcgagatcccgtctctacaagtaataaagtaattagccaggcatgctggggcacacctgtagttgtaactactcaggaggctggggtgggaggatggcttgagcccgggatgtcaaggttgcagtgagccaggattgcgctactgcactccagcctgggcaacagagtgaggctctgcctcaaaaaaaaaaaaaaaagagagaagagcaggtgtcaaattccttttatgtccatctatgctttctcttaagcagccttggtttaagagatactaatagagatacttcctaatctggctgtcgttgctttcatccttatccttataccctagcagatttaccaagaggataaatcccagctggaagtcttggacatctggctccattttcagcattatctccagattagggcagccagggagaaacttggatgtggagggcacacagccctgcacagacacagacaactatgaagtcaactattaaaagactccccatgcataaaatccttccattaatagtcaataatggctaatattgtgtgacatattttgaggacttttcccctgtgtcagggaagtgggtatgttttttatatctccatattacacataagaaaactgaggcacagagaggtgaagtaagtggcccaaggtcgctcagctagcaagtacactagccaggatttgagccctctggctctagagcctatgcccttaaccacgaggctatcctgctagggttacactttccttttcagggtcttgtgaggcacagcttgacccctgaccctctttgggtaccctgggccaccccatgggtccagagtctgattttgaactctaaccagccaccccaccccagcccttggctccccagcagagtgaagtgggtctgctccagcttgaggctactaggagcccattgatggcattgcctagagccacatcatgcagaatgagctcctggcagcacaagcccgcgctgttcattcggagctgcggcatgctcactaggtcctcatggtgatgctgggaggtggactagagtatcccatttggcatgtgaggaattgagctccgtgagattaagtcactggtccagaatcacagagtagccaagccaggattcaaacccagacctccacgtgccatgtgcagctctcctttcacaaatccacagctgcactccagggattcccggctgacaaatgtagtttgggtgtcttactgtggtctttaacccgcaggacccaaagctacagcgtttccagtttctttccttcccagactctcaggaaaccacttctcaaacgtctacttgctacagaattgcttgaggagagtatttaaaatgcagattcccagagttcatcctccagggattctgactttggaggtctggggtagggcccaggactctgcattcttagcagaccctcagataattctgaagcaggagggtcctgatgcacccatctctgagaaacctgctttacacccatctgagtggtatctgtcccaacccctactcatggcaaggggcccataaacctctgagggatgactaaatgttccggtgtggttcaggtttctctctgggggttgaaaatgttataaagtgcaatgggagattttctaggcagaagatgggtcctttgccttctgagagatggggctacttctcttgggtttcactctataggtgaaggcggagtgaggggagagggccgccccttgagggctcagcagggccctagcctgcgcctgttttcagaccaggttgctgctcttttggctgacgtcataaaacagagccctgggtgggcgtggtggctcacgcctgtaatcttagcactttggaagctgaggcagcgggatcacctgaggtcaggagttcaagaccagcctgctcaacatggtgaaaccccatccctactaaaaatacaaaaattagccacgtgtcaagtgaggagcacctctctctggccgccgccctgtctgggaagtgaggagtgcctctttctggccgccaccctgtctgggaagtgaggagcacctctgcccggccgccgcccaccatctgggatgtgaggagtgcctctgcctggccgctgtgcaaccctccaagtgtgaagtgacagccttgtgggtgatacttctgccctccccaagtttgcatttttgacattgaagtttactttttaattaaaagttttaaattggagaataaaaaaaaattagccaggcgtggtagcacacgtctgtaatcccagctaactgggaggctggggcaggagaactgcttgaacctgggaggtggaggttgcaatgggccaagatcgtgccactgcactccagcctgggcgacagagcaagactctgtctcaagcaataacaacaacaacagagccccaagtcagtgtttctcaaccttgccccaaccgcttccgaatcacctgttatttgtcaaaaatgcagattcctgcccccaactctgatttgttgaattaggatgaggaagaggggacagcgcccagaaatctgcactctcggctggcaccccagccatcacttatgcacctgaatgcttgagaaattctgtcgcagaacatggactttggagtgtcacagacctgggttccagtcccagctctgccacaaagtagctgcgtggtctggagcaatctcagtctctgtgaaactcagtttcctcatctaaagaaataggttactacacaagcttattggtcttgctgtgagttgattctcacaagaccaatcaaacaatgaagaaatgtacgcaaagcactgggcacctcggagagatggcacccccagcctagtggtaaagagagggatgcatagaggaatgctttctctgggaggaaagagctgggagcactgagcattactcacccactggcaaacactgacccacttcaaaacaattctgactttccatttcctctggggggagctcagtgaagctttcaaaggtgactaggtcctttcccatactcaggtgtgagccatcccaagtcccaagttggggtcaggtgttgtaaacaaaaaataatacaattttgactccttccacacctccagctgagccctccatccacggccccacctgccatttcccctccacgtgacattcctagatccctcactgggtggcaggcccagtctgaaaggccctcttggcaaaccacgggtctgccaaggtccctgggacctgtagcctcaaagccaggagtttccaaatccttccttctctttggctctcccagtctggccatgcaaagaaacgccagagcttttaaaaagtttcggccattcataatggattagtccactccggaaacattccccagctctgctgagagcctgccaggcgacttggtgacgtgctgctctcagcgcacacaatgggcatgggagaacaatgacgaggagaaaaacatcccgcccgcgtgtccatgggctcacatcctcctaggaccccgcccccgcatgcgctcccagagctgggggagtggggcggggggacggggagggagggatagagagaggtgctagaggacaactgcgagagcaagtgagggaggggaagaggaggagctcacccaaatttccccggtttggctgcattctgaaccagttgggtgagtcagattagaagccaaatctgcttattctggctctcctgctagccccgcggccactgctcacggcccgatgctgaaacggattaaaacctgagctggcaaacaaaacagttcagagttactgacctacggtgcacagcgttggggcaggggtgtgcctggtaggaggccaagtgttgccacttaacctcccatgtgcaaggagttcaaaatcccaaagcctcagtttccccatccactgaaatggggaaatcgtgcatgctctgtttccctcacagaaggtgaggcaacaagggctactgggcgtgaaagcattttcataattattaaaaacattagccaggcgcggtggctcacgcctgtaatcccagcattttgggaggttgaggcaggtggattacttgaggtcaggagttcgagaccaggctgaccaacatggtgaaaccccgtttctactaaaaatgcaaaattagtcaggcatggtgacatgcacctgtaatcccagctacttgggaggctgaggcaggagaattgcttgaacctgggaggcggaggttacagtgagccgagattgtgccattgcattccagcctaggcaacaagagtgaaactccatctcaaaaaataaataaaaacaaacaaacaaaaacccaaataattatttaaaaaaatacttggtcaccaggtggtgtcattcctctgacaaagccactgggggaggtcacagccaggaattagaaggcatggcgcttttcatcccaggcagcttacaacttaaacccaagaaagagacttagacactgaaaacctagatacaagagtgtagactaagctgggtgcggtggctcatgcctgtaatcctttcactttgggaaaggaggatgtgagcccatggacgcgcgggcgggatgtttttctcctcgtcattgttctcccatgcccattgtgtgcgctgagagcagcatgccaaggtgggcggattgcctgagctaaggagttcaagaccagcctgggcaacatgatgaaagcccgtctctactaaaatacaaaaaattagccgagcatggtggcatgtgcctgtaagtcccagctacttgggaggctgaggcagaagaattgcttcaatccaggaggtgcaggttgcagtgagccaagataacgccaccgcactccagcctgggtgacagagcgagactccgtctccaaaaaaataaaaagtgtagactatagacaactagaatttctagactgtctggcttggggtaggtctggttggggattgggagaatgcttgggggatttactgagaagtggtcactgtttctatgctaagctctgtttttcacttaggttataggtatttgggtggcctttcaggcaatggaggttatgagggagctaaggcccctgtggaccccttggcaccagcactggcataggcccacttgctaccaccagaactgagcacatatgggagcattcacggggctgattaaggaaggcttcctggaggaagggagtttgaggcatgtttgaaagaagaagaggggggattataaaacacgaaagtgacagcagacaggtttatgtaacatccaggagcaagaatgagactctgagggcatccaggacccaccttcattgtagggacaaaagcaccaaggtctcagccaggtgagggagtttgcccaaggcacagtgactgaactggaactggtgctgcagggagctggaaggaaggaaggaagtccaaacagagggaacgtggacagactcaggcacaagggcttaaggtaggaggtgcccttggggaaaatgggtccttggtctagtagcaagattgcagagtatgcaaagaagtcggagccagggtacaaggggcttaggcaccttgctagcgaggaggctcaacccttagtggtgacagtgggacagtcagtggaatgtcctgaagcctctctggaggccctctgcagcccaggaacacctaggagtggaggttggggagtagagtttggaaacaccttagaaacaagattggctgtaccccgtgactgtaaatggggactcgagtctaaagtctaagctcaaggcagcaggggtagcccgaggtgcctgctgctgcatggaagggaagggagagagctggccaggcaagagtgggttccagcaagttcctaatgtagcagacatttcatgtttgtattcactcatattttcattcacagctatgagcctagcagtgaggcccaactcagtttacaaggcttgcaaaccaggtgtcaactggctgcctgtcagacaatgcttttaggtgaccagaaggcaaggatttcccagtccctggaaaccagatgcccatcctccatgcaaacaagtgaggtggagtgtccgtgccagtgcccacacctgcccggaggcagctgctcaggtaggctgacctgggttgtaattgacagtccaccttactccctgtgtggccatgcaggtcacctaaccctagagcctctgtgcctttaaaaacagaggccagtggcttcccatctcagaataaaatccagaacccgtaccacagcccgcaagaccccgcacgagtgagcggttctcaaccctggatacatgttagggtcatctgaatcaatctgagctggggccggatggcagtggatcttaagcacttcccaggtggatctaatgggcagagccactgccccacatgatacatccctcctgccatgctgcctggctcactgtgccctggcctcactgcctctcactcattctcaagtacgttcacctcagggcctttgttggaatactctgtccctggctgtccacctggcccccttacacaacatagctcactttttttttttttttttttttttttggtacagggtctcactccattgcccaggctggatggtagtggcatgatcactgctcactgcggctcgacctgggttcaagtgatcctcctacctcagcctcctgagtagctgagactacaggcatgagccgtcacacccagctaatttttttttaaatagagacggggtctcgctatgttgcccaggctgatctcaaacccttgggctcaagcgatctgcctgccttggcatcccaaagtgccagaattacaggtgtgagccaccacgcccagcccatagctcatttttgatggagaggtccctccctgaccaggcagttcccctccctatgccatcacattcttccccctcaaacctgcccctgccttattttgtctcatcacacttatgaccccttgatatgcctgttggtttggataacgtcttataccccccactggaacataagctctatgagagtagggcttggccatcttgttcacggctgtatcctcagtgcctagcacagcaccgggtgcacagtgggttcttgagaaaacctgttgtaatcaaggccatctctgccggcaggtctgagcttctggaaggtaggggtggaatgtcatgcatcttggtgtccctggcatctagcacagggccaggcatggaggaggctgtggctaattcatggtgctgatgatttgctctggagatagaggggctcactggggtgctgtagagtgtcacggccaaaagcaagggtctgagcagtgatagaggtggggagatggcccaaaggaggctgggatgcttcaagaagggaggaaaggagcaggcctgcaacagtgtctgacacttggctgacccagggggcctagcagggtagaggagtggtggcctattagacatcagccctgaccactggacccagagagtaggggcagggtgaatgggagcccacaggagggtggggcaggggagagcgagctccaggtcccaccggggtgcaagatgatgtgggcagtgccaagcacaggagctgatatcacccccaccctgtagagttcagcaaataggacattttgtctgaagctgcagggctgctacatgcctcaaatgcccctgccaagtggccatggtggaggggacggcatctgcaccctggatattcctgacctgtcccagaagcaggcaggtgacaagtgaggcctgagggggaatgacttgtaaaaggctgctttgggccggggattccagcagaatggggcaggctcctgtttttgagagtcaccggcataaggaaatgattgcaggggtgcccaggaaaccgagggctccaggacactgggttgggttgtagctcagcctggtccctgggagcccagtggcagctcatggccaaaatcactcagcccctcttcacacccgaacccagcttccttctccggagccatcactttttgagcaccaatcatatccaaggcctggtgtaggcctgtccagctgagttccacacccccaggctggccggcactcccagccctggcagctttctagggcagaagctcagcatgcctgatgtcagaagcccctaggtgtgtgcctcctcagcagggccacagctgcagcagcaagaacggctgcccccagcgactctgggccacctctgcctgccacaagagttgccttgcaaagtgctcctcaaggcagcatctgcccatatccttccttgtgtgttttcctccctccagggcctctgcactatctccacctcaccctccccacgcctcccactccttaaagaccacagggctggggggcagacacctgggattctaatttggtatgtgaccccaggctacccctgggaggctcctgtcctcatctgcaaagtggggagaaaggggggtttctatgaggattcagtgagacaatgcctgggcacagggctgcctggcacccagcagggaacttaataaatgtctggtttccaattcccaccaatgcatttcccagcccttctcctcccctcaagcactaattgtctgagttacgaccctactttggtgtctggctgcctacaagcaaagtgaggaggtctccttcggtagaactggtgctgagctgagaatggagccctggcccgccccttacttccagagccttgggagacatcatcaacctcagcatcagcttcctcctctggaaagcagccaccctcttaagtaactgcaaaccatgccggcaaactgcaaagtgcttaaggccaggcatgaggacaggtcaggaggcagggtttcgggcctggcattctcagagtggtctcgggaagaacaaacctggacaccgaactggacaacagcaggactctgagcactttgggagctgtgtatgatgtgttgcgggggtgggttgtgtccagatcaaaggtggggaggcggtctaggcagcagcaggaggtgtattcgaggtctgcagcaattcttgcagagcctgaattacagtgaggcccacaccctcgtcctgctgccctggccttggccatctcccatgtcaacctcatcttgatcttgcctacctccctccccagaagccagggggccatttggcatcaggaacacagggattagctgcacggccagaccccagacccccgcccaggggtccctctttgctctcctggccagccccaccccacaggcaccaacttgggccaatgccaggccacaggtcagactcccaggcctgggactcctctgcccacccacaacaaccactgatgctcctcagcaagagccaacttctggctctgaacgcagcagcacccaggatacagcaaggtgaatgctaggcactcgtcccacagcctggggtgtaggggaggtcagagatacacacaaatcaaactctctcctcactatatatatatatatatatatatatatatacacacacacacacacacacacacacacacacacatacacacaagcacaccccacccacactcattaggcctggaggggggacttcagttctccatctttggcatcaatctatcaaagtcagcttttctgtacgagactgctcgctcctttctgtacatgaattaaatatattatctgtctctgcactgagtcacacgacgttcacagtaccgtggggaggagtggagggtgggggcctgaggtgggcagggcagggggcctgggtagaaaggcgag

SEQ ID NO: 2979 - DNA, 1686 bp, Homo sapiens
ggcgcccaccaccatgtccggttaatattttgtatttttagtagagatggggtttcaccatgttggccagactggtctcgaattcctgcccccaggtgatccacctgcctcagcctcccaaagtgctgggattataggcacgagccactgtgcccagccaacaggtcgatatttttgatttaagatggcttattcggccgtaactccatcgtaaatggctcactgcagcctcgacctcctggcctcaagcgatcctcccacctcagcatcccaagtagctgggattacaggtgtgtgctaccacacctggttaatttttatattttttgtagagtcaaggttttgccatgttgcctaggctggtctcaaactcctgagctcaagtgatcgtctcacctggcctcctaaagtgctgggattacaagcatgagccaccacaccctgcccccgaggcggcttttaaccagcatctggggtgaccaatctaagtagacagggtcaggacaacactgatgtgtatacagatgctgtttccctgctgttctcttctaagtatgaatcccggtcccctttgcagacccagtaggtgaatccaattacgtagagcaggggactgtggagctgtgttgtgagcagcacccaggtgatgccccatggcagcatgtcccacattccttccatcttttaaaaaaaatttttctcggtggcagtcttgctctgtcgcctaggctggggtacagtggtgcaatctcagctcattgcagcctcaacctcccgggttcaagcaatcctcccaccttggcctcccaaagccctgggattgcaggtgtgagtcacatcggctccttttcctcttcttgtgtctggaagcactgcttttttttttttgagacagagtcgcccaggctggagtgcagtggcgcgatctcggctcactgcaagctccgcctcctgggttcacgccattctcctgcctcagcctcccgagtagctgggactaaaggcgcccgccaccgctcccggctaattctttgcatttttagtagagacagagtttcaccgtgttagccaggatggtctcgatctcctgatctcgtgatccacccgcctcggcctcctaaagtgctgggattagaggcatgagccaccgtgctcagccaggaagcactgctttggtgcctaagcggcctccgcctgccccacaggccacgtcctcctgtttcgcaggctctctcccaacttctcctgctctccctacaacaggctgacctgcaagcctgcctgtgttctctgccccatgccccacagacaaacgaccagactagtgggcagggattaggtcaacccctgcagagcgtggcaggcacacagatacatgtctcattggaagtgtaataactaactttttttttttttttgagacagtcttgctctgctgcttaggctggagtacagtggtgtgatcttggatcattgcaacctccgcctcctgggttcaagagatcctcccacctcagcctcccaagtagctgggactacaggcaagcgccaccatgcctggttaatttttatatttttagtagagggggtttcgccatgttggccaggctggtctcgaactcctgtacatgtttgtacatgtttgtacagcctacaatacatgtttgataagaaagttattcatgc

SEQ ID NO: 2980 - DNA, 3143 bp, Homo sapiens
ggagagcctggacctggcaaccaggagcgccgcagcgcctgtgaccatggggccaccaagacggcccggcgcggagccagggagagagcagaccaacactaaccccgtctgtgctctcccaggaccttctggaacagagcaggaggtgaacctgttgagaggtgagtgagctcaggaagaaaatggaccgagagacagagccagccctgcaggacacgatcctcggctcacgcccaacagaagctcatgagtctctccctgccactgtggtggtggcgacctgcagcagccttccctcccccagggggaaggagggacctttctctcgtcctagggatgagacacctgcctggggcatgaggcccggctccttctcccgcagctgctgcaccagctccagcaagaagggcacctctcggaaggccaggaagcccgacacgtagggggctgtgaggctgaccatgcggctctcctcatacaccacctgacaccaggcacgcagctcagtgggaagcacagccttcggccacctgctccatccccagtccgtccatgccctgcccccctcatccttccctctcccttacgtcaccctcatggctccccttccctgcctcacctatgagatgatgggtttggaagaaggaactagaagatgtaccctgcaaattggtggtgggcaggtacccccgggacctggtccataggagcagacccccccaggacctggtccgtagcagcagctcccccgggacctggtctgtagcaacagcacccccaccccgcccccaccgggacctggtccatagcagcagccccctgggacccggtccatatgagaacccccaccccggacccggtccactggaggagccccaactcccagacctgatgtgtatagtaggagcccctgggacctggtccataggaggattccctggtatctggtctgtatgaggagcccccaggacctggtccataggaggattccccgggatctggtctgtatgaggattccccgggacccggtccataggaagattccccgggatctagttcataggatgagcccctgaagcctagactgtagaaggattccctggaatctagtccataggaggagcctccgggacctggtccataggaggattccctgggatcaggtccgcgggagccccccaggacctggtcttcatcagaagcaaggctaaggctgctggctgcatcacctctgcctgccccttgctttcctggtgtctcctcctttgtgtattgaagccgatgccccaccccacccctccatgggttgttggaggcttaaagaagacacagtgttggccaggcgtggtggctcacgcctgtaatcccagcactttgggaggccgaggcggacgatcacctgaggttgggagttcaagaccagcctgaccaacatggagaaaccccgtgtttactaaaaatacaaaattatctgggcgtggtggcgcatgcctgtaatcccagctactcgggaggctgaggcaggagaactgcttgaacccaggaggcagaggctgcagtttagagcacaacatggcaggcctgagtctcctaaccttgtgttttccttagtcacactgcccttaatgtgaagacgtttcccactatgtccacattctgcagacctgtctaccttcctgcagttttgttactgaatcccccaaatctcttggtgacagctttcaaatcacaacttccactcctcacttgtggctggatcaataattaaacacaccaaagcagacggagtgctctgtattagcacagagggttggggatcattctcacaacatcttcatcaatgactcaatggggaaactgatcaaatctgcccatgacccaaagtggggagggtccattctgataacagaatttgggttcacagagaagccagcaggctggatcactgacatccccacagagtaaaagtcactttgcacagtgacatgtggaattcaagtgtggcctgagttcccacaggaggggcgtggctgcttacatctgaatctctcccataatgttatcattcaggtgacattatgggatgactatgatgtgtaatcagtatgataatgacactgtggctgtggaggagaatgtcattctcaggacaggcctgctgatgtcttctgagctgtcacagtcgctgggatgtacggtacacacgcacacaaagagcgcatgtgcgcgagagagaatattccagagcagcaacagctgaacctaagtagaaggaatacaggtgtccaacgtatccttttccaatttggggggatgtatgtacattttcaaattaaaaatctgggaaaagaaaaatcactgtatgattagcgtagggggcaggtctggatgaccagcaatctcaacataagccagtgacctggtgcccctcaaaagctaccagtgtttccagctacaccgactgaaatggcgtgggtgacagttaggtctagggacttgggtagaccacatccaagttcctgcatttgattctgagtgcagacggaaagatggattgtgtgaacggagggcatgaccagagggccactgaccagtgaagaagctggacgtcatcgcagcctcttgggacagtgtggtcaaggagcaggcagctgtttccagcagcagaagggctgacaagcagaaggcagggaagatccgttctgttttgctacctgaaggcagaactgatcgatgggagtcacagacaagtaggagtcagctccctgcggagcagaacacactagccattgctcagcgtccagcacacaacaggctccaccaggcctgtggagcagcacacaccagccatcgctcagcatctggcatggaatgggctccgccagaggcctgcggagcagcacacaccagccatggctcagcatctggcacagaacgggctccgccatcgtttgtcagggatgctaaggacagtgttcttcacggtgggaaaagcaggccagtggttctccagcccagctctgcttcagaatcacaggaaagcttattttaaaaagcagattcttatgctatactctgggagagtttttcccccagtaagtggggtagggctctggaatctgtttttttttttttttttttga

SEQ ID NO: 2981 - DNA, 767 bp, Homo sapiens
ccgagtcggacggccccgctggggcttcttgtgcaggtctagggactgtggagccgggcccgcggcggcagcgacggaggggctgggctgctggaggcccgggccccgccgactcagccttagggcgctgcggttgcctaccagctccctggcggccccatcccaggccaccccagctagaaatcgcccctgctgctggagctgcggctgcggcggcagctcctccgcgagacctgcaggtggcgtcatctcctcccctgcggccgtgggtaggggctgccgcctgcggtcagcggtcagggaagctgagggcgagggatccgcgcaggatccattttgcagctgctggtcatccaggtgccaccctgcgggaagtttgggcagcacggagtccgccagcattctacaggaagtttgggggagcacaaggttgcctgcagaaggccatcagaagggggatttcagcaggtagctgatgtaatcatatttgcactacaacctcaagaggaatctctgcctaaataaacaaaagagtgatctgcctgctccccgcagttgagagtgctgcactgcaagtgttacctggtgaggcccacctccagcccactacttctggggtatgtgaggtctgcctgcaatggggtggattgtctacttaattccacccttcagttagccagcccaattgtccctcacactgagccataccttccattttagcctttatcagtaatgaaggggaaattttggttctcaaaaaaattaaa

SEQ ID NO: 2982 - DNA, 661 bp, Homo sapiens
tttcagagacagggtcttgctacgttgcccaggctggactcaaactcctgggctcaggtgattcttctgccttagcctcctgagtagctgagactacaggtgtgtgccactgtgcccagcaagattttaaaaaatacgtatgcccggacaccactctaaaccaactaaatgagaatcagatatcgtgaagtcactaatcattttgctcctgggtctttatgacagttttgctcctgggaaactcctgggaatgtggtagagagagagaaagagatgggaaaataagattttaagaagtgttgctatgcattttgaaaataatttttatttggtgtttgtcttgagggaaggcggtaaacatttcaattgcctttaagtgtgcttggatgctggaacgatggttctttgaatgcagcgtcaaactggcattgggtcacatggcagccagcattaacctttatgccacatttataaaacatgaatgtcatgagcccactctcagagaccttataatttggagggttaggtcagatccacaaatctcttctatctcatggtaaaggaaacctggcgtgtagcaggagatggtgtgataacaataacatattgcatgatcagtatttgtattcttcttagcaatattaaactttttgacctcctc

SEQ ID NO: 2983 - DNA, 12560 bp, Homo sapiens
actcaatgagggcaacccctgagtaaagtccatgcggacaaccattcatctcctccgacaaccattcatctcctccgacccccgcccagcactagactgcgctcctagcaccgcgccttcttccggagcctcctcccccgggctggctaggggtgagcgcaggggttagtcagtacgcacgtgacgcgcgatgcccacatgacacgaccgtgagcgggggagggggacacggagtgaagaaggggaaaagttacagaagacccgtcaaagcgcccaaagcaatttgtcccttcttttcttcgccagcggtggctcacggatccctaagggacagctggggacccaggcgcccccagcccagccccagaaacgctggacgcagttctccgctcaccccaccaccttctcttcccagacccgctggtgatgccgctgcaccctgaagttgctccttccttctttccctcccttcctcccattctttctttcttttcttccttcctcccttccccaaaagctcttcatccgcttcgggtgatgccactgacgcacattcaatttgccccagcagctctgaggaggtcagaccaggccgagcaccttccaaaggggagggtctaactgagcaaacaaagttgcacgccacaccacaacctgcccctcccctccctttagcccccaagtcgaatccccggcgaaactcacttgcactgcgggtgctctctggcccccaccccatcatcgcgcaacacacccccttcaacatgcgcggccaccctttcattgccctgcgccccgagcggtcccaccgcccggcaaaacactgagcaagccgctgctctcaccttgcttgacacacttgagccggagggggtccttgcagtgtttgatcacggccagcacgtccctgatggtgagccccgccacgggggtctcgttcacctccagcagcagctcctccgacaccaatttgctgccgctctcataggccaccttgccgggcttcacctcccccaggctgtggccccgcagcagaggaagcagtggtggtggcgtcggcggcggcggcggcggcagccggagcgagcagtagccgagctggtgagcgggtgtggtgggggtggggaaggagggtagggatgccgggggccactcctgcgtggtgcgagtgggaacgcgcgcgcgcgcctgggtgtgtgttgttagctgatatccatggcagctgcagtggcagggtgcgtgtgcgtgtgtgtgtgtgtgtgtgtgtgtactagttctactgtactggcagacgggaggaggcaggggaggaggggcgcgcgcgccgggtggggagccacggagggcttcgccgctgcctccctccctccctccgcagcttgacccggtagtgaaggcagagagagaggcaggctgggtccgcctggcagcctacgggaggaggcgggagccgggaaggaggggagcctaggcccggcgtggggaggccggcaggaagggcctcgagcccagtgcggacctttcttcagcctctgtgcgaccgagccgcgcgccaggctcctgtgcgaggaggacgcgctgactccctccgacctgggctccgatggagcagaaatagcgggacctggacttgtggcgcgcctggtgccacatctcgggctctgcgagcgtcctggcgcgggatcctgccgtttgcatccaagagaggggaggacaggggcaaaaggatgcagggaggctgctgatttccactgaagagctaatttcctgtgagacattaacagtgatttaagaaaaagattcctgtaactgtaatgtcttacaataacagaatgcaggagagcacatatcaatgaagaaaagacaaaatgtacttatccatgaagctgaggttaagaaaccagtgtcttcaagagccagggacagcactgggtctgtgcagagttgagagatggtgatgacatgtggtttccagcattcctcacccagtccagggacactgtgggtgtgcccagcttaagtccagtaactggaaatacaagcccaagttctggagagtttgagctgcagagatatatatgggaacactttgaatcttgactcattggccataaccagcagagtggaaaatacaagaagagaaaaaaacattgaactgcgattttataacatcctttactaggcagagagaagaggaaacaccaggaaagaaaactgtattacgatgtgaaaacttaatgttgagaaattcaggcatcttggggttagtgaggagaagttttaggggcttagattcttctaaacacatgtacagaaatgcatatttcatctgatatcaaatggcatttatagtgctaatctttacctcaagacttcacatcttttggtgattgcatcttttaggtttatagcagctaagtttgcatgaaaacaccagggctgtttcatttcagtcaagaattaatgttcattgattgtgcttctgcatttcatgtaactattgtagaatttgttttagttttatgagggaataattgttccaacttctatataactcaggaatttactctcaaacaacactgtcaattagttacttatctctctggaaatgatctgggaacatggagaggaaagggaggaaggggcaaaatctgaccacttaaatctaagcatattagatcattttatgctagaaagtcctgaatgatgtgactttcgttcttgtaaaacacctctttccatagattcatggcccaaacagtatataaagagtggggaaggaactgcatttgcaaatagttcaaatcattgctccatcttaactacgcagttcacaaagtgtgaagaaatgtgatcatctcaaaaaagataatggggaaaaaatatgttttgttctgtgactttaaagtcttgcaatattttacataaatgataatgggtgctttaataagaactcttgatacttttgttattgtattcaatatatgcatataatacaacaggatgatattgttttggatttggaaatgtattctttcttatgcaatcttatgcagtcatactgcttgaatatcattacctgaatttatctttcttttttttgttgttgttttacactctacttatttggtgcctgtcagtcttttgtcgtcagtttatattctactaaactcaaaaagacaatctcataccttttgtaattgtaggcattctttactagatttttaaatacacttcaaaaattcaagtactttgatttcatgccatcaagtagctgaatctatccccccgtctctttttaaatttaagtgagtagttcaatttctgtcactttctactttgtgaattctaaatcttttaaaaccatcttgccatttttcgtgcacttacccttacagaaaactctgtgaaacactacttatctctacttttatgtttttaactccttttttatattactattccctctgctttctaaatgcacatattaatttgttctttttattctctgtagctcttctcagtgtatgaattcagtttcccatcagtctccatacaattaaaaaaaagttgagtattctgttattttaataagatatctagtgcccatattctaattctgccccttatttttaatataattttattgttgatttaaaatgacaacagtttcaattcccagaaagtgaaaggaaacaaaggaataatattataggcttaatttttatcagtgaacttgtaggtgaagaaaagatttggggaaggaaatgaacatattatattgcaaaatagtaaggaacaatcagatgtgttttctagtctctggaaaagcatgtttcaagaaattcaatgaaaagttcatcatgcttgcttagattgttgagaagcaaaaacactgatgaacatttggaagcaatgagaatgtaattctaatcatactcttttaataatgttgcaaaactctccaaacactactctgtgtggatgtctttcagaatatgatgaatactagtagtcttattctgcccttttctctctatcacaatatatacattctatattgcatacacatattttccaaatattacatataatttcatgtaatttatagacctattaaggcccaaccattttcttggataggggattctttagaagtccagcttaaataaagcccgtatagaaagtttttttaaaatttatacataatcacctaaagtaaccttatctactgaactcttagtacatgctactggaaccttttatcatgtttcttcctggcttgcattacaacactgttgacatatctcagccttacttctaggcttctttgagagcatgactcatgtttgtattcctcactgaggttgaatgaataagagaaactacagtagtaggaaaaaacagtacatgtacatatcaatgaatatgaaagggtcaaatggatctattatagtaagcacaaaatcaactgacaccagcaaagtaaacccaaaatttttaatggtattttaatagatcaagaggagcaagcagatttttgagacagttgtctcctactttctctatcacagggagtaattttaaaagaaaaatggagggtaagtttctttaagagaaaattgtagtttaaaacaggtcatgggataattagaaataatttaatttctttagaggattttaatctttcaactgcttgcaattagatcctaaggcaataaaagaataaggagatttggaaaaccattgtctgtaatctctgaagaaaagtggacattaggggagtcagttgaaaagcaaagctatcaccattttctaaagaggaaaaaggtgaacctcacaaactatagaccaaaaaaataggacatcgagagaaagaatatgaagctagcataggttcacaaagaatgagtcaaatcaaacaacatgcattttttatttataaagcatgacttgttcattgtcaattcatgttagcttaatcattaggcattaatgccatcactgcaatgcatatgtcagcaataaataatcaaagaccaggcttccatcattctgtttaatatcttcaagtaatgcttaagtttgcaaatgctcttttaacacattctccatatgcagcctgcccagcactgcacacaatagacctgttacttccccctcacgagcactcctaatatttcatgtgctcatccaattgacttctcccactggtgcctcatattgaatttgtagaatcacacctgctcctttttcaaaactcttctgagttttttcttaaataattcactgaccccaaagttgtcagatatttgaagactactcgcacaattttaatattataaatgtataatgtaaatgtaattaagatttgtataatgtacgatgtactttggtaaataaaagtatgctgtgaataaatacgtatgatacaattcaaaattttacataaatatgtgataaaatttagctcatattctttttttttttctttgagacggagtctcactctgttgcacccaggctagagtgcagcagcatgatctcagctcactgcaacctctacctcctgggttcaaacaattctcctgcctcagcctcctgagtagctgggattacaggtgcccgccaccatgcccagctaatttttttctatttttgttgttgttgttgtttttagtagagacggggtttcaccatgttggtcaggctggtcttgaactcctgacctcagataatccacctgcctcggcctcccaaagttctgggattacagacgtgaaccacggtgcccggcctagttcatgttctttaaggacaattatgaatatttttatgcactgttaattttcattaagatattgatcaattaatagctatatatgttctataaattaatcctatctagtttcaatcttaaattgtttgcatataccaatctagtttattgtttgcatatattttatagtgtagagattaggcattttaataaaattttaaaatttccaggacatactgttaatgactatgcttcctactataggccataattaatttttttctattgtcaacaatattttggtagggatgatcaggaaataaggaaatgtttccttcatttgttaacaataggtgtttggggattttaaaatgaaaattgaagaagtaaaagacaccatatatttagtttgtttgatttcgtggcttcaagagttcaataatttattgaaatattttacagaccaaagaacaacagatatattacgtttataagcccccacatattttaaaggataatggtttatatatgaaaattccctgaacctacacttcatcaggaaaagctaaataaaagaagtttacatttcctaggactaatggagatttatttcccagtcctcttctctggagacaaatgtaggtctctcttgaaaagcagaaagttttgcatatgaggtatgatttagtgggctagaaacatcttttccaccctccccaaaatgtttcactatgttttatcatactatctgataattttgcactaaagttttctttctgtgttaagaaaatgcaaatatctctgaatgggtctctttgctttagtcatactcatatggctactactgaacaaaatatgttcattacaggatgaagggaatgttgccagccagcaaatccctagagtttgcactacaccaaacgttgcttagcaatttccacgattttctcagtctaatttgcaagaatcaaggagatgtttgtgtatgctacatgaagttgtaaaattggtatttattgtatgtttctatatcgaaagctttacaaacaaaggaaatggaaagttaacaggtggatatgatagtgtggcactactttagctggatggtaagggagagcttctcttaggaagtgttttaggccaggacttgaataatgaacagtatctagttgtacaaaaatctggaggaaagacttttcaggcccaggagaaatgaaaattcttttcatgcatacaagaatgaaagtgaaaattacctactctatgtcctgaagtgggaagttggcttgccagagagtaggtaattttcactttgattctttcatgccttcagttatactacttcttaggttagttcataagggtttccacaatttggttcccacttaaaatttaaaacttccctaacccattcccaccatatattgtgctaatccatgcatatgtgactttgcgtatgctgttttcattgtttaatattcttctcatgcattcgttctttcctgataacgaactcatctttgaaactccccttcaagcatcctctactttaggaggccgcttctcactgtctcctgcctaccacccattgaattgttcaatttttaagctgccattgtcttgtgcagttgacacatttctttgcaattactgatttacatgtctgcttttatcactggtgaggttctttaggacagagacattattaattcatctctgggcacatatgttccaacatattagaagtactacagagtgctattactatgtagtatgtagtattagtagtagttactcacaaatcatttttaaataagtgattataatatctttttgttattatgatttaacacaagatggaatttattttcagaagtttccatgatatatttgttctatttaaaatccaatagccattagaatattaccattatttaatgtaaaacaataaaatattaaatatgatcgttcatatttaatgcaaaccgaactcatggaaatattgtgtaaagatcaagtaatttttgacatacaattttaaactcaacttttcatatagcataccttatgatatattttcagcctacttttaaatatgttggcattgaaagccagttactaattcgctgaattcatgatttctttttaagttatagaagtggaattatgtttgagatattcattgcattacatttaccagaacttgagttcttaacatggaacctgagagtttctccaattcttaagtccctgggagaaatagattagctggatgaggaactgagaggaaaaatggtcagagatgtagcaagagttgggaagaaggaacaatgatttgctttcaaggagattttttcattggtctgttttcagtgacaaacccactgcgataatacatgtaaagtgaaaacattcaggaagttcccttagaaacctcttttctggcagttcctaattctacaacattgtataagtgaaataccatagttactgtcatagtaaattgagccaagagaaacaagggagcaggagaagaaaagaattaaagagagttttgtctttcagtcttcactctgtttcttcttgcttttaccagtcattcaggtttatataatttctttagagaggcttctactatgcaggtcttccttaaagtcattggtattacctggcatgatatgtgagcctttaatatcagtccctttatctctttatttttaaagtttatatcagtacagagtcctggattcttaattaatttaataggttagactttatgctaatattcttcattttgatgctcaaattttccaaaatttggccagcagggttccttaaagctgggtaccttgccctttcaacatgtccctctgattctttatttttatttacttatttatttatttatttatttatttatttatttatttatttagagactgagtcttgctctgtctcccagcctggagtgcaatggcacaatcttggctcactgcaacctctatctcccaggttcaagcaattctcctccctcagcctcccgagcaactgggactacaggcatgtgcaaccatgcctggctaattttttttgtatttttagtagagacaggctttcaccatgttggtcaggctggcctcgatctcctgacctcaaatgatccatcgcctcggcctcccaaagtgctgggattacaggcgtgagctgccacacccagccgtccctctcattctttaagtacttccatgttttctaaggtacaagatgttccatattattttgttatttgtcttccccagctctgaaatctgcctttccttcaaggagccttggttctttctagtgacaaattatatttagaaagaagatctgggtatttgacttgtatattgctattaattggccattgtttctagtctctttcagtagacagagctaagaaatgtaaaaggaaatatttgaatgtatgtatatgtgatatattaagtacatttaaacatattaaattcatgagttcatactaatactttcaataagccacaattcccttttcatgttttcgaaggaaaaatatccattgtctatatacagtggacatagatagtaataatactgatcttgaaaagagcagtcttaaatagatcccattaatagttaaagataacatatcttagaattctagatattagagagattatctagagctgtaatctagatattttatagatctttgctgtgctgttttgaatttgtgttggagtagaacaatcagatgacaaaagctcatcccacatggaaaaatcaaagcattcattacagagagaattttgaaataaatgcatatataaaaaatatatatgcatatataatgcatatgtatatgcatataaaatatatatatataaaatgagggttataaacaatgaaggaaatagtgatactatctatgtgggaacaatactagtatcctccctttggatgaatacagtagctacagatgcaattctggggactctgtttagcaatagcttaactattgcttggctacaagcatggataacttgttcaaagataatgaggagttgtaaatatttaaataaacaggatttgcaacataaaaagctttgtgactatgtgtctgaattcttagagttttctcccagcaagaccttggatgtggcagacttttctgtaattgtccatctcgcccctatttcatgaaaagccagagcttctctacttagtttgctaaccccaaatatataaattcaatagaagtactagcctgtttttactggtttatttgctttatctaaaaaaaacaaggcatagtttaaagtctgtttttgatagcataacaaaacaaaggttctcattttaataatgcatcacatatacacttggtaactattgcatagtaataatttaataacttgagaaatatatttatgcatgtatgtgtatatgttcatatatatgttatttttaattcagaagtaaaacaaatattggaagaggccacagttattataaaaataatttgaccagtattggacaatgcaaatagcaatcatttagaagtttctgtacaacagatgccatatgtgttacattttatttgatcatcaaaattgtcatagatattattatccccatttcatagaagaaactgagattatataatttgttcaacttgaccaacttcttataactaatacatagtagagataaggttgaaacctcattaaccaacttcttataactaatacatagtagagataaggttgaaacctcattaggtttgactccagaccccagcctcttttgagtgcatcataaaaggctttggtctgcccgtggccagtaacaacttttactaaattgattctttgctttttatctgtaaaaggaagttattcacctattttgatgatccccaatgtttttaacatcaataaatgtgtccaccacacatgatagtttttaatgttttgtttccatgattacaggattaaaaaactattaattagtgatacttttaattttgattttattaattaaaacacatctgtctacatctgaagaatagcacttgtgacaacagcatagacggcttcattttgaggagtaaattacaattgaacatgaccaaatatacatagagaaggcgtggaccacacaaatgtgattgaaagctggcgtggagtcatcttaaattgactttttcccaaagggcccctaaaagagggtagaatcccaacagatagagtctatggagagatagactgctgagacccatattatggtcagtgaagtgcaggcaaggaagggatccttagcaaaatggggagaggaatggatggtctgaaaaaccctgaaggaactgaaacactctgcaaaggaaagaagaacaagtatcagctttgacccctgccagacctaggcagcaacaacggcagctcacaaagcaccagaacaaacgcgctttcttgtgcccctacatgtcttcccttcaccgtcttgaaccctggtgtcatcataaactgtgtaagttaacaactgaggaggggaagaatgataaattgggaaaatagaaaagtgtctgggccctactttcataccgtaggccagccttctgtagcatggcagattaggcaagtgcagaagccttaattttgaatgaaagttggagtttttgttctgctctggctgtacctatcagtttcaaaactggaatagtttaaatgactaaagtactaggaagattttattacttaatataactatggagaactgaccaagattttatctagggggaggagtatcaccctacagagcagactttaagggacattatgagagaaaacagttacttagtgatttaatgttgccaattctgttctttagaataccatcatgtatttatatccctatatatcacataactaaaatatacatttatctgtacgcgtgtgtatcatatggagcacattttcttttgcagggtttctttgttttaaatgtctatttggttattttcttgattgaatttctgtgtatgcttttttcctcaatgctttagctgtaagcgaataagtgacagagctccttgctgctcaaattttatgccagataaaatattcaccttctcggactccctggcaccaggcatggccatgtaatcctacagcacagctgatgaaagagaagacatcttgctgctatttgacaagcaagaagataaaagctttcctataaagatgatggagcaaaaaaatagaaggggcctagactccctaccttcacacttcctgctataaaagcattgctattataaggttaatctgcagaaacagacttctatgtcatatgcttaaatgcatcaaaattcatacaatatccattaaattggtaaaagtatccattttaaaggattaatctgagggacccacagacacttaacacaatcaaatctcagaaaaaaaatcagttatttcattgtgattttgaggctgatcttttatgatcttttagttatcaaactgttaaatacattttaactttcaaattttatgaataaaggagatgaatcctgttattttctcagtgtgagtgtgatgatgtgtgtcatatgtgcctatgtatgcacacacatgtactcaaggagcctgaaagggaccatgactttctgggcactcaatgctacttatctctaactcctccttcaaatgtccccattctaagtctacttccttagggaataggtacaaatatatcccat

SEQ ID NO: 2984 - DNA, 2345 bp, Homo sapiens
cagcaagctgagatcgcgctactgcactccagcctgggcgacagagcgagactctgtctaaaaaaataaataaaaataaaaataatttttagaaaagaaattgagaggtatggcaggtgggaggcttcacttatatcccttaacaatagagtagataaacatacagtggaaaacaaaaaaacagcaatgaaaatgaactcaccacagctatatgaaacaacataaaggagttttgcaagtgtattcttgtgcaaaagaaggcagacacaaaataatactgtataattcaatttacataaagttcaaggaacagacaaaacgaaactacagtgtttagggacacattctcaggtggtacaactccaaaagcaaggaagcgattatcacaaaagtagttggaacaccaattaccctgcagaggtcttctgcttgactgttcagtaccatggcatgggtgatgctaacccaggctcactttttgataaatcattaggttttacatttatgttttgtgcacttttccatgtgtgctattctttttttttttttttttcttgagacggagtctcgctctgttgcccaggctggagtgcagtggtctgatctcggctcatcgaacctctgcctcccaggttcaagcgattctcctgcctcagccttctgagtagctgggactataggcatgcaccaccacacccagctaatttttttgtatttttagtagagacgatgtttcactatgttggccaggctggtctcaaactcctgaccttgtgatctacccgcctcggcctcccaaagtactgggattacgggcgtgagccaccatgcccagtctattttgtatacatttttttgagacagggtcttgctctgttgcccaggctggagtgcagtggcatgatcatagctctctgcagttttgaccgcctgggctcaagtgatcctcccacctcagccccctaagtagctgggactacaggtgtgtgcttccgcacctggctaatttttgtgttttttgtagagacgcaggtttcaccatgttgcccaggctggtcttaaactcctggactcaagcaatccacccacctccacctcccaaagtgctagaattacaggcatgagccactgcgcccagctatgtttaagacacggtctctgtcgcccaggctggagtgcagctaactgcagcttcgacgtccagggctcaagtgatcctcccacctcagactcccaagtggctggaattacaggcccatgccaccatgcccggctaattttatttaaaacatttttcagagacagggtcttgctacattgcccaggctggtctcttaactcctgacctcaaggtatcctcccactttggcctcccaaagtgttggtgattacaggcatgagctactgtgccagtctatcatacactattttttttttttttttgagacggagtcttgctctgtcaccaggctagagtgcagtggtgcgatcttggctcactgcagcttctgcctcccaggttcaagtggtgtccctgcctcagcctccggagtagctggaactacaggcgcgtgccaccgtgcccggctaattttttgtattttagtagagatggggtttcaccatgttggtcaggatggactcgatctcctgacctcatgatctgcccgcttaggcctcctgggataaagtgctgggattacaggtgtgagccaccacacccagccccatatgctattcttaacaataaaaaggttttaaaaatttgtctttgggaggctgaggtgggtggatcacctgaggtcaggagttcgagaccagcctggccagtcgggcatggtggcgggcacctgtaatctcagctactcgggaggctgaggcagaagaatcacttgaacctgggaggcagaggttgcagtgaaccgagatcgcgccactgcacgctagcctgggcgacagagcaagactccttttcaaaaaacaaaacaaaattgggctgtgtgtggtggctcatgcctgtaatcccagcactttggaaggctgaagcaggaggattgcttaaggcaaggagttcaaggttacaatgagctatgagtgcacatcagtctgggagatagactgagactctgcttctaaaaaaaaggggggtaggggtgggaaacgccagctcttaaggtagtcattagaatggtgagaagaggttgggttttgttttgtttgagacggagttttgctcctgtcacctaggctagagtgcaatggtgtgatttcggctcattgcaacctcttcctcccgggttcaagcgattctcctgcctcagcctcctgagtagctggaattacag

SEQ ID NO: 2985 - DNA, 1364 bp, Homo sapiens
gcccatcagttggcattctacgaaaatatggagccgtcgtgagcttgcatcaccttgtgcaagagctatggctatgctgagcttctccacatatttccaactttagtacatgggcaggtgaggcaagcaccactcttaccttcgaataccacacacacacaccacacacacatatcacataatacacaccccacataccacacacacaacataacacaccacataacacacatgctacatatgacatcatacatcatacacaccacacacacaccaaatacaccacatgccacacaacttacataccacatcatacacaccatacacacgacacacagcacataacacaccacatgccatacatcctacatacatcatacacaccatacacacacatcaaataccacaccacatgccacacaacctacacaccacatcatacacagcatacacacgcatgacacatagcacataacacaccacatgccacacaacctacataccacatcctacacaccacacacacacaccacacacaccccataacataccacatcacataccacacacaccatataccacatcatatacaccacacacaaaccacacacacaaacacaaacaccacacacaccacgcacacctacacccacagacactgtacaccatacaccacactgtacacaccacacaccacaccacaccagacaccacacatacagcacacacacaaacacaccacacacactgcactatataccacacacactccaaaccccacacgcattacacatcacaccacacacacacacaccagataacataccacacactacataccacatgtaccacacacaacacacatcctacataccacacacagcacataccacataccacaccacataccacacattccacatacgacatcatacacaccacacacactgcacatattataccaacacatcccacataccatatcatatacaccacacacaaaccacacacacaaatgcaaacaccacatacaccatacatacccacacacacaaacactgtataccatacaccacactgtacacaccacacacacacacaccatacacacacaaacacacacacacacaaacttctgttgaggctgtgcccccaccacttggagccactacatctccctacctcaacttctttccacttggtagtcctgtcttctgaagttagtaaatgcaggcgtgaggcagggaggcgctttggctgatcggcagaaccctgggatgagccacggcatggctgtgtggcacgtgtggtgtgggtgtgggtagggggatcccgccacgcgtccttcccaccctgggtcctgt

SEQ ID NO: 2986 - DNA, 2873 bp, Homo sapiens
acttccacaggggccagacaggcggatgctgtgcaagccggagctgccgggagggtcctgttctgtgcggccgacagcaccgtgcctggaaaagccatgctatttgggaccgtcctgctgggcaagcggccactcttccacactgaaagggaaacagaaaggaagaagcgcccagagcaggaggaacagatgtggcctccacccgagattggggctcagggagggaagagagtgtcgcatcaggatcagtcttccggcaggctccatctctcctgggatgtgctgggatcctctagtgacaggggagaagggaagttcacatgagtggttcgtggtgctggggccgtgctgtcaccacctgtgaagccagggctggtgagtgggagggctttccccagacatcgccttccagaaccctctggggctacgaagccacacaccagccgcccgagcccccctgagctcttcccctgccgcccgctatctgcgtaattcagttaccacctccaggaaatctctctggtttggctccacgtattttcatttctgcatgactggaagaaattaatttttctccctacgcgaggatctggagatgctgccagcaggctgggtcactaatccccaagatcccagccctcagggctgcagtggggagggccgggcctcgccgctgccgcctctggggtggcagggagggtgtgaggtgggtgaggcatttccctgccagcttctggaaccatcttggggctctccgctggcctccccccttccctgctgcaccgttagcaggttgactttggggttttctgattcatcctcagcctcccacagtgccagggtggaaggatggtgcttgaattaagtggctctgaatttccttccctggcagggaggaaccagaagcaacttcagcgtgccccagtgccgtgtgtgccacgcgggtgttcagacccagcatggagggactagcagggccttgttattggtgccacaggtgaaggcgctggcgtctccatggggctgctctcccggcccgcacttgctgcactgcctgcctgtggcctgtgtctcctgctcacagggtcgtggagccttcctgggtgggtcttagagcctacaacagcgctggggcttacacgcactgtcgcgtccctgtaacacccacgagggccgtggagcgttccccgtctccgacgccgggagaggtacagtcactccacaggtcatgcagggagccagtctgacggcgggccgcagcgagtgtctccaggcccctgtccagccccgcccagtccctgtccagccctgcccgggcgttcctttgcctgtgctgtcggtccccatccccagcctgccgggccacattcttagagcacctgagcacccccaagggactgggggatctggtggctgagggctcggtcatgactcggggttagcactgtaggtgcaaaagccctcacctggatacaggccctggggcccatctggggtcagggcacgggtgggagaacttgacctctgccctgcctgggtcatggagccccaaggccagcctcatcccggctgctctaggtctgcacctctggccagccccacctctgcttcctgccctgctgtgcaggggagggaggtcgttgttgctaaagaccctccagaagccactggaacattgcccggctattatcacagacatggcatccagtgttcatagaaatccacgtccaggcaaccgatgtcacctcccaggctggccccaggcccctggggacggaaaggacctaaactctacaatttgtcaatgccggagggtggctttgccaccacttcacttacaggacaaaaagtgcctgtcctccagtgctcattccctgggcaagtattgatcgaacacctactccataccaggcgggggcagagtcacatgcagtgagaggcacccaggccctgcattggatcctcacggcagccagccctgagggcaccgctgctgccccactttccagaccgggaagccgaggcccacagaagttcctagctcacagcgcaggagcccgacgcgggtgggtaccacggggctctgtctgtgacacatccagggtggtcaggcccctggaacttcccactgagttctgacacgggagggccagcgtggggacggcagggagtgggccgggagtgtgcagagtccagtgcacactgtgggctgggacccgctgcctcgcaggggcaggagaggggtggaaacacaactgctggggtactggctagggaggtgcaggccgcttgagggcagctcagagggaggctcacgacagcgtcaccatccctggtgtcagggccaggttgggtggacaccacgctgttcgtccacctcgtggctcagtctctctgggaaagcctgcgtcagtgaacgacaccccagatcctttcctgggggttttattctccacctcctgactttcctgggcagagtgagaaggcctggttctgcttctgcgcttccgtaggccgggaccttcctttcagcggagcccaggccgtgctgcgggaaacagcccaccgggcaggcctgggagggccgccttagccgagagcaaatgcaggcaagggctttgcttgtctggaaaaaaaattcctggagtggaaaccgcccttgtagcatcagtggaaaagactcaggcggagacctggcagttgggctggaaactgacgatgaggagagtgagagataactgctccccagtccccacttctgagctcgcagcttgccccgagggtgggagctggggactcaggacccgccgggatccggctttccgcctgtgctgtggcaatgagtttcctgtggcaataaaacagaagttcag

SEQ ID NO: 2987 - DNA, 6579 bp, Homo sapiens
ggctggggaggtgacttgcattttcggccttagaaatgctgcgggcatgcacgtgtggggttttcatataagccatgggaggggcgagtgcccagccctcctcacgctggtggtagaacccagggctttggcctccttttggcatagtggtctatgaagctgtatttctggtggagggatgagcctcctcacggtcatcttgcagttcttgaaagggtagttgtcagccactctatcaatgaggttttatatggcctcccatgaacaacgagaggtgtgccatggccgacggtgtcctggcagggctggagaagggattgtctcatgtgtccttctgcaggcaccaggttgtccccctggtctctaacccccagccagctgtctagtccagtgtttcttttctggattcaggaagtaagtggggtgtgtgtgtgtgtgtgtggggtgtgtgtgtgtatgtggtgtgtgtggtatatgtgtgtggtgtgcatgtctgtgtgtggtgtgcatgtctggtgtgtgtgtgtgttgtgtgtggtgtgtgtatctgtgtgtggtgtgtctgggtggtgtgtgtggtgtggtgtgtgtattgtgtgtggtatgtgttgtgcgtattgtgtggtgtgttgtgtgtggtgtgtctattgtgtggttgtgtatgtgtgtggggtgtgtgtggtatggtgtgtgtgtatctgtggtgtgcgtgtatgtgtgatgtgtctggtgtgtgtgtgtgtgatgcagtgtgtgtggtgtgttgagtgtggtttggtgtgtgtatgttgcgtgtggtgtatgcttgtggtgtgtctggtgtgtttggtgtgtgtgtgtttggtgtgtgtggtgtgtctggtgtgtttggtgtggtacatggactgtgtgtggtgtgtgtgtgtgctatgtgttttgtgtattgtatgtggtgtgttattgtgtgtggtatgtgtgtattgtgtgtgggtgtggtgtgtggtatggtgtgtgtatgtctggtgtgtgtgtgtgtgtgatgtgtctggtgtgcatgtgtgtgatgcggtgtgcatgtgtgtgatgtgtgtgtgtgttgtgtggtttggtgtgtgttgtgtgtggtgtgttgtgtgtgtgttgtgtgtgtgtgtggtgcgtgtgtggtgcgtgtgtggtgcgtgtgtggtgtgtgtgtgtttgtgtgtgtggtgtggtgtgtctgttgtgtgtggtgtgtgtgagagagatttgtacagacatgctgatttgcctgcgtagtgtcaggcccaggagaccctcctttgtttggctcttttgctagacaacttctgtttgggtaggagggtcaaattagtaatgcaccatctttaatgtattttttatggagactgtacataaaattatataaatctacagaattggttctattttaaggagagaggggaatgtatgtgggaggcaaggatcagatgcaatcgtggagactgggagcttcgggcgagtggcactcgggtgtggggagcgggagggcaagagatgagtgccgggcaagatgggcaggggcccgtgccctctgcacacatatataaatataaagaacacctagataaagtctatatatctctatatctatatgaagtcatagtttgctttatttttgtacctgtgcttagagatgttttgagcagtgctaccttcccaggcagtctgggatactagctcatgccttgacgccacctccttccctgctcttcctttggtattctctctgttcagagttgcttgggtctttctgatggaaatgtgtatatatgaaaagtttgtaaaataacaaaacaaataacccacctgcaggaaggacaagtgagctgaaggttgtgtggagctgcaggatctgatagccctaaagaaccaggaccaatgtgtctcttgccacttgggagggatgttgacttgaacttctttgcagaggggcttaacagggcaaggctgaggagatgaaaactgtgactccatccccacgtggctgtggaaaggtaaccagttcctcagagaaaacctggcttcacagcattagaaagggggtggttgagactacctagggacctacggtgacacctgtcttggtttgtagcactgtagctcagacagctcagaccgctcatagagggcatggcaatgggagagtttgtgaggctggctgcctgggcttggtcttggagaacacatggcctgtttagtgttgctgcagattcttagagccagtgtgaatgtggtatgtagtataaatatgtcatctatgtttttttcagttatttttaattggaaataaagtgccattgcaaataggatgctccaatcctgggacactgagtggaggatgaggagggagagatgaactgtgggccggcctgggagagggggtcttagtggaaccttccttctggcctccagccggggacttacaaaactgaacaatgtattggcagaactggacccacaatgggagattctggggagcaggagttcacttgtatctgagcaggaagcagtgtgccctgaagaatacctctctgagcaaattccagacctcacacatatgcaagggctctgccttgcagcctcagcaagcgtctcctggtgctagctccttcctgacttgcccggagctcggagtgatgtatttgaagctggtgctgggccagatggtgcaggcagtgaggagagactcaggactgcaacctttcggctccttattcctgctcatcactcagaaaagggcagtactaacccctttcctaaccaagacatggcactccctaagagctcttgtctatagagtttggtccttagaggaaagcagataccttcagcgtgagaagggcttggttgacagttttggggtattatgggaagagtaggttggggtaaagcttgagtctaactcttgatccttacatggacctatgaggccctgccattcagtcaggcactgtccttgggtcctcaaattaactgctgagaacactccccactttccgaggacgctgatgggaaatgggctctgtccatgcagctggaaggatccagtgctggtgccactgtcagtggcaccatccttgccttgaatgatctttcttgcaggctcctgcagctgagtgtttcttgtaagatttttcagggggattgggcaagaagaagaggtgcaaattctgttcccttcctaccttgaagccttcccagaccaccacggtctctgcacaagggaggctcccattactgttctgttggcttctagacccaccatcccctctctttctgtggactctgcccgacttctggccacatgcaaccagcagagtaaactgctccaacacctcgggcatgtcctagggcttgccctcccaccagggccagcccaagattaggtcctcagcagcatcaaggtctgggagagccactggcccacatgtcaccattctattcctcagcctccaacaggactcttcattttggggagggaaagggaagatggggccatagcccctaccttgaaattgtacagtgtggaggggatgttagtgcctacctgtgacctttctgctccactgctcagcaagatgaggtaaggttgggtgtcagaggggacctccagcttctctgaagagccagcccttaaggcacttggagcaaaggtcattgagatcagctttatgtggagtaaggaggaggcctgggaaccgcttgtggcatcagttggggcgacaggtggatgagtgtgctctgatggagcttttacggcccacagccactgccaggagcctgagctcttccccatgcttgggacacgttccttggtccccacagcagaatggacattgaattttggtgcttttccctttggtagaaggtggaggtatctgaggagttgtttctgtcttgctacctctgtctactatatagagcaagagtcgggaatagggagatgtgtgagaatcactctcccatggatcagtgtgggccctgtccctcttccccactgtcaccaaccagcagcttggggaaaaggctctgtcgtggatttttgctgcctgcttcccgcttccactcttcttggcggtagatgttcatggtgatccactttgggcggtctgaaagtaggaggtgggggaagaggcaagcctgcacacacacttcctgtccacagggggttgcctgtggcattggagggtggagtctcagagtccagggactgggaggaaggtacttgatgggatggtcttgattctggaactttagactgaggtgttagaaaggggaattgttggctaggggagaagagcagtttaacgctccacttgctaagtcgtctgtatcagtgtcagaaggtcttgacctcccattcagatttaatttcctaactgccaggtgtggggctggggatagagggcccagaagggggcgcagtcactgacgtgaagggaccacatcccgcttcatgtcagtgactcctgccccttggtcttcagtgtttttctcttccccaggagggactttgatcatgcaggatagaattctcccatcgcacacctgggggcaagttttagatgagcttctttcctccatttcacctggtggtctgaggacacacagagggtgggggtgagcaggcagtgtgggtggggaggggctacctcccccagaccccttacaaactctgtacctctcggtgcgcggcagcctcttgctgtagttcttcttttctggatatgactgtcagtttcgtcatgagatttcttgctctcatttcgaactctttctttcttccactttctttgggggcgacccccgatccatgccaggtcttcctgtgaagaccgttccaacctcgtttccatttcttgaatgttgagtattacaacatcactgcgctagggtgcttcatggtgctgttctcgaagaggccagttgggctgaatctccttcctcccactggctcctgatatcttgctgtattttgtcttctttctgatttttccctaggggtttggggtgggtgacttaggggcggcttttgtgttctccctctctctctctttcttttctgtatgtatgtatggactggttaaagtgagtttgggcagctgactttatggtatgggttggctgacttttgttcaacattaaagacaaaccaacaaattgtacagctgcacacagaacacctttgagtgtgaacttgaatggcaactagaggcttactttttgaacttcaggtatgtaactcaaaagtaaataaaaccactattttttcagtaagcttttttttcttctaaaagatgacttagaaatcaaactataagaacatgaaatcggtgctgtaccaaagccttatatgaacatattctacactctgtataacctgtctgtgaggagctccctgctctatcaccctcttctcaaaagcctgggaatgccagcgcgtgccaagcctggggctgggtcttggggacctgtgggccaagggcaccctgggaagtaaaagatgacggtgaggatgggacacccttctgctgcctgagcagactgcaaggaaaccagatgtgtgtgtgtgcgcgcacctgcatatatatgtgtgcatacctgtgcgtgtgtgtgcgtgtgcgtgtgtgcacgcaagagagtgagagcgggagagagctcacaggtgcacagtgtcatggtgaatgtactaagtacgagcttgaagggaggcccaggttggctctgggagtggggcggtgtgggaatgaaggggggatgctctctcccctgttttctgcctccttcccttctccgtcagggaagggaggtgtattggaaacagctacactctcaatcaggtgctttttttccctcaaaatctccaaactcaaagcatttataaggggcccttccaatgggcaggcacccccagccaccaaatcacagacttccaagagtaggaggaactgtctcctcccgaacccttccttgctttcctggggaagagggttcttcctgcagggaccctgggcatcctgctgctgggcctgggcctatagactgccctgccccttcttcccaaacactgagaagaccccgctggagatgaccccaaagccacgcctgctctacggccctaagcaatagacgcctgccctggctgctgatgatggtgatccctttgtcctttgacttggcagtcaaaaatggagtgacaccccagactcagtcaggaagagaacctgcagcctgcctcagctcaggctaccacgccaggctccactcgctggtatttccaggcttgctaagtactaaccaactcatccccagtaacactgcatgttcatatcctgaattacaaatcaaaatgagcaaacacgtgcataagcaaatgagaaaaaagaaggcacacatcaaatgatgagatgtgcagccagtgcaggtaccccgggagtgttgcaagttaaactgatgaaaagacgtttagtatttaattgctcctcatgtaacattactctgcttcagaaatgttttgtattttgatataaataaacatttgctaaaaaagttcat

SEQ ID NO: 2988 - DNA, 2064 bp, Homo sapiens
agaacacatacatggtgcacagaacacacacagtgcacagaacacagtgcacaggagaacactcacagtgcacaggagaacacgcacacggtgcacaggagaacacgcacacatgttgcacaggagaattcacacacagtgcacaggagaacacacagtgcacaggagaacacatggtgcacaggagaacacgcacacacggtgcacaggagaacacacacagtgcacaggagaacacgcacagtgcacaggagaacacagagtgcacaggagaacacatggtgcacaggagaacacgcacacacggtgcacagaacacacacagtgcacaggagaacacgcacagtgcacaggagaacacggtgcaccggagaaccacactgcacaggagaatatgcataaacagttcacaggagaacacgcacacacagtgcatagagcacagacacagtgcacaggagaaccacacaatgtacaggagaatacgcacacacagtgcacaggagaacatacacgcagtacacagacacagtgcaccggagaacacagtgcacaggagaacacgcacacacagtgcacagaacacagacacagtgcacaggagaacacacagtgcacaggagaacacagtgcacaggagaatacacacggtgcacaggagaattcacacacaatgcacaggagaacacagtgcacaggagaacacacacacacactgcacaggagaccatgcacagtgcacaggagaatacacatggtgcacagcagaattcacacagtgcacaggagaacacacacagtgcacagaattcatgcacacagtgcacaggagaacacacacagtgcacaggagaacacagtgcacaggagaacacacactgcacagaacaaatgcacagcacacaggagaacatgcacacacagtgcacaggagaacacagtgcacaggagaacacacagtgcacaggagagaacacacagtgcacagaacacacagggcacaggagaacacacagtgcacaggagaacactgcacagaacacacggtgatcagaacacacagtgcacaggagaacacacagtgcacagaacacacggggcacaggagaacacacgatgcacggaacacggtgatcagaacacggttcacaggagaacacacagtgcacagaacacacggggcacaggagaacacacagtgcacagaacacacagtgcacagaacacacggtgcacaggagaacacatggtgcacaggagaacacacggtgtacagaacacacggtgcacaggagaacacgcagtgcacaggagaacatgcaatgcacgggagaacacagtgcagagaacacacacgcactgcacagaacatgcagtggtgcacaggagaacagtacacaacaacacattccatgcacaggagaacacacgcaattcacaggacacaacagaacacacgcagtgcacaggacacaacagaacacacgtgcacaggagaacacagtacacacacagcgcactggagaacacgcacagtgcacaggagaacagagtgcacagaacacagtccacaggacagcacacggtacacagcagaacacccgcagtgcacaggagaacctagtgcacagaacacacaccctgtgcacagttttgttttgttttgcttttgcaattccagggagctccctggcctcccacagccattcatagagcccattctgtttgcgataaaaacagatctcctccagctcacgtgaggctaggcacgggttcctcaaaacctttttgggcagctagcagctttgactagcagctcatctcaccaggctgaggtcgctgcctgtgaacagttgacagacctaaagccagccagaatgttctgtgtcagagagccctgtccaatgggcagagctgggagacacgcaggaagacccccagcccatgcccgttctcaggcctgaggttcattctcgttctctccctcttccctttccccttcctccctcctgccctcgaatctgcaaggtctctccgggtggctgtgttctgccagggcctccc

SEQ ID NO: 2989 - DNA, 920 bp, Homo sapiens
ccatgaactgtgtgtggattcattgtctgcattggatgacgaactcttgagtgttgctgctaagcagtgtgtccccgagaaagtgtcagagcctttacgtggaccttcccatggaaaaggaaacagaatagtcaatggaaaaggagaagggcctcctgcaaaacatccttccttgaagcctagcactgaaatggaagatcctgctgtgaaaggagcagtacaaaaaagaatgtacagacattgagagcagtgttgatttacccaatactaatgggaaccattgagcatttgccttgtggtgtctcctcagctgtattcacacattccatcaccttgtcttaatggataatcatgcactaacaagccttaccagtggcttcagaggaagaacagcaaaggcgtgaaagaagtgaaaagaagcaaccacaggtcatagaaggaaataatacatacaaaagtgaaaaaatacaactatcagaaaatatatgtcatagtacattttctgctgctgctgacagattaacccaacaaagaaagattgggaaaacatatcctcagcaatttcccaagaaactgaaggaagagcatgatagatgcaccttaaaacaagaaaatgaagaaaaaacaaatgttaatatgctgcacaaaaaaaatcgagaagaattagaaaggaaagagaaacaatataagaaagaagttgaagcaaaacaacttgaaccaactgttcaatcactagagatgaaaccaaagactgcaagaaatactccaaatcaggattttcataatcatgaagaagtgaaagatctgatggatgaaaattgcattttgaagacagatattgctatactcagacaggaaatatgcacaatgaaaaatgacaacctggaaaaagaaaataaatatcttaaggacattaaaat

SEQ ID NO: 2990 - DNA, 19226 bp, Homo sapiens
acagctgtgtccggaagcagcaagcgtgcctgggcagagacccccagagtgtaaagaggtcctgggacaggctttgcacgttccacaagaggtgagcacccggactaggacttccatccgtgtggcccttcctatagcccgattcgcccgggccagagcgcgagccggggcacctgggcgttggggaccactctgctccccaaaggttgccgctacccgcccgtcccacggctcccgggcacccccgccccccgcgggcggacccacctgcgctgggaggaggcgcgggggacgcggagctgcggcgcccgccacagagcccaggcgctggctagagcggcgccacgtcccggctcatcgaaacgcagcgcactctgcaggcttggggagggacttgcggcggaagaggccggctcggaggcgcgtgcgcgggggctctgcgctcgctgtccggaaacgcctcgtacctgttagccacctggtgtgtacgagtgcgcacgggcgactgtagcgtgcgtgtgaaatggggggaggaccatgccagttggtaactcagagtgcaatgtagttagtggaagaggtttctccaacagccggaaacccgcaccttcactactccactgacctcaccctggccacaccgacagccttctagatgtcaaatctaacagggggagtttcctgtcattttctctaacctctgaagcatttgacgctacccatttctttatacttgacacccccattctggcttctcctcctgcacctctgcctctctcttctcatctgttcacctccacccctaaatgttggtgatctccagggccctttcctcacccctttttcacttcacccactgttcctgggagaatgtttaaatgtaagccttcaactgcttcgagttggagctcctcagagctgttttggcccacaaatctggcattacactttctctgggtgagttcatccacactcattgttttaattactacctgtaaattgatgacacccaaatttatatctccagcccagatgtcttgcaagcttaaataacaataaataatatacatgcacatacatattcaaacacctgttggatatcacctggtgtcccagagacacctcaaactccaaaagccaaaaggtataaattatctttcatccatcctgtctaaacattggcctttatgttttctattgtagtgaatggcactatttcctcctcacttcttaaactcgcttaaatactctttctcttcccactgccactaggagttcaaactccgaatttcttctccagattgttgaaagtcttttcagtgttctccacctcatcccttgttatcagtccatcctctgtgctactgaatccatttttctaaaatgcagatttgacgtcatatctgtgcctaaaagtgctgagtggctccttttcaggatagaattgtaatctctcagctcagcacatcagacctattggcatttgggctctgcctactctctggctgtatatcctgcctgaccctgccaaaaactcttcatgacagcctacagaaatacttgcagtttcctaaatatgttagcctgttccctcttgactctcctttctccacactcctcctttgccacagtaattcctgtttatctttaagatttaactttttgaactccacagtacaaagaaaaaaaaatgtaactcaagtggcacctcgaggaagttctctaaaatgccccagtctgatttgatagaccttcatatgtacttttaaagactgtgatttttttccctgtgcctactgcaaagaaggttttctggtggagcctttatgaggttcagggtggctagtgagtgtgtgtgtaccacacgtacacgtgtgtgatgtctttgcgaatagtgtgtccatgtggcatgtgtgtgtttataactcacacctgggtaagaaggtagtgctttaaattttttttttttttttttttgagacagggtctcactctgttgcccaggcaggagtgcagtggcacgatctctgcttactgcaacctctgcctcctgggttcaagcgattctcctgcctcagcctctggagtagctgggactacaggcatgcaccaccacacccgactgatttttgtagttttagaagagacggggtttcaccattgctttaaatctttatatatccttcacacctctctcagcccctggaaatgtatgtaaagtgtccattatatacttgtcctttcctagatcctataacaaattctcgaaaagagacatttttcctatccctgtgtatttgtagtcccagtgaggaaagagttaagccatttattggttctctttgtgccagccactgtgatgggagttttgcatacataggagggatgtgcacacacacagaattacaggtaggaggcagtaagcagagtgattaagaacatggatcctggagccagactgcctggctacaaatcctagctttgccacttgcttgtcccagtgtgacctggggcaagttacttaacttctgtattgcgtttcctctatgtctgaatttcttcaacagtaacataggaaaaatattatctagctgctgcagttgaagttaatctgttgaagttaagctgaaataaaagaatctatgtaaagtgcttagaatagtgtctgtactaagtaagggctcagtatagtaataggaagctgaggctcagaaagattaagtaacttgttgagggccacccatgtaataagtggccaaatgggacctgtgtctagtctggtccagccctcccacctcaccaccagccttcttttgttggtggtcacctccttctctagcttcctgctctgtgcacactcataggcgcaaccagatacttgggaacacagatgccctcaagtgcagatttgccaggtacagccttgcatcatagtcactaatcacattgtgattagcaatcttgaaactgggaaggttgagtcaagcaggcttaagagaggaagtgagtctcatgaaaaaatctgcatcagagaaggcagggcttgagttttggaaagagcgggcaggaagggtatttcaggtatgtaatatgacgtgaaggtgggggagagaaagccaaactaacttagctggctggcacagagaggctgagccaggtgcctttggagataagagcagtggaactgatgataataagcctcttgcttgaaggcaaaaggagttgtcaggagttatatttggcctcctatgtgggataagtgggaaccatgcaggtgtctgagagccacaatcttttttttttttttttgagacggagtctcgttctgtcacccacgctggagtagtggtgcggtgtctgctcactgccagctctgcctcccaggttcatgccattctcctgcctcagcctcctgagtagctgggactacaggcgcctgccaccctgcccagctaattttttgtatttttagtagagacggggtttcaccttgttagccaggatggtctcgatctcctgacctcgtgatctgcctgcctcggcctcccaaagtgctaggattacaggcgtgagccaccatgtccggctttttttttttttttttttttgagacaaattttgcttttgttgcccaggctggaatgatgcaatggcaccatcttggctcactgcaacttgtgcctcccgggttcaagcgattctcctgcctcagtctcccgagtagctgggattacaggcatgcaccaccatgcccagctaattttgtattttttgtagagacagggtttctccttgttggtcaggctggtcttgaactcccgacctcaggtgagctgcctgcctcggcctcccaaagtgctgggattataggcgtgagccaccgtgccctgaaagccacaatctaaatgatgtttgaagaagagatttttactgccctctatgtatagaaagaaacaaacagtaattgagtatcaacagagccccagacatcttatttactgcactcactacctatatgaaataggtattatccatattttacaatgaagcaacagggaatacagtgggtttgcagaggttagtttcttgtccaaagtcacacatcttcgagattcagaattgagtcggctgtataggtgagagtgaccattgccagaggcctgaacctgagtttcttgagacctggaaccctggcgtctttccacccctgccaattctttctctactcctgctcccaacatacatacacagaagcacacacacatagtcacttacaatggctccaggaccctgagcccgtcacagaccagagagtctggagggaggaaagggggccacgagccctgggtcagggccctgggccagggccctgggtcaaagcttggctagaagccatggtctgacggcagggggagcaagtgcgagacaggtaatggagctgtctccgggccatgtgcagtgtgtggtagtgtgtgcatttattcagtctcttgatgttcagcatcagtgctgggcctcacagcatgttgggtgccagggatccagtagtggaccagaaagacaagtctctgtcttccagagcttacagtggcgtgtagcactgtccgatagaactttctgtgacaatggaagtgtttggtatctgtgtcatctaacacggttgacagtagccccatgtgactgctaagcgcttgaaatgtgcctagtgcaattgaggaactgaatttttcattttttttcattttaattaacttaaaaatttttttttggccacgggccagctgtaatgctgtagtgctgtagtcccagcactttgggaggccgaggcaggcggatcacttgaggtcaggagttggagaccagcctgtccaacacagtgaaatgccatctctactaaaaatacaaaaattagctgggcgtggtggtacgtgcctgtagtcccagctacatgggaggctgaggcaggagaatcgtttgagcctaggaggtggaggttgcagtgagctgaggtcatgccactgcactctagcctgggaaacagagcaagactcggtctcaaaaaaaaaaaaaaaataggtgggactacaggcacacacccagctaatttttaaaaattagcccatgcctggcaaatttaaaaaaaaattatttttagagacaggatctttctatattgcccaggctggtctccaactcctggcctccaagcaatcatcctgcctcagcctcccaaagtgctgggactgcaggcatgagccaccgcacctggcctaatttaaatgtaaataactgcatggggctagtggctagtattggacagagcaggtctcttgggtgagacacgtaagatggagtaggacaggggcccatgagggcccacagaagggacacctcacccagactcaggttaagaagaacttgttttagatctggtgattgtaacggtttacatttttttctgtttaacttttgatgcttactctattcttctataaaacttgtcactgaggcataatgtattatactgaaagtgcacaaatcacagatgtgcagctctgatcctcctattttaaaactctcccagacacaggtatgggtaaaaggtttagtgggggacgggagacacagaacggaggtaaatgtggggaaggaggttagaaaaccccctcttcagggatgatctggcagaacctagaatccacatgaatgtccctgtggctgtgggggggcagtgggcatggagagtgaggatggagaaggactatttctgaggaccagtaggcaggatttggtagcaggtgagactaagatgcagggacgaagggaactgggaggaaggcttgcagttgtaaagctgaggacttgagaatttgtggtgtccacagaggtcctagaacatgggcgtggggagggatggttgcatgagaagaggaagggctacttctcacatgtttggttttgatgtggagatgtcctgaggcaacaagaaatccttgcctggagagaggctgagaggtcaaggcagaagaagtcagcgtgggcgtcaggtgtgcgcaggtagtcattacacccagcagagaatgggtgctctggggagaggggaggtgagggaacccacaaacaagctttgatagagcgtggtgagggcagggctgagggtgtggggtggagaagcctcagtggagggcaaaagaagaaatggacaacgaagagaggagaacttctgtgctcccgaagccataattaatgagaaattataatgactgaatactttatagccatgatggcaagaaactgaagctctgcccgaggccgcacagccagaagcaataaagcctggccttgtgctcaggctgattccagaagacgctttcttgctggctttccctccagccttgcccaccatgctttgctggagccggccagggccaggactgtgggaggagggtggaaggaggcatccagagacctctgggaatcttgggtgggggtgctggatgctggccttgtggggaagcggggccagcaaggggaggcaactcaggccagatggtctggatctaatcttgggacccagatgaaatcaaatattgggaaatctgagtcccagcacaagttggggtcaagaaaatgaaaggggaagagcagcgctgggtgcctgccacgtgtcagtgatagcagagttgaagcttccccatggcacaagcagaagtgcccaattcttatctcttgcaacagggacttcctctgcccccagcttcctgattctttataactctgaccatcgcagagcacagcgttatagcgagacagggcatgatggatccccagcagcccagagatactcagtgaagtcacatacccggaggtggggccagtgaagtcacatacctggaggtggggccaggtttggaaaccaggttttcaaatgactatcttagtgcttttgcacccatcagctctatcttaggatatgttgagcaacaaaatggtgaactgtgggggtgctggtgggatagtagatatggttgtaacggataggacatccatcaccaaataatatgaattaatgtgtctttgtcaacctggagggaggtccctagtgatggcactttttcagtgacgtgggatgagcacagatgccactctcataatcgaaggtcacttgcacataattgggaggaatactggatgatggcgtctggtgagattgttgggccagatttgtcatgtggtattgaatagggacagaattacactctggttctttggtcttcagataatcagctgcacaagagtgagatacgtgaggggtggaataacgatagtgtatgaagacaggaggactctggctgataagagattggaaagaattgactgtgatctgcttgccaaaagcactaacatgactttgggatgcactaagagagctttagtacccagaacaatggggctcataggccccagactctgtgagagtcaaaccctgtgaggagtgtgtggcccattttgagagggacagagacaaactgtagagtccagaggtagaaatcaggatggtgagaagagcccatgaccacagggaagacatgaagatactgaactgggagagaagattcaaggggcagatgataatggtctttcaactcctggaatagaaaccgaattgattctgcatatcttgagagcaaagaccaaagaccagagagtggatgtagatcctttatgaggaaggactttctaataattaaagctaattattctaccaaaggtagaatgggcctcaatgagaggtgggaggcattcaagcatatgttggtcaaccactttgtgagaacgtagtagtggacattcagagaccagagtctctccactctgaagttctgaaagatgctgatccctgggatggagcaggggactagagtaactcagagcccaagaagatcctctccactgcccattccccacaactgaccattccttggacacttggtttgaatgcttgcattctttctcttctccctgctccccagttccttctgagtcaggctggggaaattgcttgatggcccatgggggttgccacgtgcctgtagcacacttcctggctggggaagaagacgaaacaggttagccagtgagaagggagggcaggtccccaaggttgccctaaaagacagaagggccccagagggaaagtccccacaagagcattctaactctcccagggtgtggtgggtactgactcaggttggcgtctcttggggaagagttgagggaaaagcaaccaagaaatggtgttgaaaagctggaaaaacttcttgagccagccagaactgaagcctctgtgacaggagccaggcactgcatggtgactggtgatgataatgacatgttggctaaaaattgcccagagcactggtggaggtgggaatgtagccaagaagctcactgcctggcaaggctgctgcccagctgcagggggcaccatcacattcggttttgggcatatatgatgtgagtggtaccaggaggcagaagccctgacgttctatgtcaagtgagaagcagaagctgtggaacaaagtgagactgtgggtcctggggaaggatgggatgctgtcgctggtagatgaacacagggggctaaggacatactcctctaggggaggaaagaggaaccgctccttttgggggagcactcaggcctcgccctttccctgtcccattcatccatccaacaaatactgactgagggccctctgtgcctgatccacgctagggtgggggctgcgacagtgagcagagcacagacaaagtccctgcctcactgagcatacaggctagccctgggctgtttaatcgaactttctggatgatggaaataatcacataagcaaatgtagaaggacaactctgtcaactgctctgcctttatggagaggcatatggtgctgggtgagcacctgatggggagctgccctgtctgagaatgggggtgggcttcctaaaggaagtgagtgggagctggggctgtaggtgagcagaagccctggcttggggctcggtcaagtgcctcttctgttcctctcagcaccaggtcctgtggtgcctgcattatagctcatcctgtgggtgcagcgccccacttctgctcctgctgtgaactacctacccaaggggactcatttgactgcatttcctctcacctagcaaggtgcctgcaccatggtggttgctcaactaacgttaacataatttagccagtcaattatcaaccaacaattattgagcgccagtacagctcaatatacagtggtgaccaagacagacaaggtccctgctgtcatagggcttacattatagttggggagacagtccctgtaggagcaaatacacacctaagacaatttcagggaatctaagtgcccctgagggaaatgaaacagggtattgagactagttgggaaagaatgaatgaatgaataaatggtgagccatggaggcacccacccactgggctggggtgggagatgaggaggaggagttggggatcttagagcccagggcagggagcttggtcaggggtggctgcactccaggctgtagggccaggcctcgcagcaccgggagggagtggacagggagtggttccgaagctcagaattcagtgtaaaggagaatgcctggaactgctgacaggagcaatgctgtgttcctgagtcccctgtgggcccaatcatgactcaggcttgagctctgtgcctggcaaagaacactgaggggaagaggggcagggaggacctggagtagccctacagaggcatccaaggctcccactgctggcagccctgttgggaaattctctcttaggcccctgagcgggggttttgaggctgaggtgtggtgtgtggggccgaggccaaggaccgatggatagcagggatcaatgagtccttagagggtcagtcctgggatacagacactgccatggctggcccagcatacctcccctcagggaggaagggtggagctctcaccaattggtctcactgggcctgtgagttcagccacactctgggtttgccccaggtactgtgcagttctgtgctgaaggtttcaaagtttctgtgcatggggaaggagacagcaggagaatgggggatgaagggttcaagacctaatccctaactttgggaaggagtcatccttatccaggaaatggatgaagacatctatggctctaacactagtcaagagccaagtgaatttcatagtaagaggttccctggaagcgggcaaagcaagggtagaagacgccaggagaaacttctaggaggttgagatgggcctggctggatgaattctggcaggcaaaatggggttgggggctgggtgaaagaatgagcagtaatccagagatcagaacagctggagcaaaggcgcagaggaaagggagtgtggtcaagtttagggaagagtaaggctcaatgtggccaagaggaacttaggctgggtgagcttgggaaagctttcaccattctgcccagtccccaacccttcctctacccaaagtagaaggcctccaaagtcaaaaccaaaccagaggccggcacagtggctcacgcctgtaatcccagcattttgggaggccaaggcgggcggatcacttgaggccaggagcttgagaccagcctgggaaaccccgtctctactaaaaatacaaaaattagccaggcatgatgtaattccatgctactggggaggctgagacaggagaattgctgaacccaggaggcggaggttgtagtgagccgagatagcgccactgcactccagcctgggcaacagagtgagactctgtctcaaaaaccaaaccaaacaaaaccagacacaagaaagcagaagcagcatgatgcaggggaaagagctcacacttttatgcagagttatacagatttggtcgaatccagactctcgctgtaaagccttgcaatcctggataagttacttagaatttctgagcctcagtttcctcagctgtaaaagagtacttacctcatgtggcagatgaaaagagtagggcctaggtagagtgtttgggcgttgcaggtgcccaataaacctgaattctctcagcccctacaataacacaggtctctgatgatagggtgttaatgtgacagtgaagggccaaagccaaggcacctttgctccctcttgcttgaggccctctagggatgctcaggctgtgtctgttctggctttgcgcgtttcttctggaactgcctctctaatgaggaggtagccaagacctccttactcaccaatatggggcatatgtgttggtacttgctaatagaaattgcacaaagccgggcccacttcctccctttgcctacttcccagcattcctcatgggctcctccattctcaagggtctacagaagggtccttatgtcctccagattcaccactatcaagcacaagcagcttccagttcctctccactgctggactctggctgaggaaactattcgcccccacagctggcccactgctgagttccccgggaggcttggagcagagggcagtgggcagcagcatcccactgagaactgcagaactctcagcacatgacaactctgtccaaacctctgaactaagagacttgaccaactctagattggcttttagcagcacaaggctgtatccctaggatggccccagcccctcttaaagtgctgtcttgagaaagctcagtgctgccagaaaaatttattatttgttccagccaacacctgatgataggcccctgacctcactttcttagaacatttggctcaaaatggcttgccattgtacatatgtatctcttgcaactcaaaagcatcaggtcttcctttaaaatctagtcatcaaggccaggcatggtggctcacgctgtaatcccagcactttgggaggctgaggcgggcagatcacttgaggccaggagttcaagaccagcttgggcaacatgccaaaactctgtctctactaaaaatacaaaaaaaaaaaaaaacttaaccaggcatggttgtacattcctatagtcccagctactcagggggctgaggtgggaggatcccttgagctggggaggtacaggttgcagtgagctgagatcgcaccacccactgaactccagctcacgctacagagtgagaccctgcctcaataaataaataaataaaggacagagccctaacttaggtacatgccagccagagacagagagacagctggcctcattccattcactctgaggctttgctaaccccctgcctcctcccttgacagctcccagatcacctgtgcacaaatcagaatggagctcagctctttcccctactgtcagtagttactgaataaagcctgctttcactgctttaactaacatctgctatttctcttcgataccacctgcagaagacccagcccgtgctcctccttagcccctgctcagtcctgaggtgacttctgcctcttctgctgctcaacatggggcccatcagcctagttaaaccagcagccatggggctctgaggaggacccctaggccagggcacccatgggcatgtgtgttggggggaactgagtggagtgtcaggcagggagtcaggacacactgagggggcaaggatgctcttggttgcctgcaggcaggagctgagacagaggtgaggcttgacagagaaaggcagggataagaatgtcctgtcaccccccaggaaggtgaaacctggatgaaacgagagttgtgtccagcctagggaggtgcctggctgtggcgacccctcccactcctttgagtccccaccttgggtcttgccattgttgcctaatgttttcatgatgccaactggaagcactttgagagctggacctttgtctcataaggcttgcctgtacccgtccaccctgccctgcccagtgctgagcacacaggaggctgcacaaacaccagctgaccaggagatggagggttaaagaggggattagagcacaggggccagtgagcacaggcaggtgatagggctgaggggtcaggaggagcagtgcaaggaggggaagcctgagaaggtgggagcagtagggcccaggggagtgcgcttggtggggagggtgggccaaactaggaggggaagaccagggactggaggtgatggggaggggctgcggcaaaggacttctgaggtcatgggtggggctctccctagggatggggaggccaaaagtgtaagggaccagatgcttcagcgacagtgccaaggcctttggcatgggtggtaggagacagatgcctcagagacagggccaaggcctttggcggtcgtgggtgggtaggagccagggtgacaaagggaaagggcagccctgggcccagccgcctgcctgggtttgtccactgggccctcgtgtgtgctcctcactctctgtgcctggatcgcaccccactgtcactcacatcgtctcctcacttccctggcctgccagagacctgacctccccttctactcatgggcccaaaggggacttcaggagctgatggaaactcctcctcagtgacttgtccgtaaacctggagtcactgatacctcggtccagccctgcacccatcctcttcctgtttaatgtaggccagttagtcaaagctcacattagtggggacacctggggatagaggctccaaagcctcattttgatacctcacaacccttgggcagttgttctagaaagaggcatctccatgtgacatgcatctcacagccatgtttgggtccatatccttagaggagactggggctgggccaggccgctcaggctggtctcttctaggcattcacactgcttctctgctgtcattagtctctatttaagctgtcacactttcctcttaccctctctgttggtggggtagggaagtttctggtggtgggagcagatgcattaggacctgggaaggggtgggggctctgggtgcacttagaagtgttagacacaagggccagagtgggcctgagactggaaattatgactcctctgctggagagagaggcccagatttgcacgcagcaaatctcttctctgaatatcttagatgtttgcttgtaaggcatgggctgtctctgtggccacccaagaatgcagtagcactggctgcctccgggctgagggcagggatgaggaggagacttttcactgtgcatccttcaataccttttggattctgagccatgtgaatgtgttacctctgaaaaatataaattaacaggctgggcacggtaatttattacgtgcctgtaatcctagtactttgggaggctgagataggcagattgcctgagctcagaagttcgagaccagcctgggcaagatggtgaaacccggtctctactaaaatacaaaaaattagctgggcgtggtggcaggcgcctgtaatcccagctactcaggaggctgaggcatgagaattgcttgaacccaggaggtggaggtggctgtgagccaagatcatgccactgcatgcagcctgggcaacaaagataaactgtcaaaaaaaaaaaaaaattaacaatgcaaaacaaaaatctcttcttctttccctgggctcctttgaggaattaagcgtcttcagggaccagccaagaaccttgacttgcctcagttggggcggggctgcatctcggtcaggccctcagtgccccatcagtgctacgtctggcacactggcttctccttcactgctcaggcacattctttctttctctgtgcctgttgctggtttcatggcatccctcaagccagggataccaccaccacagtcccacaatagtcccaggtccctgttgactctgcctcctacaatgtctcgtctgctcacaccttcactgcatcacatcccagggatactgatagcgggccagccttctggctactcctctggtgtctgcctctctcctccctctagtccatcctccccatacctcagccccagtgaacttccaaaattcaaatctgatgattttacgtttctgcttaaatcctcctgcagctgacagtgttaatgctcggcccagatccctcttgaattttctttttccatttttgtgcatgacacctcactctgtcctttcttttattattttttatttttattttatttatttatttatttttttcgagacggagtctcgctctgtcgcccaggctggagtgcagtggcacgatctcgactcactgcaagctctgcctcccaggttcacgccattctcctgcctcagcctcccgagtagctgggactacaggtgcccgccaccatgcccagctatttttttgtatttttagtagagtcggggtttcaccatgttagccaggatggtctcgatctcctgacctcgtgatccgcccgtctcggcctcccaaagtgctgggattacaggtgtgtgtgagccaccgcgcccggcctatttttatttttagacagagtcttgctctgttgcccaggctggagtgtagtggcgcaatctcagctcactgcaacctctgcctcccgggttcaagcgatcctcctgcctcagcttcccgagaagctgggattacaggtgcacgccaccacaccaggctaatttttgtatttttagtgcagatggggtttcaccatgttggccaagctggtcttgaatgcctgacctcaagtgacccacccgcctctgcctcccaaaagtgctgggattacaggtgtgagtcatcgtgcccggtccccactctgtgctttcaaggctggcacctgcagcccttcttggaggactgcctttggcctcctggactgctttgccctgggtggcagtgtacccagtgactgctctgtggtcactgagcaccatttgctggtggtagttttggtgggaataaaagcccagaaaaaccttgtcccaggctggaactattctgaggccttacacaccaaagctgttccctcgcatcatgccagagctgctttctgcagctgagagggtgctcgtgcttggcttcaccaaccctgcttacttgtctccctgggagtacttcataaatcactcagggtctaaggtggatcctcagtggaaacctatcacccacaatttaagtctcagtcatatatctttactccactctctctctggaaatgtattccatactgaatctaaatttaagccacatcaaacttctagctgttctgctacttttgtgtctcagtacctgcctttaaaaacaaacaaacaaacaaaaaacccacctccacccctcgcccatcctttatgtgtctggttagtctcgcccccttcctcagttctccaggcatgctgcttctttcctcctgtgtcctcagggcactctgggtagtttactgcagcactcatctagccaaattcaactagtcttccctggtgtcttgcatggggctgggcagagagtttcaaaaaacaaatgtctttgaatgagtattgattccccaaaatgtcctagtgctctctagtgtcaggcttcccacatcctgaatctcttctaccttcaatcaaaagtgactgttcatgtgccattcccttgggtggtgtactctgtggcttatgtttctaagatgactgaaacttgtcagagagaagcacagtggtctgctgtgaatagcactattccttctggtttcttgggataccaggaccgaggtcttactccacatcttatggactcttggggtcccagttcactcactgccttcaataaatggaaggtctagatgacttctaaaatctcccatggctgaaatgaaagtcttttgtgggcgggggcctggtctgtcttgctctctgttctatcctgaagccaagaatggtgcctggtgcagagcaggctgttagatttatttgttgagagaaggaattgacaatttttttttttttgagatggagtctcacactgtcacccaggctggagtgcagtggcgcaatctctgctcactgcaacctctgccttccgggttcaagcgattctcctgcctcagcctcccgagtagctgggattagaggcgtgctccaccatgcctggctagtttttgtatttttattagagatggggtttcaccatgttggccaggctggtctcgaactcctggcctcgtgatctgcctgcgtcagcctcccaaagtgctgggattataggcgtgagccaccgcgcccgaccaggaattgacaatttcgatggttatgtattgcttgatgctgtatatatattatttcatttaattctcaaggtggtggagtcaggatttgcatgacagtttatatgagtttgaagtccatgcttccctcataatatcttgagaatttaggagacaatgccatcatggaaagttttgttccaatggtggtttttgtttgtttgttttttgtttttttgagactgggtctcactctgttgctcaggctgtagtggcgtgatcacgctcaccaagtcctcccaccttagcctcctgagtaggtgggaccacaggtgcattccaccacgcccagctaattttttttttttttagatggagtcttgctcagtcacccaggctggagtgcagtggcacgatctcggctcactgcaacctcctgggaggtgggttcatgccattctcctgcctcagcctcccgagtagctaggactacagacgcccgccaccacgcccagctaattttttttctttgtatttttagtagagacgaggtttcatcatgttagccaggatggtctcgatctcctgacctcgtgatccacctgcctcggcctcccaaagtgctgggattacaggtgtgagccactgtgcccggccccagctaatctttaaaaaattgttttgtagagatggggtctccctatgttgcccaggttggtctcaaacttctgggctcaagcgatccaccttcctcaacctcccaaggactgagattacaggtgtaaactactacgcccagccccattggtggattttaatgatggctgtggaaggctggaggtggtcctgaggcccatcttctttttataccacataggcaactgcctgtgctcctcatcaacctcaggagataacaggaatttaggctggtaagtggaagagggtgagcaggtgctgagggaatctgatcactgtgatctgctgccacagcaaatggtggcatttaggcacacagttccaaaggttctataccagtcacgtactgataagccagccctctctctaaaagaaagctttgattggtagcatttgtggactttcatgggacatgtactgtcgccatggctgattcaagacaccacatgaaatcactgaatgaggacttagaagagatgtgcatcagaagctctcagaagctggtgagccactccacttaccactggaacagtaactggggacggtccccagaaagccacaggaagacttctgccaatcttgtgggcagcctggggaagcctcagctctcactctgaagattttgaataagtaaaatgatttatgtttctctgatttatggcagccatcccatcactttggatggttatctaggctgtccggtggaaggttccctcagaatagcccttggctcctcttaggaacacaccccattgccttgcctcaggctaggacagcctcttgcataggcaaggcagctctatagggctcatgcaattagttctgcagaaagcaattcaggtagaaccatcccgagaggaaggatgagagttgtcggtgtcacagctattcctctgtccctcacttggattcaggcagtaccttctccccaagttccaggaaatcatgaacaccaaggaatctgcctttgctggactgggcctcagccagagatcaggcccagctagaaggtagcaggcatccctgaagagatggtggaatgggggtggaaaaccagtgtgagactggatgtgcccacttctagctgtggagcgactctgctcctcagctggggcatgggaaacaggtcttgcagggcagagcaggaacagttctggaggaaaggggtcttgtcctggggcagaaccccttgagaagcttcacatttatacatctttgagtctttctcccaaattgttaacatgttgctgagcagagaatcagcagtcaaaaacacattgaaagagaaatg

SEQ ID NO: 2991 - DNA, 1784 bp, Homo sapiens
ggcttaacatcacacatttattttctctgttctggaggctgaaagtccaagactgaggctccagtcaattccatctcttgtgagggctctcttctcagcttgtggacggcagcctccttgctgtgtcctcacacagactttcctcagtgcatgcgtgtgggaagaaagtgagagggagaactctggtgtctgtcctcataagaacactaatcctgttgaatcagtgcccatcctcacgaacccatttcatcttagttacttccttagaggccccatctccaaatacagccacattagagtgaggtcttgaacatacaaatttgggggagacacccacattcagttcataacactaccatttctgaaattgcaatcccaatctccccaacactccttcacccccttaccttgctctcttccccccacagttcacctttctcgtactctccaatgaattcatattatgaattctattgtttattatctgtcaccctctcccccatctagaataaaactcaatgattaagggtaggagtctttgtctacttgttctttatgtgtcccaggcatctaggttagtgccttgtacacagttggtactcaagattagctgttgaatgaatgaaggagaaaaaacatctccttcctggccccttttcccttttcattctctttgcacatcaccagggaaggaaaagaaacacacctcaataatcaattagtttgaggagagctggtagtcttcattccatttagaaaccagatctggtattcaataattaaaaataattaataattaataagcagcccaaatttccaccaacggatgagtaggtaaacaccagattaaaagacttccaagcagtccatgattctagcatactcatctatgactgctggatatgagatgtgatttgattaaagagacaggccaggcacggtgactcacgcctgtgaatcccagcactttgggaggccgaggcaggcggatcacgaggtcaagagattgagaccatcctggccaaagtggtgaaaccccgtctctactaaaaatataaaaattagctgggtgtagtggtgcacgcctgtagtcccagctactcgggaggctgaggcagaagaatcgcttgaaccaggcaggcggaggttgcagtgagccgacgtcatgccaccgcactccagcctgggtgacagagcgagactctgtctcaaaataaaaaggcaacacgataaatgaagtgcatttattaggataatcaacagttaccaggtccggttctaaacggaatgaaaactaccagctctcctgaaactaactgtaccctcgttaagtctcttagtgtgtggaactgtttcttcatctgaaaattgaaaacaacaagacatgcaaggtacagcatgaggtaatgtgctcagggtgctttcaacagctagacttgtatactagttccagctgcgcagctctctagctaggtgactttgaacaagcagtccaaccttctgagctcccattttctttcctgtaatagttggataaaatcacctcgtagtggcaagaatcaagagacttctcaaaagttaaacatagaggccaggcgcagtggctcacagctgtaattctaagcactttgggaggccgaggcaggtggatcacttgaggtctggagtttgaaacctgcctggccaacatggtgaaactctgtctcttccatctctactaaaaatacaaaaaaaaaaaaaaaaaatagccaggtgtggtggctaatgcctgtaatgtgccagtt

SEQ ID NO: 2992 - DNA, 9875 bp, Homo sapiens
aaccctgcccagtccatcccaccccggagccagctttcctctcggccccgcgcggggcccctccctgtcaggcccagggccgggctctggcgggaaccccgctcggcccccgcctcctgcacctcagcaccatcccgtcgccccataagcctcggccccgcggcgctgcaaccctcccttctgggaaaggaatgtgcccgatacccactgcttagctcggcgtccgccgctgcctccacagcaggccctaagcccgagtcccggcctcgccgccgccaccgccggccggcctagagctcggagcctccgcttacctccccgccccctcctgctaccgcactcggaaacccgcccgccgcaaacaccctaggaacagtttctccaatcaacgagccgaggccggggccgtcgacggatgtccctctgattggcagcagagagggcccaatggctgagtgtacctcctcatccccggacctgatttcccaagactgacataattcccggcccaatgagtacctaggcccgccccgcggtatggacccaccaatgaggagggcgaaggccctagtgtctggcattctgggcccctcggccgcgccttcgcggcgggcgatgttagtgggcttgggcgttgggtgaagtatccaggttgggcgcttccagcgctttctgtggcgggggaatgaaggcctaggtcagggaataggaaggtgtatcgccgccagagtgcggaacaccctcgccttgagggttcccacagtgacttgcaaaagtctagtgagacccgagaatgctgaggcgggacacgaagcatgtggttcttgtggttgcgacgctcgtgccgccatcttgggtgctggcggcggaaaccggtaccccaacttcccctcggtgcgaacctggagaagccaccccagctgtgagggacggttgcgcctcatggcccaggcaagggtaccttcgctggagcagtaccgcggacggatatcatgagggtggtgggacgttggcggaacgttggcggaacgttggcggtgtgagaggtgtggggtaatggcgatttttgtcatggtagaaacagcccaaaggacccccctcgtttggcctcccacgcagcttagtcttgcttttttagggatgtttctcattttttaatttctccagtcccatctggttatattgccaaaacatgtttgtgactctcaaacgttagtttactcccagcatcacttggggagcttgctaagctacgaattccgaggtcccactggagagtctgatttaatgaccctggagtggcggccggataacctgcctgctggggtgattttaacgcagctgatgcgaagaccccatttagggaatcattgggttggcgtttgcaatgcgttcctcccagctataggacaaagaggtgtcaactcaactgtgtcttcttagaagagcccattatttataggtgagtcattagtccctgtacaactaaggacaaggccaactgataactcagtaaataatcgagtccattttgtgcttgcgagttaggggcttaatttggggtggtttgcagattaagtactttcactgcatataataaacgtacaccagcaaaccactcatggaattcttaaaaaaacttctgagctagtttaccagtttcaaagactaattcagagagcatgttttacctattctaggctggactggaactcctggactcaagcgatctttccatttatcagggactactgacgcgtgtctcccaataaatacctgagtataaacaacatgaggactagaattttgtgcgttaactgttataacttagtagacactcaaatactgagtacttgaagggggactcaagcaggcaggcctctgattttcctgttaaaagcagaaattaaccacaccttggaggatgtacagttttgaaggatatggcatgttaacaataaaataggagaccattcagtccccgaagtagtgagacaatgaagataaagactggtattgtataagaaaggaggaatatttaggtgtggccatcaactctaaaaataaataaggttgagaaggaagtattttaaacatagaactgggcccggcgcagtggctcacagtagcaccttgggaggccgaggcgggaggattgcttgaccagcctgggcagcatagtgagacccccgtcgctacaaaaaaacaagctgggcttggtgccacacatctatagtcccaactactcaggaggctgaggtgggaggatttcttgagctgggagattgaggctgcagtgagctatgatggtgccagtctgggcaacagtgagatgcttcctcaacaaaacaaaacataaaattgagagatataaaggctcaactacagtgtttaactacaagacaattttgagaaggtgaaaagagcatactaaagttggtctttttttgacagaaaaatacagaacaattttcagtcctaacagttcaaactaaaactggacaatcgtttatctgtggagtttcctgcttagccatttcacaaaggtgggcagaaaaagggaaagagttgcaagggccgaagagagtaaaggtgtagagacaaactcagtcgcaacagcaggcctaggcctggcagggtgtgggcgcccaggatatttgatgctccatggaagggagtggagacagaaagactgtcttccattctgtctagagttccagatcaagtctgagcaggtgcaagctttcccagaacctgctgattaaccttgtaaaacccagggtgtgtccttcttcacccaggaagccaccccctcctttcccccaacactctccccctccctttgcctgggacagctgttaataggacagttacccaagaagcaaaagaaggatcccatgctgatgtgtcatcagtcccggtatatccattaaatcagactgagaagaccactggaaaaagtgagcgcatgcatgtggctccctaagggaaaggctggcagccattgtaaaactaggccttgcccctgcgactccaggctgggcaggagagagaagaaggcagtggaagccgagaagagggttaggtctaaagcacacggatttggggccagctaactataaaacatacacggaaatccccacccccaccccaggaatagcagtgtagtgtctaccgacccagcttccctggtaggaaaagctgctgctgccgccaacagccacatccatcctgcagtcatccctggaggatgacacatgccaggaatcctcagagaaggggctgtgggagggcaggctggctggggctctgatttcttctggaacagtgaaattgctttttccctaaaagggaaacccaggctttctgccattctggttgtccattatctttcctctaaaaatgtctctaaggccaggcacagtggctcacacctgtaaccccagcacttcgagaggcccaggtgggcagatcacttgagccaggagtttgagaccagcctggccaacatagtgaaaacccatctctacaaaaaaaatacaaaaattagccaggcgtggtggttcatgcctgtagtcctagctagtggggaggctgaggtggaaagatcacccgatcctggggaggttgagggtgcagtaagctgtgattgcgccattgcactccagtctgggcaacagagtaagaccctgtctcaaaaaaaataataaaaagaaaaacatgtctttaagttttgctaatccatataagtatttcttactctgtaacctcatctaatccaggggaatagattagatagatgattgcctgagatttccttacagtcctgagagatggtaggaatacatcatgtcaatactaaatgttagcatgttttgcaaagaaatcaattagttttctggcaaatccggacatatggccctctctcttatatggtaaacatcatcagcaagcttgttaccattaaaccaccaaaaagtaaagctctcctgcaagccagcctctttcctatgcaccactaccacactcttagaagattgcttctcaatcctggctgcatattagaatcacccaggtgggtagctcgtaagaaataccaatgcccaggtcccaccccacaccaattaaaacagctgcccagagcagaattggacatcagtattttgtaaaagctcttcaggtgattcttatgcacagccagagtagagaatcactaggttggagcaagaatccacattggggtaaaaaaaaaaaaaaaaaaaaaaaagcaaaagattgtggtaatacgggaacacagactagaatgattatctgacttttttttttgagatggagtcgctctgtggtccaggctggagtgcagtgacaccatctcagctcactgcaacctctgcctccccagttcaagcgattctcctgcttcagcctcctgagtggctggtattaaaggtgcacaccaccacgcttggctaatttttgtatttttagtagagacagggttttgccatgttggccaggctggtctcaaactcctgacctcaagtgatctgcccacctcagcctcccaaagtgctgggattacaggcgtgagccactgcacccggcccgtttgacttttagggtgtgctcattctcaaccctaaaatgttctttcttcacctctacaatgaaaatgcctcattgttcattagtgtcttagtgtaacattttttgaagctgagttcaactgtcctgtatgtcttgctatgttgtctcaaacaataccaggtagtgttcttcatatagctctgtgtgacatgtcacactcaaggagctgccattaagaggtaggaggagtggatgttttggactcataggtgggttcgaaaatctggctctgtttcttactagttgggccatcccgagctaaatggagataacaatgtacatattcataaatcttaaaaatcaggtcatgtgtataaagccattcatgcctggaggaagagctgagtataaggccctgtcttgaataatcctctctccacccaccctacaactttatctcagagaaagccaaaggcgatgaagaaatgagagctgtccttagaatggtctactagaaacccatcctacagacagagcatggaagctttagttttctctagaggatgccaccagtacacacttccacgcctcatattccacacacacctccccctcttgacattaagcaggagggatagagagaggctggtacccaagggagctgtttcttctcgtcacataagaacagatgctgaaatcctaggacagacagcacagaaatgtggcagcaggagggtgactcagaggaaatgaaatggtctccccttcaagctataccaaggcccagaggagaacctgctttgaatcacctgcctcctgggactccaaagggcagggaccaattctgagtgcactacttcacaggttccagctgggtagggatgtgcacagcccacctctccatcctactgtgcctacccgaagggagtagagggcagagaaacatgaaggctgcattctttttgaacccaacttggcttcctcgagctggggaggctctcctgccgagtctgctgctgcacgtgcatgcttctcatgtgctgccagccttaaactggaaagtcctcttagggccatgctctgtggaagacactgtcccaatactggacacacatagctcacatgtttatgtgaaactgcattaaaggtgcacttcaggatgtgtggggaagcggttgtcatggagagaaagaagttctggggtctctgttgaaggagtttggggaggggttatcattggggagaatcttgtccttgaaaagttgaacttggctctgaatttacttattcaccactaaactaagatgtaaagagattttatgggccaggcacggtggcttacgcctataatcccagcactttgggaggccaaggtgggcagatcacttaaggtcaggagttggagaacaacctggctaacatggtgaaaccccgtctctactaaaaatacaaaaattagccgggcatggtggcacgcacctgtaatccctgctacttgggaggctgaggcaggagaattgcttgaacccgggaggcagaggttgcagtgagccgagatcgtgctactgcactccagcctgggcgacagagtgagactccatttcaaaaaaaagaaaagatgtaaagagattttaagaagaggaacaacaaggccaggcgcggtggttcacgcctgtaatcccagcactttgggaggccaaggcaggcggatcacctgaggtcaggagttcaagaccagccaaacaacatagtgaaaccctgtctctactaaaaataaaaaaaattagctgggtgtggtggcgcatacctgtaatcccagctactcaggagactgagacaggagaatcgcctgaacctgggaggcggagattgcagtgagccaatatcaccccattgcactccagcctgggcaacaagagtgaaactccttctcaaaaaaaagaaaaaaagaaaaagaaaaagcaacaacagtgatagatgtgggggtgatgagaactttgtggttcctaagcttccttccccagccttctctcattcctatccccttggcccctctccagtgccttcccatccctaacgtgtataactgactccttccccacctcccctatggagccagccccctaagtcccctatcttcccaggtcttcctctgtcccttctggaggctgctggtctttcatagtgggtaccatagccaaacagaggctgagaaatgctcctggaggctttttggtgctgtccttgtaaatatgagccaaaaaaaaaaaaaaaatggactagctcacagaaatattaagacatcaaaataaccaaatcagtattttttagaaataacatacccagccagcatgaccattgacataacttctgatgatctggaatccgaagaaataaaatgcccaaatgctgggtcttttccctggctgctgttatcaaatagtgtcattatgttccctattataactgatagcctgcaagaaaggttcagatgtgccttctaagtcatcatatagggagggtcagtagatgcttcctcagatgtctgcatggcctgcttcctcctttcctttagctctttgttcaaatgtcaccttgttaaaggttttctcagaggactatgaaaatggctttctggcttgcctgtcccttacccctcacattccacatcccatttctgctctatttttctttgcagcacttatccccaactcatataatatctacttttcccatttatttgtgtattatatcttgcacagaaacgcacgcatgtacatacacaaacacttgattgtaagttccatgagagcaaaatttttcttttgtctactattgtgtcccagtggctagaaaaatatctggtacatactaagcactcaataaatatttgtacagcacataaaatatgttgtcttttttttttttttttttttggagatagagtcttgctctgttgctgaggctgcagtggtgtgatcttggctcactacagcctctgcctcctgggtgcaaatgattctcctgccttcacctcccaagtagctgggactacaggcactcgccaccatgcctggctgatttttgtgtgtttttagtagaatcagggtttcaccatgttggccaggctggtctcgaactcctggtctcaagtgatctgcccgccttggcctctcaaagtgctgggattacaggtatgagccaccacacccagccaatatggtatcattgataggtacattttaattattattagttaaaatttggtatttgtgaatatttatacatgatctccctcatcctgaattcctttattcatttacttcacaaatgcttattaaatatctgtcatcggccaggtgcagtggctcatgcctgtaatcccagcactttgggaggccgaggcaagcagatcacaaggtcaagagatcgagaccatcctggccaacatggtgaaaccctgtctctactaaaaatacaaaaattagctgggcgtggtggtgtgcacctgtagtcccaactactcgggaggctgaggcaggagaatcactggaacccgtgaggcggaggttgcagtgagccgagatctcgccactgcactccagcctggtgacggagcaagactccgtctcaaaaaaaaaaaaaaaaaatctgtcaccaagccttgtaagaaacactagggattccacagtgaacaagacaaacataattggccaggtgaggtgggtcacacctgtaatctcagggctttgggaggccgaggcaggaggagggcttgatcccaggagttcaagacctgcctggacaacacagcaagaccctgcctttaaaaaaaataataataaataaccaggcatggtggcacgtgtgtatcgtcccacctactcaggagactgagacaggagaatggcttgatcctgggagttgtttgtgtgtgtgtgtgtgtgtgggtgggtgggtgggtagcaggttctcgctctcttggccaggctggagtgctgtagtgcggtctcgggtcactgcaacctccacctcccaggttcaagtgattctcctgcctcagcctcccgagtagctgggattacaggcacctgccaccacccccggctaatttttttgtatttttagtagagatggggtttcaccatgttggccaggctggtctcaaactcctgacctcgtgatccgcctgtctcggccttccaaagagctggaattacaggcgtgagccaccgtgcccggccgacactgggaatttgaggctgcggtgaactatgatcacaccactgtactccagcctgggtgatagagcaagaccctgtctcaaaacaaaaaaacaaacaaacaaaaagtcacattcattggttcttgcagggctcaaagtctgggcggggagaaggaacacttataaacaaactagtaaaggctgggaatggtggttcacgcctgtatcccaacactttgggaggctgaggtgggaggatcacttgagcctaggcgttcaagaccagcctgggcaacatagtgagaccttgatcatgatcaccctcctccccctcctcctcctcttcctttctttttctcttcttcttcttcttcttttttttttttttgaaacagattctcactcccattgcccaggctggagcacagtggcatgatcatggctctgcagccttgaacccccagactcgggtgattctcccacctcagccttctgagtagctgggactacaggtcacaccaccctacctggctaatttctttgtagttttagtagagactagatcttaccatgttgcccaggctggtctggaactcctgggctcaagccttctgcccacctcagcctcccaaagtgctgggattacagatgtgagccattgagcccagacttgagaccttgtttctacaaaaataaaaaaaataaaaaaataaaaaattacctgggagtggttgcatgcaccagtggtcccagctactcgggagactgagatgggaggattgcctgagcccaggaggttgaggctgcagtgagcccagatcgagtcactgcactccagcctgggcaacagagtgagaccgtgtctcaaacaagcaatattagtaaaaataatatttagagattgaaaaaagtgcaatgaaagaaagaaataggaactgagagaatgtgacaggagagacctatcaagtcagatatggtggctgtcaggaggaccttttggtaattatatttcagcagaggcttgaagataagaagacttgatgcattcagtgaggaaaacccc

SEQ ID NO: 2993 - DNA, 22081 bp, Homo sapiens
cttctgcgagggcgcgaggactccaggagccgtcctggttcgagcatttctgaagaaactgagttcccggcgttcgcagcctgggagtcacaggcgcccacccaccggtaggtccttgagtttcgagagccagtagctgaaggagagaggagaggcaagtgcctacaactcccagagcactgcgcggaggcgcccggccgcgctgtcctggccgccaggctgcctctcccgctgggggccgccgcgctgtctgcgggctactagcgccgggcccctccgcgtcgccacgcctgcccttcacagccttggcccataaggtcaccgaggggcgggaggcgccgcccgggccctccttggaggcgggcgctgctcccgcaccatcctcccccagttctcttagactccggggtactttggaggccgagacagacacgctgtccctgctgccacggaggtccctgcttgcaggtgcaggctgttagaggagagggtctgaaaacaagaaaggggaatagctgtatgataactgcttgaaggcgagagggcccagcgacagctctgttttagacagggcctccaggcctcttagactcagtccctgccacgcacccactcctgccctggccgctgcgacggcataatctcgggatctttgaaggcagatgcggggctaaaccatcccacctgacgggaaccctgccacaggacccgacatatccctgtctggacactgctgtaacgagtcaaagtcaggaaggactaactggagcccagagattcccaggtgctgctgcctcagacctgtggactctttggaggatctcttacagtttgtgaacttctcagttcctctactgctcccacagacaacgttgctaaacatattaattggtcccataaatacttgagcaaaacaaatgcgaaaatctgtcccgaattcagcctagaagaagcccagccctgcgcgtcacacttctgtgtagtggaaccccccttcccaccccgccgcaggccacagcaggagggccagcagacggaaaggcgaccctctccttgttgaggattcctttcgatttccttccagctgacattctaccacagttttagctgcttgcaatcctctcaccgtccctcatcacctacagtgtgtgattcaaattccttagcacaatcaagaagcccctccttagtttggaagttgcctagctctccaaattcaactgcctacctttcccgtctggaacttgccaggctagtaaattcagagggtttgcagatacgtagatgttctatgctttacctaaaatgcttttacctcccagccaacttttttttttttttttgagacagagtcttgctctgtcgcccaggcttgagtgcagtggtgcgatcttggctcactgcaacctccgcctcccaggttcaagcaattctcctacctcagcctcctgagtacctgggattacaggtggtgccaccacacccagctaatttttgtatttttagtagagacggggtttcaccatgttggtcaggctggtgtccaactcctgacctcatgatccatccccctcagcctcccaaagtgctgggatttacaggcatgagccacggtgcccagctctcccagccaacttttgtccttcaagaccttgtacctgtctggtctctaaaaagtacctggccttcctgttgagtcatacagccctgcctccaagtgtcagcgtagttcatgctggagacctcttaacagttccatggtatgacactgcggatatggctgtcttttctttgtatcagtgtggtgattcagagggtatactagggattctagaacgcacttctggctcaggggctgcttgtgtaacttctgtttctcagctgcctggtttgtatcatgggatgatagtatctcccctcagaggattgcggtatttcatgaggtgatacgtgtatggaggccaagtgctgttttatattttaagtgatctacatcttgattttcacaacaactgtataaaagtgatactgttggccaggtgcgttagctcacgcctgtaatcccagcactttgggaggccaaggcgggtggatcacctgaggtcaggagttcaagaccggcctggccagcatggtgacacctcgtctgtactaaaaatacaaaaattagccgggcatcgtggcacacgcctgtaatcccagctactcgggaggctgaggcatgagaatcatttgaacccgggaggtggaggttacagtgagctgagatcgcacgactgcactccagaatggatgacagagcaagactctgtcttaataatagtatcacttttttttttaatcaacaatctcattttgtaaatgaggaaatcaacttacagacgacctgagtgacttgctcacactgccagccaggaaagtgctaggatttgagcccagactgtccagttacagagattacactctgccattgtgcctctccagaagcactggaggtaggtctagtgcatagagtaaatgtaaatgctgaaacaactgtggccctaatgaacatcccatttctccagctttttactctccccttaacttctgaatgaccgtctgcttctaatctgccaacttggtctaagatcctcacggtgtttcctcctgattactgttaatgcacggaggttgtctggaaggttcataggcagcctgattgactcagtatgtattagctgagcacctttggagggcacagcctgagtggtgggaattagttcctgggggctgtcctgcggtggagactcccgtgagccctctgtcctgctgtatgaaggcagccagtggaaaggcatgtcctcgctggtgctcaaagtaatctgctacttctcttactacacttttcattcattcattcttaaatcgttgaaggcatactctgcaggtactcttgggcacagagatacggtgtttagtaagacaaacactgttcctgggtcttaacgggctttacattccaatgggataaacaacttaagtaaatattttcagagaggagtaccaagaagaaaaggaacaggatgatataatggagtgacttggagatcacaggtggtaagaggtcactctaaaaaggtaacatttgaaggctgggcacaatggctcacacctgtaaccccagcactttaggaggctgaggaaggaggacagcttgagtccaggagtttgaggccagcctgggcaacatggggagaccttgactctacaaaaaatttaaacattaactaagtatggtggcacgtgcctgtagtcctagctactggagaggctgaggtgagaggatctcttgagcccaggagtttgagactgcagtgagctatgtttgtattactacactccagcctgagggacagagtgagaccctgtctcttaaaaacgaaaacccgactgtatcaaaaggtaacatttgagtgggacttgaaagagtgtgcatgcgaaggactgaagacagaatgttctgtgcagagcgaattaatgcaatggctttgcagtgcagatgggcctggggtggtccaataaggttaggaccaaggtggctggagcatcatgagacaagcgtggtacttagcttgcctttggttaagtcactttctctatttgaatttcagtttctcacctgtaaaatatgagtaattttatctgtattagccagtgtgtaattagaggaaaaaccatttaatacagggtattgtttacaaaggtgttggaagggcatgagaaacaaggggagaacaagggcacccaaagcctgacccccacaaggctagaggagcaacaggaaaattcgtttccagagactgattcctcagctgctgagcaggagcctggagccacacttgctgcctggtactactgacacacaactggaaccaccgctgtggcctggggtgccaccagaagccagagattagaattgctttccccatctcatatcttccaaactcccaccagtgcctcccactggctgagtcagatgacaagggagtctgggaaatgtagttgtttggcttccagccctgaccatggagagtatagaaaggcaggtgtaggggagaaaatagatgccattcacacagcgcctatcttgcagggctgttttgaggagtaaaaactcagcctatttttattcctcatagcatgtagtagcattcagggaaaggcaaatcttccaaaacaatatcttaggtataatagttctacataaaggtttgaatttaccattaaaagcatcaaaatgagcattttaaaagtagaattttaagtctgaatgggcagtatattcacatggtataaaattcaaattacaaaacaatatacagtgaaaaataagggggtttttttgctcatcttcttgtgacctggctctttccatctctgtccacaaccctctgcaggcaataactggtacctttgttatggatcctctgcagatataaagtagacatatattaacaaatgttttctttggcccagaggatgcatattatgcacattcctccatttcttgtttgtttttgttttttccacttaattgtatcttggagatcactctgtatcagtatatatctgatttgttttagcagtacatgataatccattgtttggatatgccataattgtatcagccagtctctggacagtcttttactatttcaaggagtgctgcagtaaacatgtttgcgccacttcctggtacccattgcaaataaaactgggataatttcctgacgagaacttgctgggtcagagtgtaggcacttgttgttttgataaatattgccagactacaccccactccctccagcagtacatgacactgcctatttccccacagctgtgccagcatggtctgttagcaagtgttttctttttgcaaatttaaaagtggtatctcgctaaatgcaatatggtagcagaggacatttgtggaaaaacaggtgaaatctgggctgggtgtggtggctcatgcctataatcccagcactttgggaggccgaggcaggcggatcacaaggtcaggagttcgagaccagcctggccaatatagtgaaaccccgtctctactaaaaataccaaaaaaagttagctgggcatggtggtgcaagcctgtaatctcagctactcgggaagctgagtcaggagaatcgcttgaacctgggaggcggaggttgcagtgagccaagatcatgccactgcactccagcctgggtgatggagtgagactctgtctcaagaaaggaaaaaaaaaacaaaaaacaggtgaaatctgaatggggtcttgagttcagttaatagtaactgccaatgttggttcttagttttgacacataccatgactatgtgagatgttaatgtcaggggaaccaggatgaaggctatacagaactgtactatttttgcgacttctctgtacatctaaaattatccttaaaaaggtttctttaaaaaatgacatcttgttttctgtaaaatttgaatttctcatgagtgaaatggaacgttttgaatatgatgctctttttaaaaggtggccttaataatttgtatttactaaggaaaaaagtcagagtttatttactttaaaaaaattcaggccgggcgtggtggctcatgcctgtaatcccagcactttgggaggctgaggcgggcggatcacgaggtcaggagatcaagaccatcctggctaacatggtgaaaccctgtctctactaaaaatacaaaaaatgagccgggcgaggtggcaggcgcctgtagtcccggctactctggaggctgaggcaggagaatggcgtaaacccggggggtggagcctgcagtgagcagagattgcgccactgcactccagcctgggggacagagcgagactccgtctgaaaaaaaaaaaaaattcattaacagtacatttaaaatttctgttactggagattgtatttctcattccatccattaatgtgcagcttcaatgttttcccccagatatgcaatttcacttacaggatcttgttcttcagtgacatgtcataagagttaataattccacaagccaccctgcactgctgtgatcctaacaatattgaaaggttggtgtgtatcctttcctacctttcctcattctaaaatgtttcctcgttctaaatgccaagctggttttgaacaactgacctcaggtgatccacctaccttggcccctcaaggtgctgggattataggcatgagctaacatgcccagccctaatctgctcttcttagatggatacttgtcagattgggttaagacccactctcatggcctcattttaacttaattttctctttaataaaagtccaaatgcagtccattctgaagtactgggaggttaagattgtgttatttgaattgaagtgagggtgaggggcaggggcacacaactcagcccataacacgtaggattaaaaaaattcttcgggtccggggaggtggctcacacctataatcccagcactttgggaggccaaggtgggaggatcacttgagcccaggaactggaggatgcagtgagctatgactgcaccactgcactccagcctgggtgacagagtgagaccctgtctcaaaaaataaagtgaagcctcagcctcagcatacagtgaggcagtgtgtgtgtgcagtgaatcgaagttccagtcatcattacttcatttcagggctccacactgccatctgggcatccccaggcctctctggactggccctgccccaccctcatggaggtagcctttacctggcaggcacctcagaggctggtcctatatgtcacatcattgagataaaaagaaatccaaggctggaagcagtgacaaatggtgtggacttggtggaagttgcccagggagatggatgagaatggtgacatcacacatagcacggctttttctccaaaatcccaggacttaccacagtggccacactctgtctctcacctgttcactttcttctgctcgctcgctctctctcagcctcccctgtcccaccttttccatatgcgaagactctcccccagcacccctgtggtggtttaaaagcatggcagcaaactcctcggcattccttccttcagggtggtgcctaagtcccctcccagggaatctgagtgggcctataactgcttcagtcagcagggtgtagaggaagtgatgctgaatgacttttaaggttggctcctaaaaggccatagaggctctgtcactggagctccctgtgctgtgatggaagtctgaagtcttaatgctgaagaagcccaagccatgtggagaggccaggtgtcaaagctctagtgagcatcacagctgagcagggacagggccctctgcttcttgtggagccctctctagattccccacacacagaatccacaagcagaatgaagtggctgtgatttgatgcccctggtttccttgttatgcagcagtagatcactgaaatcaacccccttctaaaggcctctctgcagacattctccacttggtgagaccaaagctagcctaacagggctcagcagcagagaagcccagccattggccaaaaaagccactggctaccatgcagccaggatgtccttggggagccttgatctatcccaccacatcaacatttccacctcagacatgggaaaggcaccaaggtgtgagcatgggcagtactcctagggaaccccaagcacaccccattgccccaagatgcaaatggaactcctcactggtcccatagttttacaatgtgagtctaggaaagcacagatgagccctcttttatgttattgtccgccttggcggagaatggaaacagcaagaatgctgagcttgtggtgcagacttggagatgcatttgtcactagaaccttagcgcgtgcttgtacaaccctggtggtggagagatgaatggacgaggcccctcctttccatagctcatgtggccagcccctcatctaaggcaggggccaaaacagagcaggaatgtggaagggtggccagctgtcctggcttgcctgggcctgaggggagtcccagggcatgggatttttagttttaatattgggagagttttgggcaaactgggccaagttggtcacatgagggtgtggcaagcaaggcaaagatggtttgatcattgcagcccctcacttcccatagctcactgcagagcctgtgtcatcctgacaacaacgatgtggaaggtgagacatctggcagcattttgacttcatgaactgggaaacgcacatgggtggaggcgcctgcccacgctgcccagtgtctcatggtggccacaagaggctgcggctcctgttgctcaaacagggccctgttcttgtccagcatttccacagcaaggcccctgctcacaccagacacttccagggaacccttggccagatgacagcagttgctctggtagttaacgttatgggaaacagattctaggaagcgcccatgcatcgcatcacactttttcatctctccttctgtccatccttctgcccactcctagttagggcatgtgtgctccaggctgggagccagggcagcctcatgggtcagccccatccgcaaggaacccatgtctggggagacaggcattcaagaatgagatattttcaggtgagtgctaggcaggcgatatcactgaacatacttaggggtgagtggggaaggaggtctacctaggtaaggaggtatgtgagtctgtcctagccaaataccacagactgggtggttgaaacaacacagttcctgctcacagttctgcaggctgaagtgcaagatcaaggtgctggcagatcccgttccggctgaaggcagatgtctgccttcttgtgtccccacatggctgagagacacagagagttctctccttataagcataccctttctgtcagattaagatgccaccctgtggcctcattgcaccttcgttgcctcctaaaagccccgtttccaagtacagtcccattctgaggtcctgggagttaggtccttaacacaggaattctaggcggacacaattcagtccctagcacccccgttcccagttggatcaaggcctcaaaatgaagacaggcttgtctcacctcacctgtccctcttctgagaagctgcaagactgagagggagctggagataataggttgatttgggacaaggacactacagggtgaggacatggctctgtgtcccaaggttttggggcagcagactggtggaggaccatgctcaagggttctgaaggggagcagcttccttggcagcccgaggcccaagacacagagggcagagcacacagatacgagctggggctggatacattgctgactctgggtagaaggcgatggaaatgagggtctgacgctatgttcaatcctgtcccaccctatgtgatggctggagggacaagggaaccccagtaggatgatggattcctaggggttgcaaaaggaatgggcagggccagccatcactgagacagcacccaggcggtctcgtaggttttgcttagagactgtgtgctccacttgccattgccaggagaggcatccacccaggcgtccatgaatacatggatacacacaaggaggtgcagccacatgatacaatgtgattcagctaaaggagagtggagctccggtccatggaccttgcggaggcaccttgagaacattgttccgggtgaaagaagccagacacaaaataaaatattgtatggttacaacaatgtggaaatgtccagaacaggcacatccacagagacagaaaccagatgtgttactgccaggggctgggggcaggagggaaaatggggatggcttctcgggggaatgaggtttcttttgggagatgagaatgttttggaagtagatagaggcgatggctgtgccacattgtggatgcaccaaatgcaactgaattgtactctgaaatgattaattgtacattgtgtgaatttcacctaaatttaaagaaaaaggtgaccatgagagcaaaatctgtcccagccatggaaacccccgggctcacctgggtacacttaaaccgaactctctggccccttgctggtctacctccccagcccagaccaacaaatagcaggtcctggagatatctgggcagcatccacacatcatttccatagagcacatgccaggggccctggcatgagtgggacagagatgagggagaccaccgcagagagccacaggatagatactgtgctgctcacaaaggtcctttaaaattttccagcagcggctgggcatggtggctcatgcctgtaatcccagcactttgggaggccaaggtgggtggatcactttaggtcaggagttcaagaccaacctgggcaacacggtgaaaccccgtgtctactaaaatacaaaaaattagccaggagtggcagcgtgtgcctgtagtcccagttactcgggaggctgaggcaggaaaatcgcttgaaccagggaggcggaggttgcagtgagccaaaatcacgccactgcactccagcctgggcgacagagtgagactgtctccagaacaaacacaattttccagtagcaacacttaaaaagtaaaaggaggtgaaattatgttttctctttgagacagagtcttgctctgtcgcccaggctggaatgcagtggcgcaatctcagctcactgcaacctccgcctcctgggttcaagcgattctttggcctcagccttgcaagcagctgggattacaggcatgtgccaccaagcctggctaatttttgtatttttagtagagatgtggttttgccatgttggccaggcctgtctcgaactcctgacctaaagtgatccacctgcctcggcctcccaaaatgctgggattacaggcataaaccactacgcctggcctgaagttaattttaataatatattttacttaacccagtatatatccaaaaagtatcatttcatcatgtcaattagaatttatgagtgagacataggtgggagttgaacaatgaggacacatggacacagggcggggaacatgacacaccggggccggtgggagtcgggggcagtgggagggatatcattaggagaaatacctaatgtaaatgatgagttgatgggtgcagcacaccaacatggcacatgtattcctatgtaacaaacttgcacattgtgcacatgtaccctagaacttaaagtatgataataatttaaaaaggaatttgagatattttaacattctttttctttctttctttttttttatttttttgagacggagtctttctctctcgcccaagctagaatgcagtagtgtgatcttggctcactgcaacctccgcctcccaggttcaagtgattctcctggctcagcctcccgaatagctgggactacaggcacaagccaccacacctggctaatttttgtaattttagtagaggcagggtttcaccatattggtcaggctggtgttgaactcctgacctcaggtaatccacctgccttggcctcccaaagtgctgggattaaaggcgtgagccaccacacccagccaacatcccttgtctcccctcccctcccttcctcctcccctccctcttccctccccttttcttccccctttttgagacagactcttgctctgtcgcccaggctggagtgcagtggtgcaatctcggctcactgcaacctccgccttccagtttcaagcgattcctctgccttagcctcctgagcagctgggactacaggcacgcaccaccacggctggctaattttttgtattttagtagagacggggtttcaccatgttggccaggatggtctcgatttcctgacctcgtgatctgcccacctcggcctcccaaagtgccgggattacaggagtgagccactgcgcccagccaacattatttttcttcatactgactcttccaaattctctgtggggttttgcacttggagagtatctcacagatcctgaaacccagggactcctagaaacttctctccaattctttagagagaacgctgcagctcggaggggcctcggggggatctggtgtgacttttcccatttccacagaggaaacccagcgaagcctagggaggtcctaagatgaccctggggccccagtgtaagcttgcagcggagccaggaccaaatgcctgtcccaccagccctcgcctccctgctagggcccaaggcgtctctgctcttccggatggagaaagaagctgccttttgaggctgcatctcatcttgtggtttggggttggagttgggagagaatgcctgagaaaaggtcaggtgtggtggctcacacctgtaatcccagcactttgggagcccgaggcgggcagatcacgaggtcaggagttcaagaccagtgtggccaatatggtgaaactctgtctctactaaaaatacaaaaaatagccaggcgtggtggcgcatgcctgtagtcccagctactcgggaggctgaagcagaagaatcgcttgaactcaggagactgaggttgcagtgacccaagatcatgccactgcactccagcctgggtgacaaagcaagattccgtctcaaaaaaaaaagaaaaaagaaaatgcctgagaagataggaattggtggagatgaggggacacaggtccccaggcctcctggacttacatagcctgggaaggcggagtcagaagaaggaggatggtatgcgggaagagaggcaagaaagatgccagcgagggagaacagcagggggcatgggaataatttgggatttgcttccacggattgggggggcgacaggtcttagcttcctgtggccactgtagcaaatgaccagaaatggggtggcttcaaacagcaagcatttgttcagaagaatgaaatcagggtgctgggagggccgtgttccctgagaggctctggagagatgctccctccctctcccacttctggtggctgtggcctgcctggactcgtggccttgtcacgccagcctctgcctcatggttgcacgtcagccttcttggtctcaactctccctccgcctccctcgtataaagacacttggttgggtttagggcccacccagataatccaggatgatctcctcatctcaagatccttaatctaagtacattgacagatatttttccaaatatagtggcactcacgggttctaggaattaggatgtgggcatgtcactttgagggtcaccattcaacgcactgcaaagtgacagagtgagaacatcagtccaaaagtaaggagagaccctgtgccatcagagacggtgtatcctgtggagtcattcaggcaggtgacttggaacagggagtttcagcgtagtgagcccttggtgcctggcttaggagtgaatgagattaggaggttacagaggccttcctaagaggccccaagagtcttccagacctcagcacccccatctggaggggagcagtggggccctgttgccctcacacctgtgtctctattgtctgaaagttcagtagaagggagttcaccacctctgtcacctctgtcagctcctgcctgggggccactctctcctcacccagacacaggctccccagccagatcactctggaactttccctggcagctcagagtggcaggagtcagagctgtgttgacattgcacatttttgaacctgtctacagcagcctgggttgggcacaacctggaattgccctcaggagctgccttgggcctgtgcatcagtgaggccagggcggccgcctctgtactgacctgccagtcggctggctcttcctgcttccttcctgctgctccaggcctcccaggtctagcacacgtgcattcattgtggccaggagtcctgcattgaggctcaggacacctgggtctctgtcccacctgcccctaacctgtcaccccaccttggggccttggtttctctcctttaaaaaggagttgaattatggaaggtttcttccagcttggtcctctgtacaggggattgtgccaagcatgggtggtgggcaagagttaaggaggaaggtggctggctatagtggctcacgcctgtaatcctagcactttcggaggccaaggcgggcggatcacttgaggtcaggagtttgagaccagcctggccaacatggtgaaactctactagaaatacaaaaattagccgggcgtgatgacaggcgcctgtaatcccagctgctccggaggctgagacgtgggaatcacttgaacccgggaggcagaggttgcagtgaactgagattgcaccactgcactccagcctgactttttgagactctgtttcaaaaaaaaaaaaaaaaggaaaaggaaaaggaaggtgatggcaggtaggggtttcctgagagactatgaggggagcccagggccagagagagcagggaaggcccagccagcgactgctatctatagagtgggccagtgcctgtcaggtcactgtatcctcccagcaaactcctatccttatttgttctggaatgttctcagtggtgtctggtggaattgctctcctaggtataagctcagattgggtttctgcccatcctggggtcagctgagacagggtagtgtgtgttgtagggagaagcactgagctgccctctgacatccttcggctacagggaccaaaacgagtttaggaagggtgtgatctgatacgtttattcttttttttttttaattttcatttttcttttttttcccctcttttttttagagacggggtctcgtgttgctcaggttagagttcagtggctattcacaggcatgatctcactgctaatcagcatgggagttttgacctgctccgtttccagcagaggctggttcacctctccttagtcaacctagtggtcccctgctcccaggaggccaccatgttggtgctgaacttagtgtgaacacctgattggcatagcacactacagcccagaactcctgggctcaagtgatcctcccgcctcagcctcccgagtgactggactacaggtgtgccccacgacacccagctaaccattttttaatgaaaaaaaagtgtagttttctccatttttttcattcaaaaatctttctttcagctaatacttataagcacctgctttgtgctaggcttatttgtgcagtaaattctttttttttttttttttgagacagagtcttgctctgtcgcccaggctggagtgaggaagccctaatatataatcttcagtcaactgttaatctggaagcctcaccacattgctttttggattagcagaatgccatcctggggaatcccagcagaaaggaagaaaggagcactgtcagtcttactggtcacccctggccaaggcccagtcatgacccttccttccatctccatttgatcccatcataaacctcaagaaaagtaaaaagcatcatcatcttaggaaaaagtgtggcgggggtgctcaatatgttgatcatgttatggcaagactccagattatctctcttcttcttttttttttttttttttaggcggagtctcactctgttgcccaggctggagtgcagtggcgcaatcttggcttactgcaagctccgcctcccgggttcacgccattctcctgcctcagcctcccgagtagctgggactacaggctcccgccaccatgcccagctaattttttgtattttttaatagagacggggtttcaccgtgttagccaggatggtctcgatctcttgacctcgtgatctgcccgcctcggcctcccaaagtgctgagattacaggcgtgagccaccgcgccgggccttgtgcattaaattctaaaagcaacgctcgtacggaaatgcaggcattttgtgagcagcgcctggttccctcctggctgtgcagctgtggggcctggctgtccttactctccagtgcaggtggagctcctgtggaaagtgcaaagggtcctgtttccagggctatgagtgctgtcacttgtcacttgtatgcttgcgccagggcacccagtggggcaggcatggaagcttgttgcagcagcaccctcctccctgcccctggaaactaacatgacctcagcaggacaggccatttctgggaggcagcctgtccacatggaacacgttgccatggatggtatgatggtggtcagctgcatgggtcatctggcgcaagactggcccaggcatctctgatcttagggctgacaagcgctggatgaagagtaagtggtggtctgggctctggccccagtgacatcatgcgcttgcagtggccctgaatagccacccctgcttctgcgccttctttctctgcttagaaatgagccctgccatcacgctggacccttcatccactcaatatttttcttaagtgggttcattctttgaacactgaaacatattatttaaaagggaaactggccgggcgtggtggctcatgcctgtaatcccagcacttggggaggccgaggcaggtggattgcttgagcccaggagttcaagactaacccaggcaccacaggaagaccctgtctctacaaaatatcaaaaaattagctgggaatggtggtgcatgcctgtagtcccagctactcaggaggctgaggtgggaggattgcttgagccctggaggttgaggctgcagtgagctgtgattgtgccaccatcctccagcctgggagacagagtgaaactccatctcaaaaaataaatattttatttagaaaaggaagctctgtgcagccacctaaatggaacacctgtatcatgtgcaggtaactgcaaaagtaaatacaatgaagaccaaagccaaaatattataaaattccagatagacttggctgcctccctacatctcggtgcctgggctctgcatttgttggagttaggggcgtgctggcctggagctgagccctacttcacctacacaggtgactggaagatccttgaagagggaggctctttcccagcaggtgaggggtgccattgaacttggggctttgctctatctaggaaggcctgccagccggcgtgcctctgaagaaatgctcacctgtgagcagggagcgctccctaaacgctagtggtgggattctccctctctccactgggcctcaaaacacaggctctttgttcacatggctggagactgccgagggtttggctgctgctcaggaccgcctggattcctcacagagagtggcaaggaggcatcaggatacaccaggaaattcccagaaccataaggtgggagacccaggtttgagtcctgcctttggcaccaagccagctgggggactttattattcatgcagtctacaaatatttattgagcatttcctgtgtgcctgatactgtgccagggctgggctttggcagtaaacaagatggaaatgaaattgctttggcaatttggcagtctggcaatttggcaatgaacaagatggaaatcaaaccccttgccctagtggggcttttattgaagtgacaggagatagtcagcaaacaaggaaacaagtaggaaacttccaagtagtgatatgggatcagaataagatggggtaataggatagagtgcctagggagccagcattagatggggaggtcagggaaggcagtgtctggaatatgggtgtgatgcctggagacatagcagccattttgtgaccatgaggcaagaagcatgaggacaaaaaacaacatagcaacgatgctgcagagggaagttgagaagagcctaggcctttgatgacatcattgcaccactgcacaaactctggaccttcatcctccaggcttcatgatacatgagataaatgaaatgccctgtgggttaggcttttctagcagctaaacatgtctttaactaaaacagacttaaacgacaaggaagagcaaactaggagaatatgtagaagaagaacatttcaggtagagggaacacatgtgcaaaggccctgaggcaggaatgagcttgaaagagttgatgaacataacgtcagtgcagctgaagtgtgatgaagtggagggacataggtaagcagaggcagcattggggcccttgggttttatccttcatgcagtaaataagagggcattggggacttttgagcaggagagagacacgatgtgattgaggttttagaaagctctttctggctgctgcatggagcccacagggggcaagacagcagtcaggccaaaaggtcaagtgaggagtgatggactctggcctgactcggccacagcagagatggagtctgggggccacgcatataatacaccacacacacctcaatacacccccttctgcccaggcagacccaggttccagtcctgaccctgccacttgtcagctctcaaacctacccattttctctctccttactgccccaatcatagtgcaggacgtcatcgtctctcacctagcatctgccacggccttctaatctgccttcctacctctagccttcatccctcccatcctttttccacatcccagccacagttatatattttttcttttctcttttttttttttttttccagatagaggttcactgtgtcacccaggctggtctccaactcctgggcccaagtaatcctcccacctcagcctcccaaagtgttggcattacaggcgagagccactgtgcctggcctagccacaataattcttttaaaacaataaatgtaaccatactgcttctctgcttagaatcttctagtggagcctcagcgtcaagtctagatccctggccatggcctgtgtgtttgtcagggcgttgtcagctgctggagcaaatgggctgagaaatgcttcatagttaagatgcagttcagtctggttcttcctcactgtggtgtgaagtaggtgtctcttgccagtggatagctttcctccacgcggtgattcagggacccaggctccaactgtcttcttccccttctctatccagccagtttaagggaagcagaggtgagggaggagccctcccactcttagaagcctcagtccacctctgctcacaattgactgcagggggagactatgaaatagtctgtgtatccagggaggtcagaaaatggatttttaatgattcactatgagtctcacaacagtctttctttctggcaacgagatagcagtgtgctctttcttctatcacaccctcccccagagggatgaccccagactccatctgtctctgcctgtggccctgcatctcctggaacattccatgctctccgctagtaccatcccgtgatctccaagtaaaatccagttcctgctccctctgaactgactgggggcagttaaagctctcattagggaagggggaacagggacacacagcagcccccacaccacaattgcagaatctgactggcggtgttgtgaagctccctgtcctactcgtggagggatttcccatctctgctttctgggaggcccctcctcatccagtattctccgtggcaacatctgaggtggggaccacatggtttttgcagctcttttcctgcctgtacaagggtggaggcccaaggcttgttctacaatgacaggcttgtggtgtctttggcaatacaattccctccagattttagggagttttccttccaataagttccatgtgaccacacccgaggtacttttctactgtcatcttccagcagctttatttctttgcttccttatttcccatgtctctgtctctgctgtctctgtctgtctgtgtactgacactgaccttgagaacatctcaacagttagtggggcaagaccacccacttcatttgatccttgctgcaggattaaggcctttgtagacctgagagttttaatgagcctttgctacttaaaacctttttatttttatttcctgctatttgagatccattcacagttcacttttccaacactacaaggcctcaaactcttcatatttccctttcttctatttccacactgtttatatcttgcttgagtgcgtctctgtctcacaataccttactgtacaccaaaggaatgactaacatacttttttttttttttgagatggagtctcgctctgtcttcaggctggagtgcagtggcacgatctcggctcactgcaacctccgcctcctggtttcaagtgattctcttgcctcagcctcccaagtagctgggactacaggcatatgccaccatgcccagctaatttttgtatttttattagagacagggtttcaccatgatggccaggatggtctcgatctcttgacctcgtcatctgcctgcctcggcctcccaaagtgttgggattacaggcatgagccaccgcacccagcccaacatacatttttattgcagctcactcagccaccttcttctggagctacaggcttacttctcccagtcttcccttcaagctattgtaggctacaggtctaacaaacatttcacctctgcatgacataagtctcccactttccattctgcaacatctattttcatgttccctgctgcctggccactaagccaatggtacatattttaggtttcaagttatggcggcactctattttgaggtattcattagtgcacactatctcctgtaacaaatagaccccaaaatgcagaatgattaaaacaccacagagatgtgtttctcacataacaagccagagtgagagctcattagtggcacgtggcttttctcctgaaaagctgaatgcagtgattcggaaacccgtgttctttacagttagtagattcacccttcccaaggcctagtaaccaatggtattcagcggtggaacgggaaagagagagcctggagagagcccatatccatactccttgcagaatgcagacctcaggccccatctgctgtgtgggtggcaggaggtgcagctgtgtgcccatgagtgaaaacccattgaactgctaacaatctctcccacacttcagggctgtccatcatccagccatcccacctctccagtctcatcccttgaccttccccctgccagcctcactcatcttcattcgattcctcaaggatggcatgactctctcatctctaggtctttgctcatgttggttagtccacctggagccctctctccctcactgttctagccattcacccagccagccagccatccactcatccaccaaaccatccacccacctactcatccagccatccacccagccatccattcacccattcatccagtcacccacccatccacccatccacccatccacccatctacccatccatccacccacccatctatccacccattcatccactcttccatccatctacccactcatccacccagccattcatccacccacacccatccatccacccactcactcatgcatccactcacccatccacccacacatccactcattcatccacccacccatccacccactcactcatccacccacacatccactcattcacccatccacccactcatccactcagccatccatccacccacacccatccactgattcacccactcatctgcccacccatccatccacccactcatccacccgtccatctatccatccacccactcatctatccaccaatccatccatccactcatccatctgtccacccactcatccacccacacccatccatccatccacccactcatctgcccactcacctatccttccatccatccactcatctacccatccatctatccacccaatcatctacccactcacccatccaccctttaatccatacactcactcatctacccatccatctatccacccacccatccacccagccattcacccatccacccatccatccatccacccacccaccatccacccacctatccactaattcacccacccactcatccattcattcatccatttacccatccatccatccacccacctatccacacacccatccactagttcacccacccacccacccaacaaatgttttgagcac

SEQ ID NO: 2994 - DNA, 427 bp, Homo sapiens
gtggtacgagataatgagtcctatttttctctcacataatatgcatttgctctcctaggacagtgtaatacatttatgtgaagtaaagacatgcgagactggtggcctgcaaatagcatccgttgatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactacatggactctgtcctggtatccttttcctgtgtggttgccccgtgtcctctggcc

SEQ ID NO: 2995 - DNA, 2407 bp, Homo sapiens
agagcttcaggccagaagataatccaacatgaggcctgaaagaaacttgggccagaaaatctccagggtacctgcccgccgaagtcccttccgaggactctcctgagccagtggctgagacatgcacatccatggtggaagctccaggtctgggcagccctctccctgcagtcacagactatgcccactaggaacacccacctgggacaaagcctggccacagtcagagagcaggacggctctcaccaagcccctcaggtggctccccgccgctgaccctgtgctgcgtggcacaggcttccccaacgccctgccacatttggcttcctccaagcaggctatgtgcttaggatgagatgtggctacttttagcaaacaacactagagtggcttcagcccagccacggtgacttctcgctcccataagagctcaagagggagaggtgatctccctccccagccactggggaccccagttcctgttgcctattctgccactgtcatcttcctgcaccacctcatggtcctggatggctgcacaggctctagccgtcatgcccctattccagctaggagaaagggggaagcataagtggcaaggagaagcaccctccccttcttcttttttttttaattgctctatacatttattattagctattattaatgcagaaccaggggacaaaaagctcacaaacactctacacaatttcacaagacacattgcaggggaaaaagtgactgagatggatcaacagtatgctagggtcttggtggactcattcctaggggaggtggacctctaattcctggtggagggggtctcattcctggagggggcatgcctactggtgtccctcgagcagagggaagcccaattggtgggcccgtgggtggcctcataccaggttcagaagctccaagtttaactgtggacattggatctgggggaacggcagtcgtgaccgtgggcaagagtagcaagatgctgccacacacggaccacagaatgagacgtatcctacaagatggccgagtcttcattggcaccttcaaggcttttgacaagcatatgaatatgatcccctgtgattgtgatgagttcagaaagatgaaactaaagaatgcgaagcaaccagcacgtgaagaaaagcgggtttcgggcccctccgcttctaaagaagcttgctgggggcgccacactcactgccattgctcagagcttggttacacggcccggccacaccaggccacacagagacaagaagcgcaatgtgctggcaaagactcttaccggaggagaaggggagaatggctgtctttgccaaatagcccgtcacgaacgtacccctgctgggcccccgcaagtgcaccaaccgactcgaaagtcccagagagggctggcgggcaaggacctgagtctccagccacccctgcaggaggagcccagggaccctcgcatccctgataaggaagcaggtggcgtgccctgctgtgaccccgaaacagcctgtagtctcaccctccatttccacgagactctaagtctgccgcttttgcagcaaaagcccagtgctgggggtgagcgtgtggggagtgtgggagacgggctctgacccggccaccctgggcagctgtgctcacgcagcacccccgccgttcccagctggacttcacctggcaggacagccaacaggcctcaccgtggcctccgtcccgggggtcgtgcatgggggactgggccagcccgagcagtgggacatgctgccttcctaccctgctccacctgccacaaacacaaactggaatgttctcagccacctccagacttcacaccctttgggctttggggcacagaggtcgggctgccctggggagaggagggagagaaggaggcttcgagagagcacggacatgagtcagacctgaaataaagcaaagccacaccgcctcacgttttaaagcaattgccaatgtctcagcgtgttctgaagctcagggcgacagccgggggcggataaacacctgccacagatgcccagcatgcccgtgccacccccgtgccacccctgaggtctctggactgaaggaagcagaaggccctggagggcacctcctgctgggccagggccactggggtctcccaggagcacctccagccctgccccccatgcccagattgtggggagcacagggctcgctccactgtccatggaagaggctggaaattcagcccagccatccccaccccagggacaggcctcccaggagctcacactcaacccccacaaactgacgtggacttggggtcccaggcatctttcctcccagacccgagagcagccagaaacaaaccctccagaaacctgcctttcactggtacaaataaatcgacaaagagggcaaa

SEQ ID NO: 2996 - DNA, 1117 bp, Homo sapiens
ctgggctcaagggaccctcctgttcaatcacccaaagtgctgggattacaggagtgagccacctcatctgaccttgatggattcttttaaactaaatctcatcctttaatatttcaatcacacacacacacacacaacacacacccacacacacacaccacatatacaccacacacacaccacacacacaccatacacaccatacacacacaccacacacacccacacacacaccacatatacacacacaccacatatacacacacgcacacacgcacacacatacacaccacacacacgcacacacgcacacacacatacacacacaccatacacacaccacacacacatacacaccacacaaccacacacaccatacacacacaccacacacacacaccatacacatacaccacacacaccacacacaccacacacacaccatacacacacaccacacacaccacacacaccatacacactacacacacaccacacacacaccacacagccacacacccacacacacaccacatatacaccacacacacaccatacacaccatccacacacaccacacacacccacacaccacacaccatacacacaccacatatacacacacaccacatatacacacacaccacacacaccacatatacacacacaccacacacaccacatatacacacacgcacacacacaccacacaccacacacacatacacaccatgcacacacgcacacacacaccacacacaccatacacacaccacacaccacacacaccacacacaccacatatacaccacacacaccacacaaccacacacccacaccacacacacgcaccatacacacacaccacacaccatacacacacaccacacacaccatacacacaaccacacacaccacacacacacgccataccacacacccacaccacacacacaccacacacacaccatacacacacaccacacacaccatacacacacaaccacacacacaccacacaaccacacacacaccacatacacaccacatatacaccacacacacaccacacacacacacgcgtctgcagtaagaattttatgaaccaacacttacc

SEQ ID NO: 2997 - DNA, 3046 bp, Homo sapiens
gccatggtacggaaagtgtaaatattttaccaatagcggaaagtaaaggctttcctagttgggacagcatatagggaaacgttaaggattataggcaccggagaggtaacccggcttgaggggttggttaaagggaaaggcgagacttagggcgagaccgagcggggctaattgaggcgacccggggaggggcgggaccgcggactggatttcgacttccaaattcccacgaggtataggagtctgagggttgcacaggaccttatgcattgtttgactcctccagagcctttagagaaacttctatcaggcccgcctgctaggcactagtcggggagataatgtagccagggagatgtggcggacagaaagggcagagaggctctctgaggagcggatggaggatcgtgggccgctttactgagaaggaagagaccctgcgagaaggagtagtgtcgacttggtcccgtcagccggaccccacctggacggctggggccacttgtggtcgccgggaggcatcctcgcgatatcttaagctgcgactcagaaaacaaatcctactcctggcatcatccacagaaccagctgttcacaccccacatcctcctcagctttctggagtctcagccttaggctggaagcaaggatgggcgccattcctgaggaagagaaccgctggacatgggttctctgaggatggggtaatttcctatttgtatgcctgttccctaggccaagggtgctggtgagtggagaaggacagggtgggggagactcagcagggaccaggcaagcagctgtgtgtcaagaggagggtgtgtaggtgctcgtgagctgattgaactaaccgaattagtgtcttaactgaactgacagacgcttgccagagacggcctccttagcccacaccgtctatatttgaacctcatgtctccatgtcttccacctttgtcctcagagacacgctcacctttgcctcccaccttatgacacctggctctggtctgtatttggtatctccttttgttctcaccttctgagctttcatgcagatcactggcatgtcagtgacatatctgtccatattttgattaaatgaagagttacacctactaagtgccaggtgccaatcacagctatctcggcatgtttgctcccaaaggacacagacaacactcagagggttctaaaactgagttgaggaggtgtgggtttcagcaatgagacagaattttaaaataaaccaacctctattttattaaaatgtagagtttggggactgcaggagggaagcagtgtttctcaaagttctaggagtactcagcaacccccagagggtttctttaaaagcaccagctgggaacctgcattttgaccaagttctctgtgggtttccgtccctcagaaggttgagaatcactggctgagggatgcagtggagactggggctgtcttgatccttctggcttatttgggttccagggagtgactcgcttgactttttttgaacaagctaagcggattcatttgtaggttcctggcattccttcctttggttcgctgaggcgctgcaagagttagtagagttacaggtgggggagtaactgagacaaggcccaggccatgtgagtgccatcccacacctgagcacttcccagagccaagtccagagctgagcccagactcagcctggacacagaactgctcaacacaacgtcctcccaagtcccaggggctctgcttctcttcctgcgaatctgccttttgcctgacctcacaaaagacttcctcttccctcccctcattctttgctccttcccacccatccatgtttcctcagccctagccccatctagtctctttcccagaggccgcattgtaagccctcctgtcgtctccagcatgttagatgcctgtgtgagtctgttcatgtgcatctcggtgtacacgtgtaccagcatggttttttgtttcgttttgttttgttttttaagatggagtctcgctgtgtccccaggctggagtgcagtggcgcaatcttggctcactgcaagctctgcctcctgcgttcacaccactctcctgcctcagcctcctgagtagctgggactacaggcgcccgccaccatgcccggctaattttttgtatttttagtagagatggggtttcaccatgttagccaggatggtctcaatctcctgacctcgtgatctgcccacctcggcctctcaaagtgctgggattacaggcgtgagccactatgcccggcctgtaccagcgtgtttttagctgtgcaggaacagaccctgagcaaggggagggcatagcactcagagtcaaggctaagattgtccagctacagaaagcatttgggatctgcagacacacacagctctcccacctgtcagacagagaacccaggggacatgcttgtaagacaaagctgaaaaaaatctcagagaaggggggctgctgggttttgagggatgcaatcttctagcatctcaaaccatggagggaagatgagcagccctccctcacatgccgagaggacgccccagtgggctcagagatgaacaggccgtcagtgctaggcagaccaggagaatgggacatgaggtcaggcctagttatgaacccagatggggctgtgcgccagacagcatggccaggggagccggtgaggtcggcaggaccacaaagaggtgagtgagccagcaccacgcagcaggtggatgtgaggatccatggtgggccaggagcaggtggcccgagaaaaggtgcacttcagggagtggagcaatgtccaggagggcacgcccaaaggaggcagcacggccaccaccctgaggtagcagcctgggcagggacagagaacttttgttagagaccagcagatcctcatgccaaaatagcggaccccaagacaatgcagggagcccccacactgagacatcaggagcagcctgacacgcagggaggtggtggcagcctgggatgtgggtaaagaagacagcacagcaggctctgcctctgcacctg

SEQ ID NO: 2998 - DNA, 11556 bp, Homo sapiens
gttcctggctccctttcgcccgcaggtcgcccaagtccagccccacgacgcagtgccgactccccgccgtgcccccagcccggcccgggttgcggagccctgctcctgggcctctgcctgctgcgtccaccctgggggaagcgcccgtcgtaccctccacaccgggggcttcccctgaccccttaggccctccccctgcaggtgccctcgcgcccctcccggggtccccagtggattcggggccccggcctccctggaatgagagatgcacagactgggccgtgatctcccaccgtgtcctcacagccccaagacagaatgccatgcggattggcaggagacctcactgtggggttcttggagccaaccctccaggccatgtagggtccagccctacgggacttagtgggtgttctccccgtgtgcggagacgagagattgtaataaataaagacacaagacaaagagataaagggaaaacagctgggcccaggggaccactaccatcaagacgcggagaccggtagtggccccaaacagctgcgcccgctgatatttattgcatgcaagacaagggggcagggtaaggagggtgaatcttctaagtgattgacaaggtgaagcaagtcacgtgatcacagaacagggggcccttccctcttaggtagccgaagcagggagagagaaggcagcatacgtcagcgttttcttctatgcacttataagaaagatcaaagactttaagactttcactattccttctaccactgtctactacaaacttcaaagaggaaccaggagtacaggaggaacatgaaagtggacaaggagcgtgaccattgaagcacagcaccacagggaggggtttaggcctccggatgactgcgggcaggcctggatactatccagcctcccacaagaagctggtggagcagagtgttccctgactcctccaaggaaagggagactccctttcgcggtctgctaagtaacgggtgccttcccagacactggcgttaccacttgaccaaggagccctcaagcggaccttatgcgggcatgacagggctcacctcttgccttctacatcacttctcacaatgtcccttcagcacctgaccctatacccgcaggttattcctaggttatattagtaattaaaagctaatgattaataatgtttatagtaatgattggtaattgtctatgatcatctctatatctaatttgtattatgactattcttattctaattattttctttattatattgaaacagtttgtgccttcagtctcttgccccagcacctgagtaatcctccacccacagggccacaggccccatgagatctctgaggccacagagtgtgtccacacacgtgacctccagggtgattcgggccagagcacaggaatggcccaggcagaggtggcctgggcgtgggcagagatggctcgggctgggcctgaggcatccaggggctcagcatcgcatctcctcaggggggccatctgagactgctgggccagtgaagaggcttctcccgggtacccacctgtcctgtccaagagagaacagccagccccacagccccaaatgtctctgtcctccaagaggccagatgtgaatcacaggaatttacagcccagcctggcatgggatttatgagtctgcctccagccagggctggtggggagtggccactgtcagccccccattgccgctgatggatgaggctgtttcctgtaagacaaactccctctgtggcaggcagtggagggagacacatccaggccctagggccaaccccatacctgtcccagagccggatccctcgtgccctcacagtccatgcctccccttgatccccagccctacacagtgacacgcaagcaggaggtgcacccaaggggcccagctcttagccagagctctgcctcccacactgccatctgcaccccctccccatgacctttaaaacctttccatcccagggcccaagccttgggaccagcccaagatgggatataccacactcaaagccagaatggatctctgaggtagcccagaacacacacacgcacgcacgcacgcatatatacacacacatgcatgcatgcacatacacagtacacagatgagaaaccagggtccagagaggaatgggccttgcccaaagtcacccagcagcacagtggtgaagctgagaccccagcccacaagccccctggactggtcatttcagtgtccggtcacagtggactgtcatatggccacaggggtagttttcacctccaaatgcaggtgcctctccagagaacagacagacctgggtttgagtccatgccccaccactctgtgtgtaaaggtcataaactctctgtgcccgttccctcacctgaaaaatggggatcaaaataaccccaacttaccaaggttcttacgaggttcaagtgagaggatgcaggtagagccgcaggacagagtgggcccctggcacatgctccctgagtggtaacaatggttctccaccatctctcgtgtctcaaggggccccgctgcctgatttgctgcgggcaggaggacagtcatggttgggtggggcaggaggagcaaggagagtttgagtgtgggactgcagggcaggagtgaggccacttcctactggaggagaccctggaagtctccctggaggtggtggcatcaagcagaggatgtagaactctgtttctcttgctctgaagctgactgggggcttcttgattgccacagggatggagggaagcaccctaccctgaaagcctagcccaagcttctgccctggatgacctgaggaggagtccctcctttctctgggcatcagcaaaatggggccgggaggactagacaacactccctagaggcacctttctgctctggccttgttgcaagctgaagaaggtcctccagacccaccctctgcagtacccaattattgccactgggcagcagcagggagtaaatctgcggtccggcctcctttccctgccggccagtccctctcccagcatccggtggtctttgctcctccgtccccccgccaactcgccagagagccagagctgagcgtccttcacatccagacatctgatgctcccctcagccctgcagagagccagcatgctggctgcttttcagatggggaaactgatggccaagaggtgaggacttgctcaaggtcacgcaagagccaagtgtgcccacagcggaggtggtgtgaaaggagactgcggtcacacggacctggctgggatcctggtctcctcacctccagctgtgtgtcatcgggcaggtcacccaccctctctgagcctcaattgatataagtgctgaacacatgaagccaccgctttgtttccaatagagtttatgccccaagagtgcaaagacatgtctgtcactcacctcagcacccccagagcctggcgcagggtgggattcggagaatagcgcctgcctcccagggcctgcctggcactcagcagacactgtgtctcctcaaaccgcaaccccccaacctggccccagccctggatcagcctcacctcgcctcattcccctcccatcagtctttcctgcaggacacccacccacccggccttgagggggggctcctgctcacctccccaccccatccctctcggccccctttctctgtcctggcctctccctcatgtcgctctctcctgccgagcccccacttggctctacgctgtttacaagagaatgatgacagtttttatttctctgttttatctcccttcctcccctgaagggaaacgtgcttccaatcttccaggaaaaattgaaggctccggatgagaaaaagcaaacaaaggacagtgggaccatgggcgtccccacccccaccacccgcaggccccacactcaaaccagcgcccgtgcccacgcccatgcagccgtcctccgccaggccccaagaacggctgttactttgggggtaattgaaaatgtcgatcattattctagagcataagtaggtcacagggacacagggagcgagagagagagagagagagagagaggaaacctggtcatgggagaggatctgggggagagaaaggccagctgggaggatgtgggcgtggagaggaagagggagcagaaggaacgggagggcgggcaactctccaccagtgagcagggccacggactcagggggatgtgtcctcccaccagccccccaccacaccccgaaaggagccgggtggcaggagctcctgtttagtcctcccgtacctgagcagccccgagagtgggtgtctgtgagtgctgggagcaggagtggggacctggcttgtcttcatgggggtgccctctcacgaccacgtgcacagcgcccagaggccaggtcccaggctggcgggctgagagcagccagcggtcccctctcctgggggaatgcagggactctcctgacctccctcccatcacccatcccacctctctctgcatgtcgggacatctcatggtttgtggatttactactccagggcagtgaggggcgccagtgtgtgtgtgtagagtaaggtgtgggtctgtgcatttgtgtgtgtgtcttgccccacgtgtgtgcggtaagggacgtgtgtgtgcacagcccctacctgtgtgcctccagatggtgtgtccatgtgtccctgcaggcagggcccctcttctgctcctggcccagggccaccatccccccaggtcctgggaacctgagtggtgattggccttggggttccctccagcaacagtggaacaacagaccagcccccaccccagccagtgtccaagaggctcgtgggactgtgatgtcaccaccaagccctggctgaggtaacccaacatggagccaggcctgtcttgccccctagagagaagagaggaacctcaggtgggtctcctgccaggcaccgagcctcatccaccctccaacatctgctcgtggtgggagagggtgaattcccaccctctcacggacacagcctcagacctcctggaggccagggctccaggtgaagaccaagtcttcgtacccccggacccagccagagcctggcacagggcaggagcttagcaaatgtttgttgaatgaatgaatgcacggatgggggctttgtgtgtgatcaagtgccaggctccggagtctagtgacctgaagatacagattcaagtcctacaaggatcaaaccagggcttcctgcaaggtcaagcgagaaccccctgagttgttcagaaggggccacgcagcagtcggccagacctgggaggccgtgcctgaccttctgcaagtcacctctctgggggcactaccacaggaaaggcaatgtcaagtgatgggactgcttcatccaaaggtcaatcccaagctaaatgaccctgtcattttgcaggccgaggcacaagggaggccccattcatcttccctggagtcggcatccctttgattgcggggccacctctcatctgaacatcttcacccccccccaatattccttctgaaccctccatcctccttctccccttctcttgggaccataaacctaccccaagagtgagtcctagctccagggccagctcccaatcctgcctctgtctggtggcagctggggccaggctgaaggtctgtcctagactgagccataaaggcaaaaataatacttactcctaatagaagtaaagcacttcaccctagatgagccctggtcctggtcacacacagaacctagacctttatttagagatggaccattaatttgtcatgtgggctaggcatggtggctcaaacctgtaatcccactttgggaggcccaagcaggaggatcacttgaggccatgagttcgagaccagcctaggcaacataacaagaccacgtctctacaaaaagatttaaaaattaaccaggtttggtggcatgtgcctgtagtcccagctactgcagtgaaccaagattgtgccactgcactccagcctgggcaacggagcaagatcctgtcacaaaaaaaaattatcacgtggccgaagttatttccaggctccgagcgccagcttcctcatctttccaacagagggccttcacctgggctaagtgttaaatcagaaagcccctattcagaggttggcctgcagttccctgacctggtaacactggggagcattggctgctgtcacctgccagctcccacccccacccaacacttacacaccaagcatcactaatttttgcagctgccatgataaatggcactgttggcaaaatgacatctttctaatctgccacaagacagacgggtccccgagctcccacagcctcccaagagccagcccaggccatccttgttgagaggatgggcagatgcaaagcccagggcctgggggcgggtgggatggagaggagacctcagggcccagaatcaaggacatccctagtggggtttaccacaggctcttttctaaatatttagttgtatgtgtgcttttaaaaatattccaaagaatattatatgctctgttcctttctgaccaaagttagggcttcaattcaattttcttttcttttctttcttttttttagacagggtcttgctgtatcgcccaagctggagtgcagtggcacaatcacagctcactgcagccttgacctcctgggctcaagcgatccccccacctcagccacctgagtagctgggtctataggcgccagctaccatgcctggctaatctttgtattttattttgtagacacggggtctcgccatgttgtccaggctggtcttgaactcttgacctcaaatgatctgcttgccttgctctcccaaaatgctgggatttcaggcttgggccactgcacccagcctcaattttcactttaaattaaaacctggatattgttcaggtttataaggatgaaccattagacactggttctgaggcggtgctctcttcctgtcaccctctgctctgcggaacagtctgcctctgcctgagccattaggtctgggggctttctcacccccctcctccctcccactccctccatggctcccaccctcccacccagcctctttgctgacctcagccgcatcccctccatgcctcacactggcctgggactgccaggttcctgtgtccaggagtagaggtgaattggggctctggatgccaagaacagaggaaggacaaatgccagccccagagaccctcacctcctcaagaccaacaggagctggcgcctgtccgcccagcagcagcaaagccagagcgggtgccagccagggtgggtaggcacaggcctgggcttgaagattgagacagcgctgccccctcctggctaattcacggctgctcctctgacaggcactgccaggctaagctgttgaggttggggacatagtgagtgaccccaaaaacagcatgtgacaagctgaccttccctgcagtctgcccagctgggagctgcctcccactctgcccatcctgtccgagcttctcccaaagcatcttccggccctcacaccttcagggcaaagcccgaggcccctcccggctgcccacaatgtggccccgggtagcagcctcgccccctgcaccccaggcccctgctgctctgtgcctccccagttccctgtcactgcacctgcatgctttgctctcaccttgacctccaccttcgccctccccagcagtctcctcttgtcctcttaggtccctccccgaggaaactcctctcccaactcccaaccagagggactccgctcctctgcctgcaccccgacctgccctgcccctgtctcggggactgcacactgtcagcacagtcccacagttctggaacttgggagaacctagacctcttccaagcctaccctgtgcactgtctaaagggcaatcctgagcccagagaggggcaggagctgcacaaggccacacagcctgtaatggcagttaggactggaatgcagctctcccgagtctctgcctggggctccttggaggacagacacatggcttccccacctggtgaaccagaatggaactcttcaaggacagggactgtatcattccttccagtgtccccagcccctcacccagagcaggacccacaggaagcaactgtgaacagaaaaggaaaaaacaaatacatgaaaatgtatctctaatgtcttctgtgtgccggacactcagcaggtaccggctctgctactagaaatcttggtcaaattgctcaatttggtgtagaaaaataatttctggggatgaggggcagtgagtgccccaagaggggcctcagtcacgaatgtcgatgaccagtgggcacaggtggagtgagtgcttgatgcccatggtgaaagcagggatgtggggcttgtgcacagtgacctgctggacctcgtgggagccggggccaggccgtggcgtgaggtccagagggtaggcgaagcgcttggccatgctgtaagtagggctgcggttctgatagatggatggctcaggtcgggcgtacgtggtaggtccagggcctcctgccacatcctccttgtagaaccagttcttgtccctggaggccagactgtagcagggagcagctcggctgacaggggtgttgggccccagcaagagtggcatctggtactggttgggagccgggttgaggtccatcactctgtatgggcgccggtagccaaacgtgtactggggagccctgcgttcccccggtgggtggatcttctcaaagtagtactggcaggatgcgagggtggggttcaggcctgaaagggagtggcgggaagggagggctctcagagcagggaacagacctcattctctgctagccaactgatggtcctggttatccactgtgacctcaggctgaccacctcagcagcagggcagggacatccaaatggtcacttaggccggacgcggtggctcacacctgcaatcccagcactttgggaggctaaggcaggcagatcacaagatcaggagttcgagaccagcctgaccaacatggtgaaaccccatctctactaaaaatacaaaaattagctgggcgtggtggcgtgcacctgtaatcccagctattcagaaggctgaggcaggagaatcactccaacccaggaggtggaggttgcagtgagccgagatcacgccactgcactccagcctgggcaacagagcgagactcgatctaaataaataaataataaataaataagatggtcacttaggccatcctgacatcaggatggcaacacagtggtcatcatgtaaaaaaccataatgtcatcataacattccccttggattacccccagttgctacagtgtcagcatccagacattgtccctctgacagcgacacagaaacattctgagatcactacagtctgtgagctcgttcgcatgacaatattgcatccacaacaggagctccatgtcatcataacgtcacctggtgacatgctgcatgtcataacattgacttcaagacatggtgatgtcagcattgcaatgtcggtgtcttgcagggagataccggcatccagacatttccaaggaggaagtcttgaccctttgcccctgcccaggtcctaagggtgcaccccaccccccaacctcccaacccccaacatctgtccataaccccatcttacgcaggttggagatgcgctcctccatggggacctgcgggcagctggacattccaaaccgagttattttgggatccaagagatagcaaggcccagggctgctgtggcacaccatccctgcagggcaaccaaggagagggcctggtcagccccaaaggctgccccactgagcacctggcctgcctccaggcaagatctccctcccacttcagattctgtggctcctgggtgtttggggacccttgatttcctcatctgtaaaatgggacttttaacacatgacctggtattttcaagaacttgctcagaggaacagtaaaataacagctgcccagcagcttgggcagccacccacccaatcaggggttggggccaacggggagtaatagccctgtggctgctgtgggcattcagcaaaggcccagccaggccaggggcttaccttgctgaggtgggtattctccccagggaaaggcctgacaggcaccccagatctcagacccccgggtgcacgccaccacaccctgcccagcagcataggtcatctgtggcctctgcttctgcccttccagtgggttctaggccacctgaggagctctgggggccaccacttccccactggcctcctagctgttcctgcctggccacaatggcaagtgaccctagcagagcatggcgaccggagctgaagggccccagccaaaggccagaaaaaggagactctgctgtgccagctggacagggccaggatcccctataggctcccttgggagaggcggctaggggatgcccatggagttgccccaccctcaatccccgctggcttcctctggacccagggggccccttgagtgtctcagattcccagtggctacagagaatggctccatgtctctcccctcaacctccaacaacagctccaaccccagccggatgactggggtggcaacgctcacgcttctctgagtgccggctatgcagggtataagctggtgccttgaacatggagatgtcatgatctatgtagcccgtgcaggatggccggaggtacttggcgggccccggacctgtaaggatggacaggacagccctcagcctgggcccaccaggtcagaggcaggggaagccccagtacagcgcaccatgggaacattgggggtatttgttcttgctgctatcgcactgccacgagcccagcatccatccagctgcttcgtttgggggaaggcagtatttccagataaaatgcagtttcccttggacagacaatgcataataagaagctaatagttacagttaattgagaacttattctgctccaggttctccactaggcatccgacgtggattatttccgttaagcctctgaacaatgctgtaaggtaaatgctcttgtttttcccattttacagaatattgaggcttagaaatatctacccacatatcacaaactagtagtgtgaagattctaagaccatcatccagtagaacccaaaccttcaatccctgcactaaactactcccacttagagcactagtcagtcattaccaacatagtaagaattagcgtctgctgtcccttgagagtaaaattgaagggaagtgaggaaagctaaagctaggacaaaggctcctagtctttttccaaagcgggcctcactgcaagtcccatgctcccctcctcccccacccacttggacaatcccagcagccaacactgcctgtgagggtcagcttggaggctcaggtcttctgtaaggcttcaaggaagttggaaggggctttgcaggaggcaggctggaaggagtcctggagagaggggagggggcccaagcccagggtggggatggctct

SEQ ID NO: 2999 - DNA, 1349 bp, Homo sapiens
ttgttctactcggttttattcttattgctcaggcttgagtgcactggcctcttctcagctcaacctccgcctcttgggttcgggtaatgatggttccacgtcagcggccctccgcctcttgggtttgcgtgacggttccacgtcaccgaccctccgcctcttgggttcgggtgatgatggttccacgtcagcggccctccgcctcttgggtttgcgtgacggttccacatcaccgaccctccgcctcttgggttcgggtgatgatggttccacgtcagcggccctccgcctcttgggtttgcgtgacggttccacgtcaccgaccctccgcctcttgggttcgggaggtggttccatctcagccgccctctgcctcttgggtttgcgtggtttttctgcctcagcctcctgagtagctaagggaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcagcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaaggggatggagcagacactcggcacgtgtcttgagattatcatccgctgagggtggagctgagggtagagctgagggtggaaggggagtgagcagacactcgggaggtgtcttgagtttatcatccgctgagggtggaaggggagtgaggagacactcaggaggtgtcttgagattatcatccgctgagggtggaaggggagtgagcacacactcgggaggtgtcttgagattatcatccgctgagggtggaaggggagtgagcacacactcgggaggtgtcttgagattatcatccgctgagggtggaaggggagtgagcagacactcgggaggtgtcttgaggctcagggagttatcagttatagaatgttgttgagttggaggaggtggctggtggcccatcctgttttttaaagtttcagctgtgaggtagggccagtagggcaatcctgaagaatgacgatgctccgctgccgccattctgacctgtagggccaaaggagggaatgttt

SEQ ID NO: 3000 - DNA, 2319 bp, Homo sapiens
ggtattttctccatggccataaaccagaagcaacaatgcagatttctaaagaaactgtatcaagctatccaagagatttttttttttttcattctgaaggttcaagatacaggcacaagaagcatcagggatgggaactgggtgtgtggggatggacatcattaacatgacaaacacagaaacagtttggttctttttccctcctaagcctttgtctgtgaaatggggttatggcaagaagtgtccagagtaactggtaaattcaagaagattaagaagacttcgtgtgtggggggtgtgtgtgtgtggctaaaaaggatatcagacctagagtcttggtcttgggcagaagaggaagagaagcaatcgcgccttttccagcagacagggatcaaggttgggggggaggggaaggcaggcaggcctcccagaggaaagaagaggtgaatacgagtgtgttcacaaaactactccccattcattacattaaaaaaaaatctttttgcagctctctggatttccattttctaccaccttactgcaaagttggggctcagaatgttcgaaagaggtgctgaccaggcagctgagattggggaaaagggatggtggtgaactgtggtcaggataagaggaaagctggcaggttggggaagaaggattgcacaggggaggcaaagactcactccatgccatgcatgctccccgccccccccaaccccgtcccccctcccccaggtaagggtgggcagacctggcagaaggctggttcaaggcatgggggtgtgcgtgggggggctccttttgggggtggggggcggacgggattagttccaggatgggagaagctcggttctggctgggggagatgcccttagctgcaaaagctccgggcggccaggcagagtgctggcctcggtgggctcacagggcggagaagggggtcgggctgcaggaggaggcgcctggacctccggagcagagtcgggtagcggtccgtgccgggacgggggacccgtcggcgccgggacaatacaagcgcctcggaccgagtccccgaacctgccctagccaaaatggcggccgagaaagagcggaagtgacggtctcactctgttgtccaggcatgatcacagctcactgcagccttgacctcccagactcaagtgaacctcccacctcagcctcccaagtagctgggaccacaggtgagtgccaccacacccagctttttttatatttttgtagagacaggatctccctatgttccctaggctggtctcaaatgcctgtgctcaagccatcctcttgccttggcctcccaaagtgctgggattatagacatgggccattgtgctgggcctcaatttcttcagcagccaagttaagccaggaaaatgtagtaattaggaatactgttcaataaataatttagagacacctcttacttttatttccagaagaaagtcaacttaaacttacttgctcaaagcatgcccttactcaaattttaaaagatactacatgaccataacctatgctacagttagaaattaactgatctcttctgaaatacctactttagagaaagtgggtaaacataatatttgccctggctttattggatagcttagcccaaattttaactggcagaacacttttctaaatggagagaagagcttaaggcagagatttttcaaattagtagggatgtgagctttgctgagggtctttaaataatatgaaaacaagtcttttgagaaaaaaattgttatataattcagtaagatgtttaaaaattactgtagcagctaagtttctgcctcagtgtcattaatatttttccttactgatagaggttattgctcaaaagagaaaaaaacggctatgtaatcaactgctgtcaaattgtttcccaattcacaatatgcattttaaatagacctgctttgatagatgaaatgtttcatcaattcaacagctgaaaagaaccgaactgtaaatgcctgctctaaatgtattttctagtttaagaaatttgagatacatttttaaggaaagggcagaggtgtgtatttctttttcaattcatacagacacagccataaacatttcatcagttaacattatcttacttctgagatcaattaggtataaagatctatgattccagtttttaaaaagactatttcaaattattccccatgtaaaaaattctacattcacatactctaatgaaggcagcaatactttatgcaaaaaaaaatatacatttatttataggtctcaatacagcaaaatgaaaacgaaaattgagaa

SEQ ID NO: 3001 - DNA, 1044 bp, Homo sapiens
attaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaataccaccaatcaatactcatcattaataatcataatggctatagcaataaaactaggaatagccccctttcacttctgagtcccagaggttacccaaggcacccctctgacatccggcctgctccttctcacatgacaaaaactagcccccatctcaatcatataccaaatttctccctcattaaacgtaagccttctcctcactctttcaatcttatccatcatggcaggcagttgaggtggattaaaccaaacccaactacgcaaaatcttagcatactcctcaattacccacataggatgaataacagcagttctaccgtacaaccctaacataaccattcttaatttaactatttatattatcctaactactaccgcattcctactactcaacttaaactccagcaccacaaccctactactatctcgcacctgaaacaagctaacatgactaacacccttaattccatccaccctcctctccctaggaggcctgcccccgctaaccggctttttgcccaaatgggccattatcgaagaattcacaaaaaacaatagcctcatcatccccaccatcatagccatcatcaccctccttaacctctacttctacctgcgcctaatctactccacctcaatcacactactccctatatctaacaacgtaaaaataaaatgacagtttgaacacacaaaacccaccccattcctccccacactcatcgcccttaccacactgctcctacctatctccccttttatgctaataatcttatag

SEQ ID NO: 3002 - DNA, 1809 bp, Homo sapiens
agaaagtcgggctctggagtttgagccccagtcctgccaccaatttgcagcatgaccttgggcacgtgtactccagtctccttgctggtgataatgagtccctgtcccacagggttgtcatgagtacacactgggagcatgtgggtaaagtgcctggcacacagcaggtgctcaataaatggcagccgtgatgcgggtaaatgtggggaaggcggagggaagccagaccaccgggggccgagcttcatacttggtatgacccttttgagcagccaaactctggccgggaaagtgaaaccaatttcctgactgtgaggggagccaggcctcttaattcagtgcgccgggtgtgaggatgtgggccagaggcccgggcagtgcagagagcccaggaaggcagggagccaggaggccccagggcacaggaatggaccctgtgtgaggaggtcagaacaaaaggggctgcctgcttgaggaccgtgtctctaggagattttggaaggagggctggggcacagtggagggcacgggcagactccacaaagaccgtctggaaaggcacggtcaaggtgtggcccaggccagacccaagacagctgtagggggcaggccggcagcctctgtgccttcccttggagaagccagcatggcctccttggcccccaggaacctggtcattcctgtgcccctgcccacccatggctcaggcactctggtacttcactgagccagcaaaccccatcccagctcaaacaagcccccggccccaagccaggcccaagtgccttcgcagcctgcagactccaagcccgttcaggccctttccagctgttgacattgctgaggggccttgcgggagctgatgtcatttacataaatagtgtcactgccgtaaacccagccagtgcccctccccctccccctggaaaacgtcataaaaagggctggttccaagtttccaaaaggaaactctctgggaggttttgcgtttgcgatgcctcctccaacaggcagctccagcatgaggcggtgaccacccggcttgggcttctcaggggtgtccctgggcccactgccttccggatgggccagccccacgctgggcaggggcaggggcaggggcagagacaggcagcagcaggggcttcctctcctctctccacaggcgatgtcccgcgagcggatccacaggctctggtcaccgcggcggatgcggctcgtgccctgcttatacacggagatgatgttcaccgtgaacttccaccagtcccccgccttgtccgccttcaggatgtggatctggacggctgcaaggaagcacaggcagacgggtgggctcccagctgctgtggctaggtccgccctgcctgagcctggggagaagggaaaggagacccagccccaggaagtgactgcacagagtggcccatacaggagcgcgtgggtggtggcaagctgatcgtagacccccacctgctaacaacagggccaagaagccttgcctcccacgctgtgagggtgccacccagcactgccgtcgggacaagccatctcctggccttgtcaaggcccactttgtccaggaagcctacagtattttccctagtagaaggacttccccaaatggagcatgcatcagaatcccctggccggcttgtgaaaatacactgctgggccccgccccagagcttcagattgaacagatctgggctgggccatggagtagacttgagccctcctgagacaggagcagcagcttgaagaaaccaacacacaggcaagctctgtggcttcagcagccacaaggac

SEQ ID NO: 3003 - DNA, 2211 bp, Homo sapiens
agagaaagggcctaggacagaacccaaggagcacccacgtttggggagcaggagggaaatgaggctcctgaggacaggtaggttctgatgttcatacgttttttcagtccaccttgctaatcccagctatagcaagcatttggggctggctttgccagactcgccaaccctcctgtttccacagccccagtctgctctcagcttagggctgtagccagccctcttccctgccatggtttatatgatgtccaccaagccaccgtgcacaggaagggtctcagcaaaatcactcttggataagtgtcaggagcagaagtggcttgaattagaaacggcttccacagggaggagctggggcccttgggcaagtcatgtcgattctctgggcctcagtttttctttctgtatgtggggacgatggtgttcatcccaccgggctgtgggaaaattagatgtgatcacatgtgtgagccagagagacttcagtggtgtctaacaacaaatgccgcaccttggttctcaggagaaatgtgaagcgtcccctctttatgcctgtttgaaacctgattctcttgccaggtgtccatccctcaggggacagtgggtgaccccaagcccataacaacagtgactgctcctgaagggaatcttggacatgcacacacacgtgcacacatgtacagtatgcctggggtccacccttgccagttcagtcttgattagatccagttgaatgctggccagtgaccttctgagtgaagcagaagctgccggcccagcccctcgggggagccagtgagatgtgatgccgcgtctttcttcataaacagaggagcggagcatgcccactgcaggatcagtgtccctgcaggttctctctcattctctacatcagggcaccccgcaccacacagatgcatggggccagaaccaaagcgcaagtgagcgatccctgcggggatctcccagaacaaactagaagcaaaatctgcctcttcctgaggacaacatgcatttttccaggcctttcaaagcaaggcaggtcaattgagttataattggctctctaattagaactgccacaagctgttaaattctttacctgctgcctgatatattacacaaaggtgacaaatctgcttctgcctttgcaatgatcaaagaaagccagctagaatctcaccttccttgccgccagcagcccccaccagctacccttactgccactcagacgcccacacacccaccagcaagtatgacatggacacagcccagtttacaaggaaattggctgtagggaaatcaagctcagaaggctgtgttgctgagccaccgtttggagcctgaatgggaggagacagagccttctcatttttctagatgtgggaagtgttctgaggatgtttcaatgatgctttgagcctctcctcgttccattgttctgtgatagaagaaaatgtatctcctttccctttctgaatcctcaacactgaaaaggatagtatttttgtgttgctcccctcaaccatcaagacgacagtgtgctttggatgatgggatcagtgtgttttgtgacatccagtgtcacctgtgtcttctgtgttgtctctgctctagtgccagtgcctcttgcaggtcctgctggttcacacttgcatgcagtgcagctgatgccagtatgtcccttcctctcacctctccctggctccacccacaatgacatcacctcggtagcttggaatcggccatggtggaagtgtttataccacggaaattggcaggcgccacaaatcaaggcctttttctctttcagagaggcagtttgctgacaccactggactcagatggtttgaactgtgatgggggaaaggcaggcacaggagacgggagcagagtcaggagagcaccggacattggcagagaagaacggtgccaaatggccctaacccggggctcctggggcacatggcgcttgtggcacagatctgatggaggttctctgccattccagagggacaggggccaagggggaaggaacgagccctggaattgcccaggatggtggcaggaagggtagcacggtgggggagcgcgcgttgtggagcaaaagagccccttgtttgaattctagctctgccatacactggcagtttgtaggaccttggccatgtggccgtgtgatttaacctctgtaatacagaagtgaattcc

SEQ ID NO: 3004 - DNA, 24704 bp, Homo sapiens
agcagtttccaggctcccctcggcggggctgaatgatcaaaactggtgcgcggtcgggtgggatgggcaggcgagaaggccgttttcctagcactgacctacgggtccctccctgaaacgcggtgtcagatggttactgattaatattttggagaggccgcggcggcaggcagcgggtgagtctctaatcttctaaaaggggttcctatagaaacgcggagcggggcgcgccccccgctcggcccaggcccgggctgcggcgcttcgcacagcgcgcccctccccaaagcccctctttgcgtgggcgctcccctctccttccccccccgccaacaaaaaatcagagcagaaaaaaggattagatcggctgagcgcgaactgaatccctctcgattctgacatttcagcctattagcatttctccacggagccttctgaaacctattaaagtgtaatattaaaaacctcttggctgggggcctctctcgccttccatccgccgcgccccctccagggagggcgagaccgggaaaaaaataaaatctgttgagctcagaggaagtagccgccaagcccaaaaagtgcttggctggccacggcggccgtagggggaagggagccccaatcccccagactttgtacttttattttgcgctttcagcaaaatcctttctgggttgagtagccgtgagctgcccgcggccgacctacctgaccgggggcgcagggagtgcggaccacgccagcaggactgtcctgggggcccccgcaccctctctctgcagccccccgagcccggctaggcattacgtaccctggaaaggaagcttggaggggcagaaatccttccaatgctgcctcgaagagcaactgcagtgataagattttaattaaaacaagagaagcccgctctttcgccccgcgctgcggactcagcgttttcgcattgcccgttctgttttttttaaatcaatttttaaggcaactttttgggaggggggaaaaatgagcgagttagtgcccattcgttctattttcttttctccacttttagaaaaaagtggggggaggcttcgagaacgaacgggggggtgtctaatttaattccaggataaatttgaggaaaaaagttcagcctcttgagggcagtttcaagttgcccttcctggagcttcctgcgttagtttctaggctgccctcttttggaagctgtagctccgctggggaggagggaggagtgagaaggaaagaaaggaacaaaaatagccggagccgaggggaacaagccacggtgtccgcgtttggagctgggcgtgcgggtctcagtggcggcctcggcattcggggcggcgggaggcgcccggtgcatccccgggacggccaggagcaaagacggagaggagaggggggttagagaaaggaggtattgtgtctgtgtgccttaggggaggaggggactgcaggaatcgaataaacgcagtcgagctgcgcggggctgctggaagcccaggcgggggaagggggccgtgtgtgggggcgcagagcgcccttgagccttacgcagaggtcttgtgtgttcctagttaagccctcccacgcccgaggccccatcgcttcctctccaccctctttacccaccaatattccaagcccagatcctaattccccaccgcattaccccgccctggatttggggaatgtttttctttattttaatatagctcaaggaaaaaatacgtatatcttgagagatttggggtggggaaaacaaaagccttgcggagtagaaaaaacaaaggcttatttttataaatgtttaatgttttcaccccctggatgctccgagacgccgtaattgtgacggcggggtacgtgtgccataaatcatttagttgctaataaaaattctgcctgtttgccctggatttgccaatggcgtttgcatttttcaagtgtgcgcctcggcggtgtgacgaacccagccggtatttcattagggccgcggttcggggcagaggaggtcccctccccgcctgggctttgtgcgcccagcccccttgcaccggcccttccatacctgcccccggcacccactccatatttgcgcggccctgcagccaccggagtccggccggggagcagggcctggggacgcggtggtggtggtggctcccagttcctggccaccaggcggggcggccaggacgcatcctgcccacgcggttttccagggctgccgcgtgcttgggggcgcgggcgggccacgcggagaggccacctgcccgggccaatctgtacgctccgtgatcttcgcccgctccccggccccgcgccctggtgtccctgcagtcgctgagtaaacagcgactgggagccatcttggggcggaggaccgatcccaagcgaagtagtagtggctgcagcccgggtgcccccattcgtaaaggggagcctctaggacatccctaactaggcttcagggtccagggaaacgccctccccagtatggcgggccacattgaaatgtaaaaaccaggcctgggcgctgtggccatagggcacaggccataggccaccaggtccagccgccatcttccgcgccccacccccattccatcccctccccctccccaccccctcatacttttgtttacccagcgggataggtggccaaaaactgtggacgcaattgagtgaaagtgcgtgtgtgtgtgtgtgtgtgtgtgtgtgcgcgcgcgcgcgcgcgtgtctgtgtgtgtgtgtgtttgactgggtagaaaatcggctgggggctgggggggtcttccttgtagccctaagccgcagctgcgggagaagctgccctggctagccgaggcccggcccagcgtgcttctccgcggccagcctgggccaccggagccgaggccttccctgtgttcctaggccgctggctccggcctccgctccctggacgcctcccgactgacaaaattctccgtctttgttttaaaaccaaaggacaggccaaccttgagcccggccgtcacccctgtcgcgcttttgttggcgcaggctcggccccctacaccgggctggtgcagctcccgcgatcagacggtctctctcaattcggcgttgaacccggttcttcccaaattctggtattgctggccgcttggacacgttctccccttatccctcccccagcggggaaagaaaaagccaggatcctttccttggcgcggccacccgagccactccacccgtcgcgccaaccgcctttccaggtggggaccaaagcccccactctccgctggcatctcattgaagggcacccccccgagggattgccagcttctgctgccagctgagaggccgtgtggctgggcgtcttaagcgccggtttccgcaggtcccgtgtctggcgggcgcggctaaaacccggagaggctgtgcccgggaaagccacgttcgccgtcccctcgctgcgacaggcccagccgcgatacagcgccaagtctaggtcgggccaacccagccaggagctgcccggacctgcctgaaagaccagggacgcggcgccagcgccccacaccccaccgagaccagggcgcaaggcgggcagaattcggactgatgcgccaggcccagccccgatggattccagctcctctcggccccgcctccggccctggcctcttcctccagccggggtcgggtcctccactccactgtttggctgggaaaggaccgagacgcgctcagtgcacagggggccggctgcggccataaatctccgggcgggccctccttcccgctgctcacgccggggtgctccgggccggtctcgtgtcccgggccacgccgcgcaccctgctcaccccatcacggcctggggacccggagactgcgcagggaaccacgccaggagcttctccgttcaccaaagagagggaacggcctcgttcctcggtgtcaacaccatccatctctgagggcgctggaccctgaggtggcccgagcttcacaggatcaccgccttggggtaggggcgcccgggcctggcatttcctcctaggaaggctcggtgagactgggatgggcatgcggctctccgctcgagcccaactccggtgccacctgcaccacggaggggtgaccccagggtcagggtcagagcggcttctcagaattcagcttgccacctctccgcggaccctgccttcatctcgtgcctcctcagagccctctgcgggcgcatgaagggcctttttttttttttttttttttttttttggcacaggtggaccaacggggggtgtgactgtgggcaccgtgcgcggaggcggaggctcatctggttcccaccctccgtgccgctggatgccccaggattttctccaaccggggtcccggcttggagccctccttggtgcgagctttggctcagcaatggggaaagcgggaatgggtctcgcccttgtggctgcctggtggaagcggcggttttgacacacgaatagtcgtggggagcagatccagagagggcgcatttgcaataataacgcttagtttatctctgccagaggggcgggaacaggccttcgcgctggtgtcttacatcagccaagcaaaccatgggcgcgattggagccaaccacctccagcggggttttgctccagacttaaggtgcacggaaaccggagcattcagcccttcatggatgcctcccgaaaacctcaccatgccagtgacacgactgcaaacggcgggtggcacatgccgggggcttgggatgggagggtttggaaacctcgctccaaggacgccctcagccaaggagcttcggctccttcctagaatttctagaagcacttttggagggaccgagggcttccggccgggcccagaggaatttgagcgcttgcccgggcaggcagaagcgcagcctgggagtggagaggctgctgggccacattccggcccagcttcccccgctaggccccagccctgccgcggcgccccaggaagcacctccgaaaacaaagcgctgtggtttcagcccaaggttaaagtccaccgcgagcgtgttttttcccccctccagaatctaagagcgatagcgtttctccaaataaaccgccaataaatcagctcccgggggcgcctgctgaagagctctggtgaccttgggggatggtttttctgcctgacccgtctgagcacaggctttggggaggagggggcagtgtcagccctacccctccagagagacgcggaagagggaatggccaagggcattcgtgggtgattacagcagtacgtgtgtacccagaggagatgggagaggcttggaatgggggaaaggggcgactgtggttatccgggggcctgtagtgcgcggtcaggaggcgtttgtgattgcgaggagggctgcttgctgtcggttcaacgattgctggagcgccggcggtgtcggcacaggtctaggcatggggaaagcaccactggggacagacacggccgctttggggccccgagtctttgtctgcctgggactggatgtgtttgtgtcggtgtgactaatgggatttatggatgtcagtgccagggtgactgatgaagggcttggcagcacgtgtgtttggggagaggcgctgcacctaggtggggagtgggtgccccgggagaggactgtcccttctcttagaggttccttcccccaccccctccctgccggctcccagctttgtttaggcctctgaacccctccggggcaggcctgtgcacgccgagttctgcagcaaattccacggccagcctgtccctcagaggcacctcagcacgccccacctctcccagccccacctccccagcacacgccacgcgtcccaaatccaggctgtcccacccccttcccaggcagagccttcccagtttgctcttttcccatctgaactccttatggtgtgctctgagccctgcttcaggcaggctttgacgaccgtatggtttgggtaccggcatacccatttaacagatgaaaaagttgaggtgcagaaaggagatgtgacaagcccacgcagccaggaagtagcaggcaccctgaactaaaccaggcagcttgctggggaccccactgtggaggccctttgcctctgggagcccccagcctggctgagactcgcttagagaaggtagaggcaaaggccactcccatgacacaggacacaacctgccacccttgtactgtgcgttataaccatcagtcctccctgccactcggtaagggctgtctccttccctgacctggcatgaggaaggaggggggcagtgaaggtcagaggactagtaggagagcctggtttggcctggggcagggtggggtgctgaggtcaaggtaacccaggggtcactttggagatcaggagagccgtggctggaaagcaggagctcctgtgtgattccacagaacctagcgcagactcaggttcaggacaaacctggagaatccatatcccctctcccttgggatcatctttttttttttttttttttggagagacgggggtctcactatgttacccaggctggtcttgaactcctggcctcaagcaatcctcccacctcagcctcccaaagtgctgggattacaggcccaaaccaccaagcttggcctcccttggggtctcttctttttttctttttgagacagggactcgttctgtcgcccaggctggagcacagcggcacacccgcagctcgctgcagcctcagcctctcgggctcaaaaaatccttctgcctcagcctcccaagtagctgggactgcagatgcatgccaccacgccaggctagctttttttttttttttttaatgttttatagagattggtggggggagggcgggtctcgtgatgtgcaggctggtcttgaacttctggcttcaagcagtcctccctcctcggcctctcaaagtgctgggagccactcacaggtgtgagccaccacgcccagcagagcttcgtttcccaatctagaagtctgtcatacaaaaaggcatcccggttttctctctctctctctctctcacacacagacacacacacacacacacacacagagtcacctccccccacctttttttcctttttatccttctttggcattttctttcaagcagaaaataaaaacatttcccatggctacagctttgaaagcttccctctcctatcagcctccatcccacgcccaccccaatgtcaatccatttctagagccagcgtcaagtcaaaaacaaacccacaaagatcaagcctgacaggccccctcccggctgccctccactctctcttcatgtattggtctgccttcaccccagagaggagcacgaggtaggaatcctatcatacacacacacacacacacacacagaggcacacacacatacaggcacacacacagatgcacacacacatacaggcacacacacatacaggcacacacacacaggcacacacacaggcactcacacacacacaggcactcacacaccagcttctatggccatggagactctctaaagaaccttctaagccaggcgcagtggctcacacctgtaatcccagcattttgggaggccgaggcgggcggatcacctgaggtcgggagtttgagaccagcctggccaacatgatgaaacccacgtctctactaaaaatacaagaattagctgggcttggtggcgggtgcctgtagtcccagctactcaggaggctgaggcaggagaattgcttgaactcgagaggcggaggctgcagtgaggcaagatcatgccattgcactacagcctgggcaacagagcgagactccattccaaaaaaacaaaacaagaatcttctagagctgctcctgccagaaagacctgttcacttggttccatctgctggaggggtccggttgtcccccacctgcccctgcccctgccttcctcacctggccccattcccgcagatcctcctctgttgtagattgaagaaagtcccccccaaattcatgtatttgattcctaacccccaataccttaaaatgtgaccttatttggagtgacggtcattgcagatgtaattaagatcaggtcacactggagtccggtgggccctaattccttatgatgtccttataaaaagaggacatttgggctgggtgcagtggcccatgcctgtaatcccggcattttgggaggctgaggcaggaggattgcttaagcccaggagttcgagaccagcctgggtaagaccctgcctctacagattttttttttcaattagccaggcatggtggcacatgcctgtagtcccagcgacttaggaggctgaggtgggaagatggcttgagcccaggaggtcgaggctgcagtgagctgtgatcatgccacagcacttcagcctgggcagtagagcaagatcctatcaccaataaaaggaggtgtttggaatcaaacagctatggagggaagacaaagtagaaagatgtagaggggggtggacacaccagagaggcctgggacagacccctcaagccctgccaacacctgccaccttggactagaggcttgatcttggacttcaagcctctagaatggtaagagaataaatttctgttgtttaaaccaccagttagtgacacctcactatagcagcttaaagagactcagacaccatcccaaatctaagagcctacaagggtcaagtgggaaccattgacccttgtagctcctggcagttccagccagctatctccagggtgccagatctgctgttgttcctgggaagctggcgtatcagtcagaataggccaggttatgctgcagtgacaaacatcccctacatctcaatggcttgatggaacacagaaaaacgtattctcctcttcacattgtcaacacagcctgggcactgctcccaggctgctgacctccttgtggtgtctggccagcctgagccagttagagttcatgagttgtccacctccatgtgaggtcaccatggggcatgcacagactcccatgtccctggtgctcacaccccacacgatcacacttagctgaggggtgctggagaggagagtcttgctgtgcccgggaagcggagaaaaaacaggtattggtgagtttagacaatgttggccacacttgcaaagccacatctcctgagctgctaactttggcacttcttttaaaattgtggtaaaatacacatcacatttacccatcttaatggtccccccgatccttttttttttttttttttttttgagacagagtctcactcttgtcgcccaggctggagtgcagtggcactatctcggctcactgcgagctccgcctcccaggttcccgccattctcctgcctcagcctcccgagtagctgggactacaggcgcccgccaccatgcccggctaatttttttgtatttttagtagagacggggtttcaccgtgttagccaggatggtctcgatctcctgacctcatgatccgcctgccttggcctcccaaagtgctgggattacagacatgagccaccacgctcggcccccgcccccttttttttagatggagtctttggtggtgaaatctcggctcactgcaacctctgcctcccaggttcaagtgattctcctgcctcagcctcccaagtagctgggattacaggcacccgccaccatgcccggctaattttttgtattttcagtagagatgggatttcgctatgttggccaggctggtctcaaactcctgacctcaggtgatccacccacctcggcctcccaaagtgctggggttgcaggtgtgcgccaccgcgcccggccaccaccttaaccctttttaagtgcacaggtcagtggttcaagcacattcgccttgttgtgcagccatcaccagcatccatctccagagctgttttctgtcttcccaaactgaaaccctgtcccctttaaacactcccgattcccctctcccagcccctggctattgtactttctgtctctatgaatttaattaccctaggaaccccgtatgagtggaatcatacaatatctgtcctttagtctggcttattcactcagcataatgtcctcagggtttgtccatatcacagcggctggcagaatttccttcctcttcggggctgaataatattctgatattcccaacatgcttgtcacctctacaagcctgtgaggctgtgtgagcttcccagggtccccagaataaaaactgggtggtttacacaactgaaacttaattgccttacagttctggagactggagttcgagatcaaggagtgggaagggctggttcctcctgaggcctctctccttagcttgtagatgccgtcttctccctacgtcctcacatggtcgtccctctgtgcgtgtctgtgtcctaatctcctcttcttataaggacatcaggcatattggattagggcccaacctaataacttcattttaatttaatcgtctcttttaaagaccgtatttccaaatacagtcacactcagaggaattaggggttaggacttcaacatatgaatttgcgagggacataattcagcctatatcagaggctcttcattttattgttttattttactttttgagacagggtctcacttgtcacccaggctggggtgcagtggtacaatcacagctcactgcagccccaatctcctgggctcaagcgatcctccctcctcagcctcctgggtagctgggactacaggcgtgtgccaccacacccagctaattttttattttttggagagacagggtcttactaagttgcccaggctggtctcaaactcctggcctcaagcgatcttcctgccttggccttcaaaagtgctgtgatgacaggcgtgtccctcactttattctatcactctctcccccatgcctggcccatcagacctcagtgaatgtccattcaatgaatgaatgaagtgatgtcatctcggtagggttttcaaggatgaataggagtttgctaggcagagaaggcacagagggcattccaggcttaaagaacagcctaggccaaggcctggaagcctcccagcggggctctctgtctcacaggtcacatgccagacctggggcagggaagagagctgtggcccctctcagtccgcagaggccagccaacctgctccccatgagctggagcccagccaacctccacaaggaccaggaccccagtgcctctgctcacaggagctggctcagatgattttcgctatgtcttttacccttcacgcctgggtggcttgagcgtatttatttaactttcattgtattggtgtttttgttgaaagtgcaggaattattcatagccggtttcggttctcttctggcaatgaccgcatcttcctatgcaaggtacaaattacctgtcaggccagttcaccatcagtcaggggctgtgacccagccccaagccaccgaggctcagctgctctggaagatgggtctggctggaggtggtggggcctgaataggtctttgtcccccaagttgccaaggatagggaacatggatgggaaacaaggggattggcccaggaacaaatcctccctctgcgatcctgctcagtctacctggccactcagtactcagtcttctcatctgtaaaatgggcattggagtgagtgtctggcatggcgggccatccacattgtcacccactggtgtcacccactgcctgggtgagcctgggcacatgggtgccctctgtcacctccaaggaaaggagacagagatactcatagagaagagaaactgaaaacagaagggacacagaagggcttagaggacacgtcctcagctaatctggccccctgggttgtggtggcatgagaacacagccctaaaaagttcctcctattgaaagatggggtcatctgggcacagtggttcatgcctgtaatcccagcgctttgccaggccaaggcagagggatcctttcagcccaggaatttgagatcagcctgggcaacatagcaagatcccatctatacaaaaaaaaaattagccaggtatggtggtgcactcctgtagtcctagctactcaggaggctctcttgtgcccagagttcgaggctgcagtgagccatgatcatgccactgcactccagcctaggtgacagagcaagacattatctttaaaaaaaaagaaaaagaaaaaggtgtggtcagctgggcacagtggttcacacctgtaaacccagcattctttgaggccaaggtaggaggatagcttgaggctagaagtttgagaccagccaggacaacatagcaagaccttgtctccacaaaaacaaacaaaaagaatcagctgggtgtggcagctcacacctgtagtccagctactcgggaggctaaggcaggaggaccacttgagcccaagcattggaggctgcagcaagctatgattgcaccactatactctggcctgggcaacagagtgagactctctaaaaaataaaaaaaatagctagaacacagggtttggcagaaaaggatatctaaggctatgcttcataaaactccaacaggtgcaggccaggcgtggtggctcacgcctgtaatcccagcactttgggaggctgaggcaggtggatcacctgaggtcaggaattcgagaccagcttgaccaacatggtgaaaccctgtctctactaaaaatacaaaaattagctaggcctggtggcatgtgcctgtagtcccagctactcgggaggttgagacaggagaattgcttgaacccaggagttggaggttgcagtgcagtgagccaagatcatgccactgcactgcagcctgggccacagagtgagactgtcaaaaaacaaaaaaaactccaacaggtgcagaacccggtttcacacattttccagacctgcccatgtggggaccacagcaatgagacactgatcaatgtttaacaagttctcaggtggcttcagcctgaggtggggtgggggataaggagagaacctgatgtgtagcctctgccaatgtctgtggtgtaaattctcccagcttcaagctaccaacgtgatgtcactgaactcagacttgggaagagatgtgtagtcgctcacttatgtagcatttccaccacagataactgtagcatccggcggtgctggctttcactgcatgagtaacccccaggagaaaaccacccagctgagcccatcctgactttctgacctgcaaaattgtgagcaaaataaggggatggttctagactgctacattttgtagcaatttgaagcacagcactagtcactagtggggccactgagtccagtgtgggatgatgcttaaaagggtggaggggccgaaccaggccagagcacctttcacctacgcctgactgggagaatccatgccagtctgacgtgctccagccctgctaacatcgtgagaaaaagccagtgacaaggctgacagccctctggaagggtctctcatgggcctcagtggccactgctcctgggacagaaagcccccacagggctttagcaggagccagggggatttgtgggcaagttgcccacctccgtgccatgctgactcctgccacactaaatacccgcccagccccacaccgcctcagacacagggtgaagaggccaggacagggctggccaggggccctggtttaaaatagcagcaccagtcctttgttttgtctgcaatgcagctctgccggtctagctcctgctttgatgttggtatttaagcctcttctgggaacctgaaccttccccaagcacatcagaaacccacactcgggcacatacatacatgcatgcacacacttgcatgctcacctgctcccctgagaagccagaggaggtagcctcaggctccagagctgtcccccacctctgcccaggtccccctccagatctgtgttagtgtcctgtggctgccgtaacaaacctgcactcactgggggcttcaaacaacagaaactggctggacacggtggcttacaactgcagtcccagctactcaggaggctgaggcaggaggatgtcttgagcccgggaggtcaaggctgcagtgagctgtgatcacgctactgtactccagcctgggtgacaggaagaccctatctcaaaaaaaagaaaaaaaaatcagaaatttactgtctcctggaagtcagaattctgagatcagggtgttggcagggccgtggccttccaagtctctgggtggactctctccttgtctcttcccggcttctcgtggtgccagtcatccttagcattcctctgttgtttttcttcttttttaaaaataaaggccagggccagtggctcacacctggaatcccagcactttgggaggccgaggcgggcggatcacttgaggacaggagttcgagaccagcctggccaacacggcaaaaccctgtctctaccaaagtgagctatatttgcactactatactccagcctgggtgacagagcaagaccctatcccaaaaaataaaaataacagctatgattgcagtggtgcaatcacagctcactgcagcctcaacttcccaggctcaagccatcctcccacctcagtctctcaagtatctgggactgcaggcacccatgaccacgcccagctaatttttttttttattttttttttgtagagatgggggtctcactatgttcgtctcaaactccaggcttcaagcaatcctcccacctcagcctcccaaagtgctggggttacaggcgtgagccatcatgcctggcctcttgagaccttgtctctaggagaaaaaaaaaaaaaaaaccccacacacacaaaaaacaactccatctggcagagtaagagggtgagaggccaggaatgggatgtggccacctctgacccccagagccccagcccttagtgtcttggggggacaaggcatgtctggtacaaggggcaacagccagcagggactggggtgggcactgctggttccgctctcatccctctgatagtgccctgggccctgtacccacaccccaggttgcagagaaccccccctgccccgcccccgcctggctgccgggaagtctagctgggccaggcgggttctgccgggaactgccctccctgagctgaggcccccctgcccctctccccgccatggatccagcaggtgtttgcctgtctgacccctgtgctgggagcatggcttcccctgcttgggaagtcttcactgtctccagcccctcagcccttcctggggctcctggggtccacttcctcagctgtcttcctccccccagactgagacccctttggggtaggacctgggtgctgggtgagctgggctggcgcagagctgggaacgggcaggccttcactgacccacttatgaccccacggtcatcagagccatcggggccctagggctcaagggcagggctggggccctggaattcccacaggtgcaggggatgatggctcgggggtggggaacagaggggcccaaggagtcaacagcacctgaagggccagagtgaggacgtgacaggcgtccagcagcgcgccccacccatggccctggacttagcctcaaaccagaaaggagtgtgggctgtgggtgcatggtcctgagaaggtggcaccgtcatgcttgcttcacgagaagccccgctcacccacctgtgcgggcactgccatccccaccctgcatgggttccacccctgactggcacacagtgggtgctatgcccagtaggtgcaccccaacatggtggcagaagtggcattgggcttaaaggctaagatctgatcgggagagaaccccattcacctctcaaaaccctagacaccaccccagtcacaggaacagatagggaggtgtcggagggaggctgggctgccctctacgacaaaagaacgtcctggcaataagaactgctcagtagtggcacatggggcagcccaacgtccagcaacagagggatggatcagttgtggtttattttttttttgagatggagtctctctgtcacccaagccggagtgtagtggctcgatctcggctcactgcaacctccacctcccgggttcaagcaattctcctgcctcagcctcccaagtagctgggattacaggtgtgtaccaccacacccagctaatttttgtatttttagtagagacgggatttcaccatgttggccaagctggtctcaaactcctgacctcaggtgatccacctgccttggcctctcaaagtgctgggattacaggtgtgagccaccgcgcccggcccagttgtggtattttcatacttgggaatatgattcagccttaaaaaggagcaaagtcctgatctgtgctatgccatgggtgtacctcgaaaacattccagccagacacagaaggtcacctataaaatgatcccatttatatgaaatgtccagaatgggcaaataacagaagctgactgggggttgcgaggggcctgtgggagtgagtgtttaacagatacggggttcctttgggggcaatggaaacgtcttagaactagatagaggtggtgcgtgcacagcactgtgaatgtgctacctgccactgatttgttcgctttgaaatggggaattttattttttgaggtcttgctctgtcacccaggctggagtgcggtagtggtgtgatcttggctcactgcaacctcaaactcctgggctcaagagatcctcccacctcagcctcccgcgtagctgggactacaggcgtgcaccaccatgcctggctaattttgtgtatttttttatagagacagggttttgccatgttacccaagctggtctcaaaactcctgggctcaagcgattttccctccttggcctcccaaagtgcttggattacaggcctgagccacctcaccagcctgtgaattttatgtcatgggaattttacatcaattacgaaaaaaaaaaaggcgcagccctcagcagtggtgagccctcactgttgggaacaggaaaccaaggcctggccgctggaaatggggctaagagggtctcagaggccttcctcgtacacacctgccctatcttccagaccctcccagagtgggtggtggtccccacagctccatagcggcccctctttcccccagggttgctaccaacactggccgaccctccaccaggtctccctaccccagcccagcctctccttcctctgccacccccctccctgcccccacagccaaagcttgggcagcactggtccccggcacatcccacgtcccggcctcctggaactcccttcctgccattgcctcttcctggaaaacccttcccgtcgcccaccctgacttctcttgtcatcccgaaaggcccagcatgagggacacctccccagagaagccctccctgggttgggcaggtaagaccctctcccgcgggctctgggcagctgtgctctgctgtgtgatctgtcaggcagcagctgtcataggcgactgcctgcaagtggcctggggccaacatctgcctaagggtttcccatcccagctcagcccccagcttgcagtgtgacccagagtggacccccagctcctctgaaccccatttcctccccacagacagagcgcctcccagcctgccagggaaatttgggaagacaggaaaacatgttcagcacagggtctggcttggaaaacagcagccaccatgactcggctgatgctaaaggcttgcttccttttttttctttcttttcttcctttttattattactatttttagagacagggtctccctctgtcacccaggctggagtatagtggtgcaatcatagctcactgcagcctcaacctcccgggctcaagccatcctcctgtctcatcctcctgagtagctgggactacaggcatgcaccgccacacccaactaatttttgatctttttatagagacaaggtctcgatactcctggcctcaaacaatcctccggcccaagcctcccaagcagctgggactacagacacctgctatcacaccgggctaatttttttatttttagtagagatggattttcaccatgttgaccaaactggtctcaaactcctgggctcaagatctgccagcttcagcctcccaaagtgctggattacaggcctgagccactgcacccggcctattttaccatcattttttaaatgaaaaataaaagggagggggatctttggggatctgcgtgggtactttgctccgctgccacagtgatgtccccacggccccgcagtccaactgcgtcccatgcaaagtatcactggcaaccatagcctcgtacctgagctgcctctgttccagggacacgttccggagctgacacccctcctcaccacccgccctcgagtcatgctgcgccactgcctctgccccccaggatgccccgagagggcaccttcgaccttcactcctgggtgggccacatgggtgtggaggccagactggcttcacccctgcagcgatccgtccacctggagagggcaccttgtgcggtttaatttggttgccatcatcctggaaccaggctgtccctggagacctaatcccttctggggatttaaaagaatcaaacttgccaaggaagacgtgagcttctggccccaggctctgccagcttcccattttaattgggaccatttttagccctcaccgggaggcttccgaaaaccccccaggcatctccctcggggcccacaggggtgacgtgtgcccaccctataccaggagctccctaccctcatctcggagcccccagcacccacaccagctgccccttctatgggtggggctttcagctctagaagtaaaagggagttgcccaaggcagacctgagctcagagcctgtgtccttgaggggcccttggtgggcagcaggtccccctcctcccacccagagccccccccttccatccggaagtgttgcctaccaccgaggctacaaaacccacatgccagtccctactcaatgcccctaggaccgaccgacccggcgtgcccgggaatgccccagttttctcactgaacaccttccatccaggcaccctctcatccctgggacggtgggtcacccagccacccacagataagcacggtagggggttggagggtgtcccccgaaaagacatgtccactggaacctcagataggctctcactgggaataacggactctgcagatggaattaaggtaaggctctcgagataagcgtgcctgattagagtgagccctaaatccaatgactcccgtccttaagagacacagagcgcactcccacgtaacgagtgcctgacggccgggacagagactgcagagaagcagcaacgggcccaggagcgccaagcgtggcccgcagccaccagaggctggagagaggcctgggaaggattctccgtgagagactagagaaggagccaaccctgcctgcaccttgatctgggacttctggcctccagagctgtaagacaataggtttctgctgctgaagccacccagcgtgtgggcatttgtaaccgcggcactagggaatgaacacagtaggtgggccaggcacagtgactcacacctgtaaccccagcactttgggaggccgagacaggaggatcacttgaagccaggagttcaagaccagcctaggcaacacggcgagaccccatttctacataatattgaaaaattagccaggtgtggtggtgcacacctgtagtcccagctactctggaggatgaggtgggaggagcactggagctcaggagttggagaccagcttgggcaacatagcaagaccccttctttacaaaatatttaaaaactagctgggtgtggtggcatgcacctgcaatcccagctactgaggaggctcaggcaggaggatctcttgagccttggagttcaaggctgcagtgagccttgattgtgccactgtactccagtctgggagacacagtgagaccctgtctttaaaaaaaaaaaaggccgggcacggtggctcacgcctgtaatcccagcactttgggaggccgaggcaggcagatcacaaggtcaggagatcgagaccatcctggctaacatggtgaaaccccgtctctactaaaaatacaaaaaaattagctgggcgtggtggcgggcacctatagtcccgctactcaggaggctgaggcaggagaatggcgtgaacccaggaggcggaccttgcagtgggccgagatcgcgccactgcactccaggctgggcgacagagcaagactcggtctcaaaaaagaaaaaaaaaatgctgggcacattggctcacgcctgtaattccagcactttgggaggctgaggcgggtgcatcacttgaggtcaggagtttgagacagcttggccaacatggtgaaaccctgtctctgctaaaaatacaaaaatttggctaggcacggtggctcatgctcgtaatcccagcactatggaaggccgaggcaggcagatcatttgaggtcagtagctcaagaccagcctggccaacatggtgaaaccccatctctactaaaagtaaaaaaattagctgggcatggtggtggacgcctgtaatcccagctacttgggaggctgaggcagaagaatcgcttgaactcgggaggcagcggctgcagtgagccaagatcacaccattgcactccaccctgggtgacagagcgaggttccatctcaaaaaacaaaaacaaaaattacccaggcgtgatggcagacacctttagtcccagctactcgggaggctgaggcaggagaatctcttgaacccgggagatggaggcttcagtgagccgagattgtgccattgcactccagcctgggcgacagagcaacagagggagactccttctcaaaacaaaaacaacaacaacaacaacaaatagttgcatgtcaattttcccattgcagggggttggatgatgttcccccaaaacttcctgtccacctgtgacctcagaatgtgaccttatttggaaacaggatctttgcaggtgtcattggttaagtatctcaagaggagatcatcctgggcttaggatgggccctaaatccagtgaccggtgtccttccaagaaaaggaggggcgccgggcgggctggttcacacctgtaatcccaccgctttgggaggccaaggcgggcggatcatgaggtcaggagatcgagaccatcctggctaacatggtgaaaccccgtctctactaaaaacacaaaaaattagccaggcgtggtggcgggtgcctgtagtcccagctactcgggaggctgaggcaggagaatcacttgaacctgggaggtggaggttgcagtgagctgagatcattccattgcactccagcctaggtgacagagagaaactccatctcaaaaaaaaaacaaagaaaaaagaaaagaaaaggaggggacacaggcacagagaaggccatgtgacgacggagacagatgggagcgatgcagctacaggcctgggaacaccgaggatttctggagcctcgggaagctgcagggagggctggaacggagcctccccgacggcctccagaagcagccagccctgcccacaccttgagttcggactgctggcctccagcactgtgcaagagcaaactcctgtcattagaagcaacctaggctgtggccacccgcccatctccctaggaggtctggctgctcttggatacccggagcctcctacctcagcttgctgggcactgaccttgagcgttgctccctcgacctgcagtgctccctgcagcgccccaccccatgggggacacaggaggggactctcagagccgtccccccgacaggccgaggctcctcccaggagaggaccccactgccccgccagcactggacactggacactgttttccataaacatttctttgaactgaatttcattcttctcacccaagaaatctctggaaaacaatgctgaggccagggtggagtgccggggagaggggatgttttaatggtttgtggagggttttctgttttgttttgtttgtttttttctggcattgtctctctcttctgatttccctgtaactgacagggaggaaatggattctgaaaatgggttccttcccacccctgggggctctgagatcaaagtgtggtggggccgggtggacaggacttggtgctccgaggtggggtccttcctgattccctcccaccttctccaccatgcccccctttacccaacggggcctggccaggaaggggcataccagggggctattctgggggacaggtctccagggcacctgccctgcgtgcccacccagtgaggggttcctggcccagagttgccccctcagcatatcccagggggctggtgaccctgtaggcccctccactttgctaaagaggatacagggagggttggtggcccagaactcacgaaccactgctgaccaggaatggccaagggaggcccacacagaacacccaatcccacagccacctgctctagtaccacttggggcctctccagccactggcctggctgcatttgctctccaaaactgccactttcttttagtttttaagggacaggctcttgctctgtcactgaggctggagtccagtggcacaatcatagctcactgcagcctcaaactcccgggctcaagcgattctcccacctcagcctcctgagtagctgggaccacaggcacacgctaccacattgggtgtttggatggatgagtagatgggtggatgggtgggtgggtgggtaggtggatcggtgggtgaatgagtagatgggtgagtggatggatggatggatggatgagtgtgtggatggatggatggatggatggatggagaagtggatagatgagtgaatggataggtggatgggtgggtagatggatggacaggtgggtgggtgggtgggtaggtgaacggaagagtgggtggatgggtgaatggatggatggatagatagatagatagatagatagatagataaacagacagacagataggctaatggatggatgaattcgtgctttctgtcccttgacctggtctacaagccacttccccagctagacaaagagagcttagaaccccatccctgccaggaaacagacaaaagctgtcggggtcttttttctctctctcagccttacctgggacacacagagctttacggtggggccttgttccagttgctgcaggctgccattcctgaaggtcgggggacaagctgcctcttcaaccccagctctgctgggggctcctcagcggctgggggagttgtgggtggggcaggagacctggcgagaagctcacgggtaccctcacccacctcatcccgccctgtgcccagccctgaccccagccctccctctttgtacctcaccccgtggaaggaaacacactgaaggtggggaggggtgggccagagcctcagactcctaagacaaagggagaaaaatggaccgaagagaggcagggggtagacgcaggcactgccttttttcttttgtagacagggtctcactcttgttcaggctggagtgcagggcgccatcatagctcaccacagcctccaactactgggctcaagtgatcctgcctcagcctccaaagtagctgggacgacaggcatgcatcaccatgcttggccaatttttgtattttttgtacagatggggtctcactctgttgcccaggctgatcttgaactcctggcctccagtgatcctcctcagcctcccaaatcttggggattacaggcatgagccaccacccccagccttatttcctgacatttctatggtaaaattgattgcttttataatcagaaaaaatatacagtgagacttaaagacacggtctgtaaccttgagaggccaaaacagcccgcagagggacaggcgactggccattttgatgctagggccccaggcacgaagcaggcaagtcccccctccccactttggccggcgagactttgaaaagaaagctggacgtgcaggagcaggggttgggaaggggaattccaggaaggggcctgggactggggccctggaaccatggtggccccccaggccagatccacccctggacaggtgcaaggactctgggagcggccccaaggatccaaataccttcctcagcagcccctttaatttgctttctgcagaaagtaagctaatgccggcagcggagacttcatttaggagaagagcaggcctcggcatatccctagcattggcagcattcctgggaggagaggaggggaaggctggggaggggagggagactgggctagagggagcccgcagattcacctaattccagggtggaattgctcgccagccaccgtgccctccatcattctccagaggccccacctagtttcctcattcatcagtcaccaggccttgtcctatggcccagccggggggagatgtcaaggccagggacccctctgaggctcagagaggggtgcgtagcaggagcagtaaagccaggactgggcacggtggctcacacctgtgatcccagcacttagagagacagaggcaggaggatcgcttgaagccaggagttcaagaccaacatggtgagacctctgt

SEQ ID NO: 3005 - DNA, 8331 bp, Homo sapiens
gcggggactactgggcggggctcggcgcgggggcggggcctggcgggagtagtctcggggtcggggcggggcccggcgggcggggctcggctaagcacagtcttggcgcagcggcggggcctggtggggcgtggctcggtgagggaggtctcgcttgggggcgtggtctcccccagtaggcggggcttggtgccgggggcggggtctggcgggcgcgggcgcgtgtgcgtgttgtgggcctcgcactggcacgcaagtctcagcaattcctgagaatcctcggaggaagaggccggggcccggtgcggcagcgccttgggggcggaatcgcaggcgcgggtcgggccttgctggggcgcggggcgcggcccccggagaaagcggccgcctcgggacaggagggacccgggagaaacccccctggggcggctccgcatgtcggggtcgcgactctaggcgaccttggtagaggggctcgtttgcgccgagctcgcgacccccgagggagccacggccccgtgaaccacgctgcccgtcctggccactggctgccgcctttgtttcgtgggaccccagcccgcaaggcctgcggagccgcggcctcgtcccgagtgttctgagcgcggtccgagctgctcctgcgtccactctgctgccgacacccgagcgtcgcctggagccctggcactgaggggcgcaggccgagttccagaccagcctgggaaacgcaaagcgaccccacctccacaaaagtgggttttctttaagtttttgactagtccgcaattcacagaattgacattttggcagatgaagattgcaagtaaggaaactaacggtatctcagatttgttctttagcaatttgctaaacctctcctctgactgcctttattaggtatttgttttcgagacagggtctcactccactgcttaggctgtactgcagtggcgcgatcccagctcgctgcagcctccacctcccggactccagtgatcctcccgcctcagcctcccaagtagctggtaccacaggcgccagcacgcctggctaattgttgtattttatgtagagaagaggtctccctgtgttgcccagcctggtcttgaattgggctcaagtgatcctcctgcttcagcctcccatatcgctggaattactggcataagccactacacccggcctgatcatctttaaagaaggtggttctggccgggcgtggtggctcacacctgtaaccccaacactttgggagaccgagaagggtggatcacctgaggtcaggagttcaagaccagcctggccaacgtggtgaaaccccatctctactaaaaatacaaaaattagccaggcatggtggtgggcacctgtaattccagctacttgggaggctgaggcaggagaatcgcttgaacacgggaagcagaggttgcagcgagcctagaccacaccattgcactccagttcgggcaacaagatgaaactctggctgggcgcggtggctcacacctgtaattccaacactttgggaggccaaggcaggcagatcacctgaggtcaggagttcaagaccagcctggccaagatgatgaaaccccatctctactaaaattacaaaaacttagccaggcatggtggtgcatgcctgtaatcccagctactcaggaggctgaggcaggagaaccacttgaacccaggaggcagaggttgcagtgagccaagatcgtgccactgtactccagcctgggcaacaagagcgaaactccatctcaaaaaagaaaaaagaaactccgtctcaaaaagaaggtggttcacacacacacacacacacccccaagaaagctcagggctggaaggcagccaacctggctgtgaccctcatcctgcacacgtgagcttggtgaccagtagctgattctttaactctctaagctttggagtctggatgtgaggtttagaattcatgacaagaagctggaaggatgccgccagtctgactcctggactggttctcttgacatctttgcaaaagctgctgaaatgttctggtttcatttcattcttttctttgccatgatctcttagatttgttcgtggcaattctcataagagtgaagaaaatgtttaaaatggctgttgggctcccttttgtgacaccttgtggggaaggtgcccaggtatgtataggtgctgagcgcacggccagcatggtgtctgtggccgggcctccctcctggacagtgcggccacagcccctgaaaggtatgtcttcatttttattttattttattgagatggagtctcgctctgtcgcccaggctggagtgcagtggcgcgatctcggctcactgtaagctccgcctcccaggttcaagccattctcctgcctcagcctcccgagtagctgggactacaggcacctgccaccacgcccggctaattttttttttttttttttttttgtaattttaatagagacagggtttcagcgtgttagccaggatggtctcgagctcctgaccttgtgattcgcccgcctcaacctcccaaagtgcctggccttcatttttatttttgaacttacctgcctcacctcgttatgtctttatcttatttttaaacttactcagttcacccactgtggaattgggagtatatggaagtattcccacccccagttttatataccgccccagagctgaccattctcgctcatttccccgggtcctggccgactcgagtgtgcctttccttccgatcctgctccacacagatctgagggatgctgccctttccttctccacctgcccctccctcacatccagccccaccagcctacacgttagcttaaatagggagcttttacattccccatgaaagggaatccagggacaggctgaggcaagagacccccagtgttcatgagatgccatctagagaaaacaccgtggtgctgaaggcctaagtcagaccccggggagagaggcaccagggtgactttgggtggagagtcctgtgcctgttctacttctataaatatactcaggtcaggcacggtggctcacgcctgtaatcccagcacgttgggaggccgaggcaggcggatcatttgaggtcaggagttcaagactagcctggccaacatggtgaaaccccatctctactaaaaatacaaaaaaatggctgggcacagtggctcacacctgtaatcccagcatgttgggaggccaaggcaggcagatcatttgcggtcgggagttcaagaccagcctgaccaacatggagaaaccccgtctctactaataatacaaaaattagccaggcatggtggcacatgcctgtaatcccagctactcgggagactgaggcataagaatcgcttgaacccaggaggcagaggttctggtgagccgagatcacgccattgcactccagcctgggcaacaaaaagcaaaactccatctcaaaaaaaaaatacaaaaaaatgagctgggcgtggtggcctgcacctgtaatcccagctacttgggaggctgaggcaggagaatcacttgaacccagaaggtggaggttgcggtgagcagagaccacaccactgcactccagcctgggtgacagagtgaaccatgtctctaaataaataaataatatgtttgtctgaaagtgcctttttaacaaagtatgagatgtgtacataaagtgcacatagcgcaagtgtcgcacgcagtggattttcacacgcagcacgtgaaatgggaaaacactggcccggcacggtggctcacacctgtcatcccagcactttgggaggccgaggcgggcggatcacaaggtcaggagatcgagaccatcctggctaacacggtaaaaccgcgtctctactaaaaatacaaaaaattagccgggcgtggtggcgggcgcctgtagtcccagctacttgggaggctgaggcaggagaatggcgtgaacccgggaggcggagcttgcagtgagccaagatcgcgccactgcactccagcctgggcgacagagctagactccgtctcaaaaaaaaaaaaaaaaagaaatgggaaaacattgaggatgaagtagcaaatatttgagaattcaacttgattggtggctgttgcaggttcatacgtgagtggttacgtagtgggtagttaaactgacaatgaccagctgaattttggtgacaggactgctcctaaggtttgaaatgtagcgtatcctctgattcacgggctaagctctgccacttagcaggaggagctcatgatagagcaggttgaggggaaaactttgccccataagggttcttcactgcaagtgagaaggtcttggctttgagcctccaatttcaatcagacagaaagcagaccagtcggcaggacagtatatgcctctggagatccgtgctgatgtgggggcctcagatacaagatgcctcagggcccaggcgtgaccctctccttccctcctgcacggagatgctgtgagaattagacactcccacagggccctgtcagacactgagctagcctctgggaaccggaagatattcaaaacaccagccaccccccacacacacagacaaggcgctggagggacagctgtgcagcggcagagcatgagaggtcttgatcagttaactcagtgaggttaggaggcgaatttttttttttttgagatggagtcttactttgtcacccagtcaggagtgcagtggcgtgatctcggctcactgcaacctccgcctcctggcctcaagtgattcttccgcctcagcctcccgagtagctgggactacaggtgcgtgccaccacacccagctaatttttgtatttttggtagagacagtgtttcaccacgttggacaggctggtctcaatctcttgacctcgttatctgcctgccctggcctcccaaagtgctgggattataggtgtgagccacaaagcctttttgttttcatttttgagatggagtctcgctctgtcgcccaggctggagtgcagtggcatgatctcagctcactgcaacctctgcatcccagttcaagcagttctccgcctcggcctcctgagtagctgggatcacaggtgcccgccaccacacttggctaattttttgtatttttagtagagatgaggtttcaccgtggtggccaggctggtctcaaactcctgacctcaaatgatctgcctgcctcggcttcccaaagtgctgggatgacactgagccaccgcgcctggcaaggaggtaacttgatccatacgtttgcgtttacatggtgcgaggaaagggcacccttggtagatggaacagcgtgtacaaaggcccggaggtttaaaatcaccactcttctagccctcatactaactttgcctattttgaactttatataaatggaattatattgcatgttctcttttgtatctgacttccttttctcaatactatatgagtggtatccatgccatttaaagtaatggtggattaactcaatgctacgtcgccttctagttgatggagggcaggcaagacccacagtggggctgagcccctcgagggttcctggctttgcccaggaaacaattcaagggcaagctggaagtgaaagtaaacaggccaggcatggtgggagttactacccctttccatggcaatgaccccacgacccaaaagttactaccccttccctagaaacttttgcctgggctgccccttaatctacatgaaattaaaagtgggtgtaaatgtggctgcagaactgtcctgagctgctgctctcagcacactctgcccagcacaccccgcctgcaggggccgtcgcagagctgtaaccctgccgcttcaagctgttttgttttgtttttctttcgagacagtctcgctctgctcttccagtttgaatatcacgcaggctggagcgcagtggcgcaatctcggctcactgcaacctctgcctcctgggttcaagcaattctgcctcagccacccgagtagctgggattacaggcacacgccaccatgcccggctaatttttgtattgtattagagacagggtttcaccatgttggcgaggctggtcccgaactcctggcctcaagtgatctgcccgccgtccgcctcagtgtcccgaggtgctgggattacaggtgtgagccaccgcacccagcaaaagtgctttctcgagatggaatctgcgcctggtgaagatgctctaaacattgctgagataacaaaggatttagaatattccataaacttcgttggtacagcagcgatagggttcgagaggattttccagttgtgagagaaggtctgctgtggacaaaatgctaccaaacagcatcgcgtgctacggagaaatcttttgtgaaaggaagaagctcaatgtggccagctttattgttgtcttattttaagaaattgctggccgggtgtggtggagaatcacttgaacccaggaggcagaggttgcagtgagccgagatcacgccattgaactccagctgggcataagagcaaaactccatctcaaaaaaaaaaaaaaaaaggaagaaattgccacagccacctcagccttcagccaccaccaccctgatcagtcagcagccacaaacaagaccttccaccagcaaagagatcccaacttcctcaagcctcaggtgattgctggcactttctatcagtatcttagttttttgtttgtttgttttttaatttttgagacagagtctcactctcttgcccaggctggaatgtagtggcaccatctcggctcactgcaacctccgcctcccaggttcaagcgattctcttaccttagcctccggaggagctgggactacaagcacgcaccaccacacccggctgatttttttccatttttagtagagacggggtttcaccatgttggccaggctggtctcgaactcctggcctcaggtgatccgcccaccttggcctcccacagtgctaggattacaggtgtgagccaccacccccagccattttttttttgagacgaggtcttgctttgttgcccagactagagtgcagtgacattatctcggctcacggcaacctctgcctcccaggctgaagcaatcctcccacctctgtctccctagtagctgggaccacaggtgcacacccccacacccggctaattttttgtatttttggtagagacagggtttcaccatgttgcccaggctggtctcctgagctcatgcaatctgcccacttgacctcccaaagtgctgggattacaggtgtgagccactgtgcccagcctattattattattatttattgtttttttggtcttgagggagggtagggtggtgggagcccagttggggagggagtgaggagtggtcaataaagtattttaaattgaggcatatgcattgttttgtaaacataatgttattgcacacctgactgcactgtggtataaacataacttttatatgcagtggaaaaccgaaaaatccctccgactggctttattgcgacatttgtgttattgcggtgtctagaactgaaccgtggtaacccaggcccgcctgtgctaacttccagcactaccgaggttgacgcagctagatggttttctccccggctggttgctgcttctcacccacagaggcggtggagcccttggaactgggcagaacacagggctgccttgtcaccactgcctggctgaacctgaaattgggccgtttgacagaaagacttgaaagggccaccagtaaattcttttttcttttcattgattttcctcttcttactttcctcctcctgaagttggggtcatgtcccaagaagacccacaaggcctggcctgtgggtgcacatgtggggagggtcaggtctgtcggctgaggagggcattggtaggggactttgagcagtgctgctccggagacacgaatgatgggatgggaggctctcccatatctgccgagagcacagcaccccatgactcctgggagcttgtcatagatgctgcagatgagtccttcctcagacgggatatttgctaatgcctctgccagcctgggcttgtcttctcagggcctttcaaaatgcacacacccttcattctcatgatgtccagtggatcaggttttcctttatgtgtcatgcttttagtgtttaagaatcatttctctaacccaagtcacactgacatcctccttttcattcttaacgcacattttacagttgtaggccttacattttggcttataataagttctgaggccaggcacagtgctcacacctgtaatcctggcactttgagaggccaa

SEQ ID NO: 3006 - DNA, 8776 bp, Homo sapiens
agttgcagcggcctggccacctcaggagcacgctgtctcttcccgacgtgcagcccggggcccggccctgtccccgggtgactgctccccggcaggactgcacatctgtggcggcaggcccagctcagggctcgggggaggttcggccttgccttcaaagagctccctctcctgcagggcgagcgcagagcggcgggcgagaccacactgcgtgtgctgagggcgcactggtcttagcgggagggaagcctcacgagcctgtacacttggaggagccctaagcgttaggatctgctgcgagggctgcctggaacggagccctggctgcaactagaatcaactggggagcttttaaaatatcagtgcctggctctcacctccagattgatgctagatggttgttcttaatgggaagaggccaaagcatgtttatatgctgtatggagagtgacaatgggatccagcatacacatgaagagagtagcctctggctaaggagaacggaaatagagtaagttcgtcagtggaatgggaggaaattgagggagttttgtctaaaggagtctattttttccttcagtcagatgttaggtagttgctgaacatgggggatgggtaggtgatgggataaagaattgtagggaagtggttcactctggagtaactgatgatggaatgctgggaaagcttagtgaacagctaagtggaaggccccactgggtgggagaccataaggagtgtaccagtttagaaggctgtgatgttttccgcagagctaagtgagtgggagtcaggagagcagaaataggaccatttgggatctgcagggaagcgagatggaaggccttgcttgggagagggttcagtgaaggctgagtagatgaaactaaaccaagggtacactgataaactggataaactgaagaggtcaaggaactcataggtttgataaggatgaaggccaggtgtagtggggaaagaaaacccagtccaacaactaaaattccatccatttcatggagccttcctgactaatgggaaatgaggtggcaacttcccccaggtcccaccctgtctgactcactcctcactcactgctcttcaaagggcccgtctccatcctctttctcaagaagagaaaccatggatgttgtttctaaaagttcagcctgaaaaccactgtctgtatgaactcaattcccatgattttttgaggctttatatgtttcagcacaaatattaaatggaggtaggatagagaagcagaaatggcaatgaggaaaaaaatggaaaaaggtatgcctgcatgttcatgagtgagtcagcagaagagtggagggaaaagacaataagacacggggtatcagctatgaataggaactgaaggtccagattgaagggcaacagaactggcaggtggagatggaagcagcctcctgggggctgtgtcaagcttctccattctccatcctgtaaaggacaaaggacacttcctacacagtacccacacagaagagctgatgggagggttagcctgtgaggacgagagagtgaagatgagggcaaagggtttgccagttaataattctgcatgtttcttgggccccagccagctagctggtatcctcttccaaagcaggctgggaccttggctgaaggaaccagggctggaaagacatcgggctggcagaggggagagactgcatgcaaacattctttgtatcttctgcaatttgagagttggcctggaaccctgaaagtcagggccaatgtctgatccatcagtgggtaaccagtgcctacatactatgggtatcattcactgttcattgaactgaacaaaagaaacttaggaacggggaaagggatgtgatagaacctgcaggaaaagctccggagagaaaggagaggctttttgttagggggcaaaccaggggatgctatcaagatggaggaaagggagttagcaagatccagaagacacgtgagaaggaccaagaggggaatgagaagcttataattctattagtactttttctggcaaggatgaagccagctgcattccctatgttcgaatgtttccatcctgtcaggtaagttctatgatcacctcttaatagataaaaaaaaaactggaatcagaggttgaaggctttgctcaaggtcacagaccgggtaaggtgaaagcaacacaggtgtttcaggctgaggaaaaagcacagacaaaggaatggatataggaaaacacaggacaggtagagaattgcaagggattctgtttggctaaagcaacagtccccaacctttttggcaccagggaccagtttcgttttgtggaagacaatttttccaaggatgggggcttgtggtgatgtggggggcaaggggcagggggatggtttcaggaggaaactgttccacctcagatcatcaggcattcattagattctcataaggagtgcacagcctagatcccttgcatgcacagttcacaatagggttcccactcctatgagaatctaatgctgctgctgacctgtcagaaggcggagctcaggcattaatgcttgctgacttgcccaccactcaccttctgctgtgcggcctggttcctaacaggtcacagaccagtactggtccatggcccaggggttggggacccttgggctaaaggatatggctaacgaaaggccttcatatgatagaaggttaatgagtggccccagatcatgaaatgttttgaattttaaaaaatgagtttactttatattggggtgtctctgaagatttttttttttttttttgcgacagagtctcactctgtcgcccaggctggagtgcagtggtgcgatcttggctcactgcaagctccgcctcctgggttcacaccattctcctgcctcagcctcccgagtagctgggactacaggtgctcgccaccacacccggctaattttttgtattttcagtagagacagggtttcactgtgttagccaggatggtctcgatctcctgaccttgtgatccgcccgcctcgacctcccaaagtgttgggattacaggcgtgagccaccacgcccggcccgtctctgaagattttaagtggcaggctgatatgatccccactgtattttaaaaagacaaacttggggacgggcatagtggttcacacttgtaatcccaacaatttgggaggccaaggtgggtggatcaattgaggtcaggagttagagaccagcctggaccaacatggtgaaacccaatctctactaaaaatacaaaattaggtgggtgtggtggcgtgtgcctgtagtcccagctacttagaaagctgaggcaggagaatcgcttgaacctgggaggtggaggttgcagtgaaccaagatcataccactgcactccagcctgggcgacagagcaagactgtctcagaagaaagaaagaaaaaaagacaaacttggcaacagcaaggtatattatcaagaggaaagcagaagaaggcagggatatcagctgggagccagctcagaggtctgggtgtgacataacaaaggcctgacctagaagaatggcagtgagaaggaagaaaaggggatacaacagaaagaggacccagaactgacagcagatgtccagatggataactcaggtgggacaggatgaagaaaatgaatgcagtttgggacatcctgagtttgaggtgagatggcccattcaacaagcaatctaaaacacaatactgtgcattcaggagaaaggacagagcttgagaaaaaaatctgaggattctctatacagaggtgaaaccacacaaagtggactggagtgtggtagctctagttttggctgtattcagaaactttcccatcccctgctttcatttcctttgagaaattccctaccccattggctcattaatgctggtagtctcccctacttcctcccagtccaagctcctaatggcacataatccaagcaaaaccagagctctcccatgagatgagttcgaataatgtagagtggagaaatgcagagacagagtccagacaacatttgagcctctgagcccacctagaggcatccacataacccaaatacagctggttctctttttttttttttttattaagccagtttaattgtaattttgattaggctagtttaattgtaatgtcttgcaatcaaaacagtctactagaccatcacataaaaatgagattgctcaggagaaagtaaaagagactaacagttaccacttgagtgttgactatttgcctgaagggcctttttaagaagcttggactttatctggtagaaaattaagagctacctaaagatttaaatttaactttaaatatgttttgttgaaggtgctctttgaagttggtactataatcccattctatagagctggaaactgaggttcttgtaagtgaagtaactttctaaggccacacaatggataagtgttcaaaccaggatatgaacttgaaaataaataaactgcaatagaactatgggtgctagaatggaagtatacagggcacaggagaggtacagtttaagaatggtcaagtgtacaggggaggaagtagtaaagactttacaggagtaggtgacatgtgaactggaaggatgaattgtttatcaggtgaataaggggtttggagcaggaaagagagagggtattctgcgtagggcagagcatgtataagccatggaggtatgaggcaacacctgactcccagctatttccttatggctacagctgagagcacttatggcaaagtggcaagagtcgtagagtatgccatgacaaaacaaagtctgaaggactggtggtcagtgtggcgggaagagaggcaagcatggcaccaaagagctccggttttgatctccagtgaattacacacagccacccacgaagaactgagcccgacctagcaagcacagacaagcgaggcaagaattcatcacaactgcacagagaaagctatgtgtggtgaagggcctcctttagggactgactgtagaaaaactatggaactgagtggttagctagtctagacagggaagagatacagttcagaaggcatgaaaaagaacatttcaggtgagaggtcttatcatttggcctcaagtcaaaagaacacaatttcttaatgaaagaacgtaggcaacaactaggtgggagaaatacaattcacaaaactagatttgaaattgacttatcatgtcaggtaatccaatgtaaaaatgctccagtacctactccacacattactagggagataccatgggggacgaaatatgcacaaaaagcgtctcctgaggctaagctcctgagacatgagcacaggggagctgcagagggaaggagaggttatgacctcttagaggaattggtcaatcgtttttttcaagcaacaatcactgagagcagagagttccagatgttaccctatgaatagataatatgtattgtgcttctactgttgtcagcattatcctaagcactttatatatattaacccatttaaacctcacagcaaccctatgaaatagccattattatcgaccccaggaataaggaggcaaaggcatagagaagtgaactaacttgcccaaggccacacagctggtaagtagcacagctaggatttgaactggggcagtctggcacgaaaacctgctttttaaatcaaaatgttattttatactacttctccaaagacaaatcataatagtaataatagtagcactaccatttatagtgtttatgatatgggctagatgctatagtatgccaggcacacacattatcttgcctaagatcactcagctctcaggtggaagagctggattcaaagttcaggatgcttgaatctgggagacaataaagtgcaccaggagctagaataagtttgtacaaggtacaaatgtggagcataaaagaggaggtaattaatcttacctggtgggagtggtattgagttgtgggttactggaaaacttcacaacttcacacaggggtgacttttttttttcttttttttcttttttttttttgagacaaggtctggctctgttgcccaggctggagtgcggcggcacaaccacagcttactgcagccttgacctcccaggcccaagcaatcctctcacctcagcctcccgaatggctgggaccacaggtgtgtgccaccacacttggctaattttttagtagagacagggtcttcgtgtgctgtccaggctggtctcgaactcctgggctcatgcagtcctcacgcctcagcctcccaaagtactgggatgacaggcgtgaaccactgcaccggcaagagtggggtgacttgtgagctgatttttgaaagatgattgggtattcatcagacagaatgatagggcagtgttccatgcagagggaacagtgggaataaaggaatggaggtttgaaagagctgtcacattcaggaaactgcaagcaatgttgatggcttgggaattgagtgggtggcatgacaataagaaggaggcagggggctgcatcacacagaatcttacttgcctttccagaaaatctgagctattttttaagtttttccaatgaagtaaatgtaatggccaaaaagagtaaataaatatccctagggaatctggtggcttagtctgaagctgttcagactagtaggaattctttgaagactattttttcttaataatgcatgcatgctggctgggtgtggtggctcatgcctataatcccagcatgttgggaggctgaggcaggaggatcacttgagctcaggagtttgagaccagcttgggcaatgtggcaaaagcaatctctaccaaaaattaaaaaattagcctggtatggtggcgcacgcctgtagtcacagccacttgggggctgaggtgggaggatcacttgagctgggagatggaggttgcagtgagccaagatcgcaccactgcactctaacctgtatgacgcagtgagaccgtgtctcaaaataaaataataatgcatgctaaatgtgtgttctctgttttaaattactcttaagtaaaatgaacattccaggatgattttaccttgtaattttcagtatgcctggcacacccacccctaccaacccacccaccaggtatgttgtccatatgcccccatctctaccaaaaatacaaaaattagccaggtatggtagcgagtgtctgtagtcccagctacttgggaggctgaagtgggaggatcgcttgagcctgagaggcggaggttgcagtgagccaagatcgcgccactgcactctagtctgggtaacagtgagacagaccatgtctcaaaataataaaataacaatacatgttaaatgtgtattctgttttaaattacccttaaaatgaacattccaggaagattttatcttgtgattttcagtatgtctggcacacccaccctacatggggagtaaactatcaaaaggcttttaatcaacggaataatgtgatcagatctgcagttcagaaagacctatctggcagccttttggaagacaagttaaagtgggcaggactggagataaaggattttaatcaggggagtaatgtgatcagatctgcaatttagaaagacctatctgtagccttttggaagatgagttagagtgggcatggctagagatatggagtctgaacaatacttttagtaagagaggcctagagcctaaactgtaggacagggtggatggacactggggagacagaattggtaggatttagtatctgattaggtatgagggggttggggacccagagggagaataatttagaatggtttccatattcctggcttagaagagaaacaggtgtgtaggctagaataactggatttggacattcaaccagctgtggatcatacaggtagagatatccatcaggaatctgcagctcagcaaagaggtctgagctgaaaataaaactcgcttaaattatgcacataaaagtggtggtcacagaaagcaggtagaagaagaagaaaagggggttaaggacaagtcctagagaataacatttaagaagcaggaagaagtataaaagtccaaaagctgcagagaaggaatggccagagaggaggatgaacaaggagagcatgtgccatagaagccatgggggagaaagagactaaaggaaatggtcagcattaaatgctgcagatacattactatgaggattgaaaaaactctggatttagccattaggtcaacagtgatctctgagtttctgaggagtggtggaagtagaagcccaaacacaggggttgaaaagtgaatgggaggtaaaagaaacagtgattctaagcactttgtttcaagagcatggcgcgagtgagtcagtgagaggggatgtagggttaagaaggatcttttaacatggaagagacactaaaatggcactatctaaggccatgaaatgtagcccagagaaactggcaaaaagaatgaaggatagactgggtgtggtggctcacacctgtaatcccagcactttgggaggctgaggtgggaggatcgcttgagctcaggagtttgagaccagccagggcaacatagagaccctgtctccattaaaaataataataatttaaaaattagctgggcatggtggcacatgcctgtggtcccagctacttgggaggctgagaggtgggaggatcacttgagcctagaggaccacctgagttgcaggatcacagtgagaggtgattgtgcc

SEQ ID NO: 3007 - DNA, 6912 bp, Homo sapiens
agacgcagccgagtatcttgaggagaaggactttaaagcgttcagggattttagctgccgctgtggagttccgccgctgttcttccgctggagggcgcagtagttccttaagagggaatggtgcggcgaatagctgtgagttcaaagtcctgactacagagttttgctcttgttgcccaggctggagtgcaatggcgcgatctcggctcaccgcaacctctgcttcccaggttcaagcgattctcctgcctcagcctcctgagtagctgggattacaggcatgtgccaccaagcccagacagaatcttgccctatcacccaggctgtagtgccgtggtataatcttggctcgccgcaacctccgcctcctgggttcaagccattctcctgcttcagcctcctgagtagctgtgactacaggcgtgcaccaccacacctggctaatttttgtatttttagtagagacggggtttcaccatattggccaggctggtcttgaactcctgacctcaagtgattcacccgcctgggccttccaaagtgctgggattacaggcatgagccactgtgcccgaccataactctaacattttatcatcaagaaatgcttgctatatgtatacatacattagattcacagcctgcataagagtttgtgtgatttcttacttagtaaatactgagtggtaaggacaattccaaattcatcccatgaaagttaatagggaattcctagcaggtcataggtcagatagaaaatctgtccttcatgaaacgctgaggacgtgcaattccaattaaacccactcaatctggagaaagaaatcaaagggagggggtgggcctggaaagagtacatcttatcttcaggtactgtttgtttgattttttttaatacttggggtttgtttctgggaagaattcttgacctggcaaaaattcatagtaattactcaggggaaaggaaaaagaagaaacaaacaaacaaaaaatacattaatgtggttggaaaaaaaatctaagaacatggtgttggtgggagagaagactaaatgtttgtggaagacccacccaagtgcttttgatgtttgaccagttattatcttattgttcttcctgctatagatacagctgcaatttatgtaacaggatgtttaaaaagattaaagagaatctgtagtagggttctgagatgataagagtccctagaatatgcatttatggacgtttagaatataagttcctgtacattcttagaataaaccatctatttgtttccttttttaaaaaagaaacaaacaaaatttgtatttcagtatggctgcttccttccagcaagtgatatggaataacaggcaaagacagcaaaccaataacagagcaaagacaagttggtgctggttcaaactgtggcccatgccggttcttaattagctttgagctttgagtctaaaatgttttaactctacattatacacgtgtttggaatttatttggattcaacctgttcatcagaaaatgggttattctatgatacaagcaggatcattgtgtgaaatttatgactgcaatcacccaacgtgaagatgaaagtttaaacatttttttgctagaggagttttcaaaaaaaaaaaaaaaaagtgttctatagatgtcccaaacatacagagtgacttactggcgtttaagtctttctgccatgtggagtgctatcttaagtgataaattggcactgggcacttgataaaaggtcattgggcatattctccaagtttctggtgttagtcatgaattaattgcttgttaactttaattctcctagcaacctaggctaatacctactgcacacttgctctctctctctcactgtatttctgtgcatgtgtatgtgcataatttttttctgaacttgtttctgtttgataataacttacagacatgatgcccctttccattaagcacttcagtggatattttcttttctttgtttttttttttttttttgagacagagttttgctctgtcacccaggctggagtgcagtggcgtgatctcaactcactgcaacctctgcctcctggattccagctattctcctgcctcagcctccaggtagctgggactacatgcatatgccaccatgcccagctaattttgtatttttagtagagacagggtttcaccatgttggccaggctggtctcaaactcctgacctcgtgatctgcccgcctcggcctcccaaagtgctgggattacaggagtgagccaccacgccccgccagtgtatattttctaaaaacaaggatattctctttcataaccacaattataaaaattaagaaatcaatattgattcaataatattttctaacctacagacctcatttgaatttgctcaaatgttccaataatgtccattatggtaaaataaattctatatcatacattgtgttcagttgtcaagtgtctttagtctccttcaatctggaatagaattttccacacttcgtctttcacaaccttgacatatttgaggagttacaggccagttgttttatagagtgtcccctaacttgggttgtctgatgtttcttcacgattacattcaggttatgcattcttagcaggaatagcacagaagtgatgttgtgacccctacataatattagttgacttgttccattactgttgaagttaactttgattacttggttaaggggatgtctaccaggtttcttcactttaaaaggactatttttccttttttttttttttttctgagacagagtcttgctctgtcacccaggcaggagtgcagtggcacgatctcagctcactgcaacctctgcctcccgggttcaagcaattctcccacctcagcctcccaggtagctgggattacaggcgcccaccatcacaccagctaattttttttgtatttttagtagagatgggggtttcaccatgttggccaggctggtcttgaactcctgacctcgtgatctgcctacttcagcctctcaaagtgctgggattacaggcatgagccactgcacctggcctttacttttcccttaatagttaacaaatatcttgtgaggagatactctgagactatgtaaatatcctcttcctctggccgggcgccatggctcatgcctgtaatcccagcactttcgaaggccgaggagggtggatcacctgaggtcaggagttcgagaccagcctggccaacatggtgaaacaccgtctctactaaaaatacaaaaaaattagctgggcatggtggcaggcacctgtaatcccagaatcccagctactcgggagcctgaggcaggagaatcacttgaaccagggaggcggaggttgcagtggccaagatcgcgctgctgcactccagcttggcaacagagcgagactccgtcttaaaaaaaaaaaaaaggccaggcacggtggctgatgcctgtaatcccagcactttgggaggctgaggcgggtggatcacctgagatcaggagtttgagaccagcctggccaacatggtgaaaccagtctctactaaaaatacaaaaattagcctggcgtggttgcaggcgcctgtaatcccagctacttgggaggctgaggcaggagaattgcttgaactctggaagcggaggttgcaaggagccaagattgtggcattgcactccagcctgggttacaagagcaaaactcttgtctcaaaaaaaaaaaaaaaaaaaaaaaaaaagccctggttcctttagggagaattgtatttagaacaatctgggttctaggtgtactaatttgtactggagtatcatggcttgtaggccctttcagaggacagactatcacactaatacacaaatgcacacatatgcgcgcgcgcacacacacacacacacacacacaaatttataaaactatgtgctcccattgatatttccaattctgatccagcactgcagagttcattctagccatccccctttccatatttgtttatttatttattttgagacggagtttcactcttttcgccccggctgaagtgctatatagcacaatctcggctcactgcaacctccacctcctgggttcaagtgattctcctgcctcagcctcccgagtagttgggattacaggcgcctgccaccacgcccagctaagtttttgtatttgtagtggagagggggtttcgccatgtttcaccatgttgtccaggctatactatacatgggtgaagcaattagatataatagggaggagtagagactgtggggggtggggaatggaaattgcatgcctctttttttttttttttttttaagatggagtcttgctcttgtcgcccaggcttcagtgcaatggcgtgatctaggctcactgcaacctccgcctcctgggttcaagcaattctcctgcctcagcctcccaagtagctgggattacaggtgcccgccaccatggccagctaatttttgtatttttagtagagatggggtttcaccatgttggccaggctggtctccaactcctgacctcaggtgatccacccacctcggcctcccaaagtgctgggattacagtcgtgagtgctgcacccatccgaaattgcatgcctcttctaaagacattaaaaataattttaagggctgggcttggtggctcatgcctgtaatcccagcattttgggaggccgaggtgggtggatcacctgaggtcaggagttcgagaacagcctgaccaacatggagaaaccccgtctgcactaaaaatacaaaattagccaggcatggtgccacatgcctgtaatcccagctactcgggaggctgaggcaggagaattgcttgaacccaggaggcagaggttgttgtgagccaagatcgcgccattgcactccagtcttggcaacaagagcaaaacgctgtctcaaaaaaaaaaaaaaaaaaaaaaaatttaaaacagcaacaacaacaacacacggtgctaatcaaagatgtctgtgggctgaattcacttcaaaggcagctcccatttgtgaactttagcttagattttacaattgtctttgtgaattaacatttgcccttgaaaggtgtgtttgcatgtgtggatctaggtcagtgtgttccaacagttactggctggacaattttaaggataaagaagcatatttgtcactcacagtggtgaggaaacaaacacttggagggcccatgtacccacctgggctcttctgtggcctggaataccaaaagctatgacaagtttgcgagagttgtctgaagcatttggaggtttttttgaccaaataactcagacttggagaatgaaccactgggagaggcaagagagagttcccaggatgagaccaactctgtgagtaatgactggaggttcccaaaggtaggtggatgaccacacaggagaagttaggaaatggcaggactgtcagacctgtgggtagggtaaaaagattataaattaggttttctacaaggcaaccccctgggaaggaagtaatatcttgatagctttcctgggacaatcagaaaggtcatttagcaagaccatcactgatactctaaaacttggatgtacaaaaaatccataacttgatccattagtatgactaatctcattttgtttcccaacacctgacttccttttatggtggtagttgcagggcaagggactcattttgctcgcctcccttgtagagcctttgtggtaaaagttcattaagctaaaaccatagtgacatgagaaatttgagagtggaacacagactttattcttaaagcagtgagtctgtgtggccatgagtctaggttcctaatgaatgagattaagtgaaagtattgatgggacttctaggaagacagcttaaatagagctcctacctatcaaatgcactataattgtgcaaccagagcagactgtgttatgtttaatttttccctcttcctaaaatattatttccttaagttacttcaacgattcactaagtctaatagacttatactatcttatgtggtgaaggtgtggagaatgaggggataaagaattaaagaaaaatgtgccttgcctcacatttactcttttgctacacccatcacagggaataatatcctacaaaagaaagtgtgtccaggagtttggggcagtgatctgcaattaagtgagtggggacccatgatggagcagatggttgggggagagcatatgatgctcctgggaacagcatgcagtttccaagtactagggtgataactctgaagggacataaaccaataaccctccacctctccacctacactagagtaaggagagaggctaattctagcagtagtcatgctaagtggtattcttttttttttttttgagacaaagtctcactctctcgaccaggctggagtgcagtggcacgatctcagctcactgcaacctccacctcccaggttcaagtgattctcctgcctcagcctcccgagtagctgcgattacaggcatgcgccacaacgcctggctaattcttgtatttttagtagaaatggggtttcaccatgttgcccaggctggtctggaactcctgacctcgtgatccgcccgcctcggccttccaaagtgttgagattacaggcatgcccagccccctattcttttagtgtgcattaaaaccacataggggatatgactgttactacgttggtaaaatattataagggggccgggcgcggtggctcacacctgtaatcccagcactttgggaggccgagacgggcggatcatgaggtcaggagaacaagaccatcctggctaacacagtgtaaccctgtctctactaaaaatacgaaaaattagccggatatggtggctggcgcctgtagtcccagctac

SEQ ID NO: 3008 - DNA, 6904 bp, Homo sapiens
gcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggagttcatccaatttttcttttctttaaacttccataatactgacagctataatatcatatactgccatgatggttccacatacatggatcttttttcttccgtatagtcataggtgtgcactctgatttcatagcacctggcctcatgctgactctagtaaagacttaatacagcggacccttgaacattgcaagggttagggatgctggtcctccgtgcagctgaaaatccacatgtaactttggacttccctaaaacttaactgctaatagcctcccgttgactagtagtcttaccaataacatagtcgcccaggtctgttacccacactggaaattgttagcatgcttgtcaaggcctgtagcccctgactcccctaggtgaatgtcaggatccctcccaggagtatgtgtgtgagagagtgtatgtgagtgtgtctgagtgtatgtgtgagtgtgcatatctggtgtgtgtgtgtctgtatgtctgtgtatgagtgtgtgggtgtgtatcttggtgtatgagtgtgtgtgcctgggtgtgtatatgagtgtgagtgtgcataagtgtgtgggtgtgtgtatgattgtgtatatctgggtttctgcctgtgtgtgtatgagtgtgtgtgtgcgcgtctgagtcttgtgcgtctctgtgtgtctgggtgtatgatgaaatgtgtgcatatgtgtgtgtgtatgtgtgcccaggtgtatgtgtggatgggtgtgtgtgggatgtgtgcatgggtgtgtgtgtgtgtgcatgtgtgaccaggtatatgagtggatgggtgtgtgtggggtgtgtgcatggggtgtgtgcacgtgtgtgtgtgtgtgtgcccaggtgtatgagtggataggtacacgtgtgggatgtgtgcacatgtgtgaatgtgtgcccaggtgtatgaatgtgttgatgggtgtatgggaatgtgtacatgaaatgtgtgcgtatgtgtgtgcatgtgtgcccaggtgtatgactgtgtggataaatgtgtggggggtgcgtgcacatgtgtgagcgtatgtgtgcccaggtgtatgagtgtgtggataggtgcatgtgtgggatgtgtgcatggagtgtctgcacatgtgtgagtgtgtgtgcgcccacgtggatgagtgtgtggatgggtgtgtgtgggctgtgcatggggtgtgtgcacatgtgtaactagatgtatgagtgtgtacatgtgcacatgtgtgcgtgcatgtatccacatttgtgagttgtgtgcacagaggctactgcctccacaggtgtctttttcacatgcgtcagcgtgacctgccaagactcacagttccacgcgtctgggggcgggactttctgtctttatctgctggtttaatgagtttgactccttataagaaacacattttcttatttttttccaagtgtttagttgggcacctgctgtgacccccaccaggggtcacttacaccaaggtcgtcccttcccgccttcccatccgtgtttccctgtggctaaggtttcacttccactcagcagggatatgaaagctgctcctgtctcttgtgattgagtcgtaagctgggggtgaaaaggagacaatttttactggagttggatctcaggaggtgaggggagaactgggttaagcgggggctttagccatggaaaaagtagattcttaggctcagcttctgcttaaggctaggcagggattgggggtggtgttgggagagccctccatgctgagttatggttttggctttgatgttgctggttttaggaggcaccaacaaagctatggacaggaggatttgggagagatttacttacccacggtatgtaagagaagattggggatgaggagtgaggagaaggctggagaccagttagaggctaccgtagcagcgtagagaggctgaaaatctaactagggtggaagcagccaggcaggctggtcctaatgttgggagttgttcagatctggtggagaggtcattacttatagagttattaatttataccccaccttaattgcaaagagattcaaagcagtaagccatcactttagaatttaatgttctgttttcctttttatttactcattcagcagctatttcaatgcctgctgtgtgccaggtgctattcttagtgctttacttgttgtatgtgttatctaatgctgtgtaacaaattactcctgaacttaccaactcacaacaacatttattagctcacagtttctgtggagcagggatctagatgtggcttagttggggttgctggcctggggtctctcctaaggctgcagccctttcattgtgagagttgaatgacaattgctagacatttgcctatgtagttttagaaagattctaactggagcagcgcttggctggaggaggtcaattgtatgtctgcggaaagggttcagacagacttgtcatcatttcctggcgctgaccctggctcttacctggaaagcccctaaaccacccaccccagggatccacggtgcagggaaggtggtcatgcagaaaacaacctctagcgagttgctcggctgaggccctctgtaggtgaccttgtcttgcctccaaaagactggacctccttttcttcttcagtggtaaaaggagtttcttggtgccaccgtgggctctgggcagagactgtgccttcctcccttttgtgtctgagtcgccccgcatgctttggcgcagggagtttgggccagagcgatctccagccccttccagttcactggctctgtgataaggttcctggggattttgtgtcatgttgcttggaaaccagatggaaataggccaattaccattgaagtggggcggctcctgaatgttccaggaccaggagatttgagctaggcttgggaccttctctttgctgggtctctccctggtcctgcctcctaagaaagagaaaacattatttcatttgtgtagttttgctcttgctgagttttaaacgtcaaaagcagcatatgtgtaagcctttgcctcctattttgagtattagggcagtgacattttctttagcctggggattgccatgcacagtgtggtgttggagaacattaatactggaggaagccttgagttctacgccatgttctgttacaggctgcatctgtcccggcacacatcatagagcctttcttcccgggcctcagtttctcctttgataaggtggaagaaaggactagatctttcttgtaaggcccttctgggacttaacaacattcctgaatgggcccacccttgtttcccattgatcccccgtgagcctcctttctctggcctctaggcagttgctccagccatgacaagcaggtgtccactgagacctcaagatctgataagcagggtttgacaccagggaaggggcctggaatgaaaattgtttccaaacacccttgtttatgacttccagaaatggttaaagctcttctaatcagccagcacagataggacccctgccgtgaatggagccactgggatgatggtatttggctacgagggctccagagcacaggcctgccctggaggcattagagtatttttccctctccaccctggtcttctcctgtaacgtgtggccgccttttccagcacggcctcctgccttcctggtgcactttttggagaacgtggtggaatcagaggtttctggctgactcggtgggtgctttgaaccaggaaaggacaagaaagagcagagccatttagaggatttgcagatggaacttcccctcggggtccaactgtgagtcactgtggttcctgtccctgcagcgggctccatctccaggcctcccacttcaccctgggacattatggtcgctggtcagacctcatgactcacttggactcttgagccacctctgggggtggagtctctctcctggcatctggacccttggtgctatcgacgaagcttggctggcgctcttagctgctatgtgcaagacgtgtgtcccagggaaagcccctctctctctgcagaggtcaagtgaaagccacggccgcagccaacagagttcaaaatgcaggcttggaaagtccagggggctctgtggaggtgagacagccacaggctgagctttctgagcccttggggtgagtttggctgtgatacctgagagatgggggaactaacaagcgccgggttgcagtgtcgtcccatgcagaggagcgagcagagttcacccaaaaggccaacggctggcagggtgtcacgtttcccaccacacccggggctcagcctctgctgtcatttctcctccttggttttcatcttctaagggaagaaatagtgtcatcttttctcaacctgtcagtctcacacctgcctggagcccctggcagtgagacacccagtgctgtttaatctgatgtcatctctgttgattgtctgttttagaaaccaggtagcaagagggactttctgaggattaaaaaaaaaaaagtaaatccccaaactatttcggggaggatcacaacttttttttctttttttgtcctgtttagaagatcaggttcaagttgccagccagactctgggcttccaggaggagtgggctgtggatggcctggcctcatttgcatgtccctctcctcccggccctgcaggtgccacctcctgagtcctggttcctgcggctccgtcgaatctgcagtgaaggcctttgggaagcgtgggttatgtgggtccaggggtcccatcctcccgtggaggcccttgacctgaggatcactaactcacaccccaccgacttccggcccccaacaagggcagtgttcctcttgctccattctgctctgaagtcccccaaaccgcttcctggggctgcttagtgaaatacaaggctcatctctgaggacctctacagggctgaggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattatggggaagcagttgaattttaaagagtgtttcatacactatcaggtggccatgaatgtcaatttcttaatgagattttgtgctaaatgctttttgccctcttccccatgtttgttctggtttaaaaaaaaaaaaaaaagcacagtgcagggaggcagagagacctaagtttttgtctcagaaagctcctcatcatcttaattccttccgtataaaatgaggggtttgggccacacgatccctggagcctcttctattaatagttctga

SEQ ID NO: 3009 - DNA, 868 bp, Homo sapiens
cagcagggtcagaagggaggtagtcgccctccgtcgtggcctggcgtggattccgagcgttggtgtctggcggtttccgaccgttggtgtctggcacgcgccaccccgatgtaccaggtaaagccctatcacggggtcggcgcccctctccgtgtggagcccacctgcatgtactggctccccaacatgcacggcaggagcggcggcccagcactcggcactggccacttgcagacaagaagacaagaaaatgatttgaggacagcttcaatcgcggtgtgaagaagaaagcaacaaaacgaccactgaaaacaatgccggtggcaaaacatccaaagaaagggtcccaagtggtacatcgtcatagctggaaacagtcagagccaccagccaatgatcttttcaatgctgcgaaagctgccaaaagtgacatgcagtgtggccatgaggtctgccggaagtgacttgttggtgttatctcctgagttaaaatgtgaagggatttttttttttcagattactgagagtcttcagttactaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcaggtgagtgccgg

SEQ ID NO: 3010 - DNA, 2685 bp, Homo sapiens
gttaccacatgggtgagtttaagcaggagaggagaggaaagtagatgaattcaggtaaatttggagatatgacaataggtcatagtgataggctggatgtgggatatgagggaaaaagagcaatcaagggtgatgcctaaggttcggggctctagcagccagatatataacagtgttatttactgagatgggggtaccaagaggtgaggaagaaaggaagaaagtaaggctgggattaagagttatgatttggatacattaaatttgagatgcctctcagattcaagtctggaagtcagggctacagatgttaagttagcaaccagaaggtatttaaagcaatgggacccaatgagattactcagaaagagtacagagaaacccaaggatgaagcattggaggctttccaacagctagaggtcagctgttggaaaccagcaagatgcagaagaaatgagaacatgtgggtgcacatgagccaataaaagaaaatgctccaagaaacaaaaagtgacctattgcatcaaatgctgctgaaagtcaagtaacataagagagaattaaccaccccatatggcaagatggtgattggtggggacccttaaaaaggtaatttcagttggctggtggggaggacagccaagtgaatgggttgcttaaataatggaggatgaggatgtacaaatgagatatacagagagttccttttagaagctctgctgtgaacaagagcagagaaatgaagtaggtaggatagtagtcaaggaaggtttttgttgttgctgttaactttttattttcaaagatatagaaaagtagagaaaacagtatcatgaagccccatgtcacttgctttgacaattatctgcccctcatcccacttcttccacctattccccaactcattcccaactctttacccacaggattattttgaagcaaatcccagacatcattgtaaggaacaattgtttttaagtgagaagtactatttgttatgaaaaaaggaaaacagaaaaccctgttatacagtgctctcactgagaaaattccagctccatcactttagcagactgtctttaataaaatgtatgaactgtattcttcctttaaagcaggattctcaaactatcgcccacagcccactgaatggaccacgaggggtttccacctgaacagcaaaccaatccagcaaagcacaggtccttccatttttataaaggatagaggaagtccaagttcaccttttgttttctagctttatatttgtgcataatatagcttaagtaatatagcttattaagtaagttatttaggattactaaaagtagtacatttctagagtttctagataagaagtctgattgccacacaatgcctggcactgatgtggaacgcatatgctgatggttgcaatttctgtaaactgggggaaggatgcataatcccccgtgcacgtcttgagttgcttatggtttgcaattctatttttgttttttcactataaattattaagcttcattagcaatttatggtgggttatctggctaaactctgagtatataatgatacatatgtgactattaagaaatttgcaacttgttcaatcttcagttatctgtgatcctagatacaaagatttgagacagaaaaaaattaaatccagaaaattctatatattgttaacattttctgtggattcaggggaaactttaattttatggaaaacctcaatccagttaagacagtatagcagttaagagcctaaatgggatctagagagtgcaggttcaaatcaaggctttgctacttagtagctacatgaccttgggaggttatctaacttttctgtctctcagtttcctcgtctgtaattggggattataatagcatctacttcatatatttaaatgagtgtccataactgaaacagtacctggcatatattaacttctatatttttccatagaaaatattactgctatatccactacaacaattcctacaactattacagtttatgacaccagggttctgagagaggacaacctgaaaatcatgaatatgactgaaatcttcctaagtggtagatctaaataccataaatggtggctagctttataggaaaacccatttaacccgtaatataaccaaactattcactaagagcactagcttgaattttggatcttggaactatttggtgcagaaagcagcaagataggtatccttctctgaatacaggccagccatagaaaatgttctataatagatgaaagagggtctccagcatcttctttcctcctttctgtaagcctcttctaccttctaactccttgctttctaagccccaggtatctgataacttgattttgtcctgagtcctcccctgtaatacttagcaggccagttctcccctaagacattctatttttcaaaaatgagttattctctaggatgttccacttccagctattgtgaagagaaaaatgcttttataaaatgtatggttacttatatatggctaataacatcttaagattctcagaagtattcctattcttaaagttcttatcagaatctctagttattggaaattaaggcagatcaacaaaaagttaagtgaaaaaattcaaccagtctgggccaccatacagccttgtctggaagccagcctggagact

SEQ ID NO: 3011 - DNA, 605 bp, Homo sapiens
tacaccaaccaggacagaaatcattatcttagccaccagaacacagaatgttcttggtgagaagggccagtgggttggggaactgactgctgcagttgagaagaggtttggttttccagagggcagtgtagagctttatgctgataaggtggccgctaggggtctgtgccattgcccaggcagagtctctgcgttacaagctcctaggagggcttgctgtgaggagggcctgccatggtgtgttgcaattcatcatggagagtggggccaaaggctgtgaggtcatggtgtctgggaaactccgaggacggaggactaaatccatgaagttttgtggatggcctgatgatccacagcggagaccgtgttaactattacattgtcactgccatgtgccatgtgttgctcagacagggtgtgctgggcatcaaggtgaagatcatgctgccttgggacccaactggtaagactggccctaagaagcccctgcctgaccacgtgagcatcgtggaacccaaagatgagatactgcacaccaccccatctcagaacagaagggtgggaagccagaaccgcctgccgtcacccagccagtccccacagcg

SEQ ID NO: 3012 - DNA, 1792 bp, Homo sapiens
tgtacagcccacggtgcctgtgggctgtgtgggggccctgctgcagacgcgtgctcagcacctgtcacccacagctaagtcacaagagctgctggcacctgtttgcaggggaatgtggcaacatgcacccgggtgcatccagacagcctgggtgagcgggagagccacaaagaaccaacttcattcgtgtgatttccagatgcaggtctggttcagttcttgatgcccgagtttcaaagtctcctacctgaccaagtgtcctcggcctagtttgtactgaccttctttgaggagcacagatgggaaacacattggtggcgaagatctcctgcatcaccccgaggctgcgggagatcccttgggagccagctgtcggactgaggaggaggaggggtgccacagtctcgaggggttcacgctgctggccacagccctgcatgccccctcggcgctccccaagctctcggggacgattcagatcagctttccccacagcttcagggcagaggctgaagttgcagacagcaacgatggaggcctgcaggtcaggcaccgcggctgtccccagcaaccctgttctcagagactccctctgcgcctggagctagtaccagagagccccggagctgggcctggaggactttacatcctcctcacagagggccacgctcttgaccacccctacatctgtctctgcggcgataaactttccctcgactggacttctggccagatttttttttgagacagtcttgctcagttgcccaggctggagtgcagtggcgtcatctcagttcactgcaatgtccacctcctgggttcaggcaattctctgcctcagcctcccgagtagctgagattacaggcgcctgccaccacacctggctaattttttgtatttttagtagagatggggagtgggggggcgggtctcaccatcttggccaggctggtcttgaactcctgacctcgtgatccacccgcctcagcctcccaaggtgctgggattacgggcatgagccactgcgcccggccacttctggtcagactttaacagacgagctacacggtctaagccagctggggctcaccagcgccgggcaaggccagacctgcgacctgtcgagaagatgtggtcctccaggaaagctctacttcaacgacaaataggtggggttacgttcatttgggtgaaatgcatcagcttttaaaatcacagaatgaagtgagttcactgttaattaaagggtgccaaggtgacaggcctggaacaagagcccttcattttcaccaacaggaccaggcaagagacgggaagcccttccaccgaccatggccctctgtgcctctctgcaccctcccaccccacccacgagggccaggctgtgtgtcggcccggcaggaaattcaggctgacgtgggaccccacggtaactgcacctgtgtcccgctttggttcatgttacaacacacatccgaaagaaaaccaaagggagaaaataacctccttgaacctgcttaagaaaaagcacctaagttttgggtggagctgtttctactactgtgaagtcagccactgagccgcatttccaacacgacttccagcaaatcaccgtcagccacgtgccgaggctgccgggcgcgtgagagtctcacaatgacaatgtccgggaaggatttccaaacgtcagggttaagcatgggagcgattctcgtccccgccacacccggatccgccaggacagagaagccggtaccccagcgggtggtctgcttttctgcgcagaagcac

SEQ ID NO: 3013 - DNA, 574 bp, Homo sapiens
ccccccaccctccacgcaaacagcaacgctgggcaggcgaaaaccaagggagtgggaatcagcagcactttggcctggagggagaagggaagccacggtggagagacagcttggtgaaagcagatggcggggcagggccagggctggtcctcagcctgtgtctgcacccaccctcccgggcagcttgggcccaactgctccgcccccccaagatggagggggagagctggcctctggcacccacatgcaggcctctgccacgaggaaaggaaggaggccaggaagacggctgggccccaactctcctcacaggtggcagggagggaacctgttcattccaggaaggaccaaaagaaagaatccccagtgaacaccggcagggtccctctcccttaccctaccagcttctccaggtgactgcagcccaaacccagggataatctgggttttaaatgccaggacactttgcctgtagggacacgtgttgtgacacgaggctcttcctaagtcaggagctagtataagcccagcctgctgggggttccggaggccccaggtctagaggtgtggaggg

SEQ ID NO: 3014 - DNA, 3044 bp, Homo sapiens
gttccttccccttcccagcccgcagctcctgggagagaagcagaaatccagtcccctcgactccctggtctcgcctggaacttagctctcacctgggactcagctcccagagtgaaagggattgtcctgtagcgtgaacgatgagtgacacccgcaccctcccttgtaaatctgctccaacaagctctcctccaggacgctgtcttttctgtgctatcgagcacagccctgacattacagctggccttgcagacatcaccagacgacacccaagaaaaatggcagcgccagagccgtgagcatcacaggaggtctcagggacacgccaaggccgcctcccaggaaaaagcagaacaccggaaaagaccttgtgaagacttcttatcttcccctccaaatggtgtctcttgctttggctcttgtcgagttggggcttgttggaagaccaggtgaaggcccagctgctaaagcttcccctttctacttcttgttactctattactcaattaggactggtgctgatttaggggaaaaacattatttgaaaacacagaggttccctctgctttgatcctacacaggcagagatatctccaagcagagagatccaaaaaagagcgccccctgcgggaaacgttcttttaatttagactttgccgttcctcctgtggagacgttgtcacagttacagtagtgggtgatacatccccaaatttctgccacgtgctcagagagctaaggcatatcccacacccacgacaagcttacaggtgtgaacctgggtccaggcaggtgccctgttcctaactctggtcttggacgtgtgatttaagccaggcctcagtttccttgctcacagatgtggatcccaggagctgcctcaaatacttggaggcatgaatggttctaaatcacgcatgccatgcctgacacattaaccccccattctcttcactgtgcagggtgaaacaacagacagcaacccagcctgggcagcacatgtcctgcacctgggctgtgcagatactgagagcttcctgcctggagtggaaattcctgcagcatgcatgcagaaaggagatggccaggaagtcccaggaagatgtagaaagtagaaagggaggcaagagcgaggagttctcatttgggagaaaggctcaccagtgaggcaggaagtgacctttggaaacatgcgagaaccaacgtgcatgggtcctcaccaacttactctcagcagcgaggcctgccaacaagaaggcataggctcaccagctgcacacggctaatgctcacccagcaccaccctgcctgtccgtgcatctgctgtgcacgtcagaggtcaactacacgtcccagtggtagccatatgaggacagtgctggtcccagagaacaacactgatataagacccagagactggaaatctgccactccacactccttccctcagagaaggtaagaaatgagaattttataccctctccagctctgaacatgcctcctagccatgcctcttcttcacaactgtgagatcaccgcaaacataattcagcacacagagcctgaatccttatttccagataacatgagcagaaacatgcagctctctctgcgccgaaccaagtcccagtgactatatcacaccacaccaaatcacacagacgtggaaaactccaccagggccagcactcttccctaagaactcaactgcctgcatgcaacggtgctaactttcccttgaacaatccgacagagccgcgtgttgatgggaacgtcccctgacctttcaatcaatgtttatgaatttgtatcgcaaagcatcccgggaaactgtgcatgctaactggcccgaggatgatcttgcatctattatgaagcgaatggcccattcctcaaggaggagttctcccggggataccgtctgtctagctaggattcaatatacatattttgtatacctgtattttatatagataatttctaatcattttaattgttcaacattcttaccccagagcctcccttttcagacttagaaattgctgcagaaaacctcattcttctatgccagcaggaattaaaggaaacacccttggcccaaacatgaaaggaactttaataggaaacacactgtaatgggcacacacaggacccagggtgggaaggacgcgtggcgggatccccctacccacacccacaccacacgtgccacacagccatgccgtggctcatcccagggttctgccgatcagccaaagcgcctccctgcctcacgcctgcatttactaacttcagaagacaggactaccaagtggaaagaagttgagaatgccaactgatgggcacagatggagaaatgaaattagaagattgccatctgacaaccattgtaataatacttgacttgggtaagaatcatcaatgcatgcccaaactaggaggtgaaaatttgatgagtcaaaagatatgaatatagtccgaaaaaatcgccccacaattacttgttcatttcaaaggaaatagagcaacctacggtgggaaaaccttacagacaccaccttaaataagatatcaaaatgactatccccagcaggacacactgatatcacgtgcctcttgatatgatgcatggcaaggacacaacatcacttctctaggattctggccaaaattctaattatgaggaaacatcaaacaaatcatagtgatgggcactgtacagaaaacctgttctgttctgaaaaatgtaacggccataacaggtaaagaaagagggaagaaatattctagttgaaaggaaattaaggagacagagcaactacacacactggaggcctgggtggatcccagaccaaggtggcagtggtccacagtgtgccagggagcaggtgaaactggaatgttgatgccaggttagacgccgatactgtgccaactgcgaatatcctgattctggtcacggtcctgtgcctctgtaagaaaatgctctttttattggtaaatacagaaagagagaaaataataaagtaaatggagcaaaatgt

SEQ ID NO: 3015 - DNA, 2600 bp, Homo sapiens
aagtgccggccctgagaggtggagtcggggtggcagcggcggcggttgccaggagcccgcgttgcagcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtttcatttgaaacctacggggaaccaagcactgtcgctgccctccaggaattcatactctactgctaaaaatcgtcatcatcattatcctcttaataagaaaagcagtccccattatttgttgctttctgcgtgttctgcactacgttaattgccctacatgcattagctcattgaattcttacaacattcctttgagacggataccgtgatcatccctcttttacagaggacgaaacaggtgtggggatggtaactggcttgccaagaacttgcagctagtacgcatctgaataagaaatcttcccctttaccgcttttacaagaagtttgcgtctttggcggaactgatgggcaaagaaacactaggttctgcaaaaaaaaagcaggatctgttctgtgttacttttaccactcttttcagtgacatgtctggcagagcacgggtaaggagcagataggaccatgagtctacggggtttgcaaagaggctcatttgcacaagggtcagtggttctctgtggtataaatggagaagacggcatgtctgaacctgctgtagctgacaaattattactggaagtggaccagtgatgcctgatggcaagatatagagcagtagatttgtggctggggtagccttgtagtcagggctcccttaaaataaaaccttgctgacagtggtaattgtagtgtgaaaggcatagtgtcctcttgcttaatcatgggatacagactgctcacttcttaaatggttacctttgcagtttaagaggtaccagtttctctgggactagagccatggtgaaatttccattctctaaattccactcttccttgctagcttcggtgtatagtccgccttctttttttcttctggtttacattattgtttgagcttattattattcttattcatttattcaatacttttatcaagtgcctgctgtgtgctgatactgttctgtgtaatggggattcagtgaacaagactgaaaaggtacctgtacttatggcgcttacattttggtggaggaagacagacaaaaatcaaggaaataaacacgataatttcagatagtggtaagtgctatgaaaattgggaaacagcagggtaatgtgatagtgatagaggcagagttcatttagatggggtcatcagggatgccttctctgaggaggggatatccaagccgagactgaagaataagaaggatccagtcatgctctaaggatcatctagtaatttgtataatctccatattagcactcatatttgaatgagtaatgcgttgtcatatgctgtgttgtgctgtaataataatatagtactatacatctgcaagatataggacatatatgtactatttaagggatgtgaataactttctgaaacaatgaggcatagctctatgatgttgaaagaaaaataaaactatggccataaaagtattatatttccttaataatttccctcacttctaaaattgaatttcatgctttgcttgagtatccatagaagatatattactttatttgtataatctatttacattctgtgtattgctgaatgcatggcatgattaaaaaaataaaatatttgagcagaaatggggttaagaaataatgtgagttgaaacctagacctaaaaaaaggctatgccttaaggtgttttattgtttttacttttgcttttttaaaataaataaaagcttgtaaaatagtctcactcacactgtagagaaccatttgtttgtcattagattcctactttgcatagattgaacacaaataattacaattgattgaatagtaggaagaagttttgttattgattaaactatttagaaaaaatagcattatatcttatttttttataacctgattataattttgactattttttttttcccatttctcattgcactataatttgtccctgatactttggtgtactgaatttttaagtactttgaggcctaccgaggacatatcctatttcatctttgcatatcccacatcatgaattgaatttccctgccctctctttttttgttaagaagctaattattttaaaatgaagacataaaggaacatgattgtattctattttctgtttccatagttcatacccttgctggttatgattctgataatgtctttttattttcccttgcttatttaaaggaaacagtgccacacataatgctgtgcaaataagcaatcaacatttactgtttgctaaatgaatgaatatgatgcctaatccctcctggttaccttgtattttcataatcacaatttcccagaaactgtgaaattactgggattgttttaagtagtttggtgatggttccaattttcaacaataaaatataattaatatcaga

SEQ ID NO: 3016 - DNA, 2421 bp, Homo sapiens
ttatcattctcctctttctgagaattaaggacttgccttgtgttttaatccccttcctggccccactccatgcacacggagccggggccgtcgtggctgctgagtggtctgtgcatggcttggctgtgttggtgctggcacagctgcgggtgatctcgtgctagggccctcaggctggcacctctgggcagtcttgtgaaggccgcactggtcatcgtcttcccccaagtggccgttgctcggccaaccagtaactactaaaagcctccccacccaggccctgggctgcgtctgttcagcctggagcaggctcaccctgcacctggggtctggagtgtgctgggggccgggctgtggggtgtgggtcgccaggctcgtggctgctctctggagacgggtcacacgcgttggcagacccctctccgggcctgtgggctgaatgctggcaggggtgctgggctccgtccgtccactgctgatgcgagctgggtgggcttcccttgccttcacccactcaggttggagtagggatggagtcgctgctcctgaggggttctcgggggccaggacgggacttttaattccctcttgagacatcttcggggcctgagtgtgcagggtctgagcccactctgtgatgagtatggggagcatgtggagccccagggcagctcagcgtgtggctcaaggccttctcctgtaggtttttaaatttatttgttcccttgccagaaatgagtatgacacccccaactggccacagttcctgccttaaaatgaccgaggttaaaatgagaaacacagagcttcccttggaggtcacggtacattccagtccaggagagacggagccggtgtctgacttgagtctgtggagggcagcagtgcacccgcccaatctgtgcattcccttctgagcttgatttagcccctctgtttcagtcagtcatgctcattgagaacagacagcaagtgtatgaagcgggtggaggctgattcagcccctgtattgaaaagtcggtcgtgctcattgagaacagacgggaagcgtacgaagcgggtggaaaatcccgcagtccagccattcccttcaaaacatgcctcccagccactcaggaggctgaggcaggaggatcacttgagcccaggaggtcaaggttgcagtgagccatggagtccattgcactccatccttggtgacagagtgagacatcgtttccaaaaaaattctacagaaatgctctatttacaaatttacataatttcctttggaaatagatttaaaaattttttaaggatgaggtaggtaggcaggaaaacggggttctttttggataaaaaaattcacatggccgggtgtcatggctcatgcctgtaatcccagcactttgggaggccgaggcaggcggatcacgaggtcaggagattgagaccatcctggctaacacggtgaaactccgtctctactaaaaatacaaaaaattagccaggcatggtggcgggcgcctgtagtcccagctactcgggaggctgaggcaggagaatggcgtgaacccgggaggtggagcttgcagtgagccaagatcgtgccactgcactccagcctgggcgacagagtgagactccgcctcaaaaaagaaaaaaaaaatcacacacccctttagctctgacacccagagggcccccagcaggaacatcatccccccgttgtgactcccatgggggacctcatcggggggccttgggcagatgtgttgtttcccgttgactgacaaagtcaggatttttagggggaaaatactgagatttgccttattttttaaacattgagatgatggaattgtgagtggtgttttgtttagctgtgtacagtacttgcagcttcatggtgagtgaggccagacacactcagacacggcgatggccccggattttgtgttttaaagtgtttcgtcagcatttttgacttcatgttaacacttgtcttttgaaccaaggttttttctttttaaaacctgatttcctattccctggagctctgctcctgtgaacatgtttttgtgtctttggtggccccttcggcctggtgaagtttccgttcaaacgcggccggtgcccacgtggacaggccgcccccgtgtttgcactcacaggttgcacatctgcccccatggcaggctcacggcatcctttctttgccttcacagagcctgtctaaagacccgggcttgtcaagaggagcatcttcatggtgctcagcaaactactacgatcggagccgactgcagtttgttaagttgatttcatttaacgagtaactttggtgtctgcttactgtaaggactatgctcgggaacttgggagtgaaaaggaagatgctgtcttacctgtctgtgaaacgtgctttgtaagatgtgttcc

SEQ ID NO: 3017 - DNA, 527 bp, Homo sapiens
cagctcttgggcgtcatttattttttgcataggcataaattaggatctggagataaaaaacttaagaaccaatagtgcagcatttgtaacagggactgaagtgctgtctcccaccctagctcctcctcttccaaatccactcccctcccttccagtccaagggtgaccctgacttgatcctcagtagagaggcccacaggatccccctgcagcccctctggccccaccacaggacagatactcacaaagatggcgaagtccttgggggcactggagatagtgctgttgggtgacaaggccttgggcacatgctctaaggtaacggctgtggggcggatgcgggcagagaggcggaccacggcgaagccttgtggcccctggaaggcccagcagttgcctgggtgcccacctggaggatgactcggggtgactgggagtggtaccacagggggatgccgaagaggctgaggagggccgtcttggtctcgtaggtctcagaacatcgggtgctgatgacgctggcccct

SEQ ID NO: 3018 - DNA, 221 bp, Homo sapiens
gtagctgggcaatgcctgggaagctgggaagggggaggcagaggaagaggaggaagaactggaagaggaggctgctgcagagctactactagaggatgaataaggaaacctcatggggggcgctggagcagaagaggaagcaggaggcagagagtggggtgaaggagccagagttgggcccttctctgggccaggaggaagtccacccataccctgtccca

SEQ ID NO: 3019 - DNA, 1534 bp, Homo sapiens
ttttaatacagcatgaagaggctatatttctataggcgagccgtatacagattctccaggaataaggcacacaacggaatgccatcccaagggctgcacttcggagacgtcggagccttctccacgcaccttccgagctgggcccacgggttctgttttgtctttttagctggactcacacgtatggacagacacagacacggacggggtcaccgcatgggggcggaggaggtcggacggcaaggttggcaacagagaaggataagcccgctgccacagcccccaggggaccgcttggccatctcgctgaaggctggaacacccccatttcaggaggcataatgtaggggcaaaatcaagagacccagttctgacagccgggagaaaggaagggtcaagaccatggaaacggggcttctcatccgggagacagaggagcgcacgatcccgccgccagccaggacagtgggctccctggccacggacgtgccacgaggcctctctgctcccttgggaggtaggaaattattgtctccattttagaaaagaggggttctgtggcttgtctcagggttctccatgtcaggggctaggagaccgaggtgagaaggagggggctcctccatgtttgcaggggtgggggatgaaaagcagggctggggctgcaggggccagcaggggaggactcagcatccctcagcttgacttcctaagacaccaagtgaagggtcacgatgcggggtacctggcacctgggaggtttctcccaccattctgggtgaaactccccaaataaagctccaggacacagcaccggccagcctgaatcccagaacaacagagctgaaatgggccctctgctctctagtgttatgctgtcatttaactaatggggaaactgaggcctggagatgcgaagtccttgcccaaggtgacacaatgcgtcggcagcagggcaaagacttgagccgaggtctccagaacaccaggcttgtgtcctttctgctggaacagacacgctgggcttccacactgggcccagctatcttgatgtggacccccagagtgggtgggaggcagaggggaaggaaagggagtggggctgacaaaacctaaggcagtctggtgggggtcgtgggaggggctgccccacgttcaccaggacgcatctctccagcattctgtgcctcccccatgcctaacccctcctatctgggtccatagcgtggggaggggggcacacccaggtgcaatgccagtgatgtcagagggggtctggatttggggcttaaggtgggcaagggacagagaggtccactccccagccgctgttggaacacatgtccccttgccacgattgctgactcaggaaagagggatttctgagagtggctttccatacagggcaaaccggaaggttctgggtgggggcaggcggcctggctggtctggggaggtttgggattcacagtcaatttagtgcacctgtggccaatacaaggctgctcaccccaaagaggctctcagaggcgag

SEQ ID NO: 3020 - DNA, 5050 bp, Homo sapiens
ctctcggataacggggcaggccggtggcccacgcagcccaccagcttgcagggagggcagaccctgggggatgtgagggaggctttctcacgcagaccctaaaacggtgagcgccagggagccccgcctgcttgtcccctccccagatccctcgggctctggagaccttgcgggccccctgtccgtgaccacctgaaacaggtcctggagctgctactgctggcttaggctggttggtggaaaggatccagggctgttgtgaaggccttggggagtccagaagccgcctggcaccttctgggtccagacgctgcccttcagccctgccatttcagccagcctcagcgtcgctgtagaggcaggccgccctttctgccactgtctggctggtaagtccaggctcatagccgggtcatgcattccccactcattgggtactggttttcgggcagtcttggggtggggacgctggcagggtccgggtacagggccatgtgttgggcaacccagtcctttccaaagccggggctagaatgctggccctccacacagtcggtaaaggtggggctgagagtcgaccccatgttggggtcaaagggccagttccactcccccgctcctcccatcaatcagacacccctggcccttccaacctggacacccctgaggcttctccaggccttgcactcccgcagccctcatgtatgtcagacctacccaggaatggtttcagggacagtaagaggtccctgaatatctgtaccccgcccccaccagtcctgagggctgtttttttgtgtgttttgcttgtttgcttggttttgtttggtcgggttttttttttttttttttgagacagagtgtcactgtcgcccaggctggaatgcagtgcaagctccacctcccaggttcatgccattctcctgcctcagcctcccgagtagctgggactacaggcgcccacaccacgcccggctaattttttgtatttttggtagagatggggtttcaccatgttagccaggatggtctcgatctcctgacctcgtgatctgcccgccttggcctcccaaagtgctgggattacaggcatgagccaccgcgcccagcctgtttggtcggttttttagagatgggctttcttcatgttgctcagactggtctctaactgggctcaagcgatcctcccaccttggcctcccaaagtactgggattacaggcttgagccacctctgcctcacagttctccactctccagcccctcctcttgggcttcctttgtagtgcccttttctttctttcttttttgtttttttttgggggacggagtctccctctgttgcccaggctggagtatagtggcgtgatctcggctcactgcaacctccgccttctaatttctatatttttggtagagatgtcccggctaatttttatatttttggtagagatggggtttcaccatgttggccaggctggcctccacctcctggcctcaagcgatccacccaccttggcctctcaaagtgctgggattacaggcatgagccactgggccggtcagtgcccttttctctgaagtccttaaacctgggcatgacttccaggggctgagttcttctctttattcaccctaccctaaaatatcatccagtctcagggctcccatccattcactgctgaccatcccaaacttccctctgtgcccagagccctctcctgtttcagagcccctggctgctttctggttgactcaccagtcctcagcattgtccccatccctacaaagcaccactgtctacccaggcatccacctgagctagagactggggttttctggagttctcaaagctggcaccaattggcctctgcccacccctaaagtcacctctcagccaggcatcttctgagtactttctctgcagacaccctctgttccagcctcctattgactcctttcatactgctcaccatggccaggcagcagtgtgcacaccatgtgtgctcatgggcctgaccctgcctgactgtgttgtctctaagtagtgtgcgggtaggaaccacagaagtccttatcatcaaggtgcctggctcatagtgggagttcaagaaatatttgttgaatgagcaagtaactgaacgtgtaaatgcatgagcccttggcatccccctctcctgccctcaccttcctttagctgcccagtcctcttgcttctttctccttaacatcttttgaattaattccctccccctaccatgcccacccactccagaagatagtccatactatgtggtagggcctccaaggcccaggagatctggcctcagatgacctcacctccttatcttgcacttattctgcggcccctgtgatctggcttccactacactcccagcctgcagctccctggatgcagcctccaccctctggcctctgccttttttcccagcctcccttctgcctaggatgcttctccccctcatccacttggaaaacagctcagatgtcccttcctccagggaacctgtgtcctctgagcacccattactgcctattgtccttgtccatggccaggcctgtgaccaccagaccaggcacagatggcgctgcagtgattaaatggaacacctgggagttcacctggctcttcccccacatccaaggggcctcgagggaagggcagcatccctccgagggtcacagggtcctggtggctttcaaagcctctccctaacaattggtgagctaagcacaggggaggacacagcttgaaacccacttcaaagaggagacacctgaagctcagggaaggcaagaacttcccatagaaactgtcacatcgttgggaagggcagactctgagctccaacttggctccctgggtcgtggtcagctcggccctgtttgaatcaggcatcatttcctgagccctgtcctctgcctgggactcagctggtagctgtggtgtgtgtagaaaggaattatgagcacttctaaccactgggagatcacattctcagaggggtggactcaggcctgagaaaaatccctgggacagacagcagagggtggtgagagccgcaatgaacccccagtcctcacacacggcactgctagttccatttcagaagtaatgcagttcaagtccgaaaccccagaaaaaccgcggcttccctcaccccaccctacagcccccgcggatgacaactctctgccatgcaacccccacccccatcccagctttctgtgaacagatagaatagaagcttgccctggactgtgcctggggccacatcattcattcatttgccagatatacagcaagcatttgtggaatgtcggctgtgcccgggccaccctggggtgaccagaggtgagatctccctagttccttcccacagggctcacagtcaaagagaacaggtatgtccaagtctctgcacctcccaagtccccaaatgctgagggtgtgtgtgtatgtgagtgtgtgggactgtgtctgtgtgcacatgtgtgctagttaggaagggctttgcagagaaggggcccttagcgtggctctttgttggggctccctaggcagacagtgggtaggtcctggaaggagcagctgaggctgggggagcaagagtttaagccacaggagaaaggagcagcctcttttgctgaaccagagcaaaagctggagaattgcgtgcggggccttggggccggctggggagcaaggattttacccttggggtgatggggagcctgggctttaggctgggggattttgtggtcatatctgtgctttgcaaacgtcactcaggcactgtgtgtgtgtatgaggggaggcaggaggcctcaaggaggctggtgcaatttccagcccagtggatggtggcctgggccagggtaggggccgtggggatggagaggagacatttaagagatgttcaggaggcagaatgcagagcttggtgactgaagggatgtggagtctggagagagggagacatcccagatgaggcaggggctttgggcctgggtgatgggtggatagtgggataatggtgttttttaatgaggtggggaggcctgaaggatctggttaagggaaaggtaatatggtcagtttgggcaggtggcatctgagggatctagggaccaccaaggaggaagtgtccagaaggcagctggacaggcagggagaagagagaggggtctgagctggagacatcttctggggggaacagtggtcaactgggtcaccaagagatcaagtaaggaaaggcccaaagcaccacggcctgttggagcacttcagtgcatggtggggcaaaggcaggcttggaggaggtaggtatgaggcttgcgggtatacttgacccaccaccagcctccacacccctccagccccagcctggactctactttcctttgtgtgtgtcaaaagacaagagccagggatgctgctccacattcaagtcctggctttaccactgtcatcaggcttctcctagagccatttctcctttctgatgctttaagtgcacccatccgtttaatcgttaaaattgctatttgaagaagtgccgcatctcattaataatcaacacaatgcaaacacaaacaacaggagacactatttttttttgtttgcctctgagatgggcagtgatgaacatgatgtgtgaggggacactcaagagagtaggaattggtttaaatgtttaagggtaggctgggtgtggtagtggctcacacccgtaatttcagcacttcgggaggcaaggtgggaggatggcttcagcccaggagttagagaccagactgggcaatatagtaaaacccagtctctactaaaaacacaaaaatgagcacgccatggtggcgcatgcctgtaatcccagctcaagagactgaggtgggagaatcgcttgagcccagtaggttgaggctgcagtgagccgtgattgtgccactgcactccagcctgggcaacagagcgagaccctgtctcaaaaaaaaaaaaaagtttaagggtagttttttcagaatttatc

SEQ ID NO: 3021 - DNA, 1074 bp, Homo sapiens
gaggccaagaccacagctgttacaggaggggtcagcgccacagtacatgggtggcggcggcggctgcacatgcatgcctggggaatgtgagtgttcagacatgccaggcatccagcctcaccaggaaacaggcacacggggacacaggcacaaacactaaaaaccctcgctgaatccatttggctgagcggtggccacgggagcacggggctgccctcctcacagacctgcacctgggccccagggcaagacgggcgtgggaggtgcaggggtgcgggtgtgggcaggggctgccggagaggggcgtgggaggtgcagaggtgcgggcgcgggcaggggctgccggagacagccgtgaggggtgcgggtgcaggcaggggctgccggagacgggcgtggcaggtgcaggggtgcgggtgcgggcaggggctgccggagacgggcgtggcaggtgcaggggtgcgggtgcgggcaggggctgccggagacaggcgtggcaggtgcaggggtgcgggtgggggcaggggctgctggagacgggcgtggaaggtgcacgggtgcgggtaggggctgccggctcagaggcgtgtccaggaacccccgtcaggccagagccctgccctgagcggcctgcaggggtgactgcgagacagcagcgttaggcccggtctcggctgtgaagtcgcccccaccgccacgcacgaccctggggattctgtcaaggtgggggccgtctgctaggcccgggctccctgaccacgtggctaggtttgcggaggaagccaggagagtgccaacaccaggctctgtaagcgtgaggctccctgccggccccatcccggagttcaccccatccttcctgcgtccctggacctcagctgttcctcattgacctcagagacaccctgccctgccccggcttctcaggagccctgcccaccaccgcctcagctctggggacacggcctttctcccggtgcagaggcgcagctcgctgcccccagggcccatcttcctccccagcatgtttttacctcagctcattctcaggaaagaaacgatcacatctcagcg

SEQ ID NO: 3022 - DNA, 4717 bp, Homo sapiens
ttctttcaactcgatgagaggaggactcctcctgggcctggtgcttcgaggtccagacgagcagacactggcgcctgtgaccctgcagcggacgcccttcaaagtccgtgtggccgcatttggaagcctgggcggcgtggagacggcgccttcagcttgagataaatgtggccccgtcccagagcaccacccgagacatcaggagcccatcgtgggctagggaagatcctccgggacctaacggcccaggtcttccacccttggccacctccccaggtgatgcctgaagctcaagggactgtgtccaccctcaggccctgcccgtggctctggatcggcggtccccatcagaggcctgggctgagtcctcaggtcaagaagtggcgctgacctggagcccctgcctggggctggccttcctcacagtgagctgggcctcctgccatcctggctctggagggcgtctgagtggaagaggctcagcctcacctccacaccctgaagactcactctctggccctgggctctgttgtgtgcaccgcctgtctgcagggcccagcctgcctcgagcactccctggggacagaagctcctgcgctggcctctcctgtcacctagccaccgggcatcctggagtgcagccctcatgccccgaggccacctgccatcgcccaggatgactcaagatgccacctgggtaagtctagcccagaacgagaaaggccgaatgagggaaactgagtcacatctgcttctcccaggtggggctgggggcccagggggagggcacttgtggtgacgaccagggtggactaggggcctgtctcccattctgtctctgccacacgttatagagcccgacctgtgggctgggtccccccatggtgagcactgtaggctctaggaggctgaagtcctggcctgggggacctgtgggggccaggctggggccattggaatcagtatggtggtccccacctgcactccagctccgatggctgatgacgggggccctggcagctgaccccttgcctcagtggggagaccacggctcacgagggcatgagacctgcccagagcatagcccagaggccggcctggattctcacagctccgcccactgggctgtcctgccccaccccctttttagcctgctgggaccatgagtcagaacccagtaggtgtgaggggacccagccagcccaggtggccagtccagcctgagggggtgggggtctcagagattaagtcaggagcccagagtgcgtgcttagggtgcaacccaccccacagcctcccccaaggcacctcccgggggtgcagatgggggcagacgcagggacactcagggtggaccacctgactgggagctgatcatgaggtgtgcgacagcctgagtcagcctcagctcagaggagctgggatggccttgatcttccccctccggccactcaccacagctgggagggtccaaggagaccctcagccactgtcccttcagccctcaccccaccctggctggctctgcccggacagtccttagggacatcttggtcctgcccaccagccaggggacccagaattggagcaggggagcaggacccccagaccctctcataccgcttttgttctgaggccttgagggaacacggggtcttcgcgaccccaggcgagatgatgctgggacagaggagggtcgggctgcatcggggccctcctggtccccactcctgggtgagtcagcatctcagtctccagttctgggtgggcggcaccaggtgtgagcctcagcggtctccttgctggctaaggacctgggatttgctccagtgcccctcgggagggagtaggacacgtgcccagagagcaagcagaccccctccccgaccaacttctgagagcaaagacacctagagctagagattcagcaccccctgagcctcagtttctccactatgaagtgggatccgtgatctcagccttaccagggctgtgaggattaaatggtccagcccagcctggggcctgcctggagtaggcagcctgctcaggatgggctgtggaaggagggctggggtagacctttcaagtccacttgggcatggggagctgagagctagcatgccgtttaacttggcaggaagcaggccgggcgcagtggctcatgcctgtaatcccagcactttgggaggctgaggcgggcggatcacgaggtcaggagatcaacaccatcctggctaacacggtgaaaccccctgtctactaaaaatacaaaaaatcagccgggcgtagtggcgggcgcctgtagtcccagctactcgggaggctgaggcaggagaatggcgtgaacccaggaggcggagcttgcagtgagccgagatcgcgccactgcactccagcctgggggacagagtgagactccatctcaaaaaaaaaaaaaaaaaaaaaaaaaaaagcttggcagggagcaggacatttggacctcactctgctgcccccttggctgtgtgacatccaggtcacgttgcctctctgggcctcggtctcctcacctgtttaagaggggttgacagtcgtatctgccccctcagcttttccccaggaaggtggtagccacaattagcatttgttgaggctgaccctgcaccaggcccaggataggcggggcttagggaggcccgtctctcgccacgttcccctgctaggggagccccgaggccctctcagtgtcatcctcatgctacactctgtcccagccctgtgcgtcccaagctagggcactgagtgtgccagcacccgcagggacaggcactggaccctgggtggacctgagggtctgtgactacccccccagctgctctcccctagaggccacttccctcaaggaaggaaagaaccttcccgccacctcctgcagtgcggtcagctcaggccagcctgcacagcagggccagaaccagggcccctggggagggatgcctgcctgcccagtgggaggagacggcacgcccgtgaagccgctactcagccagcctgggggccacgagtgctgcttctggtggcgctgtgcggggagggagggggccgagcagggtgggcactcgcatgcctgtgtcttgctggccttcgacagatgacagccctcctcctagggtctccagtgcagagttccttggggacattatggccactcctgtccagatgagagggagccggctgcctgtgacagcgtcgcaaaatgccgccagggctttccctccctcctcctttctctcttcctcgtccctctctggttggtggtttcctgcaggctcccgtccctgctggtgctggccacaatgtccccactcccagggtttcggcgtcccagccccctgcgcccaccgcgcctgcccgccagaatccctgtgcccttggtgcgtgtggcctgccgagcctcgagcccctgttctcctcagccctctttcctcccgcgtccccaggaggtgcctctggaagccacggagtcccatcggcaccaagaccgactgccctttggggtgaggtagtaggttgtatagtttggggctctgccctgctatgggataactatacaatctactgtctttcctgaagtggctgtaatatctgcggtggacagagcgtctggaaccctggctgggagcgggcagggccaggtttgggggcagccttggcagcagtcgggggcaggggccgcctacactgagaagtctgacaggcctaggtgccacttgctgtgtgaccttggacaggcccctgatctctctgggtctcagtttcctcctctgtaaaatggaggcaaatgaggatggaaggagatgcagtgtggagcatcgagggcagaggagagctgagccgaccccaccctctgccccagccgcactgagagaggcgatccacgcagctgtttgtctgacctctgtctcccaacactccccaacactccccccgccatcaggcccaggctcatgggtggccctgagccgtaccctccactgagcaccaggagaaggcaccgtggggccaggggtggccgagacgtttggaggtcacagggctgcgagtattggcgttgcccatcaccccaggttcccagcacgtgccccagcctggccagctcagtggcagggcctctgcctgtggaggaagggaggccaaggcacctttcctgagcaggaagtgagaggaacagctctgcatacactgggtcccacatggcacaatctgaaggcagacagtggctcctctgtacctggggaaactgaggcccagagagccagggacttcccaagaccagccagcagcagctgccccttcctggggtgccatctcccctgtccctcctgccctgcgcctgcccagccctcctgctctggtgactgaggaccgccaggcaggggctggtgctgggcggggggcggcgggccctcccgcagtgcaaggccgggcctggcggggtgaggtagtaggttgtgtggtttcagggcagtgatgttgcccctcggaagataactatacaacctactgccttccctgaggagcccagtgacacgaccccatgggagggccgccccctacctcagtgacacgaccccacgggagggctgccccccacctcagtgacctgcagggggcctgagccgaagctgggtgggcatctgggagctagattcaataaagctgttctgaccatgaa

SEQ ID NO: 3023 - DNA, 13120 bp, Homo sapiens
gctcagccccaccagcacgtcatccatcatcaatgcgtctgtggccagcagccttgattcctggctcagccttcaacacccttcaccatacagccgccgcttgctgcctcgccaaaccagcgctcaagcacacgtggctgctcagcctccctgcctatgctcaggcagtgccctctgccaggaattccttttccttctgtggacgttcaaccatcttttaaacctaatgccaacggcaaaaaatgagtcactgcgccctctcttcgggtacagtaggatgtgctgggtgaggatggcctgtcttcctcacagggctgggagctccccatgggcagagcctgggtcccaggttatctctgtggtctcggggcctggcaccagccaagggtttagtaggtcctctgtaactgttccccaaaaggcagagaattcccagttgtcccagcaccagtcttgctcacaatgaaatcatctttagatctaggcatgaagatggcagacccactgtgtgcactgcattgtcggccaccaaaggggacccagggaagccagacatgtgcccatcttcaagcagtttgtgattccctgaaaggtcagggcgcagacagaacaggttcccaaagagggaaactgaggactagggagaggatgaggtgtcttattacagaggcatccctgggcccaggggaagggtgtggatggagttagattgcctcattcccacacttgctagctggttaatctctctgggcccccactccttcacgtaaaataaggatgatgacagtgcctgcccccgcagggtcgctgggaggcatgaatgaggtactacgtacaaagtgttcagaatccagtacacagtaagggctcaacacatcttatgcggggtgcagtggctcacgcctgtaatcccagcactttgggaggccaatgtgggtggatcacttgaggtcagaattttgagaccagcctggccaacagagcgaaaccccgtctctactataacaaaaattatccaggcatagtggcacatgcctgtaatcccagctattcgggaggctgaggctggagaattgcttgaacccaggaggcagaggctgcagtgagccgagattgcgcctctgcactccagcctgggtgacagagcgagactccatctcaaaaaacaaacaaacaaacacaaaaaacaaacaaacaaaacaaacaaaaaaaatcttagctgtgagtgcctggtcgtgttagggaagcaggcgcctggtagagccagagtaaggccatgttcaattcgactccatcttaagactaaaaagccacattccttgctggtcacaagatagtcatgggatgtttacagttgaggaaacagcctaaagatacctacaaggacgtactcctacatcagcacagagtccaggtgtcccaatacccataacagtatgtgcttgcaagataattatagttacgcttcggtatactcacacactaaaatgtcaaggatggtttttgttttgcttttcaagattgttttatatttcaataattttgggaagtacaggtcgtttttggttacatgggtgaattctatagtgatgatttctgagattttcgtgcacccgtcacccgagcagtgtgcactgtacccaatatgtagtctttcaaccctcacccacctcccaaccttccccccaagtccccaaattccatgatatcattcttatgccttttcatgctcatagcttagcgcccacttgtaagtgagaacatataatatttggttttccattcctgagttacttcgctcagaataatggtctccagctccgtctaagttgctgcagaagacattattcccttccttttttgtggctgagtagtattccatggtgtatacatacgtgccacgtttctttaaatcaataaagtaatcaattttgtcatgccgtgcgctcacctgcaagtagacacagtttagcttagcttttacatggacaacactcctctataagaaaaacttaaaaacaaacccgggcggtgggtcctcctctcactttctgaggatgctctactctgtaacagggtagctttcaatcaaccatcccttcttactgcactccggaacttgctttgaattccttcctgtacgaaatccgagaaccctctcttggggtccgtttcaagaccctcttctctggtaacaatggcatatccacttcagcccccttggctagcagagcaataagagggagcccaaactggggccagcccatcagaaaagggggttatctgccccaaaaaaaggcatctctgagccaatcccagggcagagccaacccacagagcccttaagagtgttgtcagctgcagcacatttgaaatcactgaaaacacacaactagggagtggcgggtggcggggggcgggggtgggtgccggttgggagggggggaacagcaaacacattttccatcctctcagttcccagcctgacccaacaactgccctcctggccccaatcggttctctccaccatgcggaggggcagatggggtagatggggtcagcgaagacaggacccagcaagaagcagcagcccagtcgaaaagcctgaagtcctgatacaaccaacgcagatgcgtaaaaaaaatgccgtgctgcgtgaaaggagccagacacaacaaagccatgctgcatgagcccactgacaggaaatgtgcagaaaaggcaagactgcagagacaggccgcagacgagtggctgccaggggcttccgctggatggggtgggggctggggggagtgcctgctaataggtacagtgcttccttctggggtgaggacaatgttctgggctagagagtgatccctgggcaacttggtacatttactaaaaattgctgtacacttcaatcgagtgaattttatactctgtaaattatacttcaataagctattggaggaggaggaggaagaagaaaaaagaggaggaggagaaaagagaggaaggggtaaaggtggaagaggaaaaggagggggaagaggaggaggaagaggagatgggcccagtgcagtgactcaggcctgtaatcccagcacttcacgaggctgaggtgggaggatcacttgagcccaggagttcaataccagccttggcaacatggccagaccctgtcttgatttttaaaaagaaaaaaaaaagtgcagaaggaggagaaaagggaggaagagataaaaatggaagaggaagaagaggaaaaggaggagaaaaaacaggaggaagagaagagggaggaagagaaaagggaggaggaaaagaaggaagtggagaaggagcaaaccgtgccaagggatgagaaaagagggagaagcaagctagaaggtcttgcctgggcatgcgcagggccagcagcgcctacaacctggctggagcgctccctccccactcagtcagtgaacatgattaagccctaccaggagctgggagcgaagctgctgggagcagggatctgcactcaggtaggcctggggttcaaatcccaactacagccctgcctcacactgtcatccaggacaacctgcttctcttctctgtgcctcggtttcttcagacataaaatgaggctgagaataacaacaacaatcatgataatttcctccctcacaggatggcagtgaggcagaggtcagatgatatgagaaaagcactcagcaggctgactgcaactgctcaatcaatgaaggccctgaggataaagtgtgaagcattagggacatgagtgaggcaggattcttgccctcagcggggctcacggtctgtaagagaagcacttgggaataaattacagcactagaggctagagggcctggaatggaggagttcacaggatagggtgcaacccaggagggcttcttggagaaggtggcacagaacccaggcttgaaatatgacaaaatgtccctattctcaagagacctcgagttcaagtagaagattcagcatctctggaaatacatctccttaagagaaaaatgctgtttctataaccataagtttctcactataggctcggctatccataccccacgctcttttttacaaataaaacaaaaacaaaatttttttttcccaaaaaatactttctccggaagagaaaatatcatccatgaaaataaatggggcagccagggctgtgaaggctgcagaggaacatcctaagctcagctgggcagctctgatgtcaggttcacaaaatagaaactgacatggggcccaatggggacagagcacagtgacacatctaccgaaattagtgggctgcatgaaaagatgaaaatctaagtggtcatggaaaatttggatgtttcaggtttagaatggaggcccgaatgtaaaacggcttaaaagcaaattaacgaaatgtggaaaatagaccgtctccatcctaccctcttgtggtcatttctgaatgatgcacaagaaaaccagtgccttgtttcacctgggaggagaatgaggcaggtaaaacagaaactggcggccctggattgagcccccacctgtgctacctgcccagtgtcgaagcctgggccaagtcagttcgttttgccaaccctcagtttcccgtgggtctcccagagttgtggcaaggatccagtgagataacaagtgtgaataacaagacctctgatacccagagtgtgaaccgaaggcagctagaatgtggcctgagcacatggtgagatgtcacattgaaatcaggattgggccaggcgcggtggctcacacctgtaatcccagcactttgggaggccgaggtggaccatcacatgaggtcaggagtttgagaccagcctggccaacatggcgaaaccctgtctctactaaaaatacaaaaattagccaggcgtgatggtgcacgcctgtaatcccagctactcaggaggctgagtcaggagaatcacttgaactcaggcagcagaggttgcggtgagccaagaccatgccactgcactctagccttggcaacagagcaagagtccatctcaaaataaataaataaataaaataaaatcaggatcatcagttctgcttgaaaaactggacgatccaaccaacattctgggcaaggaagagctgggatgcaagggaagctccttcctccccaccatttgtcacgaaatccccatccctgcctggcctggcttccgggcacagctcccgatgcagaatccccgggaaagggcctgcaaatccgggttccaagccccaaggtgccccgggtgccttgcaggaggcctggcatttaggaatccccagatcagggatttctgaggcagtttggaagggactttgccctcagaattctgcccccaactaaattctccattttccctctgaacccttctctctgctcagtgatgagtgggcaccctgagagtgcaggggtcccctcccaggaactacatgggaggggcagcaaggtactgttgccacacaagctgtccagcctcccggccttgtgcagactggtacctgggttacccttcctgcccctccctccgcctggccaaactactcccctgtcaggatccagggcaagatgagtctttctagttcccctgccaccaggccaaggaagagccaattactccctcctctgtcgggttagtttgttgtgcatctgtctgttgtgtgtctgtttcccttcctcggctgtgaactcactcactccttcattcaacaattttttttttttttttttttgagatggagtctcactctgtcgccagggctggagtgcagtggtgtgatcttggctcactgcaacccctgcctcctgggttcaagtgattctcctgcctcagcctcccaggtagctgagattacagtagctgggattacaggcacccaccactacacccagctaatttttgtatttttagtagaaacggggtttcaccatgttggccaggctgatcttgaactcctgacctcaggcgatcctcccaccttggcctcccaaagtgctgggattacaggcatgagccaccatgcctggcccctcacttaaaaaatattcacctagcttcaactctgcactgaaaacacaaaagtgaacaagagcttcaagagccctacagtcctgcaattcttgtttggtgggggagggataagaagtcagcaaacagcctccaccctgatgagggaggcagatatcagaaggacactgcacatgataatgggggtgctgtgagggaataatgggggcccgggccttatgcagaggtggtgtcagggaaggccttgcccaggggtgacatctgagtttagagaggtcctgagaagaggcctcactcaggtgctctggtcatcagtcccaggagcccagccttcgagtcatcccagcccgggcaccagacgtaagtgatgaggcttccagatgattcctgccccagctgttcagggctcccagcagagaagagctgtacccacagagccctgcttggcttcttgacctgcggaatccatgaccctgttacacccctaagttctgtgatggttcattataacaacagatcaccggaccatggaaattacttctcctcttctactctttaggctaactcgtttttatataaacaactcatccccacccagacacacacacaaggccctagagcagcagtttccgaacagtgccgtatcccccggggatctctaaaaaatactgacacccagacaataggggggaatcctaaaaatacctgaccaagactattcaagattgccaggctcatgaaaaacaaagaaaagtctgatactacatcctggatgggacgtaacattaaaactgagaaaatcggaataaactatgaactttatttaataggaatgtatcagtattggctcattgatggtaatgaacataccatgctaaggcaaggtggtgatgacagttggaaactgggtgtgggtgtatggggactctctgtaccatcattccaattttcctgtaaatctaaaactgttctaaaaagtcaagtctatttaaaaaacactgatgcccaggccctgcccccatgcatttagatttaatttctgggatgtgacctgggtatctaagttttgaaaatctccctgagtgagttatttccatttccagaagaagaaatctaggttccaactggtggggctgcatctggaatctggatccttcatcacaccctgaagtcttaaacttgctttttccataactcatgtctgccacagggtgctaggatggattctattcaaaggagggatgaggctgggtgcggtacctcatgcctgtaataccagcactttgggagacccaggagggtgaatagctcaagcccaggagtttaagaccagcctgggcaacatggcgaaaccctgtctctacaaaaaatacaaaaattagccagcatgctggcgcatgcctgtggtcctaggtacttgggaggccgaggcagaaggatcgcttgagcccaggtccaagctgctgtgagccatgattgtgccactgcacttctgcctgggcaacagagtgagaccttgtctaaaaaaaaaaaaaaaaaaaatgcccagcagagcgcactggacatgtgacgttacccttttgggcctccgttttcctgatctgtgagatggcggcagtgcgttgtgagctaatgggctaacaggtggaaaaggttcactctcctgggtctccttccaacagtgaggggagcctctagagcccgcaatcccacgctgttccaccaggggacgcgcgcacgccaggatgctggcctactccacaagggaggctttgcaaggaacaggtgtccctgtcattcactcatctctctcctgcgggccggtcggcatccagctgggggccctgcgtggccttggtccctgggagcccacagagccccggagctccaggtggcactgctgaaaccgaagccagccatccttcttccacctggggatcctgccccactagagacaccctttctcctcccaagttgcaagggctaagtccacaggtctggattcaatccagccatcattgtttcttcactgcatgttgcggggccagtcacctcccctctctgagcctcaggttcagaatctcttaaatgggcatcctcttggcacttcagaatatagtgaagtcacttaggggaaaagtgccaggaaatggaacttcatgtagaacgtggggagtatgaagacggataatgggatggtgtttgcacagtgcttagcacagcgtctgccacatagaaactcagtgtctaacatagtcacagcaacaatagccaacacttacaaagcacctaccaggtgtcaggcactgttcatcgcaccttgtgcataggagctcatctcacttcactgccttttttttttttttttttttttgagacagagtctcactctgtcaccaggctggagtgcagtggcccgatcttgggtcactgcaactccacctcccgggttcaagcgattctgctgactcagcctcccgagtagctgggattacaggcatctgccaccatgcccagctaatttttgtatttttagtacagatggcatttcaccatgttgaccaggtcttgatctcctgacctcatgatccaccccgcctcggtctcccaaagtgctgggattacaggagtgagccactgcgcccggccacttcaccgcatttctaacaagtaggctctgttataatcccagtctcagagatggggaaactgaggcacggagatgtcaatccactcaaagtcacatagctggtaagtagcagagttgggatttaaacccaggccatctggcttaggatatgagctcttttctgtattcatctcacacttcaattttaaaaatccttttccaggcaacaaaagaaaaagttgggcgtcatcaaacttcatcaaagttataaattttgtgcatcaaagaacattatcaagagaatgaaaagacagcccacagaatgggaaaaaaatatttgcaaatatctgatatgggattaatatccagaatatatatataaaatattccactgggcgtggtggctcatgcctgtaatcctggcactttgggaggccaaggtgggaggaacacttgagttcaggagttcgagaccaacctgggcaatatggcaaaaccccgtctctaccaaaaatacaaaaaaaaaaaaaaaaattagctgggcatggtggcacatgcctgtagtcccaggtacttgggaagctgaggtgggaggatggtttgaactcacgaggtgttgcagtgagccgagatcatgccaccggcactatagcctgggcaacagagccagatcctgtctgtctgtttgcctgtctctctctctatatctgtatctgtatctatatctatctatatctatatctatatctatatctatctatatctatctatatatatgtttgtgtgtatgtattcctacaactcaacaacaaagaaaaaacaatctgattcaaaaatgggcaaaggacttgaacggacatttctgccaaaaagatatacaactggtcatttggcatatgaacagatactcaaaatcattagtcattagggaaatgaaaataaatatctcaatgagctaccatggctaatttttaaatttttatttattcattgttttagagacaggggtctcactatgttcagcccaggctggtctggaactcctggcctcaagcaatcctcctatcttggcttcctgagtcactggatgacaggcatgagccacggcgcccagcccacaacttgttttttcagtcacaacctttgatgagttactttcagcagtccttgtgtggtctttcattttgattgtttccttctcatttggactcgctgtcaaccaactgaaatctagagggaatctctaactagcagccaggatatgttcttgggcgggggccacctcacaagttcccacttatttcaagttgattacactcacaaggactaccactgctgtcagcagaatccaaatgttcctcccctcctttttccagtcttaataacaaagtcatcaggtccaaatgctctcaaacctctcaacctttgccctggcagatcctgcgtacaaagatgctggcatgacgatgacacagcaccagcctcagaagcaaagggccacagtttcaccagttagagatgtgggaaagtctgagctcagtgtaaaaccaaacactgcgggtgtccaggagggtcacgtggaagtcaagtttaaaggaccccagatgacatccgttgtatagagcacaatttcacgcctctaaacctctgcccatgctgttccctcgatcaggggcaaaccactgttccccagaccatagttacctggcaaacacctgctcagccttcaagacttagaactcagactctttggtctcgaactcctgcttctcagctagccctccccaagtggagacaccccctccctcctccagggagactttacacaaattcaaattaaattaaagcacatgacatgatgcctggcatatagtaaatgttcaataaacagtagctattagggagcttccggatacctgaacacagggaggttcctggagggtggcgtgcccagggagggcatggaagctctgcactccctcccccatacctcaccctacgcatctctgcttctacagcttatcttttgtaataaactggcaaacgaagaggaagagagaccagagacatctacctatcacccacctcccaccctgcatacacagaagaggctacgcaaagacaaatgaaggacacagctgtcagccacggagaggagcctcattagaagccagccttgctagctccttcatcttggacttctagcctgtgtatctgtgagaaagcaaatttctgttgtttaagaaaaaaaaagaaaattagctattagaacccactgcaattatttacctaccttctttttttttgagatggagtctcactctgttacccacgctggagtgcagtggcgaaaactcagctcactaaaacctccgcctcccgagttcaagcgattttcctgcctcagcctcctgagtagctgggatcaagtgattctcctgcccctcagcttcctgagtagctgagattacaggcacgcaacaccacgccagtctaattcttcttttttttttttttttttttgtattttagtagaaacagggtttcaccatgttgcccaggctggtctcgaactcctgagctcaggcgaatcgcctgcctaggcctccccaactgctggaattataggcgtgagccactgtgcctggcctatttacctaccttcttaattgtctatgccttagtcataactgtagcccactgcccagcatagcacttaccacatgcagataaatatttgtcaaaaaaaggagcaaaatccctaaacactctacctcagcccaactggtcctccaagcacccccctttgtctgtgtgagttctcagtcccaaatgtctcccctcctacttcctgcacctaactggaccctcccaggtcattttcagacccctgggctgtgaactccaggaggctgacggagaaaatctccaggccccatcatgcagggcctggcgcatagtaggcccaaaaagaaataaactcaagaaccaaatgagccagcatatgctaaccaataggtttcagggattgggagaaaattctagagactaccagaggccctcccgctggcccattgcaaggaagcctcccagctgatgaatctctgacttcatcgtcacaagatgggcctccagggtaaactgtgactcgaggtcacagtccacaactgagtcactgtgttttatggtccctgtgaaaatgcagaccaaagctcacttcctggggaaaagaggagagggaggaagcctgatacaggacttggattcgccatgtggactcgaggtcctgaggggaaccctgaaagtaacaagggagatggggagaaacagagagcactggccaaggagtcacaaagaagaactccagccccagctctgcctctagaggccacaggaccatacacaagacacttccctacactgggcctgtctcctcaactgcagaaaaacttctaaggctatggatgtttgtctttcccatcagctctttgggagagcatagaaaaaaaacctggccgcaaataataataaaataataataagccgggtgcagtggctcacacctgtcatctcagcactttgggaaaccaaggctggcggaaaacttgaggtcaggtgtttgagaccagcctggccaacatggcaaaacctatctctactgaaaatacaaaaatcagcctggtgtggtggtgcacgcctgtagtcccagctactcagcaggctgaggcacgagaatcacttgaacccgggaggcagaggctgcagtgaatcgagattatgccactgcactccagcctgggcggcagagtgagactccatctcaaataataataataataatagctgctatgatttgtgaagccatttctcggtgtcaggcactgtgctaagagctttgtaagcatcatctcatttgggctctgtcctcccaccgggctaccacgtaagacgagtggaaagttcagcagacacttaagagcatggactgcagacccagaacttggaagagacacttaatggctctgagcctcagtttgcccatctgtgaagtggaaataatagcagtatctacatgacatgtaacgatagtaagtgttaggctttgttattgctatcactatccactttatagaggaggaaaagtgaggccctgagtggtaaactcacttgctcaaggcctctagcaagtggcagggtctgtagttcagcaaccatgggcagggctatgcaaatcagcagggcattggcctggcaggtcccaggcaccctctgcaagacagcagcagcacagcagctgatggccaaccccgggctgagcaaatatcacattctcagctccaggaggagtcccagggctcagggtgtcttgtttcctcatgtagctaatgcacggagtgctgcaggcccaggagagagaggagctggcaggggctgg

SEQ ID NO: 3024 - DNA, 14645 bp, Homo sapiens
attcctgcagcccggtttatgatacacacacgctcagggattgtacttcccagagaggcttccgcctgtgcttgctcccggaatctattatccatcgtgcttttttgttgcacacgtctttaaagtccaccagaatccaacgaaatggagcctcgaggaaaagaagagatttagccgcgaaggattctgggaatgctgggcttacaggggcgccgatcttcgctggcgctaggcgcttggtttcctctccgcagctctctgcgcacggtacgcctgtccctcgttggccttccactcagggcaatcaccagccactctcagggtcctcttgagccgtactaaaagtttgggaagactaaaggaaatcagaagtccctcagtctgaacaggacagccgtgagtgggtggcctgggaccctcaaagtataaaaacctatcggccggcgggaactgcttcagtcatttcaggggcagtgtttgatcagcacttctgcgggaggagattcctgaatcctgtgttccttaagggcttccctgctgcaggctggggatgtttcaatggactttccctcgagccctttggaaattacttcttaagcaatttttcgatgatcagctcctttttataggcattttgtcgttaaggggaggggactgggttacccaggaaataagtgagtatggggattctaaggctccttttcattttgtcttgtctctttccctttcaatcacagccggtggcatttttgccagtgtaagtttcttaattttgtgggtcttcctatgaatcttaatgggattggctccatcggagaagccacactcacaaatgtctttgagctagcccttctctatattgggcagctgtagtttggggcttacagttttgtaagaagtctgaagtgggtctcactgggctaaaatcaaggtgtcgacagtgctgcattccttctggaggttccaggggagaatcttttcttgccttttccaacttccagaggctgcctgcatccttgactcgcagccccttcttccaacttcaaagtagcaacctcagccagagtccgtccattgctgccctctgtatggttctctctcctccgcagccctcttccacttttaaggaccctcatggttaacactgggctcacccagctaattgaggagaatcgttaaggccagctgattagcaaccttaattccatttgcaattttattcccttttgtcatgtaacctaacatattcagaggttccggggattaggacatgtatatctttggggggtggtattctgctgaccacagcaggattagaaaaccagatggaagtgaatggataccgggaatctaggatccagctggctgtcaggctggcagaggtatcccagacctgtcagctctcaggaaagctgcatccagagtgctttttggatcactgggggatacctggcctcactctagactcactgccgtggtcgtttcagaattgaatccgtgatcaggaaatgttcccagtgttgctaatgtactcctcccacacttgagagtcctgaatcccatctcctgagaagaggcgttgggctcaagtggctagagagaagtttcttgtcagagaaatcttgctaccttgaggagaggaagcataactagactgggatggataggacacttagggaagaggaagtgtttcatatccctgggaccaggaggccagaatgaggcaaacttgcccctctgtctggcctcctgtgttgaggaggcctgaggtggcagaaggaagatgggagaagggcccccaagaaagctctggccagcctcaggctgtccccaccccgctgatatagcgtatgtggagataagggagcacccaggagcaagtgtcacccctccccttccaacagcagccaaaagggtcatgaccctggctgccctaacttggcccttgtgtgtcctgaagcacagacacactgcttagaaagatcatcctggtcgcagtggctcacgcctgtaatcacagcactttgggaggccgaggtggacagatcacgaggtcaggagttcaagaccagcctgaccaacatggtgaagccccgcctccactaaaaatacaaaaattagctgggcggggtggcacgcacctgtaatcccagctactcagggagctggagcaggagaatcacttgaacccggaggcaaaggtcgcagtgagccgagatcgcaccactgtattccagcctgggcgacaaagcaagactccatctcaaaaaaaaaaaaaagagattctcctttgtcttgcctctcagctgtcataagcaatcagtgtcctgtccccttaataatgtggtggttctcaaagtgggatccccaggccagcagcagcagcatcccccttaaaagttgttagaaaagcaaattcaggggtcccactccacacctataaaacaaattctggggtcagggcttagcagcctttgttttgacaatccttgtagttgatacgctataaagtttgaaaatcactgactcagaggaaatggctttgtggagaaaatgagccaaggccgggtgtggtggctcacgcctgtaattccagcactttggaatgctgaggcaggtgcatcacctgaggtcaggagtttgagaccagcctggccaacatggtgaaaccccgtctcgactaaaaattaaaaaaatagctgggcatggtggcacacacctgtaatcccagctactcaggaggctgaggtgggacaatcacttgaacccaggaggtggaggttgcagtgagctgagagctcactgggagacaaagtgagactccgtctcaaaaaaacaaaaaaacaaaaaaaaaaagaaagaaaataaacgagccataggaaaggccacaagacagctacttacttccacaagcacatgctgcggctccctgcctctccttttgctcagagccacactggctcttaatggcttcagaggtcacaccagcctccgtcctgccacacaacctttgcacttgcggggccatgaccagcagcactcaacacagctggccgcttctcatgcatgatgtctgagcgtacgtctcaggaggggccctcacttagtaccctgtacagtaacagcccttgctgctcccatggtgactttttatttccttttagcattttccactgttgaataagttcacatagattgggtttacttttttttttttcttaatttagacacagtgtcttgctctgtcacccaggctggagtgcagtggcacaccactcatatagctcactgcaaccttggacttctgagcttaagcagtcctcccacctcagccttctgagtagctgggattccaggtctgcaccaccacacctggctaattttattatttatttatttatttattttttagacagagtttcgctcttgttgcccaggctggagcacaatggcacgatcttggctcgccacaacctccgcctcctgggttcaagcgattctcctgcctcatcctcccaagtagctgggattacaggcatgcgccaccatgccaggctaattttttgtacttttagtagagacagagtttctccatgttggtcaggctggtcttgaactcccgacctcaggtcatcggcccgccttggcctcccaaaatgctgggattacaggcataaactactgtacctggcctatacatacacacacacacacacacacacatatgtgtatatatagatatatatgtgtatatatgtatatatatgtgtgtgtgtgtgtgtgtgtatatatatatatatatttttttttttttttgagatggagtctcactctgatgcctaggctggagtgcagtggcgggatctcggctcactgcaatctccgcctcccgggttcaagcgattttcctgtctcagcctcccaagtagctgggattacagacacgcaccaccatacccggctagtttttgtatttttagtagagacggggttttaccatgttggctaggctggtctcgaactcctgacctcaggtgatctgcccacctcggcctcccaaagtgctgggattataggcgtgagccaccacgccaggccagacctggctaattaaaaaaaaaaaaatactcccaaagcactgggctgacaggtgtgacctgtttaattcttttgtttgtttctttacttcttattgtctgcctctcttcagaagctaattcccattagagcaggtgctgtattctttgccaccaccatatcaccagtgtctacaactgcctgacacacagtaggtagtcagatgctgaaagagtgaatgaatgatgttcccccagggcaggcacgggttctccaagtgcctgtttcaacactcctcccatgccaccacccctagacccaagcttggcattccttttttcctgagtgatcaggaaggcacagccactgtccccggcctagtgtgtgatgtctgtagctaagaaaaaggctccgtccttgcctcagctctgaggggtggggcctcagagataaggaggaccctacccttgtgttgctggcccttcttttcagcatgtcagacgaatttgtaatttcaaccccagcctttccctgccccagccatagttgctaaggcaacaattgggcctcaatttcctgatgaccagagtccaccaatggctgccatcatcctgttatctcctggtcagctatttgtggcaccatctcagcagtgccccagtccggccaacgcagaggaagtcaccaaggaggctgggaggaggagcctcaagttttgcagaaactatacacggcatctgctgtgtcacacctcatatgtgctgttcccttcctttgggtgcctctcttgtctcctggcctgctcttctgtcatcaaggctgggctcgaagccttctctgggaagccctatgcgcataacgatcccttctgtgcaagcctgcagagcctttcctgtctcactgctcagtgactgacctgccctaagtccttttctcctagatttgctccccaaagaccaaggagggtctgggtcatttcatctggtgtcaagcaaggtgtgcctcggtctcccagtgagagaccgtgcatagcaggtgttccaacagtgggacttctgacacatcgacaatcctaatgacccagggactgagaccgatcatcttgtgggtggtcaggacagcaggactgaagcggtgacttagttacagcagaggaagccaggccagaccctaccgggtgtcccccctaacacagggtcccatgtgaggttgcagctcccatgccaccacccccagtgtccttgagggcgagttgggttgcccttctggaggccattagtgcttgtcacagcagcgtgttgggagatggagtctgagggccgtgatctgtgctccctctgggagtgtggtctggaagggacagaggaaagaggagcagaaggagccagaaaccaagcaggcgcggtggctcatgtctggaatcccagcactttgggaggccgagacaggcggatcacctgaggtcaggagtttgagacgagcctggccaacatggtgaaacccgtctctactaaaaatacaaaaaattagctgggcgttgtggtgcacgcctgtaatcccagctactcagttggctgaggtaggagaatcgcttgaaccatggaagcggacattgcagtgagccgagatcacgccactacactccagcctgggcgacagagtgatactctgtctcaaaaacaatcaaacaaacaaaagaaaccaagcagaagcaggtttcaaccccttcggctgatcctgccttgtccagcaggctgaatgagctttggagtcataatcaatcactttcactctgttggggaccagaggcagtgtcatcctgcccaggccacaaggcagcggcagagagcgtcacacctcagctggtgcgattctgcgtgcagccccaggctcagtaggtgccaaccccaatggccactacagggttgctggcttagccctgggatcccgcacacgcccaccgtgaggtagcctagtgtgtcttgctccagctgatgcacttccacccctggtccccggggggcatcagggacaagtctctctggtttgcagaagccaagttactctggggcaggagctgggatggtgtaagggggtagtgggcgtccgtgggccgtgcagatttcggccctgggctgggtaaagcaagcttatgctgcacctgtcccctggggctgttctatccagtgctcctctccataatcctttactgatggcgccaggctgggcttctggggcccctacaggatggtcaatgggggctggctctgggtccgcgaagcattctgtgctctgatgggaagacttaaagggaaacaaagggacctctgaagagtatgaatcacattattggcacgggtaagtgggtactggtagcaacagcaggtggtgtgggtgggggttgccaagagggcgaggtaggaaatagaatataaggagaaaaatgattgaagatctcaaatgtccctttatgaaccccccccagggcctcccacccgcctagcacagctccccaccttcaccacgccccctgccccaccctcactcgcaccagtaacaacagcgaccattgccggagcactcactctgtcccgtccccaggttcaggtgctttacataattcttgcctttcatcctcacaactccatgagggaggtagtgccatgacgcccatttgacagatgaagaaacaggccgagaggggtcaggtgacttgtccacatcacataggcagggagtggaacaaccagagttggaactaagcacactcttaccctccatgcagactccagcagagagcaaaggagagaggctgaggaagagtttgaagccacagtgacatgttccttgcccacatgtttaccatctatcttgtagcctgggggctgacacatcatcctgccttccctcttttttttacaagccctgctttgcagaggctggagaacagccaagccagagctgggagcagcctctggcctgaagccccagttggagaactcatccaggacaaagaccagtcttctgcgaggtggatgagagtgggtgtcccgagcagaggctgtagtttagggaggttaggctgcttgctcaagccctgtgtggcctgaggtatcaagcaaaacagctgtcccagtcattagacacctaatgtgtgcatgaacctgtctcgggtcctcttccttggtccatggtgtggactccctgataactgatttggagatgagggaataggtccctttcagacacagcccatgtgtaaccttctggggtgtaatagctttgacaatgtacaccccttggccagcaatgacacctctaatgctctaatgttccctcctatggaagtttctgttcagttaggcacaggtttctttttttttttttttttttttttgtttgagacagagtcttgctctgtcaacaggatggagtgcaatggtgtgatcttggctcactgcaatctccacctccctggttcaagtgattctcctacctcagcctccccagtagctgggattacagccacgcaccaccactcccagctaattttttgttttttgtagagacagggtttcaccatgttggccaggatggtctcaatctcttgacttcgtgatctgcctgcctcggcctcccaaagtgctgggattacaggcatgagccaccacgcccggctggcacaggtctatctctagttctaccatctctatctccaactccatcatctcccttttccccaccatcaccatcacctctgtctccatctccatcactcatctccatcatctctcttctgtgccattgctctcccctctctcctctttgatgctgctattgtctctctcatctccctctaaatttatatctatataatagcaaaattagcaataagcagaaaactggaaacaacgtaaatgtggagcaattggagttaagttctgatgtatttaatatggggttgacttcagttctgatatatttatatgatgaaataaccctacattcaacatatttgagtacctgtctttgccaggcaccacgactccaaaggcaaacaatactaagtaattattaaaatgatgcaaaaagtttagttcaggatggtgaattaaacttacacatttacctccttttctcctttgccaaatcccactgaaatgacattggagatgtacagaaatgaacacatccataacagagcatagaataggtagagaggtgggggagggggaaggcttataccagctactgcagttaagctgcctagttctttattcctaaatatggacaaccaaagctcaccagatatttgagataaaccagcagcataaaagagatggcccaacataaacaagcagatcaactgatcccagaggaagtcagagaacagaagacaactttgaaaaagcgtgtaagtagctatattcctcacagtgaatgccaggtttggtgtggtggaggatgtgagcagctggaactcccctacactgctggtgggaatgcaaaatggtgcagccactttggaaaacagtttggcagcttcttaaacataagacatgacccagcgagtccactccacagaaagacttgtatgtaactgtttatagtggctttattcatatagccccaagttggaaatagctgcactaccatgctgttacgtaggctgaaagaggtttcctcactacactagggtcctccatcattaatgcttctttaataaaaactcttctcaaggctgctttacttccaaaggaagctggagtcattcactgcaaaggccatcaaaaggccccacactccattgctcaaggcaacaattatgctgataagacagaaaaagcagcagccactattcctacttctgtccctcatggccagtttttctcctcatcagtcacgcctacttactctcgcactgaagtttccacctatcaatccctccccactgaaggcaaatggttcttagaccaaggaaatacctcctttcaccctcacaggctcattccattctgtcatcttttcgtaacctcttccatgtaggttacaagccactagccagcctcatagaacctctcatttcctttaagacatttaccctgcatttcactccatccttggctaccttccccctgtaagccagagcgggtgtgaggaggggagatgatagaaggattatagggttggggagcggaggctgaggaagaattgggacgtggctcagcctggcgaggagcagcctggggaggaaggaagaggtcagatgggtccgtagaaaaggaggattcaaaggacttagagcttggggtggagactgaaggaacagacaggagagaagaaatatttaggacgagtcacattgggagcagagactagggagggacaaatgtgtaaaagaatgcctggatgtcaggcacctcagactatgcccattttatgacaaaaattatctagatcttgtaggatggagaaattgaaagcactgttttctggctatttagaaccattatcaaggtttgtattggagccaaatggtgttgcagaagaaaataagacacttaggttttaggtcaggcgaaagttgaagaggttttacgtttttgagaacacaggttaagggagaagaagggggaatagagggtggaaggttgcccatagtgaaggaggcaagcccagagaaaagagagggtagagacacagaggtgggggcgggcacttgccacccaggggaggtggtacttgccaccccggtgggggggggggtggtacttgccaccaaggtgaaggatcaaggcaggcgtccccatggtaatcagacacctctagaatgtgggtgaatgatcaggcaggcatccccgcagtgattaaacaccaagggaagacttgtcttcccaagtccatgacgggcgccggcatttttggttcacagataaaacgtgtctcgggccgggcgcggtggctcacgcctgtaatcccagcactttgggaggccgaggcaggtggatcatgaggtcaggagatcgagaccatcctggctaacacagtgaaaccccgtctctactaaaaatacaaaaaaaaaaattagccggacatggtggcgggcgcctgtagtcccagctactcgggaggctgaggcaggagaatggcgggaacccaggaggtggagcttgcagtgagccaagatggcaccactgcactccagcctgggtgacagagcaaaactctctcaaaaaaaaaaaaaaaaaaaaaaaaagcgtctcctctgtttctactggaaaaggaaaggaactgaaattaagggaagggagagactgaagggtggcgccgaaattgaaaggagaaagaggttgagggataatgagagaggttggagaagagtaaaaagaggccgcttacccgatttaaaattggtgaggtgtttcttggtctggtctgaggacccgagcttgtgggtggatttttctcatggagcaaagagcaggaggacaggggattgatctcccaagggaggtcccccgatccgagtcacggcaccaaatgtcatgcgtgtccgtgtgaagagaccaccaacaggctttgtgtgagcaataaagctttttaatcacctgggtgcaggcaggctgagtccataaaaggagtcagcaaagggagatggggtggggcacttttatgggatttgggtgggcagtggaaaattatagtcaaagggggtcgttctcttacgggcaggggtaggggtcacaaggtgctcagtgaaggaacttctgagccaggagaaggaatttcacaaggtaatgtcatcagttaaggcagaaactggccatttttcacttcttttgtgattcttcaggctatctggatgtatacgtgcaggcttgggctcagaggcctgacagttacatgactgtatacatttgtcataagtcattaaattttatacttacaattattgaattttacttaagtaaataatgcctcaatcaaagctggttttttttgttttttgtttcttttggagacagagtcatgctctgtcacccaggctggagtacagtggtgtgatctcagctcactacaacctcctccttccaggttcaagcaattctcctgcctcagcctcccaaatagctggaattagaggcatgcaccaccacgcctggctaatttttgtatttttagtagagacaaggatttgccatgttggccaggctggtctcgaactcctgacctcaaatgatccgcccacgttggcctcccaaagtgttgggatttcaggtgtgagccactgtgcccagcctaaagctgatatttaaaaagtgaaaatatgtatccttagagaaattcaaacaggcaagccattaaaaagaagagcacaggatgctacgaaaaaggcacaggtttagaagacaccaaggaaaccaggaaaattaaaaaaataataataaataaaataaaaaggcacagggaataagacaatattagaaattactgccaaaacagagtggcgattttcatgtcagacagggtcagacctcagaacaaggggcagtaccagggataaagaggaccatttcctaaagataaaggatggagcagtcaggagaacggtacaatcctaaatgcacaggtgcctaagagcagagctccaaagtgccagacaaaggccaacgaactacagagctggacaatacacatgcagaggtgagattccaacaccctctctcagtaatcgacagaatcagtggacagaaaacctggatttagaagacatgatagttaattttatgtgtcaacctgacaggtcaaatattattctgtaaaggtgttttggatgaaattaacatttgaatcagtagactgagtgaagcggattgcccccctcaatgtaggtgagcctcatccaatccatgaaggcctgagtagaacgaaagtaaggggaaacgcttcctgactctcttgagtggggatgactgacagtcttttcctgccttcagacttgaactgcaatattggttcttcctgtatctccagcctgctggcctttggattggaactgcaccatcagctctcctgggcctccagctgctaactcaccctgcagatcttgtgacctcagccttcataatcatgtgaactgatttcttctctttttttttttttttttttttttgagacggagtctctgttgcccaggctggagtgcagtggtgcgatctcggctcactgcagcctctgcctcccaggttcaagtaattctcctgcctcccaagtggctgggattacaggagtatgccaccatgcccagctaatttttttgtatttttagtagagacagggtttcatcatgttggccatgctggtctcgaactcctgacctcaagtggtctgcctgccttggcctcccaaagtgctggggttacaggcgtgagccaccgtgcttggccatcatgtgaactgatttcttatttctctctctatgtatctctctctacatacacatacatcccccccccacacacacacacaccattagtttaatctctggagaaccctgattaatacagaagacatgaagcagactattaaacaacttgacctaagtgacatttatagaacactccgcccagcaacagcacagtacatattcttttcaattgcacatggaacattcaccaagataggtctcaatacatttaaaaggatcaaaattatgttaaacatgattaacaaaacagaacattttgtagaagagctagaggattaagtaaaaaaaaaattcctagaatacgaagacactaaaagagtatataagtgaaaaattgagggaggatactgtgccaggaagtacagtgtctactagaagtttcagaaagaggaaacagagaaaatcaggggctgggatgtgagaatgaagaagtaaaagaagaacaagttcccagaagaaagtatcgagattcaaaatctcatggtatcagaggcgtttgaaccagagcaacttcatcttgagtaggggcggggtaaaatgaggctgagacctactgggctgcactgccaatgccaatggtgaaggcattctaagtaataggatgagataggaggtcatcacaagatacaggttgtaaagaccttgctgataaaacaggttgcggtaaagaaggcagcccaaaacccaccaaaaccaagatggcaaccagagtgatcttggtcgtcctcactgccacactcctgccagcgccatgacaggttacagatgccatggcaatgccaggaagttacttaatatggtctaaaaaagggtggcatgaataatccgcctcttgtttagcatataatcaagaaataaccataaaaatgggcaaccagcagcgctcggggctgctctatggagcagcttttctttagtcctttactttgctaataaacttgctttcactttactgtatggactcgccctgtctctacaaaaaagaaagaaaaaaaaagtgacagtaaaataaaggctttttaggcatgcagaaactcgctccctctgtacctgtcctgaaaaaatgactgatatcagacatggtagccctgtgaaggtgtagccctgcaaattgaaatggaatccaagaggccgggcgcggtggttcatgcctgtaatcccagcactttgggaggctgaggtgggcggatcacttgaggtcaagagttcaagaccagcctggccaacatggtgaaaccccgtctctactaaaaatacaagaagttagcctggcatggtggcgggtgcctgtaatgccagctactcgggaggctgaggcaggagaatcacttgaacccaggaggcggaggttgcagtgagccgagatcgagccattgcactccagcctggggaacaagagcgaaaccccgtctcaaaaaaaaaaaaaaaaagaaagaaaaaagaaatggaatccaaggagcaaggtgtggaacccaagaagcagagaaattaacccaggaatcaatgaaacgaaaacagctttgccgcaggtcccccaaaacaagaggtcagaaggagaaaaaaatggattccatgcaacagctagcattattacaaaggggaaagacctcagtcatatggtgaagaaaatgacacgtttcttaagaaggaaaaacaacaacaacaaaactccaggtaaaaaagaaatctaatattatcatgtcctaaataaggtacaaactcaaatctggcattattttaattaactgatgtagtataagagaaaatccattttatattgctgcttagaatattcctttttgagtaacacaggctgactgacataggattatgtctttaagtccatttcattaggtttacagtaacgatgtttatataaccataatgttgtgaatacttcctccccgaactcataagctctgggttttatatattactaacctaaagccatgtatcagtggctttgcttgagcaaaggatcatttggacccagaaagcttattttcaaggcagctttcaaaaagtcaagtggcagggcagcactgttcacattttgatgtgcacctccccatcatctccc

SEQ ID NO: 3025 - DNA, 4433 bp, Homo sapiens
gggtgaaagaatgaatcctcacttcaaccctatgaggaaaccaagctcagagaaacaaccttgcccaagatcacacacctggtatatatgcgagccgggctttgaactcagctctcaactacaatgccacgtgcctctcaggatccccactcccaaaacactctcaacagctaaacatcgccgtacgctattcagggcccggccccttgacgcaggacacagaagcagttggaagagacaggcctggtcccgggtgttcccaggctaacaggcagtggctcccagcatgaatgaagggacgtagcccaaacccaacagctgcagccccggtccctggagggccacagccgccaccatgcggaagggagggctgggctttctatctacacagatttgccttttctggacatttcattaaaatggaattgaaactgtgtggccttctgcggttggcttctcttactgagcataatgagcgtgagtttcagtccctttatactgctgaagagtaattataggatgtgctgcgttgtgtttgcccattcaccagctgacaggaatttgtactgtttccagtttttggctattagagcttggattttacctcagggtgaccagcggagcaggaaggaaaggctaggagcagaagagggagaggtcaggactggccgttagaaagatcttcgggccagcagatattgggcatggagatgccacaatgggcagggaagggggccaggaagagggcttgctggcagcttcttggggggggggcccctcgccctgctgccaatccgctgctgctggacgcagtgggagtccctgagagagctcccagtccagtaatatctccgtgtggactcctcctcctgccaccctgctaggccaggggctctggacccctggtctcatcaagcactgccccattttctaggggaagaagctgaggtctgggtaaagtatggtgtctccctgggaccaggtggctggtccagagcagagtctaacatcagaccctgggactccgctctggccactgtgctgggtggcggtgggttgctgaactgcggtgctggaggaaagaagccgacagaggccagccgccagcctccccagaggtcaggcctggtccctgcctgagcacttcctcctccttgggggtggaggcctgggaggagctgcaggggatcagctgatggcaggtgcccctcttgcagacagaaagggagctgtctgacaaaggcccatgtgcttggtgaccctggagctctagtggggaccggagcttgccctgcctgggaaggcagcccccaggactgcagcagctaccccaagccatggacaagcccatgcatgccctggtcttaaccatttgacccccaaagggcccacgaacttgaggggagacacttatctctttattttcatgaatggaactgaaatttagcatttccttcttattaacagaggccaaaagagagagagaaaagaaacagtgtttagcagaccttgagactgacatgaaaagaaacgacagatattttcccattgcatcaagttactgcagattctgaatgcccatcactactctgagactgaaggccttattacagctgctgctacatcctatcgcttcacatgtcaattcagtgaggaagagcatttagctaatgatattccaactggcatcctttgcaatcctatttaatgtttcgccttaaaaatcatcattccaggccaggcatggtggctcatgcctgtaatcccagccaagatggtgcctcttctttgttccaagagcctctgagtgagcttgaggcccagtttctaggctggcaaccttcactccccacacagcaatcagaccacaccttcagctgggcacctacagggtctggaaccaggtccggccttgcaggagtcaccaccagagtcagagaccgaggaggtcacatccgcccaagtgcttacagaagcgccgtagaaatgcacttctactaaaaatacaaaaattagccgggcgtggtggtgggttcctgtagttccacgtactcaggaggctgaggcactctcaagtagttgagcctgggaagtgaaggatgcagtgagccgagatcgtgccactgtactccagcctgggagacagagtgactctgtctcaagaaaaaaaaaaaaaaggaatgagcacaccaaaactaagattttacaaatactattgcttagaaatgaggccaaatgtattcaaataaaaaagaaaccaatctattaataagaaaaaagaaagagcagcatgggcagatcagagaggaagttcgcgctgacagcactcacacccgccaggcccatccccagcacttccaatgcaaataaacacagcttcaattccctgatcacttccatcacgggagtattagtatcctcccactttagagaggagactgggcacatggctcacgcctgcaatcccagcactatgtgaggccaagacaggaggattgctttaggccaagagtttgagaccagccttgccaacaaagccagtctctacaaaaaaaatttcagaaaaaaaaaagagaggagaaaactgcggcatggggcagaggtgcgataacttgtccaaagttgcagggagagcagctggctggcccaggatgggcccctacacacacctgtccatttaaaatggtgtgaggaggtggctaagaagaaaatggcagcgtgaaacagttcatgagcaggcgtgggtcaaaataactgactctggcgtactgagcactaaccacatgagagatgctacccgaggcatttcacacccagttcctcagtatctgcactcaatgcggactcacgaggggaggtgatgggtccaccacgtctgaccacagggccagcttggacccatctgactctgccatgtcacagcccacatgaccccatgatggacatggaaaaggtcatgtgatgcccagtgtctcctttaaggcagcaggaagcaggtgatctttgtcagtcacggcttccaggcagagtgactgaagtctcataaaggggtgggtccccaggatccaggggagcatagccacaggacccctattccacaggcaaggccaaacagccatggcaggactgtagttcattcaaaggctttggtgtagggcctgggctggagctcagagccaggttccaaagggaagggctgcgcagtggttagggcacagctgtggccctgagggatggggctgggatctttgctgtctctctcacacactcagtgaccttaggtgggcttcacagcatctcacaggtcccacctgagatatagagtcttgcaatatggttaagaacgtgaattctgggccgggcgcggtggctcacgcctgtaatcccagcactttgggaggctgaggagggcagatcatctgaggccaggagttcgagacaagcctggccaacatggtgaaaccccgtctctactaaaaatacaaaaattagctgggtgttgtggcgcatgcctgtaaccccagctactcaggaggctgaggcaggagaatcacttgaacccgggaggtggaggtggaggttgtggtgagctgagatcgcaccactgcactccagcctgggcaacaagagtgaaactccttctcacggacacacaaaaagaacatgagttctggggcgagactgcctggagtcaaatcctagcgcccaactcaaactcttgagcaaagcaatgtgacccgtgcctcaactgttttatccctaaaatggggatgagtgtaactaactcccagggtcgtgtggcgagtgagtgagttagtagggtccctccctggaaccagtgcttagcacacacatatacatgctcacttggtccaggggtagtggctcatgcctgcaatcccagcactttgggaagccaagacgggcagatcacgaggtcaggagttcaagaccagcctggccaacatagtgaaaccctgtctctactaaaaatacaaaaattagcctggcatggtggcacgtgcctgtaatcccagctactcgggaggctgaggcaggagaactgcttaacccaagaggtggaggttgcagtaagccgagatggtgccccgtgcactccagcttgggcaacagagtgagactctgtctcaaataaataaaccacaagcatcgcccaccgtctccccccaaccagggctgtagtgcgagcagggaaaaggatggcagcttcaccaaggccatggctttgcttgttcctggccaagggagctaggtgaagggcaggggctccccgacagattgaaggggtgggaaaaacaaaataaaacatcaaatacattgtgtaggaagagtccagcctacagaaggccagaggagggggcctctgcagtctcagaagatcactgctgccaccactgtcaccctgggagcca

SEQ ID NO: 3026 - DNA, 5934 bp, Homo sapiens
accgggtcgcggcggccgaggctcgggcctccaggaccactggctgcccatgagagacgaaggatggcatccaagggggccggcgtgtctttctcccgcaagagctgtaggctgacctcagatgctgagaaatccagggtcacagggacccgctgcagctgggaggggagctgtccaggaggccggcctgggaatgagcacaggcctgcggctggcagagagccgggtcgagccagccctggagaagcaggcccagctggaggagcagctgcgggacaaggtgctccacgagaaggacctgtcccagcagcagatgcaaagcgacctggacaaggctgacctcagtgccaggagggtccctggtgggtgctgcatgaggcaggcgtcactgcagaagagtgacagagctgggcctggcagtgaagcgtctacagaagcagaatctggagaaggatcaggtcgacaaggacctcaccgagaagcttgaggccctggaatccctgcggctacaggagcaggcggccctggagacagaggatggagaggggctacagcggagcctaagggacctggcacaggccgtcctgtctgacgctgagagcggcagcctgcgtccaacagcgtccgaccgcagcctgcgggggctctcgggccagcggaccccgtctccaccgcggcgctcctcgccgggccgaggccgttcgccccgcagaggcccctccccggcctgctcagaagactccacgctcgcttgccctgattctctccgccctgcacttttgccagctgaaggtccagggagaagagcaacctggtccacagcctgcaggtggcccagcagcaggccgaggagctgccgcaggagcgggagaagctgcaggttgcccaggaggagctgcagcgccagcgggaccggctggaggaagagcaggaagaggcggtgcagaatggcgcacgggttcgccgggagcttgagcgcagccatagacaactagagcagctggaagggaagcgctcagtcctggccaaggagctggtggaggtgagggaggcgctgagccgcgccacgctgcaacgggacatgctgcaggccgagaagaccgaggtggccgaggcgctgaccaagggtgaggctggccgcatggagctcgagctctccgtgaccaagctgagggcagaggaggcctccctgcaggactccctgtccaagctgagcgccctcaacgagagccttgctcaggacaagttggatctgaactgccttgtcacccagctggaggaagaaaaggccatgctgcagggccggcagcggcaggcggagcaggaggccacagtggcgccggcagagcaggagtggctggaggagctgtggttggagcaggaggtggcacggcagggcctggagggctccctatgagtggcggagcaggcccaggaggcgctggagcaacagctccccacactgcaccatgagctcagttggctgcaggagcagctagcacaggtaggccaaactgtgtgtggggtggtctggagagcatgtggggcaggccaggctcgcagcctcctgcatccagtcctgggttaagtcacaggcactggagcctgcttctgggttaaatccagtcccacttctcctagctggggaccttggacaagctgcccaacctcccatacctcagttgccccatttataacatggggctagccgggtgcagtggctcacgcctataatcccagcagttggggaagccgaggcgggtggatcacctgaggtccggagatcaagaccatcctggctaacacggtgaaaccctatctctacaaaaaattagctgggtgtggtggcacgcgcctgtagtcccagctactcaggaggctgaggcaggagaatcgcttgcctctgcctccggggtttaagctgttcgcctgcctcagcgtcccaagtagcagggactacaggcgtgcaccaccatgcccggctaatttttgtatttttagtagagacagggtttcaccacgttggccaggctggtcttgaactcttgacctcaagtgatccacctgccaaagtgctgggattataggcgtgagccaccgtgtccggccgggccctggtttttgtacacacgtgcattgcagatctagagaaggtcatgacttgcccaagtacatatagcacatcagggcagaccctgggctcgaacccaggccttctgccaggactgggttaggcccagagttggggtactgcacgatgaacaagctgggggatgctgggagtgctactcagtctctgggtgggagccagctctcctggcagctgagcaggcgggagcaggagctggagcaggcccggtgggaggcccagtgacaggtggagacgctggggcaagtggcccgggagaaggaggcgctagccaaggagcacgctggcctggctgtgcagctggcggcctgcggagcgtgaaggcaggaccgtgtcagaggaggccacacacctgcagtaaggccttgggctctgcccaacccgccctgggcggtcctcctggggccacgccatgaacagcctcacccaggcacgggcccccaggggcagttactaaggagtctggcttgccaactcgtcctagctgtgggctcaggcttccccagggagtgtgggcctggccaggcaggtagattggcacttggcccatgcctggccactccctgagatccacagtttcctggggccagggaggctgagtcccagggcctcacgcactgtatgtgctgcagcttggagaaggaagccctggagggcagcctgtttgaggtgcaatggcagctggcccagcttgaggcccgccgggagcagctggaagccgaggggcaggccctgctgctggccaaggagaccctgactggtacgagtggctggggacttggggggaacaccaggttccagcccagactgcaacctcccaatgtctgtagtctcacagaagttgggagcactggagtaggagtctggctggcctgggttccagtcctgtgccaccacttagatctcaccttcccttgagcaagcccctttcctctctgggctgcagattcctcagctgatgattggaggtggcaatgcccaccttctaagcctgttgccaggatgacatgggaaaagcgtgtaaggccgtggcacggtgcctggctgagtcaacagtaactgctgttcatcggtcatcaggcctgttagtctgagttctctgtggttttcagatgactctcttggccccagaatccgagccccacttccctgcaccgttccccatcgaatctctgaactcagggcttctttctgctcatctaacattaactaagcacctacttgggtcatggaaattaattttcctgtccatgtacacctgagccagacagaaccaggaagggaaatgctggtgggtttccaacccgggagatggtttttagatgatggctataccatttccattccctgtagtcgtttccattaatgctgatagttaatgcttgacaggtatgttcatgtcagtcattaaaggagatgctttatgtgtagctgtgcagctgtgggaagttgctgctgatctcctctgatcctccatttcatcatctgttaaacggggatgaggataaactacataggcatgttatgaagacaaaatgaggttatgtctaaaatacttagctgggtgcttgacgcatagtaagtgctgagtcagtaatagggtttttgtttgtttgtttgtttttgtttgtttgttttgagatggagtttcactcttgttgcccaggctggagtgcaatggcgcgattttggctcacctcaacctccgcctcccaggttcaagcgattctcctgcctcagccttccaagtagctgggattacaggcacgcgccaccatgcctggctaattttgtatttttagtagagacggggtttcaccatgttggtcaagctggtctcgaactctcgacctcaggtgatctgcccacttcggcctcccaaagtgctgggattacaggcatgagccaccgcgcccagcctgtttgattttttgagacagagtctcactcttgtcgcccaggttggagtgcagtggtgcgatctgagctcactgcaacttctgcctcttgggttcaagcgattctcctgcctcagcctcccaagtagctaggactacatacgtccgccaccatgcccagctaattgttgtatttttagtagagacagggtttcaccgtgttggccaggctggtcttgaactccttacctaaggtgatccacctgccccagcttcccaaagtgctgggattacaggagtgagccatggcacctggcctagggttgttatatgtttgacatccgtcccatttgggaggccttctcatcagtcattttatgcctttaatgccattctaggtaggcaggaaaggggtcagggccagtgggcccatgtagcagatagggaaactgaggcccagagaggacaagccacttcttcaagaggacccaaactggatgccaggcaggccctctgcctctgggattttgcccatatggctcaactggcctaagtctgctggcccaaggaaaaatttcaacccaaccctgccctttcccccattcctctcgtgcaggggagttggcgggcctgcggcagcaaataatagctacgcaggagaaagccagtctagacaaggagctgatggcccagaagctggtgcaggctgagcgggaggcccaggcctctctgcgggagcagtgggcagcccaggaggaggacttacagtgactccagcgtgaaaaggttcaggcagctggggaggggtgggcagaagtctgagccagtgtttcatcatcgttcttgctctgcctcggtctgtacatctgtgaaatgggactccctctctgttgtggaggccctggggacagctgggaggactggaggggtggtggggaggttgtggtccttattagacattcagatacccaggtcccaaatctggtccagccctggtaatcctgatgcagagggtccacaaccacatttgggaaatgttgacctaatgcacagcaggaaagcactttcatttgctaagaagtttccatatgaagggccacgcagacctgagcatgtagaaaggcaaggggccagggaagttactagaacactgactctggggttatattgcctgggtttgaatctaatcttggtcgcttactggtgatgctacccaaggtgtctgtgccttcatttccccacctgtagaaatagggataggatagtggaaggtattgaggatgagctgagaccatctgcatagagggcttaacatagtgactggtacttagcaaatgctccatgagttatgattgctggcactggcatgctctccagagtggccctcagaacaggggccctcagccaccaaatcctagacagggcttcctctgacagaggtgcaggctatgactacatggctccagggcatgccactcaccctgcagtccccatggccttgggtggtggttatcacgcttctccatcagggggcggtaaagctctttccgaaagtgctgggattccaggcatgagctatggtgaagctcttaaagaaggggtggcttggccgggcgtgctgactcatgcctgtaatcccagcactttgggaggctgaggtgggcggatcacgaggtcaggagatcgagaccatcctagctaacacagtgaaaccctatctctcctaaaatcacaaaaaattagctgggcatggtggcacgcgcctgtagtcccagatacttgggagggtaaggcagaagaatcgcttcaacctgggaggcagaggttgcagtgagccaaaatcacgccactgcactccagcctgggtgacagagcgagactctgtct

SEQ ID NO: 3027 - DNA, 7282 bp, Homo sapiens
ggctggttaccaaggttaccgccgagaggccgcgtcctcagctggtcctagacatgcgtggcgtcggggctgtggcacggtcgggtccggggacacttgtttaacaagacatctgcccatgtccctggcccatctcattggctgcagcacatcacagtggaccttctgcctcctcccagatgcccagggacagtgatctggaaggaaggggcttgaggctgttttcctagaactcgacttgaatgcaccaaggaaaggccatttgtggggacatagcaagaaggcagctgtctgcaagccaggaggagaaccctcaccagaaacctcacagaaatcggccaacaccctcatctcgggcttccagcttcagaacaacgagaaaacaaatttctgttgtgtcctggttcccatttgtaattggcaccctaatgaaaccgttttctgtagccctggaaatggctgaaaatgaggggagggaaataaagtgctataattcagagcatggagcacaccttcctggttcacctgagctggattcggagaggtaaaatggccattacctcgtctaagctgccacttacagacacagtacaggatgaggcccagacccacagagacaacgatgatggccacagctaagatgatccagaaattattcctccaccagctcattgcagtggaatcctgagaagaatggagagagaagaatgaggctggagtgcaatgacgtgatctcagctctcagctcactgcaacctccacctcccgggttcaagtgattctcctgcctcagcctccagagtaacggggactacaggcacctgccaccacgcctggctaatttttgtatttttagtagagatggggtttcgccacgttggccaggctggtctggaactcctgacctcaggtgattcacctgtcttggcctcccaaagtactgggattacagacatgagccaccgtgcccagctaatctactgtgttgtgtagagatgcagacatctgcttaggaatcaggcactggatcacagccataccctactcattaacacctgggggacctcaggcatgtcactcgaccttctgtgagcctcatctataatatgggaatgatatctcctacttcactgaggtttgtgaggactggagatcgaacatgtacctactgggccctctagaaatggtagacatcatcactgctctttcagacatgcagcaggagggggaaggtgccatttaaagcaataattgactgcagggttgttttttttcttgagacggagtctcgctctgtaactcaggctggagtgcagtggcgcgatctgggctctctgcaaactctgcttcctgggttcacatcattctcctgcctcagcctcccgagtagctgggactacaggcgcccacgaccacgcccggctgatttttttgtatttttttagtagagacggggtttcaccgtgttagccaggatagtctcgatctcctgacctcgtgatctgcctgcctcggcctcccaaagtgctgggattacaggcgtgagccactgcaccaggccagtttttttgtttgtttgtttgtttgtttgtttgtttgttttttgagacagaggcttgctctgtcgcccaggctggagtgcagtggcgcgatcttggctcactgcaacctctgcctcccaagcaattctcctgcctcagcctcctgagtagctgggattaaaggtgtgtgccacctcgcctggctaatttttatatttttagtagagacggggtttcatcatgttggccaagctagtctcgaactcctgaccttgtgatctacctgcctcggcctcccaaagtgctaggattataggtgcaagccaccatgcccagccagttgtttttaatcacaaggacaagtcagacttaatgcatagcaggggagagaaattttgagagcttttgtttgagttgagggttagaaaaatagctggatgggtctctttgagtgagttatggtcagaagggtgaagctgaagatacagggcaaactgagttgatctgcatgagagagttaacaggcatttgggggctggaagctgacagaccagagaccgggaaagtctcggaaaaggttagcagcagagtgagaggtcaagaagagagcacaagtcagatcctggttaggaagctcccatagtggcaaatgaccaaggcgtttctaggacagtaatgcctcatgtccagccttaaattgctacctaggttatgctgtggtgtcgccttttgttaccatcaaacctccaataaaactgcataacacggccaggtgcggtggctcacgcctgtaatcccagcactttgggaggctgaggagggcagatcacttcaggtcaggagttcaagaccagcctggccaacatggcgaaaccctgtctctactaaaaatacaaaaattagctgggtgtggtggcacatgcctgtagtcccagctactcaggaggctgaggcgggagaattgcttaaagccaggaagcagaggtggcagtaagccgagatcacgccactacattccagcctggacaacagagcaagactccatctcaaaacaaaagcaaaggctgggtgcagtggctcacgcctgtaatctcataactttgggtggctgaggcaggcggatcacatgaggtcaggagttcgaaaccagcttggccatcatggtgaaaccccttctctactaaaaatacaaaaaattagctgggcatggtggtgcacgcctgtaatcccagctacttgagagactgaggcaagagaattgcttgaacctgggagtcagaggttgcggtgagccgaggttgtgccattgcactccagcctgggcaacaagagcgagattccatctgaaaaaaaaaaaaaaacaccgatctcaaagagggagttgtgagaaccccaacttgaagctggttgctctcaagttccagaggcccggacttgcgactgacgtctggggagttgggggcagcagtcttgggaactgagctgtgagatctgatactatctctgggtctatagtgctggcattgaattggagaacacccagctggtgttcactgcttggtgtgtggcggaaaaaccctcacacatttggtcacagaagcccttttctgtgttggtgattgttgtgctggtgtgagaacagaggaaaaacaccgcttgcagagtttttcctgaaacaatactctttagagcgatagaaataaataccacgacctgcgcattcaaagctgttgtatctggattgtgactgcgtggaaggtcgaggcgggaagacaggggctgttgcttttcgttataaactctgcattacttgatttttgcactacgtacatttactttgataacactggaaagaataaattggccatgtagtgtagcttccaaaaaaaactattgcttgggtttcaaggtcaaggaaatttcattctcatcagtttcttgggaaagaggaagtggaatgatgttgtcagaaagtgaaaccatgggtcattttcagaactactcagagtaataaatattttttgtcagttttgttcttacaagtgaaatggaccgcagagaggcactttttcttttcttttttctttctttcttttttttttttttgagatgaagtctcgctcttgtaccccaggctggagtgcgatggcgtgatctcggctcactgcaccctccacctctccagttcaagcgattcttctgcctcagcctctccagtagctgcgattacaggtgtgtgccaccatgcccggctaattttttttgtatttttagtagagatggggtttcaccatgttggccaggctggtctcgaactcctgacctcaggtgatccgcctgcctcagcctcccaaagtgctgggattacaggcatgagccaccacgcccggccgacacatttttaatagaaccaaggagagcttgctttttgagagagggcagctgagagagggggcctaagagaatcacatcctagttccagtaggatgtcctctaggccaccaggctggtttaatggccaaggtgcttccagagagaggaagccctggggaaggatgatagagagtacagaaaacagggagtacacaatggctgcatgaccgagttcaggccctgggaaggtatgaaagctggatcctacctgtgctggcagacctggagttgttgccacagagggccgataagattgtgagtacaggactactgagggctactgaaggatcgcaaagaagtgtttgcactggccgagtgcagtagctcatgcttgtaatcctagcacttcaggaggccaaggcaggcggatcacttgagtccaggagttcatgatcagcttgggcaacatagcaagaccctgtctctatatacacacacacacaacacacacacacacacacacacacacacacactcttacacttagccaggtgtggcggcatgtgcctatagtcacagctactcaggaggttaagctcctcctcagctactcagggggtttcaccatgttggccagggtggtcttgaactcctaatctcaagtgatccgcatgcctcggcctcccaaagttctgggattacaggcgtgagccaccctgcccacccagaatgaactttcaaaagggaacaaggattagagaagggagtgacactgaatagaaccagagagaaggggcttgggggcaggaagttgagagctcacacctaagtttccatttcctctgaggtgggaggcaaagtcaacagtgtgggggttgaggtgggaggggtccggcttgagcagagcagtgcaatagcacgcaccaactcctccaccttccagcccagtccccatcccccattcccatggcgctttcttcacaattttagttggtggagcctctctcgtgaggccatcctttctccttgcctaccgcatcccaagaagaactcagctacgtgaagggatgtcactaccccctgcaatatgtatatgtgaaatatgttgggcgcggtggctcatgcctgtaatcccagcactttgggaggccgaggcaggcagatcatgaggtcaggagttcaagaccagcctggccaacatggtgaaaccccgtctctactaaaatacaaaaattagccaggcatggtggtgtgcacctgtaatctcagctacttgggaggctgaggcaggagaattgcttgacactgggaggcggaggttgtggtgagccgagatcacgccactgcactccagcctgggcaacagagctagactccttctccaaacaaaattttaaaaatgaaaaataagttgggcatggtggcacgcgcctgtggccccagctacatgggaggttgaagtgggaggattgttggagcccaggaagttgaggctgtagtgagctgcagtcacgccactgcactgcagcctgggtgacagagccaaatcttgtctcaaaaaaaaaaaaaatgcattgagcacagtggctcacacctgtaatctcaacagttttggaggctgaggcaggaggatcactgaaggccaggagttagcaaccagcctgggcaacacagcaagaccttgtctctacaaaaaaaattaaaaatttgccaggcaaggtggtgcatgcctatagtcccagctactcaagaagcttaggtgagaggattgcttgagcccagggattcgaggctacattgggccatgaatgtgccactgcactccagcctgagtgacagagtaagaccctgtctcaaaaaaaaaagaaaaaacagtgaaatgcatttttcttccaactgagcctgtgacagtgacagttgtctcttggtgtatttgttctttttatttgtttgttccttgtctgtctcccacactgatgggcaagcagcataagagcagaggctttgcctgtaattaccactgtgtttctagcgcctagaacatcacctggggcaggacataccatacatatctgtgaatatacgaaagaatggatgatgccccagtctctttcccctgctatagatggacctcccacccgagaatgcaggcagaagtcactttgggtccagtaactgaaattactgtgctgtgcagtctaattccaaagcctcatctggacacgcgaccctgggcaggctccccgtcctgcgctggccattggctactggggccaagaggctggctgggaagcagtggcaatccaatgctggggaggtggagttccagcttcccctttgtttctccccattcctctagttgtccatgacattttcaaggaacatgagtgagcctgttgcagttctgggtggtttcagtggaaaggatttggcaagaccttccacagtgaagagggcgtgtgagtgggagagcaactgaaggcagtcaacacatcagcttcactttcatttctccaaagggcatttccagggtgtcagggacagaaatcacattttccttcaccaggaatttctgagactgtgggtttatttagctttttttttttttttttttttttttttgagacagagtcttgctctgttgcccaggctggagtgcagtggcgcgaccttggctcactgcaacctccatctccccggttcaagcaattctcctgtcttagcctcccaagtagctgggactacagtcgcacgccaccatgcccggctaatttttatatttttagtagagatggcgtttcacaccatattggtcaggctggtcttgaactcctgacttcaggtgatccacccgccttggcctcccaaagtgctgggattacaggcatgagccactgcgtccggcgtatttagcatttttaaaagaagatcttcagtaagaaatatggtttacgttgtgatagttattcacgtattcacataaatgaagcgctgaagggccctaggctggccatcaagggaacaagttcccctcccctccccttcccccatctcctttctcccctcttctcctttctcctctctgctcctctcctctccactcctctcctctccggtcctctcctctctcctttctcctctcctcttctctcctttcttctctcctctcctttttctcctctcctttcccttcttttcctttttgtagagacaaaaaaatgttgtagacacacaaaaaatgttgcctaggctggtttcaaactctgggccccaagtgatcctccgccccagcctcccaaagtaccaggattacaggcatgagccactgcacctggccagagggaataggtttcctgttcccacttagc

SEQ ID NO: 3028 - DNA, 5972 bp, Homo sapiens
gcagcgccctgcgctcaggccgcggccgaagctgccgcctcgctccccggagtcgcaccttgctggactggagctcgcaaacccccagctgctccccgcacctcgggagccgcagcgcccaacaccctacgggcccgaaggtggcgcccaagaagtgaaccagaagggaagagcgaagcacggaggctttaatggcagagggcccggtggcggggaagggaggcaggcgcgggccccgtgggcctcgggtcacagcgtgtggaggtcatgactgcgacggctcagcttctccgggtcgtctgacgccatgagggagaagtcgcggaagatgtcaagatacgtctcatctcctgggggagggaggaaaggccgggaggcggctgggccccagtgcagaagggcaggatccggcggttggggcccacctggggacctcgcgctccgagcctgggtgggaacgtgcgcgccgcgggcactgcgccagcacctatgccttgccagggcctggcacgtcgcatgcgcccaatacgcatttgttaaataacggaatgaatgcagctgggcactagggagagaggtcaccgtggaccagaagcccagagttcaggtgttgggcctggggggtggggtgggtgtattctttacctgcctgcccctgggccgcttcagcctccctcatctttgccagtcgtagcctgaagaggagggaattaagaaatgaacgacactatctttggccgggcgcggtggctcacgcctgtaatcccaacactttgggaggccgaggcaggcggatcacgaggtcaggagatcgagaccgtcctggccaacatggtgaaaccccgtctctactaaaaatacaaaaaattagccgggggtggtggcgcacgcctgtagtcccagctactcaggggaggctgagacaggagaatcgcttgaacccgggaggcgggggttgcagtgagccgagatcgcgcccctgcactctagcctgggcgacagagtgagactccgtctcaaaaaaaaaaaaaaagactatcctcacctcccccacaacttcccatcctttgagctgggttgcgttccgttcatctgcccccacccccggggtcacgtctagtgctaaaaagatgcctgacagcaatgttgatgggcgaattacgcctctcagggtgggccaagcatccttgcaccctgcccgccctcccgcctgccttctactccacgtcccagtgcacacttcgcgcagcctttctcgagcctggccccggcgctggcccagcccctttccgaggccccacagcacaggcttctgtttcggcgtcagccccgcccgcccgcccgaacgtgggtgggcgggggtggggggagtcccagcgccagccccgccccttcaggcattcttacagggtgacgatgtcagcgttggctgtttccatggcgatggtcagagggtccctgccttcagagtctcgagcccccagatcagctccccgtttcaggaacaggcaggcgagcctggagagaagagccagggtcagccggccgcccaacttctcccagccttcctccccatgccatcatccctaccccgtgtggccaagaatggttgcgtggtgcagcgggccccggcccgcactgtccgcttggttcacgttcgccccgttctggaggagaaactcacaggccagaagagaattctgcatggagaagtcgagaaggggggttgagggtggcatccctagtggtggatttcaagatgtcttagggtggcgccagttcagagaatgggagggtggagtgtggtaatcaggagtgtggaaggggttacagctaactgtaaccaagctaggcttggctctagctctttgcatgtattcatatataaatccatagtacaagcttttgaggtatgttactattttacagatgaggctgagaggttaataacttgttaaaagtctcctgtaggccgggcacagtggctcacgccagtaatcccagcactttgggaggccgaggcgggtggatcacaaggtcaggagatccagaccatcctggctaacacggtgaaaccctatctctactaacaatacaaaaaattagccgggcatgctggctggcgcctgtagtcccagctactcaggcagctgaggcaggagaatggtgtgaacccgggaggcggagcttgcagtgagccgagatcgcaccattgcactccagcctgggggacagagcgagactgtctcaaaaaaaaaaaaaaaagtctcctgtaagaggtgagagcctgggttcaaactcaggttctctgcctccaaatcacacactcttagcaaccagtctctattgttgatctctccctatgggtggaagccctagggaacaggtggtggggaaaggaggtaagggcagggcccagagtcaggagtaggtgtcagagccctagggtggggtggagaggtcagcagggctcttacagcagctgtggcctggatcagcggtgtggcattatcttggcccccattgacccagttgacatcagctccatgggcaagggcatcagccatggtgggaagagatggaggatgcccagacgctcgaaacagtagggccccagggtgcaggcttcccaggtcctcagaggggggctctgttcgggggatttggttctgttagggggaagcagctccgagtctgggaagaaaaccctcagcagtgtcccaatgctataatgggacaggtctcttctaaatgatggggagcttgggactgtggagggaatagagtgatgcaagtgtgggtatgtgtaagtatgcgtatgcatgtgtacgagtccctagggtgtgggggagagacggcatcatcacctcatctggtccaaccacacttggcctcagctctcaacccctgacgctccagccaaacccaccccctctctctctccttttcttgtgctgttggcaccccttaccctccctgcccacgcccagccccacattccttctcattcttaatgtcacactccaccgtaacccctgaaacggcagtccggtccctccgacattgtccagcggaaggcctgggcttcacactctgtgcctcccggcgctacctggcacgatgccgagcacacagcagatgctcaatgaatgcccaaccaaccctatacctggcttggatctcaagctccctggccggggcctgatggaaggctttgggggcacaggaggctgcccccttgggcgcccccggccacctcttcgccctcgaatctcaggcagcttggtcaggaacttcttctccacgtatttagcgtgaatccaggcctccttctcctgcctgtgggaggggagaagcacgcagtcttccctcttctgctccaggggtcccccattcccctgggaggctaaaccccaagctcaccgggagcagctgggccctggtttcttcactgccatggcctccacgcgggcctcatagatctggttgatgatgacatttcccagctcacacatgagcttcaggaggcccaggcagaggcagagacagggaaggtgggggtgagtgactcctcagggatcacgcccctgcaccgccatgtccttgccccaccccaagttcttgcccccaatcttcacaatacgctaagttaccttcactagttctggctcccatgagtcaagggtcagagaccggactttggagaagtgaacaccaaggctcctggagggccagagggggagggtcaggccctgtgcaggggggcagtggcctggggagctgctgctgctcctgaagacactgggaggcaaggctggcatgggggcccgtgcagaggtgctggcccaggaggcagggcagctgcggccatgtaaccgccatgtagccttgacctggccctggcaggactctgcctcgtcaccattccttcttccttaggtttcatttcaaggccctcatcactccagccacctcccttctctagtgacacttgtgacactttggcctggacaacctctcccatgtcacctcccttccaccacactgaggtggggggcgagggccttagatacttgctaaggcctcatgaccgtttctctgcctagtcttcactggctcccccaccctcagcagccttgaccccacacttcttccaaccaagccaacaaattctgggtatcccccaattctggccagactaggacacagaggggctaggcccgcctgggtccaactggcaccccagaggcttgggcccaggcctggtacccagtgacaaagccagaagctaagagaggaagccaggacagggaaggaagaggggccggtgtgatgcgctctgtattggagccgcactgtggcccgaaggagtggggctcccgcatgggccttgtggagtaacctgtggatgccggaacactgaatgcagagggtgacaccaaggttgatgctggcccactccggggctggctcccggcagtcgcagcactgggcattgccatccacactctggacctgggccaccacgtgcccgactcccccaggctcccttcccctggccattccaccagagcccagggtggcagcagagcctatggccaggtgtcctgagccctgggggagagaggggaagaaagggtggccaaggggcctagggtaaagggtgccccatctccacaggcagcctggctccgcacccccaggttaaggtacctggcctggaccccgggggctgtcatcaaggcgagcctgactgaaggcagaagcaatgctgctctgcacagcactgacccacagctgcaggaggcgctctgagtcagcctggaggaggcaggacctaggtaggagggtgagggagatggcagaggggtctgaggcctgggaagcaaagtggcagcatgggcagactgacattcagccagtattcaaccagttccagttgcattgaaagacttctgtaccagttggtaatattctcctaaatatcccccatcaccctgtaccctcttccacaatggccccccagtccagccgccaaagaattaaattaaagtctggagctgcatggggggcctccattgtggtgggccctgcctttcagattggcagttgtttagatatattagagtatcacccctggggattgcactcacttgctggtggacaccacctcaaagcagaaccgcctttctgagtcagggcagagtttcactgtgcagagacgaaggtcatccaccaccacagtcacagggtcctggcaggataaggtgataaggggccagatgtccagctgcaggcaagagctgagtctccctggggcccaggcatccaggacccaggtccactcaccttgtacttcttctggtaaaccagttggttgctctgaatggtgaaccagcgtctgtaagagaaggaaatcattacagacataggcagctttaggatgagggacggaagagaggctgtgctttttgcccatgaggatcttactgagaggacagacacctgggctgactgttccacgagacattccagagaagggtggacaattgtgcagattggaacatctaaaggatgctattcctatcttggacaacccagatttcatatagttatgaagacaactttccagcagatggcagtaaaattctttttctaataaaatgtctattgctacaatttaaaaaatactatttaggctgggctcacacctgtaatcccagcactttgggaggctgatgggggtggtggatcacccgaggtcaggagtttgagaccaccctgaccaatatggtgaaactccgtctctactaaaaatacaaaaattagccaggcgtggtggcaggcggctataatcccacctacttgggaggctgaggcaggagaatcgcttgaacccaggaagctgaggttgcagtgagctgagatcgcaccactgtgctgcagcctgcgcaacatagcgaggctccatc

SEQ ID NO: 3029 - DNA, 4580 bp, Homo sapiens
aaaaaaaaaacaaaagaaaacatgaagtgggaagggaggatacattgtgcacatacctcaaagaaatgagagtgaatgaaactggcaagacactgggagggcacacctgtgaggtaaatcagagggaaatgagaagagcatggtgccctagaaaccaagtgaagccagggtttcaaggaggaggggtcaactcacgagacgctgctgatgcactgcgatgaggatagaaaactaggcagaagccttaaccacagggagggcacagcatccttgacaagggcaggcgggggacagtgggacgtgagaaatctgaagttcaaggtagaccaggtgcagtggctcatgcctgtaatcccactactttagaaggccaaggtgagaggatcacttgagcccaggagttcgagaccagcctgggcaacataacgtagtgagaccccctcatctcttcttcctttttttttttttttttctttagacggagtctcgctctgtcgcctaggctggagtgcagtggtgcgatctcggctcactgcaacctccgcctcccaggttcaagcgattctcctgccttaaactcccaagtagcttctacaggcgcgtgctaccacacccggctaatttttgtatttttagtagacggggtttcacagtgttagccaggatggtctccatctcctgatctcgtgatccgcccacctcagcctcccaaagtgttgggattacaggcgtgagccaccatgcctggccttttttttttttttttttttgagatgcagtctcactctgtcacccaggctggaatgcagtggcatgatctcagctcactgcaacctctgcctcccaggttcaagcgattctctcgcctcagcctcccgagtagcttggactacaggcacacaccaccatgcctggctaattttttttttttttttttttttttttgagacagagtctggctctgtcacccagactggagtgcagtggcgcaatctcgtgcaatctcggctcactgcaacctctgcctcccaggttcaggcgattctcctgcctcagcctcctgagtagctgggactagaggcgggtgccaccacacccagctaatttttgtatttttagtagagatggggtttcaccatattgctcaggctggtcttgaactcctgacctcatgatctgtctgcctcagcctcccaaagtgctgggattacaggtgtgagccaccatgcccggcgatgcctggctaatttttgtattttcagtagagacggggttttaccatattggccaggtggctctgaaactcctgacctcaagtgatctgcccgccttggcctcccaaagtgttgggattacaggcatgatccaccacgcctggacttttttttcctttcttcttctttttttttttttttgagatggagtctcactgtcgcccaggctggagcgcagtggtgcgatctcggctcactgcaacctctgcctccagggttcaagcaattctcctgcctcagcctcctgggtagctgggattacaggcgtgtgccaccacacccagctaatttttgtatttttaatgaagacggggtttcaccatgttcaggctggtcttgaactcctgacctcgtgatcctcccacctcagcctcccaaaatgctgggattacaggcgtgagccactgtgcctggccttttttttttgtagagacaagaattcactttgttgcccaggctgttctcaaattcctggcatcaagcgatcttcctgccttggcctcccaaagtgccaggattataggcgtgagccaccacgcttggcccaagacccccaggtctacaaaaaacaaaaaactaggctgggcacggcgattcacacctgtaatcccagcactttgggaggccaaggcaggcagatcacccgaggacaggagttcaagatcagcctggccaatatggtgaaaccccatctctactaaaaatacaaaaaattaggcaggcgtggtggtacatgcctctagtcccagctacttgggaggctgaggtgggagaatcacttgagcccaggagtttgagactcagtgagccatgatcacaccactgcgctccagcctgggtgacacagccagaccccatctctaaaaaagaaaaagaagttgaagggggttaagagcaaacagggaagggaggaattggggatgtgaatataagcaactttttggaatttagttataaagggaagcaaagaaatgacacagtagctggaaggggaatgtggcaccaagaaaagactattttgtctcactctgttgcccaggctggagtacaatggcatgatcatggctcactgcaacctccgcctccagggttcaagcaattctcccgcctcagagtcctgagtcgctggaactacagatgcacaccaccatgcctaatttttctacttctagtagagatgaggtttcaccatgttggtcagactggtcttgaactcctgacctcagatgatctgcccgccttggcttcccaaagtgctgggattacaagcatgagctactgtgcccggccttttttatttttttgagatagagttttgctgttgttgcccaggctggagtgcaatggcatgatcctggctcactgcaacctcagcctcccaggttcaagtgattctcctgtctcagcctcctgagtagctgggattacaggcgcctgccaccatgcccagctaacttttgtatttttagtagatatggggtttcaccacgttggccaggctggtctcaaactcctgacctcaagtgatccacctgcctcagcctcccaaagtgttgggattacaggcgtgagccaccacgcctggcttttttttttttttttttttttgagacagggtattattatgtcagcaaggctggagtgcagtggcactatcacggctcactgcagccttgacctccccaggtttgtgatccttccacctcagcctccagagtagctggaaatacaggcgtgcgccaccacacccagctaattttttactttttggaaagatggggtttcaccatgttgttcaggctggtctgacactcctgggctcaagcaatcctcccaccttagcctcccaaactgctgggattacaggcatgaaccaccgtgcccagcaagaaaagatttttttccaagatagaagaccaagtgagatcctcacttacgcttctcttcatctctccttttttttttttgagacggagtctcgctctgttgcccaatctgcaatgcgtggcacaatctcagctcactgcaacgtctgcttcccaggttcaagaaattctcccacctcagcctcccgagtaactgggattacaggcttgtgccacaacacctggctaatttttgtatttttagtagagacggggtttcaccatgttggccaggcaggtctcgaactcctgacctcagatgatccgcctgccttggcctcccaaagtgctgggattacaggtgtgagccaccacacctggccctcatctctcctcttgcttgacaaacctacacagcctttttgacctgcctcctcaaacccagaaatatttttgcaaagctctattccccagaggattctgagctgtaggaggtgaaagccagggtcctttgttcctgctttctttgttccgactttatgctctgtggctttcatctcctggggcaatgagttgggctgccctttggcagggctcaggaccagggtgtgaaattctagagcagaaagaacaaagttagatatttcaaaatatcatcctgctccttttatttcaggcccttgatccacttggatgcccctttctttttttatttattttttatttttgacagtctcgctctgtcgcccaggctgcaatggtgcgatctcagctccctgcaacctccacctcccaggttcaagcaattctcctgcctcagcctcccaagtagctgggattacaggcgcctgctaccacacccagctaactttttgtattttttttagtagagatggggttttgccatgttggccaggctggtctcgaactcctgacctcaggtgatccacccacctcagcctcccaaagtgctgggattacagacgtgagccaccgcatctgacctgtagatgaacctttctaaacagggcccgcactgggctgtgggactccctgccttctgcaggtttggtggggcagatacctttctccaccctaggactgtatttgttttcaagtagtctggccaaagcaatattccctaaactttaggcattcttggatccctttatgagttttgctattttggcatgctacatgtaagttttgcttaatgtttttatgtaaagcatcttcctccttttacttcttttattgtgataaaactcatataaaattgaccgttttgaagtgtaccattcagtgacttttattacaatgttgcaaaactatcaccactatagtgccaatttctcatcagcccaaaaggaagcccccttgtgtttacacacacacacacacacacacacacacacacaaactgtgtcctcccatcccttgg

SEQ ID NO: 3030 - DNA, 1496 bp, Homo sapiens
ttcctccgcagacccaggccctccggaaggggtgagtggggaggggctttcctgagcctggagctgggctttggggcagcctgcgaccctccccgcttgtgtcccttctcctgtgatctctgtgttttcccttttctttctggggccaggaagtcagggtcaactcccaggcctcagatgcaggggcccagaacacctgctctcacctgagccccaggtgaaggggcccgggaacacctgctctcacctgagccccaggtgaaggggcccgggaacacctgctctcacctgaaccccaggtgaaggggcccggaacacctgctctcacctgagccccaggtgaaggggcccggaacacctgctctcacctgagccccaggtgaaggggcccgggaacacctgctctcacctgagccccaggtgaaggggcccgggaacacctgctctcacctgaaccccaggtgaaggggcccagaacacctgctctcacctgagccccaggtgaaggggcccggaacacctgctctcacctgagccccaggtgaaggggcccgggaacacctgctctcacctgagcccctggtgaaggggcccggaacacttgctctcacctgagccccaggtgaaggggcccggaacacctcctctcacctgagccccaggtgaaggggcccggaacacctcctgtcacctgagccccaggtgaaggggcccgggaacacctctcacctgaacccgggggtcccatcccaggaagaagggccatctcaggacatgagtcctcaggggccctgcacattcaatctgaaggtgaccctggcctggctgaagctggaagagctgtggggactcagcctgtaaacagagcgtaaggttcacatgctggttgcttaatccgtttctggaggaagagtatgacacccacttgtgatggggtccttgtgcggtggggaccggggccggcgggctccaggccagcacacctaacccatggatgtggaacctacggccgagaaggaatgttgcatgagtcggatcccagtccattgtcagtggagggtgagggtgaccccatctgctatttttgtgctcatcctcatacaaccatttggggatgtgcctattagggctccgtaagaactcagatgcctgggaagcccagcccctcaggtgcccccacacacagccttcccttgacgcctacatttctaggcacatgtgaggcatctttcctggagccccgagccagccctgtccctccccagtgcagcatggcactcaggagatacaggctggacatggggcagtcgttctggggaggcctggcctagcagccacccacctgagccctcccggccaggcttcgtgctggggtgggccatgtgccaggacaggagggtcccggcggaaagccagccccggactcatcgtgacattgagatcccactggagggtaggggtggtaataaacttctccaaacgatcgttgtcatttt

SEQ ID NO: 3031 - DNA, 372 bp, Homo sapiens
ctgacttccagggttccaccttggccagcgaatggaaggaggaaaaacatcaaaactgattttatgtcaccccttttgagaagctggtttgaaagtcagatcaccatcctggaccaggaaacaagcacagatatccacaggagccagagagccggggggaaggattaaagcaagagaagagtaagaaaatcaacagcccaagtgtgacactagagacaggaaggagtggtggggtggcgactaaccagggaatacttggcttcaggggaccgtttaattactcagtttcagctggtgcctactatgttaagaatacatgtttgggctttctagacactttgatctttcaggaagagcagattttgtgaagaa

SEQ ID NO: 3032 - DNA, 3222 bp, Homo sapiens
agtgcagctgtgttgtcaggcccagaggctgatgacagagaagcgtgagaaaggacccacagtcagaggaaagggggagaactatggcggattctgcagacatcaaaccatctaaccatttcacgatgcaatgatgcaccagcaacagccacatggccacagtggaccccgcaggcctggccctgcatcccgcctgccccagggtctggggtccatcggatcagcaccgcccaccacaagaaggcagtcatctgccagccaggaggagaggcctcgccagaaaccaatcctgccaacaccctgatcttggacctccagcctccaggactgagaaggaaatgtctgctgttgcagcgcccggctgtgctgctttgctccagcctccccagcagaccagtgtccagtcgttcaagggaatgagcctgtcagtagaggctgggctttgtggtgagccagcagggaaacttctcggggagggaggagggcaaagagaggccagcctggtggggaagaaggggtgggagtggagaagacacagaggccgcacactgagtgaggaggaccaaggcgcaaggcccttttcaccaggctcctgtgctctcaggggagacagggagggtggcattggctagaagggcctgcccagccctggagaaaggagctcacagcagggtcgtgaagagggcagggactgggtggggggtgctaccatgtgacctgctaggaatgaatctgcgttagcgtccgtctggctggagtagagatgcttcagcacgtgtggggctgcacacaggcacgcagggtggaggcccctccactctacagccccacagccagcacctgccttctcacctcttctagtccagggcccgagaagccattagcaaccatcctcacctcagtgtgaatctgcaactctgccgctccagtgtgaaggaggagaaggagagcaggaaggggtgtccaccaccacgtgcccacaggagcaaggctcccaccctcccggggtatgaacttgaacccctgtgacctctgtgggtgcatctgcacagaatgcaggtcccctgtcccccagccaccgcaccacaccagcctagccatcctcgcgagccgccacaggcctgggaccccccagggcactggaacacagcagccccagtgagcacctggagcccgagcctggaccggaggccacggacggcttcgaacaggccagcccccaggaggggcggctcttctacagccagcccggcactgcccgcccagcctcccagatccagaggcagctgctccagagagagtgggggctccagggacttctcccaagcaagatgaaaacacaggtttttgcgtgaaagttccttcttaaatactgacagcaagtttagagcccatctcagatccctggctgtgctccatcagcccaacagccacagacccaaaatttaaagtagccatgcgccctgagagcccaacctgcctggccacgcacaggccagccatggtcccaggagtgggcgtgtgcccccgacaccacacagctgtgtccctcccttccatcccccacccacaggcagagctggaaagatcagcaccacggagagagacgagcatggccagtcccaggcccccaggccgccctgcccacctgccccatccctcccgaactgtcccctcagagctgggtcctgggctgagactccccaaactgtgaccttcaaggcttctcacacagctcaccccagcctcacggcctccagctctgccgctcactgtccccaccacactctccctggacccccacccctccagctgctggggcaggaaatcaagcctccgactgaccctcctggtgggacccctgaagagaaaggcgtgtaagggggactctgtgcacacctgcgtaagggggactctgcacacctgcagaaccgcccatccctggagcccggcctgcagtcaccgtcgagaggagaggcctggagcacagagtggatcctgtggcatggggactttgccgttggcagaacacgcaccctggggggaagggccctggctccatcgtgcccagcaagtacctggcccatatcagggacatatgagtaaaggacagaccacctggtccagtccccacttgcctgaggacagcagcccagacccccatgaatgatgaaagtccttctctgggttgagctgaaacctcccttccttatctcccacccatgtcccccgtccccctgggaaagtctgcggtatccaagggcagccctgggctccttcagctctccagtccccatggtgaaagatccgcagagaggccaaccctcccttgggtcggctatgccaggcgggcatatgagaggccccagacgtctgcaacgctggcccgatgcccatccagtgagccagccccgcgctgcttctatccagggagtctctggatttgggctcctcaggcagcagagcacacatggagacgcggagaccccagagaagaccccacaggactggagcccaaggccaggggctgtgaggggaccccagtgaggggactgcagctgccccagctccacggcgcaactgagcttcagagagcacacgcccgggcctcacacgctgggcctcctggcctcagcttgcctaccctgtgaggacgaccacgaagtccatgacgttccagccgttccgcagttccagttcctgcgtcctccccttgttcctgccagcgggggatggcatcacgcaggcatggtgaatcctggcccttgggacttccctgcgccttgcacagatcgcacagattgtggtagatggtcccttgcaagtgtcatcctgcctgatgcatcaccaccgaggaagcgaccgaagtcagagacagaggatgctgccactccccaagaatgaagccgggcttcattcccatcacctaggctgcagtacaggggcatgatctcggctcactgcaacctccacctcctggactcaagcaaccctcccattccagcctcccaggtagcaaggactacaggcacacaccaccatgccaggctaatttttgtttgtttgtttttgttgagacggtgtttcaccatgttgcccaggctggcctcgaactcctgagttcaagtgatctgcccaccttggcctctcaaagtgctgggattacaggcacgagccaccacactcagccttcatcatctaataaaatctaaccaaatcctt

SEQ ID NO: 3033 - DNA, 1416 bp, Homo sapiens
aggcaggcgttgtgcacaatcagccaccagtctgggagagactgggctctgagcagagaaaaaggagctgggacagccagaaaatgaaaaagcagttgtggccccggcacaggatggcagcgaccaaaacttaagagtaggggtcctggcccaagtcccattcttctggacggtacccttggttaaaggctagcacagggtgccaaagctagcggacggtgaggagcctcagaaaagggactgatggacatcctccgaggtaccccctacccgctactggacctggtggcccccggggaccctgtcgtcgaggcacctgagagtgaaggccttcagcggggggcattgttcacagcgaacggcgggactgggggaggcggcgggacttcgggatccgcgcaccgccgcctccccaactgggccagaggagcgagtccaccgaggccatcgccaggtggagcggcggccccggcgaggtaccctcggccagcaggagggagaagcggagggcgcgtcccagaggcgggggccaagggtctgccactcacccgcgccttcggcgggctgcggcggcccgacgacgccgttcaggtagagaatgggcagcaggtgaggctgcgtcttctccagcgccgcccgcaggtcctggaagtggtcccgctccttggccaagagcagcttgagcagcagctccgccttggcgcctcccgcctcctcgtccagctgccgccgctcgccgggactgagcgctcccgcggcctcgagcagcccgagcacggcttccacctccgtcatggcctgggccaggctctgctgacactgggcgagcagctcccggcgctggggctccatggtggcgggccgcgccgccccgccccgccggacgcctcccgggccccccgaggccggcgggcgggcaggcgagcacctcggcagcagccctagggcgccgggagccgtgaggcggcgggagccatgggccggggcctgggcgggctgggggcccggggcggcgggcggcgctcagcagcggccgcctcccgggctccggagcgcagccatgttggctgccgcggcggcgggactggaagaggaggaggaggagacggaggaggagaaggaggaggcggaggtggggacggcggccggggcgcgccccgaggccgggctccagccgggcatgctccccctccccctcagcctccgcgcgcgccgcccgccccgcgagaaaactcgccccgaaagccgggccgcgcgccgcccccagagcaagactacaactcccgggagaaagtcgcctgggccgtgtttcccaggctcccgacagctccggcccggctcggaggccgcctcggcccccgtgcaccccggcccggctcaccggggccccgcggccgccacccgctcccccgtggc

SEQ ID NO: 3034 - DNA, 10319 bp, Homo sapiens
cttctgcgagggcgcgaggactccaggagccgtcctggttcgagcatttctgaagaaactgagttcccggcgttcgcagcctgggagtcacaggcgcccacccaccggtaggtccttgagtttcgagagccagtagctgaaggagagaggagaggcaagtgcctacaactcccagagcactgcgcggaggcgcccggccgcgctgtcctggccgccaggctgcctctcccgctgggggccgccgcgctgtctgcgggctactagcgccgggcccctccgcgtcgccacgcctgcccttcacagccttggcccataaggtcaccgaggggcgggaggcgccgcccgggccctccttggaggcgggcgctgctcccgcaccatcctcccccagttctcttagactccggggtactttggaggccgagacagacacgctgtccctgctgccacggaggtccctgcttgcaggtgcaggctgttagaggagagggtctgaaaacaagaaaggggaatagctgtatgataactgcttgaaggcgagagggcccagcgacagctctgttttagacagggcctccaggcctcttagactcagtccctgccacgcacccactcctgccctggccgctgcgacggcataatctcgggatctttgaaggcagatgcggggctaaaccatcccacctgacgggaaccctgccacaggacccgacatatccctgtctggacactgctgtaacgagtcaaagtcaggaaggactaactggagcccagagattcccaggtgctgctgcctcagacctgtggactctttggaggatctcttacagtttgtgaacttctcagttcctctactgctcccacagacaacgttgctaaacatattaattggtcccataaatacttgagcaaaacaaatgcgaaaatctgtcccgaattcagcctagaagaagcccagccctgcgcgtcacacttctgtgtagtggaaccccccttcccaccccgccgcaggccacagcaggagggccagcagacggaaaggcgaccctctccttgttgaggattcctttcgatttccttccagctgacattctaccacagttttagctgcttgcaatcctctcaccgtccctcatcacctacagtgtgtgattcaaattccttagcacaatcaagaagcccctccttagtttggaagttgcctagctctccaaattcaactgcctacctttcccgtctggaacttgccaggctagtaaattcagagggtttgcagatacgtagatgttctatgctttacctaaaatgcttttacctcccagccaacttttttttttttttttgagacagagtcttgctctgtcgcccaggcttgagtgcagtggtgcgatcttggctcactgcaacctccgcctcccaggttcaagcaattctcctacctcagcctcctgagtacctgggattacaggtggtgccaccacacccagctaatttttgtatttttagtagagacggggtttcaccatgttggtcaggctggtgtccaactcctgacctcatgatccatccccctcagcctcccaaagtgctgggatttacaggcatgagccacggtgcccagctctcccagccaacttttgtccttcaagaccttgtacctgtctggtctctaaaaagtacctggccttcctgttgagtcatacagccctgcctccaagtgtcagcgtagttcatgctggagacctcttaacagttccatggtatgacactgcggatatggctgtcttttctttgtatcagtgtggtgattcagagggtatactagggattctagaacgcacttctggctcaggggctgcttgtgtaacttctgtttctcagctgcctggtttgtatcatgggatgatagtatctcccctcagaggattgcggtatttcatgaggtgatacgtgtatggaggccaagtgctgttttatattttaagtgatctacatcttgattttcacaacaactgtataaaagtgatactgttggccaggtgcgttagctcacgcctgtaatcccagcactttgggaggccaaggcgggtggatcacctgaggtcaggagttcaagaccggcctggccagcatggtgacacctcgtctgtactaaaaatacaaaaattagccgggcatcgtggcacacgcctgtaatcccagctactcgggaggctgaggcatgagaatcatttgaacccgggaggtggaggttacagtgagctgagatcgcacgactgcactccagaatggatgacagagcaagactctgtcttaataatagtatcacttttttttttaatcaacaatctcattttgtaaatgaggaaatcaacttacagacgacctgagtgacttgctcacactgccagccaggaaagtgctaggatttgagcccagactgtccagttacagagattacactctgccattgtgcctctccagaagcactggaggtaggtctagtgcatagagtaaatgtaaatgctgaaacaactgtggccctaatgaacatcccatttctccagctttttactctccccttaacttctgaatgaccgtctgcttctaatctgccaacttggtctaagatcctcacggtgtttcctcctgattactgttaatgcacggaggttgtctggaaggttcataggcagcctgattgactcagtatgtattagctgagcacctttggagggcacagcctgagtggtgggaattagttcctgggggctgtcctgcggtggagactcccgtgagccctctgtcctgctgtatgaaggcagccagtggaaaggcatgtcctcgctggtgctcaaagtaatctgctacttctcttactacacttttcattcattcattcttaaatcgttgaaggcatactctgcaggtactcttgggcacagagatacggtgtttagtaagacaaacactgttcctgggtcttaacgggctttacattccaatgggataaacaacttaagtaaatattttcagagaggagtaccaagaagaaaaggaacaggatgatataatggagtgacttggagatcacaggtggtaagaggtcactctaaaaaggtaacatttgaaggctgggcacaatggctcacacctgtaaccccagcactttaggaggctgaggaaggaggacagcttgagtccaggagtttgaggccagcctgggcaacatggggagaccttgactctacaaaaaatttaaacattaactaagtatggtggcacgtgcctgtagtcctagctactggagaggctgaggtgagaggatctcttgagcccaggagtttgagactgcagtgagctatgtttgtattactacactccagcctgagggacagagtgagaccctgtctcttaaaaacgaaaacccgactgtatcaaaaggtaacatttgagtgggacttgaaagagtgtgcatgcgaaggactgaagacagaatgttctgtgcagagcgaattaatgcaatggctttgcagtgcagatgggcctggggtggtccaataaggttaggaccaaggtggctggagcatcatgagacaagcgtggtacttagcttgcctttggttaagtcactttctctatttgaatttcagtttctcacctgtaaaatatgagtaattttatctgtattagccagtgtgtaattagaggaaaaaccatttaatacagggtattgtttacaaaggtgttggaagggcatgagaaacaaggggagaacaagggcacccaaagcctgacccccacaaggctagaggagcaacaggaaaattcgtttccagagactgattcctcagctgctgagcaggagcctggagccacacttgctgcctggtactactgacacacaactggaaccaccgctgtggcctggggtgccaccagaagccagagattagaattgctttccccatctcatatcttccaaactcccaccagtgcctcccactggctgagtcagatgacaagggagtctgggaaatgtagttgtttggcttccagccctgaccatggagagtatagaaaggcaggtgtaggggagaaaatagatgccattcacacagcgcctatcttgcagggctgttttgaggagtaaaaactcagcctatttttattcctcatagcatgtagtagcattcagggaaaggcaaatcttccaaaacaatatcttaggtataatagttctacataaaggtttgaatttaccattaaaagcatcaaaatgagcattttaaaagtagaattttaagtctgaatgggcagtatattcacatggtataaaattcaaattacaaaacaatatacagtgaaaaataagggggtttttttgctcatcttcttgtgacctggctctttccatctctgtccacaaccctctgcaggcaataactggtacctttgttatggatcctctgcagatataaagtagacatatattaacaaatgttttctttggcccagaggatgcatattatgcacattcctccatttcttgtttgtttttgttttttccacttaattgtatcttggagatcactctgtatcagtatatatctgatttgttttagcagtacatgataatccattgtttggatatgccataattgtatcagccagtctctggacagtcttttactatttcaaggagtgctgcagtaaacatgtttgcgccacttcctggtacccattgcaaataaaactgggataatttcctgacgagaacttgctgggtcagagtgtaggcacttgttgttttgataaatattgccagactacaccccactccctccagcagtacatgacactgcctatttccccacagctgtgccagcatggtctgttagcaagtgttttctttttgcaaatttaaaagtggtatctcgctaaatgcaatatggtagcagaggacatttgtggaaaaacaggtgaaatctgggctgggtgtggtggctcatgcctataatcccagcactttgggaggccgaggcaggcggatcacaaggtcaggagttcgagaccagcctggccaatatagtgaaaccccgtctctactaaaaataccaaaaaaagttagctgggcatggtggtgcaagcctgtaatctcagctactcgggaagctgagtcaggagaatcgcttgaacctgggaggcggaggttgcagtgagccaagatcatgccactgcactccagcctgggtgatggagtgagactctgtctcaagaaaggaaaaaaaaaacaaaaaacaggtgaaatctgaatggggtcttgagttcagttaatagtaactgccaatgttggttcttagttttgacacataccatgactatgtgagatgttaatgtcaggggaaccaggatgaaggctatacagaactgtactatttttgcgacttctctgtacatctaaaattatccttaaaaaggtttctttaaaaaatgacatcttgttttctgtaaaatttgaatttctcatgagtgaaatggaacgttttgaatatgatgctctttttaaaaggtggccttaataatttgtatttactaaggaaaaaagtcagagtttatttactttaaaaaaattcaggccgggcgtggtggctcatgcctgtaatcccagcactttgggaggctgaggcgggcggatcacgaggtcaggagatcaagaccatcctggctaacatggtgaaaccctgtctctactaaaaatacaaaaaatgagccgggcgaggtggcaggcgcctgtagtcccggctactctggaggctgaggcaggagaatggcgtaaacccggggggtggagcctgcagtgagcagagattgcgccactgcactccagcctgggggacagagcgagactccgtctgaaaaaaaaaaaaaattcattaacagtacatttaaaatttctgttactggagattgtatttctcattccatccattaatgtgcagcttcaatgttttcccccagatatgcaatttcacttacaggatcttgttcttcagtgacatgtcataagagttaataattccacaagccaccctgcactgctgtgatcctaacaatattgaaaggttggtgtgtatcctttcctacctttcctcattctaaaatgtttcctcgttctaaatgccaagctggttttgaacaactgacctcaggtgatccacctaccttggcccctcaaggtgctgggattataggcatgagctaacatgcccagccctaatctgctcttcttagatggatacttgtcagattgggttaagacccactctcatggcctcattttaacttaattttctctttaataaaagtccaaatgcagtccattctgaagtactgggaggttaagattgtgttatttgaattgaagtgagggtgaggggcaggggcacacaactcagcccataacacgtaggattaaaaaaattcttcgggtccggggaggtggctcacacctataatcccagcactttgggaggccaaggtgggaggatcacttgagcccaggaactggaggatgcagtgagctatgactgcaccactgcactccagcctgggtgacagagtgagaccctgtctcaaaaaataaagtgaagcctcagcctcagcatacagtgaggcagtgtgtgtgtgcagtgaatcgaagttccagtcatcattacttcatttcagggctccacactgccatctgggcatccccaggcctctctggactggccctgccccaccctcatggaggtagcctttacctggcaggcacctcagaggctggtcctatatgtcacatcattgagataaaaagaaatccaaggctggaagcagtgacaaatggtgtggacttggtggaagttgcccagggagatggatgagaatggtgacatcacacatagcacggctttttctccaaaatcccaggacttaccacagtggccacactctgtctctcacctgttcactttcttctgctcgctcgctctctctcagcctcccctgtcccaccttttccatatgcgaagactctcccccagcacccctgtggtggtttaaaagcatggcagcaaactcctcggcattccttccttcagggtggtgcctaagtcccctcccagggaatctgagtgggcctataactgcttcagtcagcagggtgtagaggaagtgatgctgaatgacttttaaggttggctcctaaaaggccatagaggctctgtcactggagctccctgtgctgtgatggaagtctgaagtcttaatgctgaagaagcccaagccatgtggagaggccaggtgtcaaagctctagtgagcatcacagctgagcagggacagggccctctgcttcttgtggagccctctctagattccccacacacagaatccacaagcagaatgaagtggctgtgatttgatgcccctggtttccttgttatgcagcagtagatcactgaaatcaacccccttctaaaggcctctctgcagacattctccacttggtgagaccaaagctagcctaacagggctcagcagcagagaagcccagccattggccaaaaaagccactggctaccatgcagccaggatgtccttggggagccttgatctatcccaccacatcaacatttccacctcagacatgggaaaggcaccaaggtgtgagcatgggcagtactcctagggaaccccaagcacaccccattgccccaagatgcaaatggaactcctcactggtcccatagttttacaatgtgagtctaggaaagcacagatgagccctcttttatgttattgtccgccttggcggagaatggaaacagcaagaatgctgagcttgtggtgcagacttggagatgcatttgtcactagaaccttagcgcgtgcttgtacaaccctggtggtggagagatgaatggacgaggcccctcctttccatagctcatgtggccagcccctcatctaaggcaggggccaaaacagagcaggaatgtggaagggtggccagctgtcctggcttgcctgggcctgaggggagtcccagggcatgggatttttagttttaatattgggagagttttgggcaaactgggccaagttggtcacatgagggtgtggcaagcaaggcaaagatggtttgatcattgcagcccctcacttcccatagctcactgcagagcctgtgtcatcctgacaacaacgatgtggaaggtgagacatctggcagcattttgacttcatgaactgggaaacgcacatgggtggaggcgcctgcccacgctgcccagtgtctcatggtggccacaagaggctgcggctcctgttgctcaaacagggccctgttcttgtccagcatttccacagcaaggcccctgctcacaccagacacttccagggaacccttggccagatgacagcagttgctctggtagttaacgttatgggaaacagattctaggaagcgcccatgcatcgcatcacactttttcatctctccttctgtccatccttctgcccactcctagttagggcatgtgtgctccaggctgggagccagggcagcctcatgggtcagccccatccgcaaggaacccatgtctggggagacaggcattcaagaatgagatattttcaggtgagtgctaggcaggcgatatcactgaacatacttaggggtgagtggggaaggaggtctacctaggtaaggaggtatgtgagtctgtcctagccaaataccacagactgggtggttgaaacaacacagttcctgctcacagttctgcaggctgaagtgcaagatcaaggtgctggcagatcccgttccggctgaaggcagatgtctgccttcttgtgtccccacatggctgagagacacagagagttctctccttataagcataccctttctgtcagattaagatgccaccctgtggcctcattgcaccttcgttgcctcctaaaagccccgtttccaagtacagtcccattctgaggtcctgggagttaggtccttaacacaggaattctaggcggacacaattcagtccctagcacccccgttcccagttggatcaaggcctcaaaatgaagacaggcttgtctcacctcacctgtccctcttctgagaagctgcaagactgagagggagctggagataataggttgatttgggacaaggacactacagggtgaggacatggctctgtgtcccaaggttttggggcagcagactggtggaggaccatgctcaagggttctgaaggggagcagcttccttggcagcccgaggcccaagacacagagggcagagcacacagatacgagctggggctggatacattgctgactctgggtagaaggcgatggaaatgagggtctgacgctatgttcaatcctgtcccaccctatgtgatggctggagggacaagggaaccccagtaggatgatggattcctaggggttgcaaaaggaatgggcagggccagccatcactgagacagcacccaggcggtctcgtaggttttgcttagagactgtgtgctccacttgccattgccaggagaggcatccacccaggcgtccatgaatacatggatacacacaaggaggtgcagccacatgatacaatgtgattcagctaaaggagagtggagctccggtccatggaccttgcggaggcaccttgagaacattgttccgggtgaaagaagccagacacaaaataaaatattgtatggttacaacaatgtggaaatgtccagaacaggcacatccacagagacagaaaccagatgtgttactgccaggggctgggggcaggagggaaaatggggatggcttctcgggggaatgaggtttcttttgggagatgagaatgttttggaagtagatagaggcgatggctgtgccacattgtggatgcaccaaatgcaactgaattgtactctgaaatgattaattgtacattgtgtgaatttcacctaaatttaaagaaaaaggtgaccatgagagcaaaatctgtcccagccatggaaacccccgggctcacctgggtacacttaaaccgaactctctggccccttgctggtctacctccccagcccagaccaacaaatagcaggtcctggagatatctgggcagcatccacacatcatttccatagagcacatgccaggggccctggcatgagtgggacagagatgagggagaccaccgcagagagccacaggatagatactgtgctgctcacaaaggtcctttaaaattttcca

SEQ ID NO: 3035 - DNA, 789 bp, Homo sapiens
gctgatttctaagggcctctctcaagaagctcgtgttgataaaaaggtaatttcaggtgctcacttgagagctgtgaattaaaaacagggaaaagatggcgggtgagggcagcaggcgaggactgttttgtttgcagggggccagggtaggtcactctgctgcggtgaccttgcggctgagccctgaacaatgagcagccgcagccaacatgcagggatcctgcttgggggctggaactggaatgttgaatgtttcaggaacaggagggaggacagaatggggcttggagagcttggtggcaccagttcacccacagcctctgggctctagtgaggaaatgagaccccagcagagaccagggggtcagttaatgttcggatcaacatcattatgtggtcccttagctctgagtgaagggcggattgggaggcgggcaaggaggccaggacaacatacaggtgacataggatggcggcatgggcctgggtgctgtgcttagagccagaagtgggcaggtcgcgagatacttgagaggcagagcccacaggacttgctgatggcttctgtgagggggatgacagggaaggtgaggaatcaaggcagagtctcagctttgggatctgagattcattcaacaaataattcagtgccgcgtgccaggcctattctaaaagttgaggatatgaagacaacaatggtgatggcctcaagcagtaatcccagcactttgggatgttgaggcaggaggatctcttgagcctgggaggtggaggctgcagtgagccatg

SEQ ID NO: 3036 - DNA, 8113 bp, Homo sapiens
atttcccaaatgtggccttgggttttcaggagcccagtagtgacttctgtggtccctgacttgcaccctcaccctattattggagttgtgcttcatttctctgtgtggaaagagtgaagtattgggaaatatgaccctggtcaccaaaccaactcagagacagcaagtgctttggcaaaggaaagggctggcacagagaacagagtcgatttctcattgtcttcaccaatcttctgaacccgtgaatactttttgcatgatgatttgaagcagccaggaggccaagacagcggccaggagaagcagcaaggaattgagccttgtacatttttctcaaaaaaataaaagatggggaaccaccatgctcgagataagaaattagtctgtgaagagaccttcaagttctgtaaatggtagaaaaaaatttaaatgagacatatctttctcaatttgcatcccaattattttcttaaattgtcattcactgtaacctagggaaaacagaattcagaatcacatggcagtaatgattttcatgtcctttccctaactctaccatgactccgctcccctaacacacctaggtgtctttctttcctttgtggctcatgcaatttcttctgcctgcaattccagtaagaatggagactctgggaatggatttcagaattattcaggaggaataattttcaggatgtgtgagtgatcaaatctaggggccaagcaagtcaaagagtgaaagaagagctcagaagttgaacacatttaagaggaaagatgaaaattttggttcagtggtgtcagtagtcaactagatggaagtgtaagaaggaagatggaaatgggagactacaaaataggaaacagagctacaaagagaaataaagtaatccaaagaaagagcatttattagtggacaccaagagttggacgtagatcctttggaaatgtaatatttcaattgctcacaaattctccaaattgacaatatggcaagtctattcaaagataagtaagtcatggtacacagaccaactctattacaccaaggacacataccaagactaggagaaaagagagactgggaggaataattctgccttcggaccagaggaagagagcaagagttagagacagcttcctggaagaggtggcatttgagctagctctttaagtttcaatgggagaagaaagaaaaggcatctggaaacaaggaagcagcagtagcaaatgaggaagaatcagaagggaagccagagagcaccattatcaccagaggatataccaaatccagtcattcataagctatttattttgtgtgattttaaacaatagctgctatcggctgggcacggtggttcacgcctataatcctggcactttgggaggccgaggtgggaggatcacctgaggtcaggagttcaaggccagcctggccaacatggtgaaaccctgtctctactaaaaatacaaaataaaaattagccaggcgtggtgtcgtgcacctgtaatcccagctatttgggaggctgaggcacaagaatcgcttgaacttggaaggtggaggttgcagtaagccaagattgcaccactgtactccagcttgggcaatagaacaagactctgtctcaaaaaaaaaaaaaattaaaaaaaatagctgttaccttctccttaaaattaatttaagttgaaggcaggattatgtcttacccagctgcactacaatgcttttacagagaaggttcctaaattttaatttagtacatatattttttcattctagtttaagttacctgaattagcaatgcactgtgctccataactttatggcatttttatccataaatggcatttatatttgtgaagttctttgctttattttaaaaagcagtaatggatatatgtttaagtgaatgtggcaacatcggttatccccattaggctatctaaaaccccacgacatgaaaagggtccactgcattcaaagaaaagaaattatccaagcatcttcactgctctcaccttttcattggccattgaatggtaccaccaaaacagtcgtgttgtgatataataagcaatgatcacatcgatagtgtagtgttcgtgtgctacaagaatgcagatgatcccggcagcactcagcagccagcagattaaatgataccaccagaagtgacgaggcgaatctggacagtagaaaaattacagagttaataagattcccagagatgaatgtaatgattacagtctgtcctaacgaccttaagtagaataacccaggatcaggaagtcaccagaaggataaaactgataacctaaactgagtcactatgaactgcccaggatctgctcaggtaggagggaggcagaggggctccctggcagcgggcgtaatagtcattcactggggaagctggtaacactagacattctaggccttacccacgtgaataagctgtttagtaagaaagaacagaattgtttcttattaggtttgctggaattgctgcatactggctcacataaaggagccactttcccactggaaagaaagatagtagggatcaaaagaaaaggtggtggtctatgaaaataaggggggaaatgggaaagcaggagtaatttcaggttttaaatttatattatttctccaggggtatgtgtagggtaagggggtcagaaggaatggcattgtggctagcaatattttgattctcagcaattttacactgttattgccaatagaaactataaaacattccctctgtaaaggttagggttcctaaccattcacttatggactcagccttcctggtaaagccacttaaaagttcattctacttactagctgtaagagacaactgtggcactcactggtttaaacatgatggtcctccccttctcacacaagtgttaatgacaaatataactgaaaccagagttcatctctagcagcttggtgatctgttttattttaaagctgtattagctcacaataaaagttaatccaataaactgaaattgatttcatatttaactatgtttacatttatagtgatatttacattcacatgtagaaagatgattgaatagcaaaaggatccatttccagaactttatatttatttatttattttttgagagggagtttcgctcttgtcgcccatgctggagttcaatggcacgatcttggctcactgcaacctctgtcccctgggttcaagcgattctcctcctttagcctcccgagtagctgggattacaggggtgcgccattatgcctggctaattttgtattattagtagagatggggtttcaccatgttggccaggctggtcttgaactcctgacctcaggtgacctgcctgcctcagcctcccaaagtgctgggattataggcatgggccactgcgcccagcccatttccagaactttaaatgaaataccaaatcaggtatcattcaaatataatctcttggtaaaactagccgttgctctgttggtcccaaatggcacacagtaagaaaataaacctgtatggcatttgaaagtctgattttctaattttggatatattccttattacttgtcagttacttcattctgccactaagttctggaagaaaactcatggaatctcagaattttaatgggagaggccttactcttgcagtcttaggagccagatccagtccccataactgttgtgttagactcaggacattaaaaattgaatgaacattgagaaatctggaggtctcactaaatatgcgtttcccagcacctcagaccctacccgcctcccacccccaaggtctcttagcaaccctgcttcccaacttacaggtcatctgggatttaccttagaagttcaaaatgtttaggcaaactagaactattttgcatttgtttattcacaagaagcaaagttgaagtaggtccagaggtggcctgaatcttctttttactactcacggaattgcaagtgaggttttaggaacggctggaaaccccagcagtgctttctcataaaaatgtatttcctgttatgctaccacattgggcccaccactcattaactgagaacactggctgacccaaagaaaagattgaatagaagctgttttgaaatagaatggcaaaatggtaatcctcttctcattcatcccatagggataacaatgagctagatgatgacacaaataatagctaacatcactgtctgtgtggaattctagccctagggctcattaaataatagagacttggtagggtggccaggtgaaaaaacaaaaaaccaaaaaactgttctctactagccagatgattggcactaacagctagtctgatttctccaggctaattttatcatgaacctaccccccaattataatatttgcacgactgtatgaagccctcccttgctaaccccgaaatggtcctggtgccacatcttcatgtgctctcacaactaaatttaaatctactcatgacaacagagcaaacaaggaaaagagcccaaactgatcaaaaggcgggaaagtaaaaaaatatatatataaatgatacatctaattctagaagcagacttttcaaagaaaccactggaaccactgcttactcagaacaagaacatatggtataatttagaagataaatgtttttcctaattgcatagaaaaaaacagacacaaacatggaatgctctgcttacatacagaactgactataaactgagtttgtgttaagtattacagatttgtccctctatttctaatcaaatattggagaaagcagaatggtattccttgcacactatatataaatgtacacaattttagaaacctctagtcaaaatcatgtcttgggaaaaaatgtctctacatactgagaggccttcattaaagtataaaatcaatcacaagttgccttgctgttgctctgagatgaaagaatgtacaataatgagcaatgtccctgcttatagataagtagactattccttggcaatacgatagagttagccagcttgaatttccaaagttctaaacagagccaagaaattaaaagcaaaacccctggattcagcctccttcaacatgaatacctgcttctcaaaatgatggctctgcactgtggccaagtcactttctctaagcttaagtttactcatctgaaaaatgggaaaaaatactgcattcctcagagggtggttgtaaggatcaaatgagttaatttacatcaaggccctagaatagtgcctgggacagagtattatgtctatttgctattattgtttatgaggtttggcagtgtccccacccaaatctcatcttgaattgtagctcccataattctcatgtgctgtgggagggacctggtgggaaataactgaatcatgggggtggtttcccccatactgttcttgtggtagtgaaataagtctcacaagagctgatggttttataaggggaaaccccttttgcttcgttctcattttctcgtctgctgccatgtaaaacatgccttttgccttccaccatgattgtgaggcctcctcagccacgtggaactgtgagtccactaaaccactttttctttataaattacccagtcttggttatgtctttatcaacagtgtgaaaacagactaatacagttaatatcagttggttttcagttattttagaaaactgaatctaagtttcctgggggtgtttttattactttaaacctacagtgccttcactctgaaatgcacctcttcccccacctccaccctcatccccatcttcttctgtaatttttttatgatcctcagattatagagaagatcctaaactcaaatgtacatctacactagaaaatgactgatcttacatagcatactcatggaactttccttgggaaaattagagttagaaccaaagcaacatatatccttccatccaaccccccagaaccaataactcaatattagaaatggagtgactaaatttaaggaagagaccatcctctgatgatggtgcagagacagatccaggacccactccaccaccacaagagtgtgagaacagaaataaggaaaaagcttttaagtcaagtatgaagaccccacatgtatcccactattctccctactgcaggtctgtatgtagaatttacaaaggaagcaacaaaaagacgctacaattctcacaaaaaagacttgacttcatctactacagagaacctcaactcttgtcatcttaccctcaaagcagaacttaaataccccaggtaatcaaaggggcaataattcacttctgcaccactgaagataacccttgacttccacaccaccaattaggataaatctatttggatgaacaaagggccaagagaggagggaagaacaaggaggacaggggaggggaagctgccttctgctgctctctgctgaaagacccccttttaaatatgcccagtgaaaaggattaagataaacctccaaaaaatactgccatgaggtaacttggaactaaatatgaagggtaatactgaccagctttgcaaacatgaaggaagaagcattattacttcaaaaagattttgaggtaataggcctaaatatacaaatcctccgaaatatataaaaatgagacctactgggcagctaaaacagtacaaccctacaaagaacaagacatgattttggccataaaacctactagaaaacccaaggattttgtataatgtgaactaagcatacaaatatagaaagagatttttatttcttgccaccacatttcttattgagaagaaaataatcggtattggcaaaatggtccatgaagactcctatgaaagcacagaaagtgctagatgatgatgaaattagaataaagtgggacttggaaatgttttaaaaaggggaacacattaaccgaattatttggaatgctagaatggaagtgtcctacaaataattcaaaggtcattacatctgtctttagaatgtaccaatcctttttgcaataaaattaacaattaattccaatattaagatagcttttcataccttaagaagtactaaccaagaagggagatgttttagaggcatgttaaatgctagagagaagccagggccaggttttaagccttcagggttcaaatcacatatgactagttgaaattttatattttatatatatacagacacacacgcacacacacacattcacattcacatacatatatacacacacatccgtctctttcacagcttatcaatcccaagagaataagggctcctatcaatttcagggcccagggatccctcccactacagctatcagttcagtgggaatgggctattacttacattctttgatgaacaaataagtcagtgtcagcgtaaccgtgtgaccgctgaagaggaagtctccacataagatatgtgatccagttatggacaatccaccaccagaaatcaatcgtagaatccgttgaacttttgcctgagagtctccattgagctgaatgacacaagaagattaagaagggaatttacaagtggctaaaatcatgtttcagtctaattgtgtgactcttagaaaggacaccaggttgtgattttttttttctttttaacctagaaagtcaaaaagaatccaaggagaagctcctcaaactgggttttattcatttattggcaagctttattgacgttttaaattattcaatatgttactaataatatgtcttggtggtggtgtgtccttgggcaaagcttttaaaaatattaataaccaatgacttcaccacagctacgtgctaaaaagcagatcaaagctactttctttttgcagggggaagtgagggttttgaatggttaatatttgattcagctgcataccacattaccaatattctctgcagtgtattggtatcttgtattaggtgggcagcctaaagtggacagatatatagctgcattaatgtctgatcaaaacatttacaattaagaagaggagttgcaactcattaaataatttaaataggtttgaaaatgatggattagggatgtactggcagctttaaaaatgagtagctttgattaggaaaaac

SEQ ID NO: 3037 - DNA, 2844 bp, Homo sapiens
aattcactcagggcctaagagctttgggcagttaaatccccctccccgacaacagactaacaggtcccattttgatatcaagggctggggtttcaagacagggaactgtggggcccacgctgtcctggcctccctggaggcctggctgctctcatgccaggaagggagcttccatttactacgggcctaggatggccgccccgctgcccccagcgctccctgggtgggtgcggatcctggccagtcccccagacacgcagtctgctgaccagaagcagcgaccttcggggagagccagccaccagccagccactgctccagaggcaggcctggggccacccgggaggctttcctcaccacggaaaatatttgcctttggttgtcggctgatgccttgtcttgtgtctgaatggacaactggctgatttctctctctttggaacagccatgaaatgcgaaggtgtttaagagtaaaaaccaggcgagggcaactgggcctggcgtccagctgttttgaacaacactcttgtttttctcccagagtgaacagaatactttctgcggttcagaatactctgtgcactggcccctcttcccaggccccgccccagccccctcaggcctcacctccagctgctgcagaccattccagaactccctccctcttggcttctagtcactcagcatctgggggagagagcctcttccagctgtacatagctagcttggcctggccccagaactgctgtgttctggaaagttgtaggagaatccctcttggcgggctctccagcatggagaatcgcaggcctctgctccggaaagggaggcttttgagaggtcagattcaccacagccagaccaatgaactgtgagggctcataggggctggggctccggtttcaggggtgagaggagccaccatctgcccccatgcccactctgattgtaaatggctagactctggtgccggggtcagctctggattcatatcccagctcctgcatatgtatatgctgggtgaccttgggcagtttacttaacctctctgtgctttgtgtgcctaagctgcaagatactctaaattaaacagcaaactttcagtgctgttgtgggacgaaatgggataatgtgcttggtagctggcaggggctcaataaaaggtagcaacttccagggccaccagttcatggggagccaggtccaagtcttgtactttctatgcctcccagggagccacgtatgtctgcgacagagctggggaggacattctggggctgagggttgaggtctgcccatagagcagcggcctgtacctgcaggcaggtagagtatcatcctggctgagtctcagtgctcctcaaacattaaagtgtacatcctggtgagacgcagattttgatgcagcgggtcaggtgggacaggggttctgcagctgtaaggaactcccaggtcaagccagtgtggcaggtctgtgaccgcagctggtacggcaagatctcagccctggaagactctgggttctgctgaggctgggctcagagagagaatacaagttttgtcctgtccaaggagcaccctccaggatttcaggacaaggctctggctctgtgtccccaagccctcagtctcagagcttgggtcctgcagtggcctgggcaaccctccggactctccattcagcatttgttcctgacagcagtgcacggataaagagcagtttcatgctgctgaacttgcaatcacttcaaggcctgggcccctctgggcctcagtttccccactggcacagtgggaagctgggataagctaatcccaccctttccccttggtaattccccacattgctcttcccttcccttcatcccttcccaaaacacaggtctgaggcctgagcatccatcctaggggctgggcccccatccccatgactgcagtcatggggtacaagactcatgcagactcgtaagaacagccacttctgacctggggcctcgatgttccaggcactgtcctaggcatttgcatctacaaacttctcaccataatccaatcaccactgttttacagatgaggaaactgagccccacggggtgaagcctattgcctgagatcttgcagttggtaacgggtgcaggctggactcaggcccccacacatgcccaggcccttgagtatttgtaagggaagcagctgtttggttttcttggcacagagcatctgcctagctggtgagggcatggggaaagaggtgcccaatctagttggggatgggagggtaaaatggtactacctctttggagagctttctggcaatatggacccaaatgcaaattacatgtgccctctaacctgggcccgaagtcatctgcacaaggctaccaactgcaatgtcctttgcagcagcaaaacacgggatcccctagctgtccatccaagggggatgagggagatacatctgggaggttctattggctgagtactcagagaatggaagcaccacatggattaattggagcagtcttcaagttggtgaaaaaaagtgcagtgtagaaagtgtgtacagggccgggtgcagtggctcacactgtaatgccagcactttgggaggctaaggcaggaggattgcttgagcataggagtttgagaccagcctgggtaacatggggagatcctacctctacaagaaaaaaaatgaactaggcaggtgaggtggtgtttgcctgcggtcccagctacttgggaagctgaggtaggaggattgcttgagcccatgaagtcaggctgcagtgagctgtgactgcaccactgcacagtctgggcgacagagcaagaccctctctc

SEQ ID NO: 3038 - DNA, 8018 bp, Homo sapiens
gagggtggcagagcccagccaccagggtctgctccatgcctggtccctggagaggccctcaccctctctgctttcacccaacccgactgacacggagtaggaggtgggaatcatgcaggcagggagcttaggaagcctggttcaagcacacacctacacttgatggcagggaaataattatttcctgcagaatgggctgcaaatgtaacaaaccccctgaccttcagtctgaagagagagaactatcaaccacacagaagcaaagatccagagaaatactgagggatgctaccagacactcaaccagggccactctccgagattccagccagccacacagcaaagatgctggccggggacactgccccaaaccaccagacagaaccccaaagaaacagctccacacacagtggaagatacaccagagactgttagaaggaccatcagacaaagccaaagagacaggtagatgaaaccagataaccagccagagaggtggtcagagaacagcgacacaatcaaaggacccaccagaaacactgtaaaggactcagctagacccaggcagatacactgccgaaggacgagcaaggagcacaggcagtgaagccgtcggcgacaaagccagagagctaagacactgtcagaaacagtgccagagaaaccgtctgacacacaagcagagaaataccagagaaactgatagacgcaaacaggcgtacacccagaaaaacagcttgagagaagagccagagccacagccagatgctcagtcaggaagtatccacaccactccaaacactgccagagacactgtcagacacacagtcagacacactgccagagacaccgttataaagactgccagagaaacagccagacacacagccagaaaaactgacagagacgcagtgccagatataccccgagaaagtgccagagactcagctccagacagtgcagacatagcataacagagacaaatgtgggtatcagcctgaagcagctgcggagaggctggagagcaatgaacttcctggggcttcctgtgggagagggctcctgcctgccttttgctacccttgaccctctccaggaaagtcccctcctctgagcctgcttttcctttcctccctgtcacagccacaggtgccctgactgcccctccctggcacagtaaatctctctgtgtcctaagtggccccagctaccctttgcgcatcagtgactcctggagccttagctaccacttggcctggctccttctgaccctcagcccctcaccactcttcagctactcctcaggcctaggaggttaagacaatggccaaagttacacagccagcaagccgtgcagccaggaaatgaacccaggactgcctgaattcagagctggtgtaagagagagaaaacgagaccagcagccagaggcctacctggttccccaacctcagccctggccagtcgccctcacaccctcccccactgcctctgccatctgtccatgtctttctcctcacagccaggaagatcctccgcctcagtgccaggccactgcccaccacatgggagcaggaaccagggcatgggcaggcagaagagcaggcggagtggctgaggttagatccaaggatgggagtgttcagggagaggaggaatgggtggcctctactcccagctccttcctggtccacacaagcacacactcccacgtgcatgcgtgcacgcgtgcgcatacacacacacacacacacacacacacactcaggcccccgcggggggaggggtggcttcttcatcaaagtcgcctccatcagcctgatgagttactgtaagggccgggccctgggccaacggggctgcagccacgggagacgggtgctgctgagagtgagtgctgcagagtggggatggggtgccaagacagacactgcagggttgggggcacccagaaaagggagagactcagggaggagagacaagagggagggagagaggaggagctctgagtggagacccagagggacaaggagaggctgagataggaagaaatagaagagacgcaggggaaaagatggggcatataggagatgggcagagactcaagggcagagggagagacagatccagagagaagagaggagacccctggcagggtctctgcccaccctagagcatctccgtggcctgcccagctcctctagcacaatggaggatgggatggtggtcaatgcaatgtgaggcaagaacagggccttcctggaggctggaaggattcttgctggggatctaggaccccaacccctagggtacaagggtaaaaccccatctctgcccctgcccctgcccctgccctgcccctgcagatccagaaagccccaggccagtttcacttccccctttcctcagactcccaactgggcccaatgcccagtttgggaggctgaagccagaggcatccaggacacacctccatcctgccctggctcactccaggccacccatcccagggcaaagagcatctttcctgggaattttccaagtccacaccccatggctctgagatagatgtgcaggataaatcccatagagccccagataagggctctgcaaattagcccaggattcctctcagcccctcaaagaggtcagccccagaatgaggagggaacagagggggtaccccataagcaaggaaggagcctagcgcccaaaagcccctgagccccttgtcagcacaagggtccctgcacctctcccagcacagaaccctagtgtcatcattactcccacacaggtaacacattaagagtcaaattctggggccccaacttactgccattgtcccactgtggcataaagataccattacacaatgataacaacacccattgaaaatgacacagttgtaccgttgacaatgacacacagggatgttgacagtcaccacgatgacaataatgcagtgagtgacagtcacatacattgacaccaacaaacggggcaatgataccagttgacactgacacagtcacagtgatggtaacctcagaatcaaagatgcaatgagactcagtcacatcgagtcacactgacggtgacatcaacacagtgacacagcaatgttgatagactcagtaacagtctcacagaatgatactagtccacagcaatactggcagccctgaagtctgacagccgccgtcggtaacaaacagacacagcgacaggctccaggtcaggaacccctgttacccagtttaagaatctggcttaggacccaagacccaagaaccgtcttgccagtcccagcaatgttccgggttgccctgtacccctcccctcaccccatgcccagctgagggcagaacctgggggaaggaggtgtgagttttggaaagcctctatttatccctgcagaattacagcagtttagattgtagaaggccaaccctggggaagccctgccgccatcaggtcagggtgggggataatgagcaccactaactgcgtctcagctgtaattgtgtgtgcgggttgatctgtaatagtgtgttgcgcacttcagggtttgggttgctgtgggcacgccgaggctcaggtaggctcagtctggcctggacaatgaaggatcaggggggcctcaaggcaagtgacctcgaagcaaggttactactccaactccgaggcagggaactgaaatccaaagaaggtcaccggatggactccccccattgccaggcgtcagggtgggttcagaacatccatctgatgaagggcatccggcccagcacagagcggaggggactccccacagcttccagtccccgctctgactcccacagcccagactccagaatcccacagtgaggggaaaaggcaccttttatcctggagcctcatctccttcacctctccccacagcagcctagagggcccatctcaggaatgaggcaagaatgcaggacacagcatggactcactgattcaaacgcctggggactctagaagcctcagacctgcagaggaattaggttggagcagagaaacagagatacatagacttggagatggagaaggaaatgagagacagagcgggggcaaagacagggacaaggacatggtgggcagggaggaacagtactggctgaggggggagcctggaagagatagtcagggcaggcgggaagctccaggacagggaggaggggctgaggctgggaggcccccagatcccaccaggcctaggcagcctggacagcgtgggcggtgggggcgggggcagaggcctgagcggtccagaggcttggggggtggggggaccaggccgaggagggaggcctggcccctggcagctggcccggcaggcccctcaccagggaagggcgggcctaggtcaggggccagctcgtgggctggggccggctagccatgggcgggcaggttcccactccctatggtgtttctccctcctgtctccgaatctctgatctctagccccttctcttttccctcctctctgaatccagacctgcctctcctctcagctctctcagtgaccccacctcaagtggcatagggctccaagctgtgcctgggttcaggattcaagctttacctcctcctgggctaccatgtccccacccacgccaagggcaagcctcagtcctcaggggaaatgaccctacccaagcttaggccctgtcctcctccttagaagggggcagaataagccaagcaccagtaggaaggggccaggagggaggcagggggagtggtcccccagctctcgacgctggctgaggctgtggaaaaggaggcggcccaattgagtgagttgggggggttggtatccgcacctgctgttgtgacctccacagccggagatggggtcctggaggggacaagattccgatggattttggcagcggcctggactcagtgctcaaaacccccattcccagcctcttgcaccgtggggaccctgagatcagcatgtgcgtgccctgctgcacgtgtgtgcgggcgtgttgttgggggagcctggggccctcccatgatgggcctggctgggcagctggggaggcatcctggggagagaggaatctgtcaccagcctgtgcccacatgtggaggcccacttggggccccgcatgctgcctggtgacctgggcatgggcttgtatatgcacatacatgcaggcctgtgcttaagtagccctctagatgcagaaggcctgggctttcaccctcaaaagtcatctggtccagccccctgcctcttgaatggagaggaggaaggggcagataagttcgtatcctccctttggacacataggctctggagagcttcacagaacctgaggtactggtgccaaatcccccagcccccaaccccagtccagtctcttctggcttccagaagaatcaggaagccccctccacccaggaaaggcacacacaccagttaggctaagtctgtggggagcggggtactgctcctcttgtagggacagaacgctgtagcacattagacagctggaagaactcaacgaaaggcaggggatgggcagagcaatagggttgactgagacttcccttagcaggggggtggggtaaggaaaggcccgaagcggacgccggggacaggaaggaggctgcaaggcagggccctccgtggagacaaggatggatagaatggctttccagagttggagattaggacaaagacctatttgcctcagcatctcctaccacacccacccctggccccatcactgctatggtgcagacacacccttgaatccatacacagaggcccatgcaagcaagctcacacacacacccacccacccacccacccacacacacacacaccccggggggtgggggcagcagtgcatgtgatgcatcggcttataacaaaaaaaacctgaagatggtcgttctgacagagccagagttgggtggggggaaaagaagcttcaaatgtcttctgtgttctgttctctctgccccctaacgtgcatatgcaccatgcacgctacttctgaggagcctcctggtctgctgggcaagaccgagccatccttcctcccctttcctcccctcctcacagtggggaagccacagcaatctgttcctgatgggtaaacacaggcgtgagtacgtgcacacacgtgctcacacacacaccagccactcaggccacagagcacccagcgctcacttcaccccgagacagagcacacacttgggctctcactacacccggcagagctctcaaagcccccgcctcctcagacacacagggccagagcttcacagacacacccaggcagcctctcgcagacactggcattcagagcctaccatcgtggccacacatcagggcctcccacatggacacccactcccacagccccgtacacgctggtgtgcgtgcacacattacagtcacactcacacacacagactccctcacacagccatggtctcacatatggataccatcacacactccgaacagtcaaccttccacacagacaccattgtacacttccagaagctcagggcccccagtcgcccttggcctctcacgccccgacaccggcaatgggaaacacccacatacacaccctgaacagccacactgtgccagcacctcaggttgcctagccgtgcctgaggggagggacagaaagcctagggatgcctagggcaggaaagaaaaggaaaggaaatacttcgttggtccctaaaaagtgagaaaataaatgattattccccaggcagctccttcttccccaaaccctgctttcaacagcattagggaatgaagggagatccattccagacaggagaggtgaaggaagtacctgggggagacagatggtggcactggaatcagcaagagccagaaaggcccagaaatcagccgacttcccaggcccttgctgccttccctcatcaccctctcttccccacgatgcggatcggcagcagctctcagcctagctatctgctgtgtgatcccaaggcctcttcaaaacctctatgtgcccataactgtctagcgggcacccagatgtctggcctggctgcagaaagggcaggagaagggaaggagatgagacctccactccagccccccagcccccaccaaagccctggcatcactgtcagcccacagagaggtagggcagatgcccagcagcaggaggggagcaggcagagccagcggtgctcctctaactaaccactgaggaggagagtcctaaggtgtccttggaccctgcagccccgcccccatcactggaggagtagacgcggagtcgctgtccagtcagaatggaatccaggctgtgctggccaggccccagcccaggaaagatcggcaatgctgcagacatccttgccacttgccactccaggtgtagctggggccctgatgcctccatcctaaaaggagcctgacgtgactccacggaagacaggcaggacctaaggaaaccaggcaggggtaatgccataaagccaggtgatagggacttcggggaagggggcagtggggacaaaagaaaccaggcagcagggtgtaaggaaaccaggtgacagggccccaaagaaggtaggtggtgggagccaaatgaaatcaggcagtggggactaaagttagctaggaggtgtggacaaatgaagccaggctttggggatcaaatgaaaccaggcaagaggcccacaggatgtgagaaaagaaagatatcaggagctcatcccctctgtctagatgtcacccccacacgctgggcctctctctctgtagccccccttccactcaggcggtggtcccctcccccaggccaatggacacagccagagccccctcccctctcagaggcctggtccgattgcagccaatgggccccggccccatccctgggacctcaggaagtcccagtccctcccaccggctgcagaggcaggggggctggggggagagacagagaagagaaaag

SEQ ID NO: 3039 - DNA, 2276 bp, Homo sapiens
tcttgttctgtcgcctaggctggagtgcagtgacgtgacacaatcacagctcactgcagcctcgacctcccaggctcaagtgatcctcctacctcagcctcctaagtaactgggactataggtgcatgcaccaccatacccagctaatttttaagggcctctccacatgcctctcgcccaacaccatgatggggggacacccatggaacctgcttggcattaacacatgagccgcccagaagtgaaggggagctaacattccatgggatgactcgagaggagccaatggataactgtcccccttcttccagtgagttctgaagtacgtttcataaagcttcacagaaagactgagtggtgttcactcagagagatgttaacacactcccatattgactcccccctttctctgtttcattcctcctccccctcacccctgctccctgggatcatgttcccaaataaactactcatgcttaagcctttgtctcaggccccatgtaagatctgatcttacatggagaatttaacagcaacaacatcacaccaggggcatgctcaccaggggcagagcaggggttcacaccccggcaagcttctctactcgcttccatgttgcctctcaaagatcccaacctctagaggacatttaaaggcacaggcctagatggaatctaaccatctaaccgggagagactgtaaataagaaaaaagtccccacaccatgctcacatttagagatcaagaagaggaggagccagcgaaggagccagagaaagagctgccatccgggtaggaggaagccagaccagtgtggagtcctggactccaaagaaagacagcgttgcaaggaggagcgagtgccctactgtgcaaacgctgctgagaaattgaggaggtgagaccaggagacagaccttttggatgcgccagtaggaggtcactggtgacttggacaagggcagtttcaatggagtgacagaaacaaaaacttggctggtgtaggctaagagggaatggaggtgaagattcggagaagtagccagcagggacaaccacttcaaggaggggtgcgtaaaagggaggaggaagtggagcagaagctgaagagggtgtagggtcaaggaagagtttgttttgaaagtgagagagatcatagcgcagttatgtgccgaagggaatggtctggcagagagaaggagctggatagtgcaggagggagaaaggtgatttcaggcagtcttgagtaagtgaagggatatggtgcacaaaatgaagggattggccagggatgcaagaggaggccatccctccatctgtccatccatctatccatctgtccatctgtctgtccatccatccgtctgtccgtccgtccgtctgtccacccatccatccatccatccatctgtccgtctgtccatctatccttccgtccatccatccatccatccatctatccatgcatgcatccattgtgaggaagaaaggtagcagcgggcatagatgcaggcaccttgggagatctgatggtgagaggcacgtacgttccagcagatgacatttagtttctcagcaaaataagaagcaagatctttaactaacagcgagaaactaagggaaggtgttgagggttggagaagatgtgaaacacttatctggagagtggcgcagtgaatttagtagagaaatatagtaagattactgggcaagctgagcgcccacttgaagtttgtggtcagaagcgtcaagtgcggctattcagtatgactgtgagtttccccggcaatgctcagctactcagtgcaggtgcagggtgttgggtttaagcagggtggaggctgtgtcaggagattccaaatgaagggaaaagagcaagaaaggagagggcttccacaaatgggtgattcttgtcaaggcctacagaattgagctggagaagggggttgaaggcagtgaaaaaggacaagttcaaaggcagggagttcccaaaggggacacatcattgaatggaggtaatagagtagataagctgagagccgaggaaggggtggtcagggagcagggggttcagaagtgctgaggcaaaaccctggccatgggagtgggaggcccaggcagcagaacgagaggtggagagtgaggaggccaaagaccaagagtgggaggtgctgggtggacatctacatggatgaccttccttgtccaccatctcttaaacagctccccatcctgccactaccccttcatctgccttttcctttcatagcccctct

SEQ ID NO: 3040 - DNA, 1499 bp, Homo sapiens
gttgcagctgcctggccagcccgagagacagcggagattcattacccgccgacacaatgaccattgatggccccgtggcgttattcaaatccagtaccaattgcagccgagcccctttctccgcgccaggcccgtattgttggagcggcccactaaaagcccgccccggccccgagccgccagaggcgcctgctcgggttcagccttgcgcctcggcagcccgccggctcccagtccggctccacgggcgctgcaggtgacccggcggcgcattccagcactccccgccgcccgggccaccgccgccaccgccaccgcaggcgccccggccgcgactcagccacaggaaagcggagagcgcccgagccggtgcgtgcgcggggctgggcgggggcgggggacccacgaatccagcagcccggaccccgggctcggaaacgcgacccggcctggggctcctgccttccggattcccggagatcccaggctgggggcagggagaggggagtcggggttccccaggccagacagaggagattccccctcgacctggggcggcgctgagacccaacgcgggccactctgcggactccgggccgcgatcgaaggagccacgccaggggcgatggggatccccgcacagggtcaggatccgcgtgcttgctagtccaccttaccgccggatgggcagccgctgctgagcgcctgctaggtggtccgacgcgcagctccgagctgtcctggactggcgctttttaggagcgaaggggaaccccgcaggagaccagggccctgaactcaggggcttcgccactgattgtccaaacgcaattcttgtacgagtctgcggccaaccgagaattgtggctggacatctgtggctgagctccgggcgcaacaggggcgggggccccagggacagggctcagcgcgggcgagacctctcggggcggcggctggctggccccagcgcgaggatcgcggtcccggcccgcgcgcacagagacgccggtccctgccaccagcgccgccatccgcatcctcgtccttcttccttctctgcgggtgaccagtcccggccggcagggtccttcagtcgatcgcgtcgtttttcctcctttcaaatttcggccggaacgaagccggcacgcagcggcggggccgaatgtggtccgccctcagcccaagccgcatgaagtcgggggtgaaagaagaggccggccgaatgcgcccgctaactcgtttcgcagttgttctaacttatcaccccaatactccctacctaaacaaaacaaatcctcaaccaacccctaaatcccaaacaaaccaacccctcccgcaagcccctccggacggaccgatgggctgagcctcctccagccgctgccagggtccgacgggcaagcgtcaccaacgatgcgctccagcccggcaatctcctcggctttggaaatagaatttggaaaaacgaatccttttcattaaagaaaaatcttcgg

SEQ ID NO: 3041 - DNA, 13590 bp, Homo sapiens
gcggaaggttgcccgggctggcgccgctgggcagagccggtgcgacgtttccctttccagctttgttcttccggccctgctgtctgcctccccggctgattggattcgttactgctttgcaacgcgcacctaactccagacggggtctcactctgtcgcccaggctggagtgcagtggcacaatctcagcttgctgtgacctcagctctctgcgacctctgcttgctggactcaagcgatcctcccaccacctcagcctcctgagtagctggaaccatcatatgcaccagcacgcctggctaaagttttgctcttgtcacccaggctggaatgcaatagcgtggtcttggctcactgcaacctccgcctcccgggttcaagcaattctcctgcctcagcctcctaagtagctgggactacagcttgaggtcctacctggtgtcctccatgagaatcatacaagccccgctacagacaacagaattggaaggtcctgagagctaccagaagcatcttcagttttcatatgaaaaacttaagcccaggagtgatttgtgcagccaaggacacacagcaagttagtggctgcaccagaaatagtactcactgcctcagacagtccctcccacagtctactctgtctccaccccaaggtctggttctgaatcattcagttgtcagttgtctccttttttttttttttttttggagacagggtctctctctgtggcccaggctgaagtgcagtggtgtgattacagctcatgtagcctggacctcccaagctcaagcaatcctcctgcctctgcctcccaagtagctgggaccacaggtgggcagcaccacacctggctaattttttaaatttttttttatagagacagggtcttaccatttgccccagctggtctcaaacccctgggctcaagcaagcctcctgccttggcctcccaaagtgctgggattacaggtgtgagccaccacacccggccttatctcctaacattttgatagcacaaaattttgaaaacccacttctgtgtacgttatgaagcatagaaaattaaacagtatgcaccaaaaaaaaataaatacaagttataatattttctttctgtccccacacttaaaagaccactcttctaaaccaggccacaatcattcaagcaaaggcaggcacttggggccatcctcctccactttcccctagggaaaacaaacaaaaccaaaggaaaaacaaaaacaaaaacaggttttaaagagtgcatgtttcccagttccagggaaaattataggccagaacactgttgtggcaaacatgcatccttacatactgcagggtaaaccaaacatgcaacaaactaaattaataatgatgaaaccaaactaacagtaacttataattaaaaagccagaacggcagctgctggaaacaggagcagatccaccatcctcgatgaaactctgataatcaaataccctttcccaaaatggccaaaatccttgctcacatattccaggtaggttctttgctctgtagccaagatgtgagtagcagccagtcttccataagctactgaattatctccttggtaaattctaattgtggggctaatttttgtttccaaatactaatttttttttttttttttttttttttttttagatggagtctcattctgttgcccaggctggagtgcagtggtgcgatctctgctcactgcaagttccgcctcccgggttcctgccattctcctgcctcagcctcccaagtagctgggactacaggcacccatcaccatgcccggctaatttttttgtatttttttagtagagatggggtttcaccgtgttagccaggatggtctcgatctcctgacctcgtgatccacccacctcggcctcccaaagtgctgggattacaggtgtgagccaccatgcccaatcttttttttttttttttgaggcagagtcttgctctgtcgcccaggctggagtgcagtagctccatcttggctcactgcagtctctgcctcctgggttgaagcaattcttctgcctcagcctcctgagtagctgggactgcaggcatgcgctgccatgcctggctaatttttgtatttttagtagagacagggtttcaccatgttggccaggatggtcttgatctcctgacctcgtgatctgcctgcctcagcctcccaaagtgctgggattacaggtgttagtcaccacgcccggcttccaaatactaaatttaactaacactccaaagctcgctcagtagggttccagtaagtggggattctcatcttacttagaaagatgaagtctgttggaaggcacaccacatgcctgtaagaacccaagaaagggctggcaaatgtggaccacttcttggacttcatctagatctagtggggagaggtccccagcttgtgggcagtggagagtcttccagaagcccttgaatccttacctgccaccctgtctgttgacctgattgtgaaagtgcaaataccctcatgcagggactccaagaaactgccaaccttaaaaaaagtgggagggttggtgtattggttcatgcctataatcccaacactttgggaggctggggcaggaggattgcctgagctcaggagtcggagaccagcctgggccacatagagagtctatgtctctactaaaaataatactttttaaaaaatagccagttgggccgggcgcggtggctcacgcctgtaatcccagcactttgggaggccgaggcgggtggatcacgaggtcaggagatcaagaccatcctggctaacacagtgaaaccccatctctactaaaaatacagaaaaaaaaaattagccgggcgtgttggcgggagcctgtagtcccagttactcgggaggctcaggcaggagaatggcgggaacccgggaggcggagcttgcagtgagccgagatcgggccactacactccagcctgggagacagagcaagactccgtctcaaaaaaaaaaaaaaaaaaaatagccaggtgtggtagcactggcctgtgattccggctaccctggaagctgaggcaggaggatcacttgagcccaggagatcgaggctgcaagtgagtcatgattgtgccactgcactccagcctgggcaacagagtgagaccctgtctccaaaaaaaaaatctagccctgtgtttcctaacatcggtgtgaggcacccccatacctctcttcccacttttttttaagacagggtcccgccctgttgtccaggttggagtacagtggcagcatgatcatagctcactgaagcctagacctcttgggctcaaatgcttttcctgagtagctgggactacaatgcacaccaccatgcccggctaattttattttttgtagagacagggtctcactatgtttcccagtctggtcttgaacttctgagctcaaaagatcatcctgcctcagcctcccgagtagctaggactagaggctcatgccaccatacccggctagtttttatttttagtagagacaaaaacctcacttacgttgcccaaactattctcaaactcctggactcaagcaatcctcctgcctccgcctccaaaagtgttgggattacaggtgtgagccactgaatctggcccataggtctttttttttttgagatggagtctcaactgttgcaggggctagtgtgtagtggcacaatctcggttcactgcaacctctgcatcccgggttcaagcgattctcctgcctcagcctcccgagtagctaggattacaggcgccagccaccatgcccagcctggctaattttttgtatttttaatagagacggggtttcactatgttggccaggctggtcttgaactcctgaactcgtgatccacccgcctcagcctcccaaagtgctgggattacaggcgtgagccatggcgcccggcttttttttttttttttttttttttaagacagtctcgctggagtgcagtggcagaatctcggctcactgcaacctctgcctcccgggttcaagcgattcttgtgcctcgacctactagtagctggaattacaggtgtgagccaccacacctggccagatctttcttaatacctcaaaacaactaggaatttgggctgggcatggtggctcacgcctgtaatcccagcactttgggaggccaaggtgggtggatcacttgaggacaggagttcaagaccagcctggccaacatggcaaaaccccatctccactagaaatgcaaaacctagccaggtgtggtggcacacacctgtaattccagctacttgggaggctgaggcatttgaacccaggaggcagaggttgcagtgagctgagaccacgccactgcactacagcctgggcaacagagcaagacttcgtctcaaaaaacaaaaaaaaacagctaggtttggctacaaaggattcacagggtattggagactgcagttggaacagagttttcccaaaaagcaacagggcttctgcctcctgggcttagcagatgtgaccttggacaagttactaagcctttctgagcttcatttttctcatctgtaggatgaggtgtctccaggttattgtgaagatgtgtatatgcggtgctttatgaaccacaaagctgcatgtggttgtcaggttccctcttctggccttgtgagctggagacacacacacacatttctccccaaactgtctcagcccccaggcacctactgcaaggactcggggatcgtgcagaggtgcaaaggagtcgtgccctcctcagtcagcacattagccttggctccgaaggtcagcagcagccgcacacagtcaaactgggctcgggcacaggcctcatgcaaggcagcgcgacccccgacacgggcatccagctcagctccctgccggatcaggtgtcgagcacagtctgtgtagcctcgggctgtagcgatggcgaggggtgccgtctgcttggtcttgggggtcagcacccagaaccctagggagagcaaatagttttgggaggtggtgtataagacagggcagggcagggagtggggatgctggttccagctgacagctgacactggccttccctctgcatggtttgctgagcacaaacactgccaggctgtacctgtggaagggggcttattcaagtcctgaagtggaagaataaattggaacagccttttaatacagcttatcaatctgtaacaaaacatagtatgtgtcataaaaaaattaattgctgtataaaaccacaggggccaactaagtagagtgactcccattaaggaaatctcagcgtctttgaatggctaatagtgtcaaaggcttgttcaccttggggcctggggtggtggctcacacctgtaatcctagcactttgggaggccaaggcgggatgatcacttgacctcaggagttcgagatgagcctgggcaacatagtgagaccttgtctcttttttttttttttttaggcagggtctcgctctgtcccccaggctggaatgcagtggcgctatcttggctcactgcaagctccgcctcccgggtttaagtgattcttctgcctcagctgctgagtagctgggattacaggtgcgcaccaccatgcccggctaatttttctatttttagtagagatggggttttaccatgttggtcaggctggtctcaaacttctgacttcgtgatccgcctgccttggcctcccaaagtgctgggattacaggcgtgagccactgtgcccggtcaacttttaattcttaaaagacatacagactgctaaccctgcctcatctctgtttaggagggagctaggataggtggtggaaagggctgctatagtctgtggtctgcagggaaggaggggcctagactctcccccttccccacccactccccttctttctccctcctcttctgccctcttctggtgccccctaccctgttcagccgaccaggccagctggttgctcacagtctccacaatcatgttggcggcctcttcatcttggaacagggcttggacctgctgcaggttgccggagaagagggcttggtggacagctgggtctcggcaggaacggtgaggcctagtgagtcgggcccggggacttgacgggcacctgcggctccggcactgctgggcagccgcccgccgccggtcctcccattccagccactcctgctgcaggcggagagagcgcagcatggaggaggtgaaggggaaggtctctcttgccatggatggggcccaggggtttgggcagtggcacctgggcagagccaggttccctcgacccgactacctcccttgctctgaggagccaccctgcccccgccaccgtgagccagagaaagcagcagctgaggctataaataggtcctttgctgctctggtaaacatggtttgctcagagtcatgatcctggtgctgagaagctgctggcccaacccccagcccagggtgagggccagcccctgcccctgccgataccctttggttggtcagcaggccctcagctgaggccacccccgaaccccagcatctgcatccaccttcatctctagagcgagcatcttgggttggcaaggtccagggtgcgcaaaaaggtcagtcatggagatgggcagggctgggaggaagacaaggtgcctccagcctctctgatgttggctggagggcaggagccaccattggcccacgtggaggagagagggctgacctcagcacaggaggtaaggggaggtcaaggcagagttactgagaaggtgagcagctcttcccagcatctgcagtaacagcaataactctgtacatatgcacagagtttcacggtgtttaaatcacattcatatccaccttcacccaggggatcatacttcccagcccacccaataattagtaaacttggtttggacaataaatgaaattatcacagttgaatgcccctgagatgggtggtcttatctctgttttacagatgaggaatttaaggcttaacaaagtaatctactggctcaaggtcacagtttgtgagaggcagagccaggaccccacatagatggtgtgctttgggccaagaatggtggctcatgcctgtaatcctagcactttgggaggccaagacaggaggattgcttgagcctaggagtttgagacaatcctgggcaacacagtgagacctatatcttttttttttttttttttttttttgagacagagtctcaccctgtctcccatgctggagtgcaatggcacgatcttggctcactgcaacctccgcctcccgggctcaaacgattctcttgcctcagcctcctgagtagctgggattataggcacccgccaccatgcccagctaaattttgtatttttagtagagatttaatttagggtttcaccatgttggccaggctggtctcgaactcctgacctcgtggtctgcccgcctcggcctcccaaagtgctaggattataggcgtgagccaccaccccctgcctctccatctcttaaaaaaagaagaaaaaaaaaaaaagatggtacactttttgccttcagctgctgcagccacctggcagcctcccccattctccaagcaggacagactagtctgtagaaactgccttcaatcatcctttttttttttttctcatggtgtcacccagtctggagtgcagtggggtgatctcggctcactgaaacctccgtttcctggggttcaagtgattctcctgccttagctgcctgagtagctgggattataggtgcatgccaccatgcccagctgatttttgtatttttatttattattattttttttttgagatggagtctcgctctgtcacccaggctggagtgcagtggcgcgacctcggctcactgcaagctccgcctcccgggttcacgccattctcctgcctcagcctcccgagtagctgggaccacaggcgcctgccaccacacctggctaattttttgtatttttagtagagacaaggtttcgccgtattagccaagaataggatggtttcgatctcctgacctcgtgatccgcccgcctcggcctcccaaagtgctgggatcacaggcgtgagccaccgcgcccggccgatttttgtatttttagtagtcggtttcgccatgttggccaggctggtctgaaactcctgacttcaggcgatctgcccgcctcggccccccaaagtgttggtattacaggcgtgagccacagctcccagcaccttcaatcatccttgatttatttttttaacccagctgctaagggggctcacatggccggcctgaggagagccaaggggttgagctggaaactctgggaatggacctaagatgtttaagccacagacctgttcactcttaggagaaagcagctgtgcttccaggagcctctagggggaggaatgaagccgtgaaaccacacaagctggtgtgcctgccaagctggggaaggggagggctcaaaagctctgctcaccctgagctcactcagtgcacagcggcctgcaggcagggctggtctgtcccctctgcatctggggctcctcctggcccttctcccgctgcctgtcctgcctcctggccctgcagcagcaccttgcccagtgatcttttatttcttcctctccctaggcccttcccataagcaagttctagctcctgttcttacattttcagggactgtctcaagttcagcccctcgatgtaatgccttaaacctggatcaactcagtctttcacctggtgtttcttcctctggccatatcccttctgctccgctgccggaatgatctgtctaaaatggttaattcccttgcttaaaaacttctgctgccttccaatacctgtcctttcatttttttaaaatagggctccaaatcctggcctcaagcagtcctcccaagtcagcctcctgaattgctgggattacaggtgtgagccactgcacctggcctgcccttttcaactaagcccccaattccttggtttggccccatgccactcacgtagggtaggcatcctcatcacgcacggctccccacaaccgttccctgtcaggccattcccttagctcagaattccctcaacaccttcctgaggatctacccctaaggtcacctgctctgagaggtctcttcagcaacccattgcctgactcttatagttccagccactgcccaatctgcactcctgaaggactcaggggcacgctgtaaagcacctatctatgctgttgatgtgggtctgccatgctggatgtgggctccagagcaggccctggcagtcagagcacttggctcatggcaggcgggcctcttatgtgtagtgcattgaacgaaggtccctgttctctgccagagcaaacatccatccacccgcccgcccaagtgggtggcagcagcctgggctttttccggcattgcccctactctactgttcacctactctctgcctggctccagcctcttggtggcagtccagggtgggggatcccagaggaggaattagatcatacaaagcaaagcctggaggtcctcagagaaagatgcctctataaatgcagccttgatgaaccctgttggcacccatttggtgtgttaattgccacatcaacggcctggctgggcacccacagctgggttcccagggttgagaatctggcaaggctgggtgagaccaagagaggccaaggcaggtgggtgtccccttcctccctgaggcacacaagagtcatagcctagcccctcccctgccttcttgccacacagacctgaaggagctaggtaccctaacagcttagtcccaagataccactgtattcagtccccttgtctgtagagttagcttcctgagggcagagaaaggaggccttgacttcaacctggagggaacagggccaggtgatcagatgcccagcctgccttctgggatctcagagcctgtggggtagtgaagcacacaagaagccaggatgtgagcgtgggattgatcaggactgagcagggggaccggggctcatgggtgtcaagaatggggaataggcccagggcagaggggagcttttatttttttagagacgaaatctccctatgttgcccaggctggtctcaatcttctaggctcaagtgattctctcacctcagcctcccaagtggctgggactacaggtgcatgctgccactcccagctgtgggggtttaggtgcaggaagatcccagtgtagatggggagttagcagggagtggaaggtgggagagaaggaaatgtatggtaggttcaggtagaaaaacccaatgggaatgtgaagggaccagggtgcaggggaattagccccttcttgccctggccttgtggcacaaaagcctctagaacagggccctgctgtaatcagcaggtaagtgaacatggagttctcaaagcacttactcacttcagccttaagactgggatccagtggggcactgtggctcacacctgtaatcccagcactttgggaggctgaggtgggaaggatcacttgagcccgggagttcaagaccagtctggagaacacagcaagactccatctctacagaaaaatgttgttaattagctaggcgtggtggcacgcaccagtagtctgttacttgggaggctgagatgggaggactgcttaagcctaggagatcgaggctgcagtgagccatgatcacaccactgcactgcactccagtttggtgacagagtgagaccatgtctctaaaacgacgacaacaacaacaacaaaactggaatccatgggatcagcctctttgggaaaaggagattaacgcttccccccagaggagtgccaagcccatgcccatggaaggcctctgtctcctagctgcttagtgcaggctgaggctaaggcaggaggggctggctgtcaaacagggctatttattattttatttacttattcaagagatagcatctcaccaccttgctcaggctgggcttgaactcctgggcccaagggatcctcccacctcggcctcccaaagtgctgggattacaggcatgagcctccacacctggcccaaaccgggctctttaacctgcctcctcttgcccatgagttgggagagttttcccaactcctccttccagaaaggaaaacaaggttggcaacttggtataattagaccttttacaccccacccatgcctcttgtccacctctagtccgaaaattggtacagagaagtcacagcaatgaagagttgcttggcaacaaaattttattttattttactttttgagatggagtctcgctctgtcacccaggctggaggcagtggcgcgatctcggctcactgcaagctccgcctccggggttcacaccattctcctgcctcagcctcccaagtagctgggactacaggcgcccgccaccatgcctggctaattttttgtatttttaatagagacaaggtttcactgtgttagccaggatggtcttgatctcctgacctcgtgatccgcctgcctcggcctcccaaagtgctgggactacaggtgtgagccaccacgcctggccacacttggcaacaaaattaagtagtttgagatcatatcccaaagtataaaataaatacctgtaagtccatgctgatataaatggatgaatgaataaataagggagaataggcaaatctcccatgcagaagaattccaaataaactgccgggtgcggtggctcacgcctgtaatcccagcactttgagaggtcgaggcgggcggatcacaaggtcaggagtccgagaccatcctggctaacaaggtgaaaccccgtctctactaaaaatacaaaaattagctggacatggtggcgggcgcctgtagtcccagctactcgggaggctgaggcaggagaattgtgtgaacccgggaggcagagctttcagtgagccaagattgtgccactgcactccagcctgggcaacagagcgagactccatctcaaaaagaaaaaaaaaaaacaaaaacctgtgtagatattctgcccttaaggaggtagaacataattccccaattcttaaatgtgggctgcacacagtgacttccttccaaagggtccagtacagaaagaagaaaaaagagtaactttacaatggagaagtctggcaaagtttacctcagtcaggtgatcaaagtcagcatgaacccttcataagatgtggcaagaatggcacctgacctctggtcttcctctccaaaacccagaacctcagtctaatcatgaggaaacatcagacaaatcctgatagagggggattctaccatatgcctacccggtactccccaaaactgtaaggtcatcaaaaacagggaaggtctgagaaactatcacatccaagagtcaggatgattgtgaaatgggattctgaggggaaaaggacattagggggaaactgagtaaatctgaataaagtatggagtttagttaataatgattcattgtgacaaatgtaccatactaaggtgttaataataggggagaccacacctgtaatcccagccctttgggaggctaaggtaggaggatcacgtaagtttgagaccagcctgggcaacaatagtgagaccttgtctctatgaaaaattaaaaacttaggccgggcatagtggctcactcctgtaatcccagcactttgggaggccgaggcgggcggatcgcgaggtcaggagatcgagaccatcctggctaacatggtgaaaccccgtctctactaaaaatacaaaaagttagctgggcgtgatggtgggcgcctgtagtcccagctactcgggaggctgaggcaggagaatggcgtgaacccgggaggtggagctggcagtgagccaagatcgcaccactgtacttcagcctgggtgacagagcgagactccgtctcaaaaaaaaaaaaaaaaaaaaagaaaagaaaaatgtaaaaattagccagccatagtggtgctgcctgtagtcccagctacttgggaggttgaggcaggaggattgcttgagccctgaaggtcgaggctgcagtgagctatgactgggccactgcactccagcctgagtgacagagagagaccctgtctcaaaaaaattgctgggcatggtggctcatgcctgtaatcccagcactttgggaggctgaggtggggggatcacctgaagtcaggagtttcagaccagcctggccaacatggtaaaacctcgtctctactaaaaataaaaaaattaggctgggcacggtagctcatgtctgtaatcccggcattttgggaggccgaggcgggtggatcacctgaggtcaggagttcaagccccgcctggccaacatggtgaaaccctgtctctacaaaaaatacaaaaattagctgggcgtggtggcaggcgcctgtaattccaactacttgggaggctgaggcaggagaatcacttgaacccaggaagcagaggttgcagtgagccgagatcacaccattgcactgcagcctgggcgacaagagtgaaactgcatgtcaaaaa

SEQ ID NO: 3042 - DNA, 14773 bp, Homo sapiens
ctccgcctctacgcgctcgcggtcgccgctcctctcccgcctttgttctcgggtcgcccctctcgctggtggcgctccgagagagcagcggagccacctgcccaggccacgcttccccgagcatccgcagctgcacccgggggctgtcggcgcccgccccggagcgtgcgggaggcacagcgggaagaagtcgctgagattcggccctcgtggctttgcgtgcccgcgtggttgatgcctccgccgagaacgcggtcggccgggagccggggaggagcgtggacgccggcctggcaggtacccccgcgagaacgtgggagccggtgtatttcagctgcatttattactgatctcgggctgcaccagggcacttgtaggaccgcactaaaaacagcggaaagtgaggagccaagcctgggtccggggcggcccgccgtacagctggcctcacggattccactgcctgcgcctgcagatgacttgttctggagagtagagaatgttctcggatttaaagtacaatccggtttcctttccattcattatagttgcctacactcaacaaacaaaagttgggaaagataaagggattattctagcgcgtcacattgacaaacaccgacgttaacacgctcagtccagcctgactcacttgcctcaggtcagagaggtcaccactgacgacgccgggccctcaagccgatcctaatccagcttggttctctcagcctcagccagaccatccgttcttgcctctgtcccaccacgtgcaggtgtaagcttccgccgcacttcttgtctgaatctgccaagaagaaactgcatctttcagctaaattcttttcactgatcagggtagagtttagcggttttttttttaagaaaaaaaacaaaaacaaaaaaaaactcttaagctatttggtactcctctccctccgggattctgtctctagattgtgaaagctgtcagagaatggagtcagggaaagccgtgatgggaaagttctcactaataattgcctgatataaagaattagcacaaaagactgccaaaaccacaaccttgcacaaaggccacaaaactacacaaaaaaatgcttcaaggacatttgcgcagcaactgcctgtccaaccttggactggccatcccctttgttactgatctttgtagccaaggataattgtttcaaaacaacttacgtaatcctcctcgtttttccttttaaaccccttatcttcctttacctccctgaatacacctatagtttactatgacaccatattctacattgcaatgcccactttcaaataaatttgtcatgtttggcaaacctgtctgttatttaggttgacaagatcaaatgcaaatttattctggagtcaacaaataactgattcagtcttccaatgtgcaaggcaaagaagaatattaaggagacactgtatagattagatccctgcctataggcagcttcaacactaatacaatatggtacgaatatataattgtactttaaggcagcttaggtgggaaaacaactagcaactaaaaaaaaaaatggagtttactaccaactaaaaaaaatggaggtttcaaggttgacctagaatttgaaaactgctttaaagacaggtaagaaagacacaggtagatgtgcaatggaagtagaaattgggtttcaagccccaaacaggctgaggggtgggaaaatagacatattcaggtacatcaatcgttccagtttggcataagaatgagataaatgaagatggattctaggagttaaggatgaaatatgtagggaggtactatgatgtaatggagagaacaaagatttcaagttaagactttggtttaaatcccagctgtgcctcttattagctgtgtgatcaaaggtaaattagttaatctctctgaccctccatttcctcatttgtatgataacaataatgtccaattattccacaaatattttatggcaagccaagtattaactaagaactatgttaaatgatgaagatataaaaaaaccatttattcattcattcatcaaatgaatgccttactgtttactaagttacaccctgagttaggccctggaaatactgataagggggaaaaaagcatgaaaccgtatgagaccacttagattatgcagatatacgtgaaaataaggcccaagaccaagaagtccaaaggtactcaacttgtggaagtaagatagagaaggaaaaaaaagaaaactaagtgtaaagtactgtaaactgaaaggagagagtgttttaaaagagggactggtcagctctcctaatggagaagttagtaaggtggcagagaagaatacattgtatttatcaacctggaggtaattaactgtcttgactgtttcaagctatttcagcaaagtggtggtttcagaaactaaattaaagcagattaagggaggaatggaagcctaggaattggagccagagtatagacaactcttctgtgtagttttattataaaaagtaatggagaaagagagtatctggagaggtggtagggatgtttttaagatggaagacattagcacatgttggtatactgaaaagaatgactgagtaggaaggcagaaaaccatgattgagcagagagaggaaatgctactggaaggcagcttgtgagaaggcaaggaaaaatgggctccagagcacaggtattagacaggaagcagaatccacccaatttaacaggaaagacagaaggtggtcgcagctgcaagcaggtgagtggaaaacttgaaggtttgtttttttgtttttttgtttttttttgagacagagactcactctgttgcccaggttggagtgcagtggcctgatctcggctcactgcaagctccacctcctgggttcacgccattctcctgcctcagcctcccaagtagctgggactacaggtgcccgctaccacacctggctaattttttgtatttttagtagagacggagtttcaccatgttagccaggatggtctcgatctcctgacctcatgatctgcctgcctcggcctcccaaagtgctgggattacaggcgtgagccactgcacccagccaacttgaaggatttttatttctgatatattttctttccttcatgaaatataaagggaaaatcagctgacagttgtgtaggggagagagatacagaagatctgaggaagaaggaggtgtgtcagcaggaaagcaaagtttccaggatgccaagtgttttgccttcttgagagttatggtcatgaatttaaagtgaaactactcggtctggctttgtcaggttctcagtcaagtttacctacttggattcaggcttggacaaagtggataatggggttcattcaggaaggggttttccaggtgaggaagagggacaaagaaattgaagtctgtttgtaaaggagtgattataatgatgagccatgatatctaagctggacaaggtaggaaatttgagggctataaatggtgaaaaaagccaatgaactggagatttcaataagattagagaatggctgtcttcggggtactagaggtggtgagctggaaggacaggaaatgattgcatgagaataacttgcttgaaataaagatttcagaagtcatactaatattggcgacagcaaagtctagaggggtaaaaggcaactgaatgtgagttggttaaggaattagaaagcatacagccagtcctagcttggcatggtagaacatgactagaaaaatgaccatggaagttgaaattgtgcaaagtgatcttaataatcaaagagaaaaattaaaattgttctgtgacacttaagaacttttgttgaaacatcaaaaactctgttactgctacgtagacatatcaggaattttttaaattgtaaaactaatttatttagtatgccataatttaaaacatgagaaacatggagaatcagtctttattctttgtgaaaaacaaaagaaaacaaaacaacttaccaatagtagtgtgaactgtttgcctcttctcatactattaatcttctgtcttgaaaaattgttattctgcattctaagtttagattagcttccaacattttatctttgcattttcaatcttgtgaactattctcaggaattctttaatacaaagtgtatcagcaacacttcctgtggacctcttcacccttttgtcacagccactttaatctcttaacattaatcaattcataaaatgatgaaaccagaatttactggctgaataaggtttttatttagtctctttgtaattatcattttctttcaacaagacaaccaacttcaacacttcacccgaatgctagccagactgattgggaaaaaatttaaatttattacagtcttcagtcaaaagcaggaaaaagtctttatatcggccataatttgcattctctttctagtgcaatttaaaccaaaagatcctgaagcaacttaccttgttttttctacttactgaactttttctctatggcttctatggtgccttttgtgtaggccgaggtctcatcctatctttgctttgcttttgtcattttcaaattccctaatcacatctaatttcatttctgcattattatttttttatttgctgtactttcatctttcttggccaattcccttttaatgatccatttttgtaaaatatcatgttagtttatcactgggaatcaaggaagctatacaactacatgctttgctgcttgtaaactgaaaaactgagtaacagttgtgcagtgaccaataactgacagactctgaaagaaggattgtgatatctgctatggactgaatgtttgtgccttacctgcaaattcataaattgaagccctaatccccagtgtgatggtatttggaagtgagaactttgggaggtgattagatttacatgaggtcacgagagcagagtccccatgatggggattaatatcctttcaaaaagaagaagagatacaagattcatattccttctctttctctctcccctgcccccacccccaccaaggaaagaccaggtaaggacataaccaggaagagggccctcaccaagaaccaccatgttggcaccctgatctcagactttcagcctctagaacctcaataaaaaatatttgtttaagcaacccagtctaaggcatttaattatattagcccaagctaagacagtgcccatctgttatttacatagtgatctgtgaactgaagagctagctgtgaattttcttctttatgcaattcctcacataaagttaatatgcaatcataattgaaatgtgaaccaccttgttggggaactggtattatttaactaaaccacagtaaatgaaatttgcttgaatattctgaaagtgaaaattgcacagtgcatactagaactgtgcaaagtgaggactgccttgttttggatggctcatctatgtggatgttgaagtcccaaggaaagatgacaggagttgggtggggatgaagattatataatccagtagctcaagtcttcaagtgatggggaggaataagccaggaactacaggcagcagaaatcaacaggtaaaagattatatattcagatagcatacattttcaggagccagaattttttttaaggtcaaaggggttacctacgctaactcctggctgtaagtcatcaaagattgagaggaaaaaaacagccttcatttgagagggctgcagtggcactcctcttcagggaaaagtcagattgcttttaaggaaaggaactcaaaatgcatgtggaagagaggttgggaatatagaggagcctgatgaaccatataaagaaagttccggccgggcgcggtggctcacgcctgtaatcccagcactttgggaggccgaggcgggcggatggatcacgaagtcaggagatcgagaccatcctggctaacacagtgaaaccccatctctactaaaaatacaaaaaattagccgggcatggtggcaggcgcctgtagtcccagctactcaggaggctgaggcatgagaatggtgtgaacctgggaggtggagcttgcagtgagccgatggactgaaggaaatgtttatgtgatattttatgtgagtgatcttcacagtgggcaagtggttcaaaagttatgtatctgaatacttagcatgatagtctagtggggtcaggtgatactacccttttataggatcgtggtgaagtacagcctaggtggaggagcctaggggaaagaggctgatgatagcagggcagaggttttcttggtacaggtctcaacatagcttattggggaagaaaaggaggaaaggagttttatgttagaggaaaggcaataatagaagatattatggaggacaaagggggatatctcacccaatctggagaagcagtgagagagacgttggattgacagtgagaagtgttgctaggatctgagatctttataatgcacctggaatccacttaacctcagaaaatagcagagtattacattatggacaatctagaaccttaagagtaggcagaagaattggtattcactcataaggcaatcaagagccactgaggggttttgaggcaaagactgatacaaagttatgcttccaagatgaaaactccatcagttttatgtgtaaggtatggagatgagacgtaaggcaaagaaaataggcccattgggttttctccctgcctcattcttggaagcatttactagaggtgcagttgctgaataccagccccccaatacaaaagaagttcagtgaagtcaggggacttgtctgtttttttcaccacaatacaatctgcatctccaacagtgcctagaacatagtagatgcatgattctgttgaacaaaaaaataataaatgaatcaatgaaataaaggggctattgaaacagatttgagagaagtgagtacctaggctacagatataacaaatggaaaattgaagctattttgagccacttcaaaaaattaaaatctatagaatttaacaactaagtatatatggggttttacagaagggaaagagaaagaacagaactaaaggtaatttggatgtgtcagacctaataagaataagtgtgcataagtgcttgattacatattatttactttaattcacatgcaaaccttaggaaaaaggtataattctcattttacaaacaagtctatctatgaggcagtcaactcaattaccaggtagtatattttgcaattaattcatcctgacaagttcatcaggaaggcaaattgcatgatatgacatatttcataggttattactaattttttctgtggtcaagattagcatcaatagctccttttaaagaggtttttggctacaactatcatgtatattctctgtataatggtggagtgatttttttttcaccaagcatatttttcttttattatgaaagaacagttgttctgatatatagttgccagaaggaaactctcagggaattttagtttactaatagaattggtagaaattgtaagaaaatgatcaaaatatctttttatttcttcttaaaaaaatgggatacatgtgcagaatgtccagatttgttacataggtatacatgtgccgtggtggtttgctgcatctgttgacccatcctctaagttccctcccctccactctcacccccaacaggccctggtgtgtgttgttcccctctcttgtgtccatgtgttctcaatgttcaactcccacttatgagtgagaacatgtgatgtttttttctcctgtgttagtttgctgaggatgatagcttccagcttcatccatgtccctgcaaaggacatgatctcattcctttttatggctgcatagtataccatggtgtatatgtaccacattttctttatccagtctatcattgatgggcatttaggttagttccatgtctttgctattgtgaatagtgctgaaataaacatacatgtgcatgtgtcttcatagtagaatgatttatattcctttgggtatatacccagtaatggaattgctgggtcaaatggtatttctggttctagatccttgaggaattgccatactgtcttccacaatggttgaactaatttacattctcaccaacagtgtaaaagtgttcctatttctctacagcctcgccagcatccattgttttcggactttttaataatcaccattctgactggtgtgagatggtatctcattgtggttttgatttgcatttctttgatgatcagtgatgttgagctttttttccatatgtttgttggccacataaatgtcttcttttgagaaatgtctgttcatatcctttgcccactttttgatggggttgttttttttttcttgtaaatatgtttaagtaccttgcaaattatggatattagacttttgtcagatgggtagatcgcaaaaattttctcccattctgtaggttgccagttcactctgatgatagtttcttttgctgtacagaagctctttagtttaattacattccatttgtcaattttggcttttgttgcaattgcttttggcatttttgtcatgaagtctttgcccatgcctgtgtcctgaatggtattgcctaggttttcttctagagtttttatggttttgggttttacatttaagtctttaatccatcttaagttacttcttgtataaggtgtaaggaaggggtccagtttcagttttctgcatatggctagccagttttcccagcaccatttactgaataggagatccttttcccattgcttatttttgtcaggtttgtcgaaggtcagatggctgtagatgtgtggtgttatttctgaggtctctgttctgctccattggtctatatgtctgttttggtaccagtaccatgctgttttggttactgtagccttgtagtatagtttgaagtcatgtagcatgatgcctccagctttgttctttttgcttaggattgtcttggctatatagggtcttctttgattctatatgaaatttaaaatagttttttctaattctgtgaaaaatatcaatggtagtttcatgggaataacattgaatctataaattactttgggcagtgtggccattttcacaatggtgattcttcctatccctgaggatggaatgttttcccctttgtttatgtcctctcttatttccttgagcagtggtttgtagttcttgaagaggtgcttcacatcccttgttatctctattcctaggtattttattctctttgtagtgagtgtgaatgggagtttattcatgatttggctctctgcttacctattgttggtgtaaaggaaagcttgtgatttttgcacattgattttgtatcctgagactttgctgtagttgcttatcagttccagaagttttggggctgagatgatgtggttttctaaatataaaatcatgtcatctgcaaacagagacaacttgacttcctctgcccctatttgaataccctttatttctttctcttgcctgattgccctggccagaacttccaatattatgttgaatagaagtggtgagagagggcatccttgtcttgtactggttttccaagggaatgcttccagcttttgcccattcaatatgatattggctgtggttttgtcataaatagctcttattattttgagatctgttccatcaatacctagtttattgagagttttttaacatgaagggatgttgaagtttgtcagccctatcaatctgcatctattgagataatcatgtggtttttgtctttggttctgtttatgagatggattacatttattgatttgcatatgttgaaccagccttgcatcccagggatgaagccgacttgatcgtggtagataagttttttgatgtgctgctggattcggttggccagtattttattgagaattttcacattgatgttcatcagggatattggcctgaagttttctttttttttgttgtgtctcttccaggttttggtatcagggcgatgctggcttcataaaatgagttagggaggattccctccttttcaattgtttggaatagtttcagaaggaatggtactagctcctctttgtatttctggtagaattcagctgtgaatccttcttgccctgggctttttttggttggtaggctattaattactgcctcagtttcagagcttcttattggtctattcagggattcaacttcttcctggtttggtcttggtagggtgtatgcatccaggaatttatccatttcttctagattttctagtttatttgcatagaggtgtttgtagtattctctaatggtaatttgtatttctgtggggtcagtggtgatatcccctttatcattttttattgtgtctatttgattcttctctcttcttattaatctagctagtggtctttctatttagttaattttttttcaaaaaaccagctcctggattcatggattttttggagggtttattgtgtctctgtctccttcaattcttctctgatgttagttattttttgtcttctgctagcttttggattagtttgctcttgcctctgtagctcttttaattgtgatgttagggtgttgatttgagatctttctagctttctgatgcaggcatttagtgctgtaaatttccctcttaacactgctttagctgtgtcccagagattctggtatattacctttgttctcattggtttcaaataacttcttgatttttgccttagtttcattatttacccaggagtcattcaggagcaggttgttcaacttccatgaaattgtgtggtactgagtgagcttcttaatcctgagttctaatttgattgcactgtcgtctgaaagactgtttgttatgatttcagttcttttgcatttgctgaggagtgctttacttccaattatatggttgattttagcataagtgccatatggcactggaaagaatgtatattctgttgatttggagtagaaaggtctgtagacgtctactaggtccacttgatccagagctgagttccaagtcctgaatatccttgttaattttctgtctcattgatctgtctaatactgacagtggggtgttaaggtctctcactatcactgtgtgggagtctaagtctctttgtaggtctctaagcatatgttttatgaatttgagtgctccagtattgggtacatatatattcagaatagttagctcttcttgttgaattgttccctttaccattacatagtgcccttcttttttgatctttgttggtttaaagtctgttttgacagagactaggattgcaacccctgttttgttgttgttgttgttgtttcgtttttttgtttgtttttttttttgctttccatttgcttggtaaattttcctccttccctttattttgagcctgtgtgtctttgcatgtaagatgggtctcctgaatacagtacactgacaggtgttgactcgttatccaatttgcctgtctgtgtcttttaattggtggcattcagcccatttacatttaaggttagtattgttatatgtgaatttgatcctgtcataatgctatttgattattttgcacactagttgatccagtttcttcatagtgtcattggtctttatattttggtgtgtttttgcagtggctgctaccagtttttcctttccatatttagtgcttctttcaggagctgttgcagagcaggcctggtggtaacaaaatccctcagcatttgcttgtctggaaaggattttatttctccttcgcttatgaagcttagtttggctggatatgaaattctgggttgaaaattattttctttaagaatgttgaatattgaccctcaatctcttctggcttatagagtttctgtgagatgtcggctgttagtctgatgggcttccctttgtatgtgacctggcctttctctctggctgcccttaacaggttttccttcattttaacttcagagaatctggcaattatgtgtcttggggttgatcttctcatggagtatcttaatggtgttgtctgtattttctgaatttacatgttggcctgtcttcctaggttggggaagttttcctagataatatcctgaagtgtgttttctagcttgtttccattctccccatctccttctgctactccaatcaatcgtaggtttggcctttttatgaagtcccatatttcttggaggctttgttcattccttttcattcttttttctctattcttgtctgtatatcttatttcagtaaggtggtcttcaaactctgatatcctttcttccacttggtcgattctgctgttgatacttgtgtatgcttcacgaagttctcatgctgtgtttttcagctccatcaggttggttatgttcttctctaagctggttattctagttagcaattgctctaactttttatgaaggttcttagcttctttccattgggttagaacatgctccattagttgatcataatttttttattacacatcttctgaagtctacttctgtcaattcatccctctgatcctccgtccagttctgtgcccttgatggagagacactgtgatcatgtggaggaaaagaggcactctggccttttgggttttcagcatttttttcattgattctttcttatcttcatgagtttgtctagttttggtctttgaggctgctgacccttagatggggtttttgtgggggccttttttgttgttgttgttgtcattttctgcttctttgtttttctttaaataggccccttttctgtagggctgctgcagtttgctggggtgaatggccctactcatctgatttgctcttatacctggagatgtcactcaaggaagctggaaagcagcaaagatgggtgcctgctcctttttctgggacctctgaccttgaggggcaccagcctgatgccagtaggatcactcctgtatagggtatctgacaacccctgttggagggtctcacccagttgggtgacacagggagcaggacccatctaatgaagcaatttgtcccttagtagagagggtatgtttcactgggggaaacccacttgtctgggctgcctggattactcagaactaccaggaggagaggctaagcctgctggtccacagagactgcagccacccctcccactagggtctcaggcccagggagatccaaattctgtccctgagcctctggctggagttattggagatcctgcaggaaagccactgaggaaggatgggtcagagttagacctgaagaggcactctggccgcagactgccacagctggtgtgttgggctgtggggacaagtcatgggaccaagctgtccagcctgcctggctccagcaggggaaaagcgcagcctggaactatagaaatgggtgctgcccttcccctacccagggggcttagcatgttaggcagttgcaagtcccagtgctggctgctgcccctcccacaaggagttcaaatggcttagacatcaggcagctgcagccagtgctggccacccttcctcatgggaattgggtaagcttaagcagattccagctgagaggctgtacgaatctgcgcgttccagggttgtgatgctagccccagtggcgtgggtttgcaagtggaatcttctgatctgtgggttgcacagttccatggaaaaacaacagtttccctggctgggtagcactcttactcaccacctcccctggcttgggggaagggggttccccttccccatgtggctctcaggtgggctgccacaccacactgctcttccttctctgtgtgggtaatgccagccttctagtcaattttgatgagagaacctggataccttggttgctggtgaaggattcacatgcttatgctttttttcccataggagcctcctacatggtgctgcttctagtcggccgtcttggccccacccctagttttgcatggctgggaggcctcaggaaacttaaaatcatggcgcaaggcaaagggaaagcaacgcaccttcttcacaaggcagcaggagggagctggagtgattttctaagaataattctggccaaactttcatgcactcccgcagccaaactccatttggatctattcaggcaggaatcatatttcagctccttaactctcataagtggaaactgacaccaactcattataaaacctaagtggaaaaaaaaacccttctctgccatttttatctccttgtttatagataattcaactaataggtatttttacttgtcaatattgacatggttgttttcagttctggttgtaatgatgaaaatcatactgattatcacaggtattgcttgcctcccacaagtgcacaccctgcctccctgctagaagagtcccaatttgtacactggatccacaattttctccttttttttttttttttttttaagagatggagtcttgccatgttgctcaggctggtctcaaattcctgggctagagcaatcctcccaccctggccttcccatgtgctgggattataggagtgagccactgtggctggcaaatagccacacttttcacatgatctcacgcttcagaaaaggtaggctccagccccaatcttaaggagggaattacaactggtctagtcataggaacatgattaaattctgtcaagcaaaatgaatgtacgtggaagtctgtggggagaatgggaagttggagagaacctggatccttgatcaaatccctgg

SEQ ID NO: 3043 - DNA, 19490 bp, Homo sapiens
ggtgtagcccagaagagagtgatggcggcgccgcccaatggacgcgtgggtggaagggcccgagcctcctcatccaccccctccttccgccccccacttgtgcatgcctctgcccccccgggccgcggaactctcctggggcgaccccgagtcccaccccgctgctccgtgccgtcctcgcagctcgagccctcctccagcccagcagtgctcccgcagcgtctggccgctggtcgtcggcagacgaaagggcttgaaccgcggctgaccttagcctttgtccctcggcctagttccgcagctgccgtcgaggccgccagcccctcccccagcatgtttgggctaagccgcctcctttccgcctgcgttggagagagaggtaccagaaggaatgaaaggactggggcttgtctccatggcaactgaaagaaagagagaaaaattggtcacctccaggactgagaccctgacccttccaagcatccccactaccaaaggctgcccaagcccggaaggatcccatcccgttctgtactctgaggtcacttcctcactccgtcaaatttcactggactgtgggctaattaaaagtgcctccgtattagcggggcgtggtggcccatgcctataatcccagctacttgggaagctgaggcaggaaaattgcttgaacccgggtggcggaggctgcagtgacccaacattgtgcaacaagagcgaaactccgtctcaaaaaaaataaaaaataaaaaagagtgcctccctggggagactgtaatgcccactgggcagtgatcctaatgccccttgggcagtgatccttattcccctctcccataatgattggttgtagcaggctgaacaaaaaggttgagcttcgcttgtgcttgctgaatagaattctcacgcccactccacgttagctcccctcactgtaggactagctctgaaaattctagctcctgtaggaagccaacacagacggatctacaagaaccaaaaacagctatagctactcttctaaatctcagtgcctgacattgcctctctttctgcctcctctctccaccccccaaaaaatgtggtcctccttgacctgagggagcttccgtccaagtctgagctctgatcatcctgaagaatcaaagtatcatcatcccttggctggcaagatgaactccaacatcaaaacacttgaaacagtagtatttttacacaatttgcccactgcctctacatctcacttagtccttgcagtaacatttggatgatgaggtaacttatccagaagcacaaagcctaaagaatgacagagcttggactcctgagaagttcagctactgcccgccttatgataaccaaaagaaagcggccgggcgcagtggctcaactcctgtaatcccagcactttgggaggccgaggcgtgcgaatcacaaggtcaggagtccgagaccagcctggccaacacagggaaaccccgtctctactaaaaaaaacaaacacaaaaattagttgggcgtggtggtgggcacctgtaatcccagctacttgggaggctgaggcaggagagtcacttgaatccggtaggcggaggttgcagtgagccgagatcgtgccactgcactccagcctgggagacagtgagactccgtctctaaaaaaaaatgaataaataaataagaaggcacaccacaagttcgagaccacttctacaaaaaataaaaaataaaaaaaattaggccaggcacagtggctcatgcctgtaatccaagcactttgggaggctgaggcgggcggatcactggaggtcaggagtttcagaccagcctggcccaacatggtgaaaccctgtctctactaaaaatacaaaacttagctgggcgtagtggtgcgtgcctgtaatcccacttactccagaagctgaggcagaagaactgcttgaacctgggatgcagaggttgcagtgagctgagattgcaccactgcactccagcctgggcaacagagtgggactctgcctcaaaaaaaaaaaaaaaaagaaaatgaagatgaccaaatgggcttctagatggctaatgatattctgtttctttgatctgggtgggggttacatgggtgtgttccctttgtaatatgttatcaagacattttgtgcacttttttgggtattatactgaaagaaaacatttattttttaaaaagttgaaaaattgccttggagcagagtaaggtaaatctatgattaagcttagatttttttattttttattttttattttttttcaaaaaaaatgaggccaggcgcggtggctcacgcctgtaatcccagcacgttgggaggccgaggtgggcagatcacgaggtcaggaggtcgagaccatcctggctaacacggtgaaatcccatctctactaaaaatacaaaaaattagccaggcatggtggcaggcacctgtagtcccagctactcgggaggctgaggcaggagaatggcatgaacctgggaggcagagcttgcagtgagccaaggtcacgccactgcactccagcctgggtgacagagcaagactcgtctcaaaaaaaaaaaaaaaagtaaaatgaacctaacaagaggcatcctttctctgtggttattatagtgagaactaagttctttatcactctccggttatttacccctagagagaagccaactttctggttgtatacaccagaataagtacaagaatggtaagcatagagcttcagagaaactagccagattctaaaggaatgacttgaaaatcgagagccgtttcaatgacaaaacatcatacaaaatattcatctaccacattagaggcctatcgctaggtaaaaacaccaaaacttcagcttaaacagtagtatgtatgtatgtattatcccagtttctgtgagtcaggaattcaggattgataagctgggtggttcttgttcagaatctttcaagaggttgcagtcctctgaaagtgtagtgggttggggtatccacttccaaggtggcttgctcatatggctggcaagttggtgctggctgttggcaggaggcctcagctcacaatgcaggctttcataggactacgtgagtgtcctttcaacatggcagcaggccttccctagagctagtgaaggatgagaaaacgacaaatcgcaatgtcttttatgacctaggctgggaagttatactccatcatttatgcaatatcctgttatcacacaggtcatccctattcagtgtaggttggtactacacaaggacatgaatatcaggaggaagagaatctctggaggccatcttggagcccatagtccgccttctgccccctaatgattcacgtcttcgtctgttcctgctctctaagagccaggaggcagacttcccttgagctttcttgcagctaaagtagagcatcattagcagtaaaaattaagatatcatcacaaaggccaggcacagtggctcacgcctgtaatcccaacactttgggaggccaaggtgggcggatcacctgaggtcaggagttcgagacatgcctggccaacatggtgaaaccctgtcttcactaaaaatacaaaaattaacctggtgtgttggcgggcacctctaatcccagctacttaggaggctgagccaggagaatcacttgaaaccagaggcggacgttgtagtgagccaagatggcaccactgaacttgagcctgggtgacagagcaagactccatctcaaaaaaaaaaaaaaaaaagacatcacaagattgccaggcacagaggcttaaacaccaagttctttctcatgtcatcgtgtttcgtcggtgccgaggacatgaggggtgtagatcaggcctgtttcaaacacaaggccttttggccagagtgtaatggtgtgaggacttgggaagaccttacctacttaactgtctctctcaaaggacaaaggtatgagggggttaaaaaaaaaaaaaaaaaggcaaagctatgaagaacatgaagttcttaagcccctagacactcttccaaggtctggcctgtatcccagagtccactgctgaaaaggggcagagatgtgtgttatatgcgcacatacgtacgcatagtatagctagcatatggcattctggtggcctcgacggagctcacaggcaatataacagcattgactgctttcacagtttccacttgtctcaggaaaatagagaaaattcaagatgaaatacagtgagtttaggacaactcagtttcctaaatatggaagatcctgtcccttcccaagtattgaaagagatgaaaattttcccttagttttcaagctcaaagtctatcttatctttgactaaatagccctgatttggatactgttaacttgctcttaactactaatagtctagtgcttttactttattttattttatttattttctttgagacggagtctctgttgcccaggctggagtgcaatggcactatctcggctcactgcaacctccacctcctgggttcaagcgattctccttactgagcctcccgagtagctgggagtacaggcgcacaccaccatgcctggctaatttttgtacttttagtagagatggagttttgctacgttggccagggtggtctcgaactccaactcaggtgatccacccaccttggcctcccaaagtgctggaattacagggatgagccactgcacacagcctatttgttttttaagagacgtgatctcgggaccaggcatgatggcccttgcttaatcccagcactttgggaggccaaggcaggcggatcacatgagtccaggagttagagaccagcctgggcaatgtggcaaaaccccatctctacaaaaatacaaaaattagccaggcgtggtggcacatgcctgtggtcccagctactcaggaggctgaggtgggaggatcgcctgaaccagggaggtggaggttgcagtgaaccaagatcgcaccactgcactcagcctggaccacagagcgagacactgtctcaaaaaaaaaaaaaggatctcactctcaccgagtcacatttcaagtagtcaatagccacaagtaccaggcacggtggctcacgcctgtaatcccagcactttgggaggccgaggcgggcagatcacgaggtcaggggatcgagaccatcctggctaacatggtgaaaccccgtctctactaaaaatacaaaaaattagccgggcatggtggcgggcgcctgtagacccagctgcttgggaggctgaggcaggagaatggcgtgaacctaggaggcggagcttgcagtgagccgagatcgcgccactgcactccagcctgggcgacagagcaagactccgtctcaaaaaaaaaaaaaagaaaaaaataaatagccacaggtgtctagtggctatcacaaacagaaagctctaattagtaatttatttcaatggcctcctaagagtttgttctgcctctagtctctactctccaggcccacagctcccagggtaatcttattaaagcattctcctgtttataatctcgcctatgttaaaaaggttatggtggcttctttgcctacagaatgaagttcaaacaacttgacatccaaggagctccaccatttggtatcttcccactttttctttttcttttttttttttttttttttgagatggagtctcactctgtcacccaagctggagtgcggtggcacaatctcggctcactgcaagctccacctcccgggttcatgccattctcctgcctcagcctccggagtagctgggactacaggcgcctgccaccacactgggctaattttttgtatttttttagtagagacggggtttcaccgtgttagccaggatggtctcgatctcctgacctcatgatccgcccgcctcagcctcccaaagtgctgggattacaggcgtgagccaccgcgcccagcatcttcccactttttctcattgctttattatgcttgcataactgttctaacaaaacaaatctcacaattctctagataagccttattcttacccagctttggctcatccttcatctctacatcttttttttttttttcttttgaaacggagttttgctcttgttgcccaggctggaatgcaatggtgctatctcagctcaccgcaacctctgcctcctgggttcaagcgattctcctgcctcagcctcccaagtagctgggattacagggatgcaccaccacacccagctaatttttgtatttttagtagagatggggtttctccacgttggtcaggctggtcttgaactcccgaccacaggtgatctgcctgcctcagcctcccaaagggcatctctacatctctacataaaattccttcccgccacatttctgcttatcaaaatccaatccaacttctatggcatggcccaaatgatacctcctccttaatgtcttcattgattaccacagttcactgtaaacctgatctttttttttttttttttttttttttggagacagagtctgtctctccatcgcccaggctggagtgcactggcgcaatctcagctcactccatcctccatctcctgggttcaagtgattctcctgcctcagcctcccaagtagctgggactacaggtgcatgccaccacacccggctaatttttgtattttttagtagaaacagggtttcaccagtctggtcttgaactcctaacctcaggtgatccacccacctcagcctcccacagtgctgggattacaggcatgagcctctgcacccggccaaccctgattttttttttttttttgagacatagtcttgctctgttgcccaggctggagtgcagtggcacgatctcggctcactgcaagccccgccacccaggttcacgccattctcctgcctcagcctcccgagtagctgggactacaggcgcctgccaccacgcccggctaacttttttttgtatatttagtagagacggggtttcactgtgttagccaggatggtcttgatctcctgacctcgtgatccgcccgcctcggcctcccaaagtgctgggattacaggcgtgagccaccatgcctggcccttttttttttttttttgagacagggtctggctcagtcacccaaggtggagtgcagtgacgcaatcatggctcactacaacctccacctccccggctcaagcagtcctcccacctcagccactcaagtagctgggactgcaggtccacaccactatacctggctaattttgtattttttgaagaggcagggttttacaacgttgcccaagctggtctgaaactcctgagctcaagtgatccgcccccctcagcctcctaaagtgctgggattatggtgtgagccaccttgcccagccttatgtcactctcagtggcatttctcgtacttcctggtcctaagattcttggtgtacacgttgtataatcccaactagatatgagagctatcagattaagactttgcatctttacatcccccagtacctttcagagtgtgagtgcacacacaccatttgctaaggaatgattgcagtgacaataccaagtttaggatcccttaaaatacctatatcttgggcagaggttgcattgagctgagatcatgccgctacactcagcctgggtgacagagcgagactccatcttcaaaaaaaaaaacagtccgggtgtggtggctcacgtctgtaatcccagcacattggtaggccaaggtgggtggatcacaaggtcaggagttcaagaccagcctggccaacttggtgaaaccctgtctctactaaaaatacgaaaaaaaattagccgggcatggcggcggggcacctgtaatcccagctactcaggaggctgaggcagagaattgcttgaacctgggagacggaggttgcagtgagccgagatcacgctactgcactccagcctgggcgatagagcgagattctgtctcaaaaaaaaaactacatcttcatagtggacatatttgacatctacccaacttacaaccattcctcctatagatcatagattaggccccaacagccatgtttgtacctcctaaaccccaccaccttggaatagagacttacttctcaaagtgtgatgccacattcctcgtggggtcaaagaagcagaaaaaattggtttgcggccgggcgcagtggctcacctggaaccaagagtcttaattaaacaatcatgatggagaccaagcccacatttttcaggtcacctaatcctggcctctccatgatccagtaacctgagttacagctttcctaccataaggacttagagctaatttcttaaagcctgtagtggaggctgaggcgagaggattgattgacacaaggagtttgagtccagcctaggcaacataccaagacccagtctcttaagtaaattttttaaaaaatcaatttagtttccaaatgagatcaacatattaacatattatatttgattgctttgccttttttttttttttttgaggtggagtttcactcttgttgctcaggccgaagtacaatggcacaatctcagctcaccacaacttccgcctcccaggttcaagcgattcttctgcctcagcctcctgagtagctgagattacaggcatgcaccaccacacctggctaattttgtatttttattacagatgggtttctccatgttggccaggctgatctcgaactcccgacctcaggtgatccgcctgcctcagcctcccaaagtgctgggattacaggcatgagccaccgcacctggcccaggtttgatttctttaaaagaattcttcacaggtgctatttacctttttaaacattatttttctatttttgttttgtttttgagacggggtctcaccctgtcacccaagcaagagtgcagtggtgcagtcacagcttactgcagcctcaaacccctgggttcaagcaattctcccacttcagcctcccaagtacctggaggtacaggtgtgcaccaccacgcccagctaattttttttttttttttttttttagagacaagggtctcactatgttgcccaggctggtctcaaactcctggcctcaagcgatcctcccaccttggcctcccaaagtggttcccacttataagtgaaaacattacaggtgtgagccaccatgtctcactatttactttttattcatctcatcaagagaagagaaattcataacattaactacttacgttaggggctacagcccctaccgtaattttctaatcaggtagtttcttctatgcttggttaactggaatttgtgtgtgtgtgtgtgtgtgtgtgtgtgtgtgtgtgtgtgacagagtctcactctgtcacccaggctggagtgcagtgacacgacctcagctcaccgcaacttcctcctcccaggttcaagcgattctcctgccccggcttcccgagtagctgggattacggctgtgcaccacgacacccagctacttttcttttgtatttttagtagagatggggtttcaacatgttggccagtctagtctcgaaatcctgacctcaagtgatccacctgcctggcctcccaaagtgctgggattataggtgtgagccaccgcacccagcctaactggaatatttctataaagaatcttccctcatcaactctttgttatcctgaagtacctcaacctcagcctccagaggagctggaactactcaaatagaaaaggcaggatcaattctttccctttactgaccagttttcagaatgagttggtttcctggggcatcctctagaggtcaacaatgaattctttttagtattatcatgaactggtggctttttttttttttttttgagacggtctcactctgttgcccaggctggagtgcagtggtgcgatctcggctcactgcaacctccgccttctgggttcaagcgattctcctgcctcagcctcctgagtaactgggactacaggcaagtgccaccacgcccagctaattttttctattttagcagagaggaggtttcaccatgttgcccagggtggtctcgaactcctgagctcatagaatccacccactttggcttctcaaagtgctgggattacaggcgtgcgccaccatgcctggtgttttttttttttttttttttttttttgagacggagtctcacactgttgccggggctggtgtgcactggcgtgatctcggctcgccacaacctccacctcccgggttcaagcgattctccttcctcagccccctgagtagctgggactacaggcgcgtgccaccacgtctagcttatttttgttttgttttgttttgtttttttgaggcagagtctctgtcgcccaggctggagtgcagtgacgctatgtcggctcactgcaagctccgcctcccaggttcacgccattctcctgcctcagcctcccgagtagctgggactacaggctacctgccactatgcctggctaattttttttttttttttttttttttttttagtagagtcggggtttcaccgtgttagccaggatggtctcaatctcctgacctggtgatccgcccacctcagcctcctaaagtgctgggattacaggcatgagccaccgcacccggactgtatttttttttttagtagagacggggtttcactatgttggccaggctggtctcaaactcctgacctcgtgatccacctgccttggcctcccaaagcactgggattacaggcgtgagccaccgcgcctggccaactcatggattttaaaagcctatttgatgagtttcagtccactggagtcaggtctttttttttttttttttggaagtgctgtgatcgtgactcactgcaacctctgcctcccaggttcaagcgattctcctgcctcagcctcccgagtagctgggactacaggcgcgtaccaccatggccagctaatttttttgtatttttagtagagacggggtttccccatgttggccaggatggtgtcgatctcctgacataatccacctgccccggcctcccaaagtgctgggattacaggcatgagccaccacccagcccaaagattctatattatatatacagttttccactttttttttcctcttagcaaaacatcatggagttcactccatagcagtatagagatactcatttctattcacagctgcatagcactccaatgtagatataccttggtttattgccaatgttctgtagatggacattgtctgagttatttccagtcttttgctatttacacagtgggctataatgactagccttggacatatatctttatttttgccaatgttatctttggcttagactactagaaatggaattgctgggtcaaaaaacacatgcatatgtcattttgtaggacagaatcaaattcccctcctgaagaggcagctgctataatggtgcttccagtggttcctacttctgggtaaattgccccttgactgcaatttacagaagtgatgggagtggatgcagaggctcctgcctgtaatcctagcactttgggaggctgagccaggaggatcacttgagcccagcagtctgagactaacataggcaacacagtgagaccgcatctctactaaaaatcatgaaagttagccaggcatggtagcgtgtgcctctggtcccagcaactcaggaggctgaggtgggaggattgcttgagcccaggagtttgaggctgcagtgagacattctactccactctactccaacctgggcgatagagcatgcccttgtcttaaaaaaaaaaaaaaaaaaaaaaaactgctgggatgtcactttcaagattaagtaccaaaggactgtgacttctgttttgctctcatacattctctgtctgagagctgggagcttgtctttaagtagaaacccacccatccccagggagaaggcaggagggaaaaggaggagaggtcacagacaagccccctgactctgttgatcttcactgcagtagcttctcattacaagcaggcatctggccattgtagaccattataactgtagttctagaagtaataatagcagatttattgtacagaagtgtccacgggctcacaattctaaggacatcatcatgacagcaagtaggaaaaaaaattaaagtaattctttcaccaattaccagtttatctcttctccaattcctttggatacgcctcctgcaagaagccgatttccagctgtatgtgataatgaaagggtttttctttcttatgttaaatacaagcgaagtgattaactggaagatagcgtctgattgcgaggaaatcagtgattcagatggtgtgggaatggcacctggggatgggggaggcaggacggagatggaggaagctggtgcagcctagcctgccttgtgccaaggacacccaagggcagagggactgagctctgggggaggacagatttgacataactggtccagcctcacagtttacaggtcctggagggtgaggaaagtgggagctggctgcggatgcaggacaagaacccagggcttcccttcattttgcctgccctgccacttcctcccgccacttccacccttcctacccctccacctcccttgtgcctttcactgccttttacagcatttacattacacttcagtaaaaagttgtggttttggctggttttttttttttttaaataaaaacagcactgaagaagtagaaggaagatattcagggtttttatttttattttttgagtctgggtctcgctctgtcacccaggctggagtacagtggtgagatcatagcttactgtagcctcgacctcccgggctcaaagatcctcacacctcagccttccaagtagttgggactacaggcatatatcatcatgcctggctaaattaactattttattttaagagatgtggtctagctatgttacccaggctggtctcgaactcctggcttctagcaatcctcccacctcagtctcctgaatcactgggattacaggctggggccatcatgcccagctctaggtttttaaaatgtaggcaaggaggtcagcatttacacaaaagcagggtttgatcttaggaagcttaataaagagaggggtctaatcaaggtttcctgtaggatctgggctttaagttaggccttaaagaacgaagaatgtttgtgggtgtagtaagcaatgacttggagcagagccctctagccattgggctcaccctcacaggcaggcgccactgaccctaggggggtgtaggcagctggaggaagtactgtgtgtcccccattccagcgatggtggcccctctcagagtcaatacccttccttccaagagactgaacatacaactggacaatggccaggccacatatgacaatagactctggccagaaacccatgaccagcctgggaagccaaggaagccaaaccacagcctcagcagcaatcggacccagaacagtctgaacttagtggctgccagcttcttcccaatccccagccaccacaccccctcttccaactccagaccaaccagagaaagccaaatatacccccccaaccaaccaaagatgcccctccagttagtccgctctgtccccatgccaacaatctccaatcacagcacacccagagccttccctttttttccactataacatttcacagtccctgcctgcctttgacccctgccaaatacaagcaatcatggctgactcctttgcaaactttgaccaaatggcctctctgctcttgtttaggtggtttttatttccacatctccaacagggagtctggaaacaaactgacaatactcgtgaaatcaacacccagatgaggactctgacctcttttgcttgacctcatgtctgtgaaatttatccatgttgctgtgcatagcgatattttcattcatattcgttgctgtgcagtagtattcgaccctgtgacttcactgtagcttcaactgtggatggacatttgggttggtggatggacatttgggttgtttcaggtttggggctacagtcagcgtgtggttagaaacattcttgccaatgtctcggtggacatagctttctgtggtgtacatacccaggagtggaactgctggatcagtttatacgtatgttcggcttttggtagatactgccagttttccaacagggtcacaccagcttggtccattcaggttacaatgaaacaccttagcctgggtaatttgtaaacaacaaaaaattatttctcacagttctagaggctgggaagtccaagatcaaggtgccagcagatccagtgtccagggcgggctctctgcttcagagatacggtgccttctcactgcatccacacatggtagaagggacagaagggctccctcaagcctgttttataaggtgctaaccccattcatgatctccaccctcatgacctaaccacctcccacaggccccacatctttattatttttttgagatggagtctcgctctgtcacccaggctggagtgcagtggcacgatctcggctcactgaaatctccacctactgggttcaagctattctcctgtctcagcctcccgagtggctgaaattacagatgtacgccatcacacctggctaatttttgtatttttagtacagatggggtttcaccatgttggccaggctgatctcagactcctggcttcaagtgatctgccccctgccagcatcccaaagtgctgggattacagtcatgagccaccatacccagccccaaaggccccacctcttaatgccattgctttgggggttaggattcaacatatgaattcaaagggtacacctacattcacaacacagcactgacttagattccctgcaaaacccatgagagtttcatttcctccatattttcatcagcatttcatcttgtcagatttactctctataggttctaagtattattccccctctgctgatttacttattataaacagtacataactgatcagataaacacttgtccctttgccacccctaatgcctgcccccacttcatattccaggaacactccattaaaccaccccctactgtactggtgggtggtgggagggggctcatcgggtggggtctttgccgtattattctgtgtcactgaggcctatcacagtgctctgcacatgtaggtgcaaatatctgttgtatgattacataaaagaatgatgtgaaagcctatttgtctgtaccacaatcatgaacgtccccaaccacttgaaggcactcatagtgtcttaatcatcttaggccttcgatctggcataggtaactcctttaataaacaatgtctgctaaaccaaatggcttcctgaggcctggcattttaggctgtgtcccctgccccacctcgcccagcctggggcattgagcctggctgggcacacacgtgatagttgtaatcatattgtcataacatccctgagactacattaattacatattgagtgttatagtactattatagcaggtggcagatgttggcacactgggcagagatgtgttggtgtgaaaaacctctatgtactttaaagacagggtctccctctgttgcctaggctgaagtgcagtggtgccatcatagctcactgtaacttcaaactcctgtgctcaagtgatcctcccacctcagcctcctgagtagctggaacttgaggcacataccaccacacccagctaatttttaaattttttgtagagatagggtctagctgttacctacactggttttgaactcctggcctcaagcagtccttctgccttggtctcccaaagtgctgggattataggtatgatccaccacctccagccaaaatctcactttaagtggggtccctaactccagacatgtgataagctgtggttcacaggcataaagaacatccagcctggggccccggggtcagagttttccctcgcattgtcccctgggtccttcatccctcctaatcttgcaaaccagctgtcaattgggttgagatggtatctctttcatagggtcattatgaggattaaatgacttaatatatgtaaagcacttagcttaatgcctggcagacagtaaggtatggagtaagttgtaacccttattattattgctgttgctgttagcaacagagtgaggaatgctaggagtgaccatgcccagcaccgaatgaggccttcatagccttgggctaaaagaaaaagagcagaaaggtgaacacaggggaaggcctcaatttcaacacagatgcattagaccaaggactctgaactcactttccctggaggtgggggtgctatcagctgcttaatggagcatcatggaaaatgtgggactcaaggcctgaaggactccattcctaagagatgggagcaggagacatgctacggagtttgaatcttgcctagcacagggatttctgcctgctggaagggctctgtcagggcctagtggaagcccctgcctcagtggggcaaactgccactggacacacccatcattcatcatcacctctctgggacagtagtagcagccaggcacctccaaagagcttgacaacagaggaacccgcttcggcccctcctctgaagacaggatcctgcgctactccaactctgaactggttcaaggtgagagacgtcatccacagaggccacaaaaccaagaggtggatgcctcattgttacttcatgctgtctgggagcaaagagagggccttaggcacaaaatcctccagacccgcatctgccccttggctttctcaacccttcactctccaacttctataaataacctgtacagtggccaggcaccgtggttcacacctgtaatcccagcattttgggaggccaaggcgggcggatcacttgaggtcaggagttcgagaccagcctggccaacatggtgaaaccccatctctaacaaaaatacgaaaattagccaggtgtggtggcgggcatctgtaatcccagctacttgagaggctgaagcaggagaatcacttgaacctgggaggcggaggttgcagtgagccgaagttgcaccactgcactccagcctgggcaacagagcaacactctgtctcaaaagaaaagaacctctgcagaatgaggggaagcagggaagcaggcaggggtgaacaagatggccatgaattgataattactgaagttgggtgatgggctcatggggatttgttattctactctctctacttttttgtgtttgaaagttcataataaataatgttgctcaaaggaagctattaatagtttgaggccaggcagggtaaagagcatctcctagattttttttttttttttttttttttttttttttttttttttttagagatagggtcttgctttgttgcccaggcttgtctcaaactcctggcttcaagggatcctcccacctcggcttcccaaaatgctgggattacaggcacaagccaccacatccaacctccctcatatttgactaagaagtctcataaatctgagaacacctagcaaggaattaaggcgagggtgtggcactgttctggcttcagtctatcaccaggcagagtccacgcattcttcccagggagaaagaagcagtgacagctcttgggctttgagggaaatgattcagcgggagaaagaaggtggagaggggctaatatgcagataccattgctgcaggtggctctgcccctaagcactgaggagggcactggtccctctggccccacccagccttcaccccaaggtgaagtacgctttctcaggtccccaaggatgggtggccaggtcccccactgggagtggaggtctcactcccttccttgggttctgacctccacattatctggctgtgagggtgacctgcctggctttccccaccaagtgcagctccccgcagctgaaagccacactctcaacacaggactcctgagatctgacactggccaattcacaccctgcttgaagctggcatttgagaggccttcaggttgacaacagcagcaacaagtttgctgttcaaagtaggccaagtcacggctttgagcggcatcatttgaaaagtgctgggatcagccaggcgcagtggctcactcctgtatcccagcactttgggaagccaacgcaggtggagcacttgaggtcaggagttcaagaacagcctggccaacatggagaaaccccgtctctactaaaaatacgaaaattagtcgggtgtggtggcaggcctctgtaatcccagctactcgggaggctgaggcaggagaattgcttgaacccgggaggcggaggttgcagtgagctgagatcatgccactacactccagcctgggcaacggagtaagactgtctcaaaaaaagaaaaaggaaaaaaaaaagtggtggggtttgggtgcagtgtctcacatctgtaatcccagcactttgggaggctaaggcaagatctcatgaggccaacctgggcaacataacagcatgacctcatctctataaaaaatttaatttggctgggcgcggtggctcacgcctgtaatcccagcactttgggaggccgaggcgggcggatcacaaggtcaggagatcgagaccatcctggctaacacagtgaaaccccgtctctactaaaagtgcaaaaaaattagccaggcgtggtggcaggcgcctgtagtcccagctactctggaggctgaggcgggagaatggcctgaacccaggaggtggaggtcgcagtgagctgagatcgcgccactgcactccagcctgggtgacagagcaagactccatctcaaaaaaaaaaaagaaaaaaaaatttaattagccaggcatggtgacaggtacctgaagtcctagttactcagaaggctgaggcaggaggatcgcttaagcccgggagtttaaggatacagtgagttatgattgcaccacttcgctccaggctgggtgattctctaaaaaaaagaaaaaagaaaaagatgggaggatgggaggcggggctaggggactgggaaggtccctcaaccctttctacatgccttacccagggtatctcccatcatggctggttactgtgctaaaattataattttttttctttgagacagagtatcactcggtcacccaggctggagtgcagtggtgcgatctcagctcactacaacctccgcctcctggcgggctcaagtgacttatcttcccacctcagcctcccatgtagctgggactatagatgggcgccgccatgcccagttactttttgtattttttacctaggctggtagtgtgctaacattctaccacttgggcaacagtcttcggggctacatactgcctttttttttttttttgaaacagaataccactctgtcgcccaggctggagcgcagtggcacaatctcggctcactgcaacctccgcatcc

SEQ ID NO: 3044 - DNA, 4300 bp, Homo sapiens
gaggccaggaccacgcctgactcaggcgatcggacgggcagggaggctgcaaggcatggcatgagcaggtggagctgtcaggactgccccagcccctggctcaaagatgcccgaccccaggaccctgcctcgctggatggtgaaggccaacttcccctctgttggagctggcctgggcgttgtgggaagggctgggaggaggcccaggacaatgcagaacagacaggacgtttcacagagcaggctgccatgtccctcggggccttgggggctgctgaggccctgagaaaggtcactggaggcctggccggaagtgcagggttatctcagtacttgatttaaggctcctgcagctgaaaagctgccccacacggcggaccgggtggaggaagtcagctgtgctgcttaaccgtggagtctccgtcccggtcctgctcaccagctctgcaaaggccttgtcctccctgcctgattctcggcaccatttttaacacgcctatggagaggccacgttgagtccagaggtccgtgcgcctcatggccacatcacggcacccgttcacccacacaagggccaggagcatcccctagggaggaggagatggcagatctgcacaggctctgcgctcctctctctccggagcgtcctctcctctgtgtggcaggctcggcgcgtgatggaggagccccttctgcagggctctgtttagagggtgcccgccccacagcctgtggctgctcctactcatgccagaacagaaatgggtgcccagctggtcaacatacatttgttaccttgctttaaaatgccttgagagtggaaccaccggtgcaggcttggctggtcaagaatcatgttctagaaattatttccagtgctgagcacagtccctgagatttaaaaacgcttatgggatgaatggaaaatagcagggcctcttaccggcctgcaacgcctttagaggcacggatgccacgtgcacagacccagctccgggaagcacaagcctggtggtgtgcgggaagcggcgaggtgcgcgggaagcggcgaggtgtgcgggaagcggcgaggaccggctttaaagtcacagcagtttcctgaaagatgagggggaggaggacagtgacgctcacagcacagccacttgtcaacttggacatgacacacacaaagcccagagctcggacggcaccgcgaggaggctgggattcacgtcaggcggcacttggtgggcagttacaagaaaggacggcagccaagccagtgcctcctgtgctccggctctggggccctggacacacctggggattcagttttgcatggaccagcattctccaagcgctctgatcagtcttacaggagaagtaggctgtgtggtctgggagccttgagaaggttccgctgtaatctgtcagacttttggacaggatttttctgccttacgtggctgatgtacgtctgcaggagggtagcacacggcaccctctcggcctgctgtgccacaaaacctttgcttttacaggtctcacggagccagtgggctgcccaatgccccagtgcagagtggagacgaggtcttcccctccttcccagcttgcctgggcggcgacgcgtctcagagacctctgccagggtcaatcctggcccatgctactagctcggggtgtgaagtcacagttgatgctgaacacctggctgggccagacttgtgcccaagaaaccttataccaccaactggttttcaaaagaaaaaaattaaaagtaattcaaaactttgagatataaatataattctttaaaaactgcagcgtggttcactggccctgtgatgggctgaatgcgcccccaagttcatgtggcagccttgacccccaggacctcagcgtgtggcgtcttggagacaggggctttacagaggcgatgaaggtaaaacaagctcttatggcgaccctgacccagcaggaccggtatccttatcagaaagggatatctggacacagagacagacgtgcacgtgtggagacacctgaagatgaagatggcatctaccaggcgggggagtggcctcaggagaaacgggctctgcccacgcctcgacctcggacttccagcctccagagccgtgtgaaaagaaacttccatcatttaagctgccctgtctgtgggactttgcctcggcagcctgagcagacagtacaggctccaaaaacgctctctgcatgtgtgattctggccaggaccaccctgcccgaagccacggctatgtcgaagctaattgtgcgatttctgccggccacgtggttttgatccaaaagcatttgaaagctgctctgaagatgcagaaaagctgagtcccggcatcgctgctccttccaagcgactgttcacacacagggtgtgagtgcgtccccccatccagggtccagcctggcctaaggctcactgggcaccatccagatctgtgactgggtccccccatccagggtccagcccacccgaggttcactgggcaccatccagaggccccagatgccgacacctggggacgggctgtatcaggcagatgtttcctcccgggctccacctggggacgggccccggatgctgacacctggggatgggctgtattaggcagatgttcctcccgggctctagttttccaggccgacaggaggaagtcctgttggggccaggggaggcattggggatgagattgagaggatggtggggtcgcaaaggtttacattgcctgtgccactttctccaaggtctggggccgccaccctgtggtgcctctggaagctgccatgtggggctggcccacggtgactggccacggcggggctgtgtgtggtatgcacctgtgagctgctgaaacgcagcctggcggccaggaaccagctgccccatcctctctgcaggaggtcaggtttgagcacgtattccctcaaacgctcatagacgtcagtatctcaggacaaagtgcttgtctgagacccaggtttgggccccaaggtggtaccatcgagggaggcatgttctggcaggtgacagcccctcctctgtgcctgaacctgcagtttctgcccccgcataaaatgccgccatctcaggccctccctgacccccaacctgcacaagggctcacagctggcaggcacctgtgtggggtcgtggtaggacctgtgtctctgaggtccagcccaaggctgtgccacataggcccaaatccaagcactcccctcctgggcacgtggctgtgtgtgcatgtgtggctgggtgggcaggggggttgactctggccaccgaaatggagaggagcggtgcactccctgggtctggcccacgcaggctccttcccaagtgctgctgccgggaaatggaggtccctaggtgagacgggagccgggcactgtgggggtggcccctgaggggctgcaggttggcactgcccagctgacgcattccgcagtcctgcaccaggggatgaacgaggaatcggcttctgctctgctgaacatcccactggttcatgtccacttgtttgggtgatcctaactgatctgctacctgagtttgaatctcagcgctattattagtcaggggtcctggaggtgggtgaccccacctcacctaaaccacagagatgctcatcctcatgcatgcacacgtccatctcagcttcagctcgcaagcaggaccctcaccgtggggccacgacggaccctgcaaagctggtctgactgtgccgagcctgtcgggggttgggggaaggaaggcgggagctcggcatctggagggcagtggagaccctcagcgagtgccaggaggatctgctgtcttcccagtgttgtcttcacagtggagagatgagttcacacagccttatctgtgtttccagtggcctctgtgtgcaagacgggccacgggttttgtgcggtatttgcctgtgggtcacagccaggtgaatgggccctcctggggctgcagccccaggtcctgatgttacttgtgccagcctggccacagtgcccggcctccagaagctgctgtcagaggagcagacgggagggcagggtggacggttaacagggtcaaggccccagagccccacaccctccccagcagccagcacaccctctgttctgtgacctcgcccctgcattgcggcaactgacagatgctccccggcctccttccccgctgccgcgcaacctctgacagccacgtgtactctcctgctttagaacaaggacctttcccttttgtgcatgaatacgctctcagcagatgcgagaa

SEQ ID NO: 3045 - DNA, 4302 bp, Homo sapiens
gaggccaggaccacgcctgactcaggcgatcggacgggcagggaggctgcaaggcatggcatgagcaggtggagctgtcaggactgccccagcccctggctcaaagatgcccgaccccaggaccctgcctcgctggatggtgaaggccaacttcccctctgttggagctggcctgggcgttgtgggaagggctgggaggaggcccaggacaatgcagaacagacaggacgtttcacagagcaggctgccatgtccctcggggccttgggggctgctgaggccctgagaaaggtcactggaggcctggccggaagtgcagggttatctcagtacttgatttaaggctcctgcagctgaaaagctgccccacacggcggaccgggtggaggaagtcagctgtgctgcttaaccgtggagtctccgtcccggtcctgctcaccagctctgcaaaggccttgtcctccctgcctgattctcggcaccatttttaacacgcctatggagaggccacgttgagtccagaggtccgtgcgcctcatggccacatcacggcacccgttcacccacacaagggccaggagcatcccctagggaggaggagatggcagatctgcacaggctctgcgctcctctctctccggagcgtcctctcctctgtgtggcaggctcggcgcgtgatggaggagccccttctgcagggctctgtttagagggtgcccgccccacagcctgtggctgctcctactcatgccagaacagaaatgggtgcccagctggtcaacatacatttgttaccttgctttaaaatgccttgagagtggaaccaccggtgcaggcttggctggtcaagaatcatgttctagaaattatttccagtgctgagcacagtccctgagatttaaaaacgcttatgggatgaatggaaaatagcagggcctcttaccggcctgcaacgcctttagaggcacggatgccacgtgcacagacccagctccgggaagcacaagcctggtggtgtgcgggaagcggcgaggtgcgcgggaagcggcgaggtgtgcgggaagcggcgaggaccggctttaaagtcacagcagtttcctgaaagatgagggggaggaggacagtgacgctcacagcacagccacttgtcaacttggacatgacacacacaaagcccagagctcggacggcaccgcgaggaggctgggattcacgtcaggcggcacttggtgggcagttacaagaaaggacggcagccaagccagtgcctcctgtgctccggctctggggccctggacacacctggggattcagttttgcatggaccagcattctccaagcgctctgatcagtcttacaggagaagtaggctgtgtggtctgggagccttgagaaggttccgctgtaatctgtcagacttttggacaggatttttctgccttacgtggctgatgtacgtctgcaggagggtagcacacggcaccctctcggcctgctgtgccacaaaacctttgcttttacaggtctcacggagccagtgggctgcccaatgccccagtgcagagtggagacgaggtcttcccctccttcccagcttgcctgggcggcgacgcgtctcagagacctctgccagggtcaatcctggcccatgctactagctcggggtgtgaagtcacagttgatgctgaacacctggctgggccagacttgtgcccaagaaaccttataccaccaactggttttcaaaagaaaaaaattaaaagtaattcaaaactttgagatataaatataattctttaaaaactgcagcgtggttcactggccctgtgatgggctgaatgcgcccccaagttcatgtggcagccttgacccccaggacctcagcgtgtggcgtcttggagacaggggctttacagaggcgatgaaggtaaaacaagctcttatggcgaccctgacccagcaggaccggtatccttatcagaaagggatatctggacacagagacagacgtgcacgtgtggagacacctgaagatgaagatggcatctaccaggcgggggagtggcctcaggagaaacgggctctgcccacgcctcgacctcggacttccagcctccagagccgtgtgaaaagaaacttccatcatttaagctgccctgtctgtgggactttgcctcggcagcctgagcagacagtacaggctccaaaaacgctctctgcatgtgtgattctggccaggaccaccctgcccgaagccacggctatgtcgaagctaattgtgcgatttctgccggccacgtggttttgatccaaaagcatttgaaagctgctctgaagatgcagaaaagctgagtcccggcatcgctgctccttccaagcgactgttcacacacagggtgtgagtgcgtccccccatccagggtccagcctggcctaaggctcactgggcaccatccagatctgtgactgggtccccccatccagggtccagcccacccgaggttcactgggcaccatccagaggccccagatgccgacacctggggacgggctgtatcaggcagatgtttcctcccgggctccacctggggacgggccccggatgctgacacctggggatgggctgtattaggcagatgttcctcccgggctctagttttccaggccgacaggaggaagtcctgttggggccaggggaggcattggggatgagattgagaggatggtggggtcgcaaaggtttacattgcctgtgccactttctccaaggtctggggccgccaccctgtggtgcctctggaagctgccatgtggggctggcccacggtgactggccacggcggggctgtgtgtggtatgcacctgtgagctgctgaaacgcagcctggcggccaggaaccagctgccccatcctctctgcaggaggtcaggtttgagcacgtattccctcaaacgctcatagacgtcagtatctcaggacaaagtgcttgtctgagacccaggtttgggccccaaggtggtaccatcgagggaggcatgttctggcaggtgacagcccctcctctgtgcctgaacctgcagtttctgcccccgcataaaatgccgccatctcaggccctccctgacccccaacctgcacaagggctcacagctggcaggcacctgtgtggggtcgtggtaggacctgtgtctctgaggtccagcccaaggctgtgccacataggcccaaatccaagcactcccctcctgggcacgtggctgtgtgtgcatgtgtggctgggtgggcaggggggttgactctggccaccgaaatggagaggagcggtgcactccctgggtctggcccacgcaggctccttcccaagtgctgctgccgggaaatggaggtccctaggtgagacgggagccgggcactgtgggggtggcccctgaggggctgcaggttggcactgcccagctgacgcattccgcagtcctgcaccaggggatgaacgaggaatcggcttctgctctgctgaacatcccactggttcatgtccacttgtttgggtgatcctaactgatctgctacctgagtttgaatctcagcgctattattagtcaggggtcctggaggtgggtgaccccacctcacctaaaccacagagatgctcatcctcatgcatgcacacgtccatctcagcttcagctcgcaagcaggaccctcaccgtggggccacgacggaccctgcaaagctggtctgactgtgccgagcctgtcgggggttgggggaaggaaggcgggagctcggcatctggagggcagtggagaccctcagcgagtgccaggaggatctgctgtcttcccagtgttgtcttcacagtggagagatgagttcacacagccttatctgtgtttccagtggcctctgtgtgcaagacgggccacgggttttgtgcggtatttgcctgtgggtcacagccaggtgaatgggccctcctggggctgcagccccaggtcctgatgttacttgtgccagcctggccacagtgcccggcctccagaagctgctgtcagaggagcagacgggagggcagggtggacggttaacagggtcaaggccccagagccccacaccctccccagcagccagcacaccctctgttctgtgacctcgcccctgcattgcggcaactgacagatgctccccggcctccttccccgctgccgcgcaacctctgacagccacgtgtactctcctgctttagaacaaggacctttcccttttgtgcatgaatacgctctcagcagatgcgagaaaa

SEQ ID NO: 3046 - DNA, 3488 bp, Homo sapiens
ctaataagatacataagaaatacacaaagttgaaagagatcatatgagcagaaacacctatagcttggctcaaaagttcagagatagtgaaaaattaaaagacatctttggaccaccaaagtatcacagtcagaaaacaagatgagaaatcatctcacttgcaaacacggggcatttcataataagccaatttcgaagtagatcttgtagccctggtaaaacgtttagagaactgcattccagcagacaactgactgcagcctcacgaaagacccatacaactaagttgctctaaatttctgacatgcgtggaactgtgagattagctgcataacaaccccctcttaatttaatggcttaaaacagtactaatcatcaattatgttccatggtgtgcatgtatcaggaattcaggagtggtttgttcaggcaaggtctttcatgaggttgcgttattgttactttaagccactaagtttataatttattatacaacaacagataatcgatatagcaggcaagagattaatatcttgtggacctacagattgcatattttcatccagtgagaactttcctgttcttgcaaggcctctgccccccatcacaaaggtgctagcaagtgatgtatagaataagctagaaaggaaaaggaagcagaacactcccaccccacaatcttccctcgatgcaggtagacacctaccttgagcaagacaaaactatgtgtgtgagcgtgcgcgtgtgtgtgtatcattggacttaacacaaaaagaaaactacaaatacaagtgggagaatgatctcacaactttgatatatccacgaaatgctaaatgtgaaattaaatatttggttaatatttgcttgggaaatatctttaaatggaaattctactagttttcaattctaaacgttcatcttctaaaaaatcatttaatattctgacttacatccacagaagaaaaaatgtaaaaaataatgtccaatgatctacctaaaaccctgtgttctaaagtattgaatttgttctacattaagacctcaatgatttgggccagcagaaccatagacccgggctaggttgagttgctctaatctggtgtctgctgtcttttacattttgtttttgtttcttattgtctgtccagtccagggttcagaactcactgatgaagaaaccttagaaatgaatgcaatgccttagcgacagggaagtactgggggcaacttcgtggggatgctcttggaaatgaaacaggcttatcctagaggctggacataaaaaaaaaattgtcaacattttcctctttcttataatttgtttagtctagaatttaaatgaaatctgtgtcatggattactcaaagaacatcttataaagaaggccaatatataaaagagataaagctcagtcagcttggctgggacaggcagaggacggcagttttgggggtgccctagagtgcatggtgggagcggccctgatttatttggttattagtgcttgtttgcatcattctctgcatttcatattataactaatttggtaaatgcttatctagtaaattactacagtcctgatacaaagataggaccttcaaaatgaataaagaaaacaacaacagtaacaacaacaacaacacagataaagcaatctacagtaaagaggaaacaattagagtcaatttcataacatcaatggattttcctttgaaggaatctactgattcaggaggtcatctggattataccagctggctaaagtagaaagactagagaaacgctaaaacccaacaatgacaacaaaaatctaaggagtatagttgattgatttaaaaataaatgaagcgagtacataaagtattcattaaataaccaaaacagtcaaggataaaggaggttttcaagtggtggcatcttaggactttatgaggatacagagtaaacaattcctttactttcagatttctgttacatgattccaaatatttatatatgtgattttcagactactcatatggttggcttatatttttattgtttcattttgaaatttggtatgtgattgattcagctcaaaactatagtcaagaaggccctctgtgtaaactttgtatattcacatgaaatccttgcttaaacctttcaatgactttaactgtctttaagacatgagcacagaggccatcaaatgcctgggacagaattaattatcaatctgttagcaagaaggtagaaaaatatgggaaaatatttaatatgtaattagagcttggagacaactaggtttgaaatgaataaagtgaagactgtgaaaatggcttaccagttattattactcctcagtgctatgaattatactcttggttgctatgatgtggcatgctgttggcttgccattttttattgcccagaagtaactggcagttgttatttctcttggacgaaaatatgagttgaattcaagaagtcacattggtccacggaaaaactaaatttttctcattgtaatgatgatagcatgcaaagtactattcatatgactaaagtcttaggttgcaggaatgatttttaaatattatttcttatgctattaatctattcaattctaatctatcattcttatgtgttcattttttcccgtatttcttttggttttatgaattctgctccagatacttaattaaccagattactacaaactaaacacaagggagaaaaacaagtttgccagcccccaaaattatttaagtatcatgtgttcagagctaagtattatatatatcaagatacaagttattctcgacagaatgaaattctaagattcaaagtggaaagatgtatatgaggaggtgaccgtgaagatggaataacccatcacagacaagactgtcttgagttaacatgtaaatggattggaaacagacgtcagtatctgaaaacaacaagaaattagagaattttgaatttattttaaatataaaagtaaatggccgtggaaatatttctgtttttcaaagtccaaaattaatgaattgcacacttatttattatttcaaaatccagactaggtgaatgaaatcctctgtgcttttaaatcacagaattctaggaaatatcacattataataatcactgaacaatttcctttttagaaatattttttccagctctctggtgactcagttcttccttaaaaagctataaattttgcctatttttctttctaataaacaatgaggatcttaccaacagaagcaaatctttctttaaaaatccacatactttaatgtgattgctttgacatggcaaaatgaaattgccatattcaaaagcaagacatcaaaagacattcttttctaagactattacatttgtgtttaaatgttttaattaaaaactgtattaattcaaattttttgatgtttctgaagaagttgtctaaacttcccttaaaaattccatgtatatcgttttttccttta

SEQ ID NO: 3047 - DNA, 481 bp, Homo sapiens
cagcagcgtccgcacggagcccagctccgaaaggtccttgaccgtcgtcttgccgtccttgagctgctcaaactgggctctgctgaggaccccggaagccaggagctcgctggctggcacaggggcacggaggccgctgaaggacagcctctcctgccgcagggtctccacctcctccacgatggtaatgagaatcttgatgaccttctccacggtgaccttgcccgtgcggaactgacgcaacagctcctgccgctgctccgcagtgaagtactcagagctgatgagctcccacaccgtcaccgtcctgcccttgaagccacccacggggacctcaaccggggtcttttcaaaggtctcacgggcctgcagctctgagtagagctcctcctgccgggcccgagcagccttttctgagagcggcagcaggctcagcccggtcagctggtcgggccggcaccgctgctggagctcgccgtag

SEQ ID NO: 3048 - DNA, 6167 bp, Homo sapiens
ggcgagaagccaggcaggacgccacgacgcgtcgtgtctgagagaaaaccgtctcccctccactcaggcttcagccccgaccccacgctaactgggccagggcaggggctgggctgggaggggacccagtgagctcagggctggaggaaacggtccctgctttgaagtggctccggcaccggcctctcccaccaccctgtcatgtatgaaggagttacagacggcggcggggggagggggggtctgtcctgctggaaggacggagggaagggagatgcctcactgagtccagaggtcgaggggtgggtggggattctgcgaggatgaggaggaggaggaggaggtcccgccaaggtcagccggggcagcaacacctcccggcccctttgccgaggtcctggcccaggtggggctcccgggagcctggaggccaacggcggaaagacagggacctgatccctccagcagtcccagccgccggcccctcacaccctcacctctcccaggaagtcctcagcatgctgccggctggggcctggcgctggggcaggagggtggccacccgcgctgaagatgaggacaagcccggggcgtgggtggtgggcgtttcctctgtggggtggacgaggctcttgcggtgcgtgtgttggggacatgagacggggcggggcagctgccaggcggccaatggcttccacaccaggggccaagagcagaaccccaggagggttatctcagtcttcccggcagcagtgagctctgttcgtttttctgagtaatatggaaatggcacggctcagccacacaagggcctgggcaaaggtcacggccagcaaagaacacagcctgggtcctctgagtcccgagtccacgcgatcctgacccgtccaccaccctcctcgagacacgacaagagaagcaaagaacatggaaagcagaattcctgggggtggcctcaaccccaagccctgccgatgcaaaccggcaccttgaagatgcctttggaatttaactggaagatttgaatgacatgggcagacacagaagagggagaagcattccacaggggaggaaaggcctcagtggggacctatggagctcccaggcccaccgcagggaggcaggtcctcggtcatctgcggaggtcagtatctatcaaagcccagccgcagatagatgagctgggcctggcggggtcttgtaggatgtgtaggagtttgtgaggcagagcaggaatgaaagcagaggggacaggaggggcagaaccagagtcaggacattcattggctaatttcctgttcttggtccctctcccccattaagccacaacctcccccacaccagagcaggcaccaggtcctcctcgtcacaagtgccaggcataaagcaggcactcaataaacatccaggaaggagacggcaggggaggaggcgacatgatgactccaggacccagagtggaggtgatgggggaggaggtgacaccaggacccagagtggagagggcaggggaggaggtgacaccaggacccagagtggaggggatgggggaggaggtgacaccaggacccagagtggagagggcgggggaggaggtgacatggtgacaccaggacccagaatggacagggcgggggaggaggtgacacggtgacaccaggacccagagtgtgaactagaagaggggctataagtagtagcatgagatttggggctgggataaagcggtgggtccagtcaggaagctgcccatcccatacctcccgcagaggtggctctgccttcagcactgctgaccactgggcaggcctgggctgccagggtctctctgggatcagccctgccccatctgctgggggctgagccccattccctgcagccccccatcaggccctggtgtctggataccaggcacaacggggccacctcctgggacgggcccaggccccaagacgatgcccggctgggatgctggccgcatcctcctctgtcttctctatttcctgggctaggctttttttaaactcgaagcaaagccagcaggagatgactctgcggcctggcagctgagcccagggttgacccgccagtgccgccctccagccttccccctccacacttcctctgaggccgggcagtacccgggacctttggcacctgcctcagtttccatctctaggggagacaggagcacccccactccctgacacaaaggtctgccccagaggccctgtctaggggcccagcccgtgggttccggctcaggacagagcacaccagggagaagagaaactggctctttctccgcctgcgcgggccaggcccgaggcacgtgccccccacggggaggcgggacccctgagtcatttcctgtgctatcagctccggaagcagagtgggcctgctcaggttcccagaaacacagcgcgatgggggacagactccgcggctgccacggaaacaaatgagtaaatgccctccccagaatagcgtggccgggacagaggcacagccaccggaggccagacctcgaaatagctcgtgctgggcagccgggggtggcgttgcctgcacggaagagtgcggaggccacctcctggggcaggtggacaaggagaagggcaggcggacaaggagaagggcaggcaggcatcccagacccagagaagactcagccagcctgggaagcagtgaccgtctcgggtagcagaatccccaaagcgtcctgcactgtgggggcttccagtctgtgtgcagaaaggccgtaaagagacggtctcatgagatgtcatcaccacgagccgcagagggtcctacgagggaggcgtgggacatgtctgctgatgcccactgggaagtgacatttagcagagagcagaaggagaagcaggagctaacggggttcccggcagagcaggggacacacaccaaggccctggggccgccagtgcaggcggattccaggaaccgagggaggatgatgtcactgaggtccttcccgctgactccgcaggggctcgggcctgattcaaagggaaacaaactcctagcgggcgttttcccagaggctgcaccatcagctccgcaccagcaaggtcaggctgccgtgcggggggcggcctgcagaacaggagcccagcgggggatgagggggcctcaaagccttcacaccagagcacccaggctctaaaccggacggcagaagagatgggagccagaggctctgggcaagactgggctgcggggccaggggtgatgtcatgtgccgtgtgtatgtgtttatttacttagttttatacatatatgtatctattttatacatacacatacacatggcctggccatcgggcacgagacggggtctccagcggaggggaagcttctccttccaaaacagtgggagcatctcataaaagatgctcttgagacaagcgtgggaagatgacacagtgagacccgactcacggctgggacgttccaagctgggagccaaacgcaggcgcaaaaggcagccgttgtttgatcgtgaagtcgtcggtcctagggggtctctaagcacgtcgctctcccacccactttgagatgttaacatcccatgtggtgggtgagcctggtgtattcatcggcctcggatctggagacggcgctgggtcaaacagaaccgccctggccagccccagcagtcgcagcccgggggcaagcggaagacagcggccctggaaaacctgaggccgctgccggcacctgccagcatcacccttgtttccctctgcactttctcatattcccatattctcttccaagagatagcagttgcatttctggattaaaacactaggaatacggcactcagcgcagtgtttgttgggggcctggtgctgcctggagggcaagtcttcacaccggacatgcaaagacgcgctattttccaaagacaagttagcgacactcacatccacttccccttgatcaacgacatagaagttgtctccttcattccctgtaacaaaagaagaaagtcaacagatacaaagtacatccagacatacaagttacagtttctcttgcaaacgactttcgcaacactgttgcagagaccctcgaagcaacatcctgggtgctaccaattctttttaatgacaagattatacaaacattgagataacttgttaaagagcctgttcttaagtttcattagtgaactttctctaaacaatgagaggtgtttttctttttgtttgttttttgttttttttgagacggagtcaggctctcggctcactgcaacctccacctcccaggttcaagcgattctcctgcctcagcctctggagtacctgggattacaggcacctgccaccacgcccagctaatttttttgtagttttagtagagatggagtttcaccatgttggccaggctggtttcaaactcctgacctcaggtgatccacccgcctcggcctcccaaagtgctgggattacaggcgtgagccaccgcgcccggcctcacaatgagaattttatgcgtgtgtgtgtgtgtgtgtgtgtgtgtgtataattttatattactttagttttatacatatgtatatattttatatttacttagttttatacatatatgtatctattttatacacacacatatgtatatatgtgtacatatatgtatacatgtacacacatatgtgtgcacatatacgtgcatatatatgtagacatatatgcatattatatgtgtgtatgtatgtacaagtctatatatatccttttgaaatttgagacagagtcttactgtatcacctaggctagagtgcaatggcgtgatctcagcccactgcaacctccgcctcccaggttcaagcgattctcctgcctcagcctctggagcagctgggattacaggcacccgccaccacacccagctaatttttatttttagtagagacagggtttcaccatgctggtcacctggaccaccaggctggtctcgaacccctgacctcaggtgatctgcccacctcagcctcccaaagtgctgggattacaggcgtgggccatcgtgcctgcccttatgctattttttttttaagtgcatagtccatttttcccctctggactttggctccgaggagcaggcagaacgtaccttgctgtataacagtctccccagcgatgtgagtgacagggaacatggcatcgaatatgtcactgaaaagcaaaacacgccaaattagggctgcaggcagcacagggacatttaaacccttcctcccctcatttcacagtcttgtgtaaatcgcttcacagtcattggggaaaatgagaaaatccatgagagttcaaagaagaaaattgaaatccttcatgacccgaaggccagagatggcaccgccagccctgggcacacaacctcccagccccatttctgttctgtgcacagacgcagtttgctgttttggtttttacaaaaatggggtcatgccatacatgcattttgaactccatttagaaaaacaaaagtaacaatagattgtgaacattctcccatcggtaaatacaattctactagaatacaaccagcaatcttgatgacatgttttctgcattgttttcctttcagggagaacactttcagtcgaaggagcctgggacccttgacacagaagtgacatgtgcattcggaacctctctgtggaaaacacagacccttcatgacacgcaaactcgaagccgatgcaataaccaccttcggagaccagacccctcaaagagcactcagcccacaatgtgacgcagagaaaccagagacccaggcagggagtgcacccacggggacactccgagggtggcctcctgcctgccctgattacttaaaaaggagattcttggaaacctttgcgggcccacaggtgcaccctgactcccagggatgggggctgagccacccaggaaacaaatatgaaatcaaagatccagacagccctgaccctcctgattccagggtccataaataagtcattcttaaaatagtggttgttttctctctatttaagaagtgcttcttttttgagtccttgttcccaacttccctggcaactcagtttcctgtttcctccgggaggaaggcagaactgcaggagaggtcagtgtgtggcagggctg

SEQ ID NO: 3049 - DNA, 1034 bp, Homo sapiens
tttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcagtggtggggcagccagggcagcgtcaagagtctgagccagacatgatggagaggaaagcatcatcatggtcattctctgtctcactgtccagcagggactcccctgaggggcccagggctcctcctccatggtgggaggtgagcttttaccaggttccaccacccccaaagtgtgtggggttgcgggccctgggctttcagggcaggtggctccagggggctgcccagggtcaacactccctgtcccacctggtggacgctcatgagcaacggctgccaacttggcaggttgttttctctggttggaggccactgagtgactggcaggttgctgggcctcgtgtggctgcagggaggggtcaggaaggggatggagtaccaggagaacacggccgcagagtgaccttccacattcctccacacgaacatgctgacgccacgggaggcctcactgaacgcaggcctgggggccgagcacttggtccgggcagggggttcctggcaggggctcacacctcctcgccccctcctcagccaaggtggcttgggcccagagaaggggaggttggagaggagcagaaggccaggcctcaattcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcctgatccatatgaattcctcttattaagaaaaataaaacatccaggattcaatgaagaactgactatcaccttgttaatcattcagaaacatgttgcaggcttaagccatttttga

SEQ ID NO: 3050 - DNA, 1635 bp, Homo sapiens
cgcggagcacggaggacggggccgggcgacctgggcaccagcaggacccgaggccaggagccaggggcccagaagattgagcttctagagcctcagagatggaattcgccgttttgccgcgatttggcgttaacttattgacccatggggaggagggtcacttcccgtgaaaagaaggcagagatgttttgctgtgcccagtgtgaggaagcgaaggaaaagaaagatcttttgaaaatgtgtacatctacttgcagcttgaaaattccaagtgccagacatttttcttggaggaaataaatgtcttcaatttattcatcttacctgttgattatgttctgtaatgatttattttataatttaatccttgtctagaaccgaggccatctttggaaagtaaaagacctaggtctctttggtccaggagacattgtggccctctcttaaaatcattgactgccgagatctgggcccaggcggctctcggactgaaccggtctgtgctaggcagcctggcccactcggccttcaaaacacaagggatgggagacatatgctcggctcacatcgttttgttttgatttattttaaactgcttaagatgattttagcacaaggagtggtgtatcttacttgcattctgagagccactggatttgcaagctagagtacaattttttttttaatccaaatttagaaattgccttttagagtagacaacagcatgctactttgccttttaactcacttttaaagaacgattcttaagatcaagtacattgaatttggagattggtccccctccgttattaggggctggaaatggcccacttttcaaaaataaggtcagaaaaggggtgtttctgacctaagagttcttccaggctgggctcgtaccacagagattcttccacacccatgtcctgagtccttgtcctacacaccattttttcttccaaggagaaggagtgtggcattcagttccagtgtcatcgtgtggaaaagagtccctgcctggctgagaaactgtcacaggcagccgggccacttcccagcatgacccacaagcccgatggtgcccctcgaatggttaagggacccgtacagataccattcttttaaagcaagccaatgcaatcttcacgaattgcagttccaccctggctgctggtactaactctaataatggaaaaaaatttaaaagattggggacaacaggaaacacattggatccccaggggaaacggcctggaagctacagtagagacatgggtgacccaagggctctgttcaagtcctggggctgttccctttattcctccaagcctcagctccccggatttaaagtgagaacagcacccagcccagcccactgtcaagggctgttgcaggaatatgacaacagccaccaatatttgcatagcagagatgcccagtttcgttttctatttgaaagtttctctgaagggggatgtgctagagacacgagaacaactgctaccatcttaataacttttctggcaatacacgacgatgattgtttatgttaatctcataactattaacaataattcatttcattctcataatgaattatatctatttgacttataataaatagaatcatatcagtaa

SEQ ID NO: 3051 - DNA, 3330 bp, Homo sapiens
ggaggatcctgcaggtgttgaagggtgtattcacttcctgtttctgctgtagcaaaatatcacacgtttgatattctcttacagatctggaggtgctaaagttcagcagtctgaaatgtattggcaggcaggttctttctgcaggctctggggaagaacctatttccctgccttcttcacctcctagaggccacctgcattcccatgtggcagtggggaatgaaaacaggaaagtggcagctctgaccgaaagcaatgtgattgataaagagggtgggcagtggggggacatttcctcaaaagaaaggattgctattcaccgaagagggagtgaagtcctgggaaggcaagataacaggtgtgcactcagctgtgatagagaggccgaccaggcacgctgtttgcagcaaaatgggcgttatgctttgcccctggaggcgtggaagtggggcaagagggtagagaaaaagttgttccagccactacggatgtgtaacaagttactgcaaatcttgttgacttaaaatagccacttggtttgctcatgattttgtgggccaggaatttagacaggactgagcctggcaggtctcactcagtgtttccctagcagctgctcagatgtcatctgaaggccccacagggctggacgtccaagatggctcactcacatggctggcatgggttgtgtccaggtagctcagctggggctgccaacccagggctctgcatggcttctccagcatggcggggtctcagagtagctggacttcttatgtggtagctggcttccccctcccactgagtgggaatcttaagaggacgaactggaaacttcataattttttttttctttgagatggagtctcactctgttgcccaggctggagtgcagtggcctgatctcggctcactgaaacctccacccctgggttcaagcgattcccctgcctcagcctcccgagtagctgggattacaggtgcccgccacagcgcccggctaatttttgtatttttagtagagacagtgtttcaccatcttggctgttacacgcctccgtataagagaccacctgagcaggcttagtggagcaacaaggctgtttattcacttgggtgcaagtgggctgagtcagagaaaggagtcagcgaagggtggtgggagtggaactggttctataggtttggggtaggtagtggaaagttacagttaggggcagtttttttgggcaggggaagaatgttacaaggtgcatagtcacaaggtgggggaagtcataaggcacgatatcacaaggtggatggattagttggggaagggcaggaacatatcacaaggtggatggattaattagggtagggaaggaacatatcacaaggtggatggattagttagggtagggcaggaacatgtcacagtggtggatggattagttggggaagggcaggaacatatcacaaggtggatggattagttagggtagggaaggaacatatcacaaggtggatggattagttagggtagggcaggaacatgtcacagtggtggatggattagttagggtagggcaggaacatgtcacaaggtggatggattagttagggtagggcaggaacatgtcacaaggtggatggattagttggggaagggcaggaacatgtcacaatggtggatggattagttggggaagggcaggaacatgtcacaatggtggatggattagttggggaagggcaggaacatgccacaaggtggatggattagttggggaagggcaggaacatatcacaaggtggatggattagttagggtagggcaggaacatgtcacagtggtggatggattagttgaggaagggcaggaacatgccacaaggtggatggattagttggggaagggcaggaacatatcacaaggtggatggattagttagggtagggaaggaacatatcacaaggtggatggattagttggggaagggcaggaacatatcacagtggtggatggattagttggggaagggcaggaacatatcacaaggtggatggattagttggggaagggcaggaacatatcacagtggtggatggattagttgggggaagggcaggaacatatcacaaggtggatggattagttagggtagggcaggaacatatcacagtggtggatggattagttggggaagggcaggaacaatcacaaggtggatggattagttggggaagggcaggaacatatcacaaggtggatggattagttggggaagggcaggaacatgtcacaatggtggatggattagttggggaagggcaggaacatgtcacaatggtggatggattagttggggaagggcaggaacatatcacaaggtggatggattagttggggaagggcaggaacatatcacaaggtggatggattagttggggaagggcaggaacatatcacaaggtggactgttgcaaggtcggttaatcattaaggcaggaactagctgttccgtcttctttagtggttctcctgttgctccaggctttgtgactccaggaggcctgtaacgtgtgggtcacaggggtcacaatggctcgaccatggggtagcccattcaggggaccttccactggccaggttggtcttgaactcgtgacctcatgatccacccgcctcggcctcccaaagtgctggaattacaggcgtgagccaccgcgtcccgcccaaagctgcataattttttatcctcaaaagttaagcagctttccttcccctacagtcagtgttataagtgagtcactaacgtcagcccacttttgagtagaggggacatagattcccacagctcaatgggaggagtgtcaaaaaaatgtatgagcatattttaaaaccattgcaaagtatgtcatggggagagtgtccagaggagagatgactgagttgggttaaattgccaggccaggcacagtggctcatgtctgtaatcccagcatttcgggaggccgaggcggtaaaatctcttgaggccaggagtttgagaccagcttgggaaacatagcgagacccccatctctacaaaaaatttaaaaattagccaggtgtggtggtgcatgcctatggtcccagctacttgggaggcttaggtgagaggatcgcttgagcccaggagttcgaggctgcgttgggccacgactgcaccactgcactccagcctgagtgacagggtgagaccgtctcaaaaataaatgaataaataaataaattgccaggccacagaaaatgcttaagtattacaactggtaaatcataagagttatggttgatgtggctcccag

SEQ ID NO: 3052 - DNA, 2833 bp, Homo sapiens
tacatctatttaaggttacatgatattttgatatccattatgtgttgtgaagtgattaccacaaccaagctaacaacacatccaacacctcacctagacacctttctggtgtgtgtggtgagaacacttgagtctaattcctcagcaagtttcaagaaaacagtatgctataataattattattattttgagacggagtctcgctctgtcacccatgctggagtgcagtggcgcaatcttggctcactgcaacttctccctcccagttcaagcaattctcgtgcctcagcctcctaagtggccggggctacgggtgggcaccaccgtgcctggttaatttttgtatttttagtagagatggagtctcatgttgcccaggctggtctcaaactcttgagctcaagcaatctgcctgcctcggcctcccaaagtgctgcgattataggtatgagccgccacacctggcctgctattattaattatagtcaccatgctgtaccttaggtctctggaacttttttcttttagagatgaggtcttgctctgttgcccaggctggagtgcagtggcaccatcaaagctcactgtagcctcgaactcctgggctcaagagatcctcccacctcagccttccgtgtagctggaattacaggtgtgtgccaccatgcttggctgattttaaatttttttgtggagacagggtcttgctatgttgttcaggctggccttgcactcctggcgtcaagcgatgctcccgccttggcctcccaaagtgctgggattacaggcacaagccattctgcctggttaaaacgtgtttatctgaaagctgaaagcttgtaccctttgacctacatcccccgccttcccctgtgccctcaccaccataaccactgctctactctgcttctacgagttcaattcttttttagattccacagataagtgaggtcatgcactatttgtctttctgtgtctggcttatttcacttagcataatgtcctccaggttcatccattccagaggggtgttttaaaagacaatcttggccgggcgcagtggctcacgcctgtaatcccagcactttgggaggccgaggagggcagatcacctgaggtcaggagttcaagaccagcctggccaacatggtgaaaccccatctctattaaaaatacaaaaattagccaggtgtgatggcggggacctgtaatctcagctactcgggaggctgaggtaggagaattgcttgaacctgggaggcagaggttgcggtgagccaagatcacgccaccgactctagcctggccgacagagcaagactccgtctcaaaacaaaaacaaaaacaaaagacaatgttgagtggtgggtcttctgctttaacccctccaacacctctgactcccgccttgtctccctccagccatgcgggttcccaccctccagcctcagcctgtccccatctgtgtccctcagactcagaggtgtcctccccagagacgcagacatgggcctctgccaccctgtattacagtgccctgcagtcaccgcctgcctgtgcatcccttgccatgctgtgacctcttgtgtctctgttttcttcttggtaaaacggggatacctcagagggcagctgtgcaacaggacaaattcacacacgagacactcgggatgctcctggcacacagacagggtgaagcatcccttgtccccattgtcaccttctctattagctcgggctgccataacaaagtgccatagactgcgcggcttacacagcagaaatttacttcctcctagttctggaggccagaaggccaagatcaaggtgccagcgaattcagtttctgtggaaattctcttccgccttctcactatatcctcacagggcctcttctctagacatgcataaagggagacagatccctgctgtctctctctttttttttttttttctgagacaaggtctggctctcttgctcaggctggagtgcagtggcacaatcccgtctccacaaaaattagccgagcacggtggcacgtgcctatagtcccagctactgggaaggctgaagggggagggttgcttgagcccaggaggttgaggctgcagtgagctctgattgcaccattgcattctagcctgggcaagagagtgggaccccatgtcaaaaatacaaaagatatgttgaagtcccaactcctgataactcaaatgtgactgtgttgggaacatctggagtccttacagagataatcaagttaaaatgaggtcattagtgtgggtcctaatccaacaactgacgcccttatacaaaggagaaacctggacacagacatgcacagaagaccatgtgaccatgaaggcagagatcagagtgatgcttctagaagccagggaagattgccagttaatgaccaaaagaagccaggagacaggcctgcaacggattctgcctgaaggctcccagaaggaaccaaccctgacaacaccttgatcttggacttccaacctccagagctgggaggcgacacaattctgttgttggctgcagtggctcacgcctgtaatcccagcactttgggaggccaaggcgggagaattgcttgagcccaggagtttgagaccagcctgggcaacacagtgagaccccagctctacaaacaaatataaaaaagtagctgggcatgatgggatgcacctgtagtcccagctgctcgggaggctgaggctgcagtgacctgtgatcgcaccagtacacttcagcctgggcaatagagcaagacctcatctctgaaacataaacaaaaaaaccaataaagtctctgttgct

SEQ ID NO: 3053 - DNA, 3439 bp, Homo sapiens
ccggtatccaggctctcccagagcggcactttagctggccaaggcctggagcagagtgtgtgcagcgctcccacggccgcctgcccgggcctgcccccgacacatgcttagtggaattctcccgtggcagcccagagtctccggaacgaaggtctccacagccaaagccacgcaagaggctctcctgctctcatttccagacgcaccctcatccttggcctctccctgcctcagttctctttgactcctccggtccttgttgctgctcagctccagggcacccccacctcccaggacaagtcccctgactttacagcttacaggcccagaataacagatggccagaggcatcccattcaagactccccgcctccttcctagctcctcagtctctcccaccccaatgtggtggtgcccagggagggggtcaggaaaccacagagggcctgtgggaggcgtacagctggggacaagcgtgggctggaagaggagcccagtctgtagctgagactcccagggcctcatgaccttccaggcagcctccaccgctgctatgacaggcagatgcccgactttccacctgctttctgacctggctttggcaaggcctgagcacctggcctgctttcccaggagtacagttacagcagctgatctagggaacaggtgtgggctccgtgtcacagctgctgctgagcacatctgtacccacagtgaggaggctgcagctgcagcagggcctgtcagtcactcatactctccccggagttgggctgggggcactgaaagggccaggggtggagagaatctgagataagcattcacagagcaccttgctcctagagatcccaaagtgtgacccctgacaaggttttcccacagtcagcctcactggcaccagcagcgtgggaattagggctggattctccccttctgccttgcttcccagcccttgggccacagtcagctcctcctccttcctggctagctcagctcagcttttgcaggatggaactctgaatcctggcttccagtggctctcccagaaaactaggagggaagtgcttggaagaatggctctttattcatgcaaatgatttcttgccatttaagagcctcaaaccacaaaatcaattaaagagaaaaggggaagatttgggggtctgtgccagccactggatgcaatgctttacctccatcatcttatcaaatcttcccagcaaccctactgcatagctattatcaagatcatttctgtttcccagaggagaattcaaggttacacagttaggatgcagtgaatctgggatttgattgccgtcctgactccaaagcttgcactctgaccactgggccacactgcctcaaatctcccattctctgttaaatccaacatctgagccccattctttctcccttgcagggaatcacctgcctacctccacctcatccatttctcaccacagctggattcacctctacagcctttacctccagtcgtatttggcaattcatccttttccagctcctatcatcctcccctaccctcaccaaagtggacatcgcagcctctaaatctgaacggagctgacacctagcacccaccctctcaccagctacctctgggttcccccacccggtattcccttcctcacatccaagcctgttcccctcaggccctgtcatggcctgaaatagtctttgcccctgtctaccactctccagggtccctcttgacacctacttctgctttcccctctcaagacaccttttcttggcattttaagactatttactgactatttattgatataggaaaatgcttacagaatgtattaggagtatcttacacttttttaataattatgtatgtaatacatgaatagattctccttgtaaaaaacaaactcaaacacacagaaaaagttaatgactcccttgatgactgccagtttgaagtgtttttccagaccttaaaaaaatatactttcatacaagcatatgtacatatagaaagatatactttaatggggcatctttcatcataaattggatcataatgtgcaaattgtttcacaacttttattctctgtttgttttcagacagggtctcactttgttgcccaggctggagtgcaatggcacaatcatggctcactgcgccctccacctcccaggctcaagccatcctcctatctcagcctcctgagtagttgagacaacaggcatgtgccaccatgtctggctaatattttaataaaattttttgtagagacaggttctccatatgttgcccaggctttgattcttctaatgctcggtattaagactctatgactgtgtattatacatagagtttacatgtgagtaagttctgggtggagagacactattccttgctagggccttaagagtctggctgcagctctgctatcacatgggcaaaaccagctacataatttacaagatccagtgcaaaataaaaatgtgacatttcttgttaaaaatcattgtgaatttcaagatggcaacaacaaagcattaaaccaagcagggggcctttctaagcttgagcccccgtgtgactgcacaggtcatatgcccatgaagctggctctgcagagactagctgaccgttggactggctgtgtcctggattcttttagttaatgcattccgtgttctgacaatggacattcctgtctcagcctccacattggatctggtcccctgattctgcacccaacattcctcagccacattccctgctccaaagccagagctctatgtattccagcacaagcaaagtcccagggtccatgcctgccagtcagcattgctctggaggcacccacaaagatggcaaagatggggggtgaagggggtattggacaatgatattcctgtgcctcgagtggaaagtctctcaggagataagagaggactgaagtaccaaccaagaaacccgggtttcattcccagctctgccactaaatttactgtgtccttaattggcaagttgcttaacatcttggcactgttatctctttatctgttaaaggagagagtttgattagattgtctttaagaccattcccacttccagctctaaaagtctgtatttaagtgactctaagagactgtaataataatagataacatttgttgaccattaccttatgccatttacatgttgatttaatgctcataacaaccgtatgaggcaggcactgttattcccattttacagttgagaaaattgagactcagtttaaaacatgcatggggaacaaggtagctttttggggtggtggaaatgttctaaaacttggttctggtcatggctgcagaactctgtagatttagagttgtatatttcgagtgggtgaattttataatatgtaaattgtacctcaataaagctgttgaaaagaaataa

SEQ ID NO: 3054 - DNA, 6498 bp, Homo sapiens
attctctgttaagccactgaatgaagaaggctgccacattttcctctgggtcaatatcaacagcaaaacaatatcccagaacggtcatttctgggacaataaatagttttccagagctgctatcttaggcctctctgccactaagggattaaagagaaatgcacacccctccagaatttcctgtcctgtcttgcggttaacttaaaacattttcaactcccgcctccccctttctcaccatctctcttcatggttaaagaggttataaatttgcaaaggaaatgattaagcaaatccagaaaatttggccatgggacctgatttttcaaggccttagtttttgaaagctgaagaaatctgtccactgaaggatttgcacatgagttttttagtcttagggctggggcataatttcctgtttttgtattctcaaaactgttaagctacttgtgaacaactggccagcaaagatagggagggggcaggggatgcggagagagggttgtgagcccagaggggaggagaaaggctgtttctcctcagttctcacagaacctctatgaaaatagaaagatttatttatttatttactttaaagactgtgaagtagagacaaggggtagattctagacattgaagttggaggtgtgagtggtaaagaggagaagaaacatgttttagcaggaacttgaataagctgattgaaactcaaagaacagtctgtttccataagcatgaacatttcttagacactcattttgtgctttgcatggaatacatcgttaaatccccacagcaactcagtgaggtggattctactagtgtctccactttatggatgtgaaagtgaagctggaagaagttaaggaacctgctcaaagccacgtggctagcaagtagcaccactgggattgcaaccaaggctgtttggacccagagcctgtgttcatagctactgctctcttctgaagataaaggaggagacaaggatgtcagcatgaccatagcatacatgttcatttatttagagccagggaagggggtgggacactaatcaaggttgccccttcccttcacttcccttcccttcccttcccttcccttccctcccctcccttctcctcccctcccctccccttcccttcccttttttctcctcttaaagccaccaactgtgctaggtatttgtatgtttactctcagatcatttttccaagcttctcttcaaactgcatttcccaggttccattaccaactggcttctggttaagttcagccagtgggcggcactgacacgtatttttcctgcctcctccctccagtcaacaaaaaggtactgcttgcagaagcctccattgggttccagctaccctcaagcagcctcacccccatccacatggggttctatttcccacagggtgccgggttccctagctccagaagcatcacctcttccctttggctgtgtgtctctagtggtggttctttttgtagcctatttctatttctttctttctttttttttttaaattatactttaagttttagggtacatgtgcacaatgtgcaggttagttacataggtatacatgtgccatgttctatttctaatctccgggtgggcctcacggccccatggttgtcttttcaactcttccagtacctttaaaactagcacccatattaatgtccttctattcagctccttgtcatgggatagaggttcccgagaaaaccctaagacacagatcacagatttttcttttttttttttggaacaaagtctcgctcttgtcccccaggctggagtgcgatggtgtgatctcggttcatggcaacctctgcctcccgggttcaagggattctcctgcctcagccccccgagtagctgggattacaggcgtctgccaccacacccggctaatttttgtatttttagtagagatgggattctccttcctcagccccccgagtagctgggattacaggcgtctgccaccacacccggctaatttttgtatttttagtagagatggggttttaccatgttggccaggctggtctagaactcctgacctcaggtgatccacccgtcttggcctcccaaagtgctgggattacaggcgtgagccaccgcgcctggccgacacagaggtttttaacctaagacacagaccctgagacaaaaacttaggtgcaagtagtttatttgggaagtgatcccaggaagcacaaaaggtggggtgggggggcgtgctcatgagtatgttactgctgtgggtgacgggtggctcggtcttgctgaggacccttgagagaacacaaagacgacccctcaacattgtcccactgagagatggggcagctgaggtgtttacctttcctctcccatctttcactgattgagaattgtccttcggggcataaaatttcaggtattttcaaaatgccatgcaggtgggctaaacaagctcctacagcccctggagaaagccaccgagaggaaaagcaaagaacgaggagttttggggtgggaagctgtcagtgctgcaggtaaactcgggtagtctgaagacgatggggcagggcagccacagcacctactgccatggcgacttggccaccgttataagtagatgcaactgtacaaccaaggatagccaagggtggacctgagccccctctccagaaattctgccttactttagaatggggtgaacagcagggaaaatgaacatttttctttgctttttctcctccctcctttcttttttctagataagccagccagccaactgcttatgaggataaggagaaactggggcaaagtttaaggatgtcgcaaagtctgggtggccttcagtccatgaaagagaacacatctgttctatctcaggctgaggtcatctgcatcctcatcaataagctgactgagcactcattacctgccagacacggtgcctacatgctctaaatgcacggtctcgtttattctcagcaactttccgaggtaagtgctgttagcattcccattccacagaggaacaaactaaggctctgagaagaagtaatttgctcaagacctcacagcctgggatcatgggtatgaatcatctgggtgaatgatgaggccaaatcccaagtccatgtttatgacacttagaaataaccatttaaatgtcctttgaagggtcaaaaccatttagaggttttatctctttcttacaatcttcaaagaagtttaacaccttataataaatatctcacagataactcaggtcacttagtgaatattagttgaattgcttttgtattagatcctacctgcagccaaaatataaatctatgttaccctccagctcaaatatcttccatggctccccattgccgtcaagagacaatttaaactcgttactatggactttttactccaagtccttgagatccatctgtgccacctccccagcttccatcctcttatccgttctcctcacagtctcacttcagccatgctaagctacctgccattctctctgtggaccctgggctcttgcacttgctgttcttctgggagcccttttgtccaacgcttattcattctgtgtgagttaactcaactgtcacctccccaaagtggccaacctccacccactgtggtcttgcgccagtgccttcccctgagtcccatgacaccctgcatttgcttctcttacattgtattattattatctttttgcctgcctgtctctcccacagacatgaaagcaagcttttatgtacttaggttggatttcaaccttggctctgccatgtgtgttcttgggcaaagttgtttttttctctgtgagccttagtttcctcagctgccaaataagcagtgaacaaagttaagtcatgtgacacacaatacctggcatatagtgaggttcaatgttagctttttttatctaagcatcttcagggccagtctttggaccaaacatgctgttgatgctcagtgaagtggtagctctacctggaccagtggttttcaaattttctccttcattggaacctcctgagaggctgctaaaacacaggttactgggtcccaccccaagagtttttgattctgcgggtatggagtggggcttgagagtttgcattcctaacatgttctcaggtggtgctgaggctgctggtcctgggactgtacttttagaaccactgggctggttacctgggaagggtagatgtctggttagggtgatcagacattcagagctaaaacaaattcacactagaggataaggcaatccacaatgggtgtggccacaggatatttgtttagcaatttatccattcaaccaatatttgttgagtatctaccatgtccaggcattgtgctagacactgacaatagaacaatgaatgagcaagacaagaaggttcagatcttgataagttcacattctagtggcactgctttggaaggtgggggccgtcattacacaaatcccatgggtgtgaattgaagggacacagttagtttggggaatggttagccttaaagccactgataccaataatggctttactgtctactgtatcattgtattgccttctcaacatgatttcaccaaaatgattcattgaaactgattatggtattcccataatccccttgcctggaactgcatccatcattcagcacagttttaggatgaagtcaacccatggaacatggcagaatggagtgtcagagaaccagagccaggctatgagacttaacaccagttatatgaaacgatacatttcctcattatcgttgttagctggaagagagtctcagagaatcaaagccaaagatgttatacaacacctattatatgaaatgataaatacccttattgttacgattatctgccaattcaagtaggggttttctgttacttggtgctaaaagttccccatgatagaatagcttgcctttcctaagtgcttacaatgtgccagccactgcactaaatgtttggtatgcaccatctcactgcatgctggcagcaactccacgagtaggctctattattagcccattgttgagggaggacactcagagtttaaatcacttgctctttagttgggagtggagaagatgagaggtaaggctgctttgtggagcaggatgggccagtaaggattacttaaatgcattgcaatgacaccaactgaaacgttttgcaatcacacaatcttccttgagcttcttccaagatagagcagataaggatggaaacacaaaccaaccaaccttatcttcatttggaggactgagaatcatagaaggcaactgacttgcccagttcagctttctcgttctagttctcctaattaaacttgactgctttctagaagttaatcaacaaatacactctcaggctgctttggcccagtttcccggttaggcaatcagggaaaaagggctaggcattgtaaaaccccaggtcctgcagctcccccacgtggctgcattttgacaaaagcaagcttctgagagagtagatcacgtaaggaaccagcccttccatggctgtcattagcagaagtgcagctgggggccattttgtcaagaagtgcttatttggaaaaacaaaacaaaacaaaaaatgaaaaaaaaaaaaaaaatctatacaggtgcatgccagtcccccggtaatgaaatgtaacaaaggaagcacttaagttcagtgagggaaatacagctttaaattacagattgtacccagagcactttataaacggtaatgtgtgataatgtattatccttacttctgtgaaattgtggactgcaacttctgccggggccagttaaagggccaggagatggagagggttgcgtgaatgccattcaagaaaagggcaacagaggctaaggggttaaactccccagaaaaccaatttatgcaaagggctggatcctgaccggcattctgcactaaagatctgaattacaaatttagagaatttgctgctcgacaacgaatgcaggaaggacctcactggctgctgggaacaactgcccttttgaatgaattcttttatggttaccagtcaaaaagtcaccgtcagctggaactggaagggaggtgtgtgtgtgtgtgtgtgtgtgcgcgtgtgtgtgtgtacgcgcagtggcagccatttcagctcaatagctccattcctggaaaggccacttcttcttgacatgggagaagacacacttccctgtgtacctaaaaataaataataagtaaataaataataataataagaaagtcatttttgctccctcccccaggtcttaattcttctttctcttttaatcatgtttttctgtgtgccacctttgctttgcttatttcccccactgcttgttctgtctgatggcatttctgggaatctgtgtcctaaaggctttcttgggtttattggtgagtttcagctctttttcactctagttctgcataaggggtgggc

SEQ ID NO: 3055 - DNA, 2369 bp, Homo sapiens
gttttttaagagcttaggatcacaatggggaaaataatccaaaaaaacaggcaagatattatagcggggaaaaacattaatcataacttaggatttctctccccatggaactgttatcagctataaatcggtttaggattctatcaagatcagcaatggcaaaacctccgcaggcttccagcccacacaggggcaccttcctctcctcttccatgcagggcagttggaagccccctccccagtttcctctccaggatcactgactagacctgggccaagtctgaggaggcctgggagccagtacacattcaggggtcactgactcttcagataatgccctaaacaactggagtgtgggcttgtttgctccaagagcagctgccctgtcagtggaactccggcgcacttccactcaatactggactgggggggatgaaagagggatttttaaatggcagaaaagtgttcttctgggctgtctggcccgggcagggcgggttgtgacttggaaaagaaggggaaggtagggaggccttgaacttagggacagccagcaaatgatccttgcagcttttggaacacaaggcagggctaaggttacctttcagcttccttgcttaagtagcagtggctaagtgggttaaactttgctcggcctgcaggctccccctgttggtcagatacttgcattgacatcctcagtgttcaatgctcctggaagagcccaggagagggcggcactggcccagggattgcaggtcagggaactctagcaaattcccacaccctagggtacagccaagaggcccattcacaaggaaaaagctcttccttacagcaaggatgccagtcatctgccctcctactgcaggaaactgcccttgcttaaaagaaatgcacaggctcatacacacacacacacacacacacacacacacacacacacacacacacactcactcaccaaggtttcctttggacttctgcccttcttcctaggcccaagcagaggctattctcagccaggtctggaggcgcccctgtgatgatgctcagggcagaggcctccccatggtactctacctggcagatgtgcttgggggccacctaaggagtggaggaggccccgggtgccccccaccctcctcttagactggagatacaattgagacgcactgagcagggatctcagtgggcctaagaaaaaaggctggctgcacatttgtgtagcaattgagaaagaagcagaatgtaacttcccagacttaaaggccccacactaactctagtccccatgaagcggaattcttcctttccctcacattctgaaagctaccagccattacgccttgcccatcagttctgcccagcggaggctccactgggccgccctctgttagcaggaagggtgcttggaagccccggcacagagcacatcattgagcgactgaggcgcccagcagaggccaagtggaggacgccaaccgctcacattaggcagaaggggtctcacttgcatcagcatggagatgtcaggggcttttcagaaacttacaaacttgtacagagcatggcagcaatgattcagtggggtgggaacttatacaaaggcagagcatgggggggtccagggtttggaaggtggggtccagtgtgtctgaccaggccaacctgatgactgattactcaacaagtcagagtgatcctgcctgaaggaaaagccagcaccagattcccacctttgcgagctacaccctcaggtgagtagccaggacagggcactgcattcatcctgagctgcccccactcccccagcagacatcaagagcccccttccctggactttggtgccatcagaggggacacaacacaagcccacctgtcaggagcccagctccggtcgcgccacaaattcttaaggaccgacttcactcctgtccaaatcttggctcaaagataatcctctccaagtccatgaacagcgtgagtctttcatctctactttcctcctcatagcggggctggagggagggtgagtttaccagaaactccaaaatccctcaatcctgtatttccttcccaaagggattctaaaagaaattacggccaaggtatgtgtctgggcatggggacatggaggaaaggggcctcatctcctttttcgtccctggctgggctctctggacaacacaggcacgtccccctgactgaggtccccatggctgtccctgagcaggccaccagccccacggcacacggtctctctcctgcaccctgcccaaagcagacagaacaacagtatagtgaaggtggatgattaacagtggaaataaaagaagcctgtgatcaatccctcctctccctcccgc

SEQ ID NO: 3056 - DNA, 5383 bp, Homo sapiens
aacccactcacgtccccttccatgctatggaagctctgttcttttgctctttgcaataaatcttgctgctgctcactctttgggtccacactgcctttatgagccataacactcaccgcgaaggtctgcaacttctctccagaggccagcaagaccacgaacccactgggaggaatgaacaactccggacgggaggaacgaaccactctggacgcaccgccttaagagctataacactcactgcgaaggtctgcagcttcattcctgaagccagcgagaccacgaacccaccagaaggaagaaactctgaacacacccaaacatcagaaggaacaaactccgaacacatcagaaggaacaaactgcggacatgccgcctttaagaactgtaacactcaccacgagattctgcggcttcattcttgaagtcagtgagaccaagaacccaccaattccggatacattttggtgacccagatgggactattacctatcgccaagcggtgagaccactgcctatcgctgagcggtgagactatcacctatcgccaagcagtgagtaccactggacccctttcacttgctattctgtcctatttttccttagaatttgggggctaaataccaggcacctgtctgccagttaaaagtgactagcatggccgctggactaaagacatgggtgtcaggctttctgggaaagggctctctaacaactcccgactctttggagttgggagcgttggtttgcctagaaccagcttctgcttttcctgtacttctgggctgagccgagggtcgacagagaggaaagccatgcagctctagggtcccgacaagacaacaagttcgttgaccctgcagccatgagcggaacactcaaaggcatgtcgcccaagcgagactcgcccatctatcctatctatcctgactcttgcccccgggtcctaatgcctgccagacaaacttcctctcacctctcttctccgagtttagtcctgcttctaaaatttgctgtctctggtgcttttctagtttctcctataagaacgacttctagaactctgttacattctttaggcacccaggctcaccaatcagaaagacataatttttgcccaaagccctgtcatagtggcgactacctggaattttacgatccctcctcagactaacaggcctaacaaaggtattcctgaagctaggatatggggagcctcagaaattgtagctttcctattcatataagtgaggacaaaaggtgtcactcttccaaccctggagatcccttccctccctcagggtatggccctccacttcatttttggggcataacatctttataggacaggggtaaagtcccaatactaacaggagaatgcttagaactctaacaggttttcaagaatgcgtcggtaagggccactaaatccgaccttccttggtcctccatgtggtctgagaggaaaactagtgtttctgctgctgcgttgatgagcacaactattccgatcagcagggtacagggactgttgcagtttcttgggcagggggagaaacaaaacaaaccaaaaccgcgggtggttttgtctttcagatgggaaacattcagccatcaacaggctcacccttgaaatgcatcctaagccgttgggaccaatttgacccataaaccctgaaaaagaggaggctcattttttttctgcactatggcctggccccagtattctctctctgatggggaaaaatggccacctgagggaagtacaaattacaatactatcctgcagcttgaccttttctgtaagagggaaggcaaatggagtgaaataccttatgtccaagctttcttttcatggagggagaatacacaactatgcaaagcttacaatttacatcccacaggaggacctctcagcttaccaccatatcctagcctccctatagctcccattcctattaatgataatcttcctctaatctcccctgcccagaaggaaatatgcaaagaaatctccaaaggaccacaaaaccctcctggctattggttatgtccccttcaagctgtagggggaggggaatttggtcccacccgggtacatgtccccttctccatctctgatttaaagcagatcaaggcagacctggggaagttttcagatgatcctgataggtacatacatgccctacagggtctagggcaaactttcgacctcgcttggagagatgtcatgctactgttagatcaaaccctggcctttaatgaaaagaatgcagctttagctgcagcctgagagtttggagatacctggaatcttaatcaagtaaatgatagaatgacacctgaagaaagggacaaattccctatcggtcagcaagccatccccagtatggatccccactgggaccttgacttagatcatggggactggagtcgtaaacatctgttgacctgtgttctagaaggactaaggagaattagaaaaagcccatgaattattcaatgatgtccaccataactcagggaaaggaagaaaatccttctgccttcctcgagcagctataggaggccttaagaaaatatactccccggtcacccgaatcactcaagggtcaattgattctaaaagataagtttattatccaatcagccgcagatatcaggagaaagctccaaaagcaagccctgggccctgaacaaaatttggaggcattatcaaaacctggcaacctcagtgttctataatagggaccaagaggaacaggcccaaaaggaaaagtgagattggagaaaggccgcagccttagttatggccctcagactaacaaaccttagtggttcagagaggacagatagtagaggccaatcacccggtagggcttgttatcatgcggtttactaggacactttaaaaaagattgtccaatgagaaacaagctgccccctcgtccatgtccactatgccgaggcaatcactggaaggtgcactgccccagcggacgaaggttccctaggtcagaagcccccaaccagatgatccaacaacaggacagagggtgcccggggcaagcgccagctcatgtcatcaccctcactgagccccgggtacgtttaaccattgagggccaggaaactgacttcctcctggacactggcgcggccttctcagtgttaatctcctgtcctggacgactgtcctcaaggtctgttaccatccgatgaatcctgggacagcctgtaaccaggtatttctcccacctctcagttgtaattgggagactttgctcttttcacatgcctttcttattatgcctgaaagttccacacccttattaggcagggacatattagccaaggctggagctattatctacatcaatatggggaacaagttacccatttgttgtccccctacttgtggagggaatcaaccctgaagtctgggcattggaaggacaatttggaagggcaaaaaatgcccgcccattacaaatcaggttaaaagatcccactgcttttccttatcaaaggcaatatcccttaaagcctgaagctcataaacgattacagaatattgttaaacatttaaaagctccaggcttagtaaggaaatgcagcagtccctacaacaccccaattctaggagtacaaaaactaaatggtcagtggagactagtgcaagatcttagactcatcaatgaggcagtaatttctctatatccagctgtaaccaacacctataccctgctctctcaaataacagaggcagcagaatggttcacagttctagacctcaaggatgccttcttctgtattcccctacactctgactcccagtttctctttgcctttgaggatcccacagaccacacgtcccaaattatgtggacggtcttgccccaagggtttagggataggcctcatctgtttggtcaggcactggcccaagatctaggccacttctcaagtccaggcactctggtccttcaatatatggatgatttacttttggctcccagttcagaagcctcgagccagcaggctactctagatctcttgaactttctcgctaatcaagggtacaaggtgtctaggtcaaaggcccagctttgcctacagcaggtcaaatatctaggcctaatcttagccagagggaccagggccctcagcaaggatggagagggaggacagggaggagagggagaaggaggggaaggaggggaaggaggaagggaggagagggagggaggggaaggaggaagggaggagagggagggaggggagggagaaaggggagggaaagaaagaaagggacctgggaatatgttaatggacaaaacagaaagaaatagtttactgtctgtcttccccactgagttgggaacgccatgacaacagggcctgggactgtcctagtcaagactgggttcccagcaccaggctctgggccctgtgcagaaatcagtgtatgaaatattttgcttctggttcagtcctaaagggccaaccctcccacggacaactacatacgctggctggacaagaaacaaacaattatctgaaggcactgggcagattctggagggagtgaccacttaggagagtggcagaacactctctcggtgtttttgaaaatggttttgaaaactttcagcctgagggcagactgaaattgtgcttgaagagccacaggatagagtccaaggtgaccaaagctgccgggaagtgaggggggatattccaaagaggggagagccagagcgaggagtcccgaattctgtgtatcaactctgccctaatctcttgctgggagatgtatgtttttgttgttgtttttgttttgagatgggttcttgcactgtcacccaggctgggtgcagtggcacgaccacagctcactgcagttttgacctccctggttcgagccatcctcccacctcagcctccagagtagctgggagtgtggtcattcatcacacccagctaatttttgttagagacaaggtctcagtgtgttgccctggctgaagattagtttttaaatcttttgctgggggtgcatgtatggtctgtaaatcagcaagaagccaggcacagtggttcacgcttgtagtcccagcacattgggaggccgagtcaggaggatcgcttgagttcaagagttgaagaccagactgggcaacatagcaagacctcatctctacaaaaaaataaaaataaaaacagaaaaaccaaaaaaactaattccaactaagctaccaaaacacgaaactcaacactctttggaactatatgatagaatccagagtatccacatcttattcctatatcccaatatccaagaaacaatccaaactaactcaaaatacaaagaaacaggaa

SEQ ID NO: 3057 - DNA, 842 bp, Homo sapiens
tgaatactgaagggttggtaggggaccagagaatagaggaagcattgtaggttctagagtggagaagggaccatccaaaatggagtttgaaagagaattctggcctttgtgtttagagtctggaattgtcaagagtctgaaagcacagaataagactgcagctagagcaatttaggcgccatagtttgtcaaaacagagacgggatctcactgtgttgcccaggctggtctcgaactgctggactcaagtcatcctcccatcttggcctcccaaagtgctggaattacagtggacaaccttcaatgcactggtactttgtaccctgacctctactgtgatgaacactcaacttgggcaaggaagtgaaattctccaaaggaattattaagataaggaccagcagtacaatgagcttttcactgtatgtctgacctgaaagaagaaaatcttttcagaggactcctctctccccttcagtcgccaagacaatgagagctcttgctacagaatactcatggtcatttcttcccctggcattcataaactaacatggttcccaagcactaccttgttggctgagagagagtccccgcctgtgttgggaggcaggctgagggctgcgacggctgctgtggtgattgctgctgctgcatgcgatcctgcaggctccgtgcttttcgaatactgatttgcaacttcttatcgactagggctctgctgtgcgtgctacagctggcaccatgcagggcaagtcttagtttagctaaaatgcaaaagaaaatatagcagaaacagaacacaaaacacaaataaaaataaaaagaataaaattgaaaaaaaa

SEQ ID NO: 3058 - DNA, 2568 bp, Homo sapiens
tgttaatcctagctgtgtgcagtctctcttacccttctgtgcccagctcagtcttccctagggctgggtgtattaggactggctttgtcccacagcttggggccatcggtcctgtctcccctctgctggccgggcacagctgtggtgaggttgggcagctgaacagtgttggctttcatgaggaggcagaaagcagaggctggcctcagactcatacagaaggtgggggttggctgggtacgagggatgtggagcacaaaagcctctcatcccccattaaccagggcaccaagcccacaggtgtccccagcccactggatcagaaagagttcagtaagaccggaagctcctggtatgggtttctcccagttctctagggaaggccacctgcaggtcactgaaacttcaagcaccagggaagatctaacatttgagtcccttccaggccatcagaggcctagtcagccacatgggaaacttccaagacctgactcaggcatcattccaccatggctaaggcaccagccggggaagacttgaaagaaaggggcaggagctcagatgaagagaaatcctaagttacctttctaggtcaaggcctgtccctggccatctctgaacttcagctagagcttcaagtctgtgcctggagctcctgggaaggctactcaccttgaacaccacgcttgacaggacagcatggtgcatgccgctgcatccgtgagcagtgtgtctcctgcatgcagaaagggagcagagaaggccaggggcttttgctaaaaatagtggccagaccagagctctggagccacctgtcccacctcaaatgggtctgggggtcaggaggcagggttttatctctgtctaccatctccctcgaacccacactgcaacaggaactgtgagagtctttgtaagtaaactgccctgtctaggtcagtacccacctgagctttggacgcacacagcttttagtacccacctgagctttggacacacacagcttctagtgatttctggggccccaccgtaaagtgagcatgctttctgaactcgcttctctgtgactgatgttaggctgggcccagaggcacagccggggcctgcctagcactcacatgctggacaggtctgggagaggcagagtgccccacctgccactaggctgggtgcccacagcccgcatgcagcagcttgctgcaccccaagtccaggtcgggctcagctctggctcacagactggagacaatgcagatgccagagcaaagggccaggaagggtcaaaacattttattctcttttttttttcttttttaataaagttaaacagtaaaacaaaaattcacaagctgcctccctgtccacccccgcctccctcccctgccctcggtcttcggcattggttccctttgctccaccccactcacagagacacagggcatccaactgagaaaacgaaactgctctaagcacacggagacgtgatgaagggaggaggtgaactgtttccacattcaagattaaactgagtgaatctgcattttctgggttctgggtggttgcccttcattagccaaattgaaaaaagaaattccctggaccagatgctgaaagagaaaagaggggttggtagttggctatggattttctaaggaagatcactttgctctgattatggaaaagtcttcaagggctgcttcaaactcaaacacagagagaaactctatgggtatcaaacagctcaggctgtttttgggtgcaagagggagcacgtgactgtattatacatgggtagcttctgacctcagcattatctatatagtacctttgctcttgcagagaagccttggtactaggcagttagagatgcctccctgaccctgcagagatgcggtggctaaaggtcccaaggcaaggggtgcctgggaaccttcctgtcttcatccttagcaacagccgagtggatagatgccctgctagatgagaattcagctgcccccgctcatgggcccctctgactcccaaagagctgcctaagaggcaatgagtgtgttggcttgtgatctgggaactcccaagaacagcaggcccacctaccttcaaagctgaagccgccaggaccgccaaagaatgccttgaagatattgtttggatcaaaatctgtagagcagggcaagtaacatggaagggaagaaaaggtgaaaaattagaaatgttcgaagagaactgatgacactgagaacagatctccaaagctttcctggagagtctcactcccctcctttcccaacacttcagactgcaagtgagcaaacctgccccatcccgtgcaaaacatgctacctgatcccactcctaggacatgttcccttctccttccaactgctgccccaaaggaagctttctctgcttcagcttgcttcattgggctgttttctcaacaaatggaatgccatttgcacttacacaagactttccccatactctgtctccctataatgctggagcggctactaaaaaggataaaatgtatcacttaaatgttaccaaaaataaatataagagcaa

SEQ ID NO: 3059 - DNA, 1076 bp, Homo sapiens
gtgatgttcttgcgtatctgggctcggcgctgccgctcgtgcttgggctctgccgccacgtccagggcccgctcgtactggggcaggcagggggcacagcaagctgtcagcagggcaggaggccggcaggaggccagcagatgcccacgactcccggggtgcagttacgtgctagatgctgtgtgatgtgggcactgacccgcaacactgagctgtttcttcatgggcaaaacagggctgcactcacctcgttcagcacagtgaccagggccagcgagtactcgatgacgtgctggggatcggcctgccgcagcagccccgggagcacactagcggtgagcccgtgcagccagactgtgagccccattgcgctgccgttgggctctgggagggtgatggccagagacctacgagcagaggggggtggtgagcaggtggcagtctcgggggcgccctcccacggcctggctcacctgttgagggcgaccacagcggctcccagctggtcctgcaccaccacggccaggcccacctcgaagtgtggcctgaaacccgggggcagcacggctccgtagccggagaggctgcccttgtagacacagaactcctcgcagtggccctggcgacagcgctgcagcagcagggcgtacaccagcggggcgccagcatcctccgcgtcatgccagcctgagggacggtccccacggcatcacgggagggctccgtgacctcacagagtcgggggatcccgctgctccccctacgcaggcctgcactcacccatgcattcgaagtgcaccttggtggtgagagcgtgcacagcgcccagtgggaagaggcggcaagagccccccagcggcgggcggttgggggacagggggatggaggcgcagccctcctcctcgccagagcggcccagcaccgtcagcgtgaaggtgtatccctcgccgtcccgcagcacgccccgccgcagcaccagtcacatgcctgcgctgcccgtggatgtggtggtctcatccagcaccagcgtcttgttgctgaacgacacacactccaaggacacaatgggcacccgg

SEQ ID NO: 3060 - DNA, 4675 bp, Homo sapiens
gggaggggcctggtggggcccgggcagggcatgttttcgaagcatggagggagtggttacagggctgggctgggctctgtagactgcagggttggtttggagcatttggacccacctgctctgctcctggtgactttgggttcagatcacagggctcctgccaccctctcctcagcccttgcgctccgtctctcctggccctgctctttgataaatgccttcatctttggggcactccttcacaggctctttctcacctgtggatgagggcagggccccttgggtagaagggatagtaactccatgtgacccagttttggctaaaaatgggattggtgacaggatgggggcagctgcatactgagccaggtgtgaaggagcagagagtggaagtgggtgtgggtgtggactcagctaaggtgcctggggcgcaggacgtgccatccaggctgcagggcggagacagaacggggccgctggggcgcctgtctctgtgctgcacgcacatcgccccttcccgccactcctctgggaagtggcctgatccctgcagctgctgaggctctaagcagaaacggacttgcagttctgacacctcttgcttaccttccccttcataggggacctgcggctcctctgggccctaccatgctggcattttcctccatgtgtcaaacacatgggttcagccagcgaagatggtcctgctggctggagcagcctggggccagaggaagccgtatcaaccgggtgaggcctagtggtgggggcggtggcaggcctgcgtccactgcgggagggtgcaggtccagccaggacaggcagtgtgccaaggacaggagtgccctcagggcactgcagccaggaggcgaggagcctcagggaagactcccagtggtggaggcacggctggcctggccacgccgtccagcagggcaggcatccagtaattcctcccggccaaggaacccctccagtaggaaaggtggcaacaaaagaaacagacactaattggagatgtagatggttcagggagaagaaaataacagagaaagaaaatctctgattaatatcctcaggaaaataagtgggcatcatgcattcacgggacaagaggtgtcaccatggagaagccacattgagagaataaaactgaccttctgtgaattaaagatgccataatagaaatgggaaaaataatagaagaattggaagagaaagttgtggaaatttccagaaaatagaggaaaaaggcaaaaatatggaaagtaggagagaaagagaagaatgaactagcaggctgaaccctgaagccagcattccaattgatcacttgaggtcaggagttcaagaccagtctggccaacatggcaaaaccccgtctctactaaaaatacaaaaaaattagccgggtgtggtggcgcatgtctgtaatccctgatactgtggatgagacaggcaaaactagctgggcatggtagcttacgcctgtaatcccagtactttgggaggccaaaatgggaggatcacttgagcccaggaattcgaaaccaggctgggcagcatggtgagaccccatcgttagaaaaaatatttttaaaaatttgccaggtatggtagcacatgcctgtattccagctccttggaaggctgaggcaggaggattgcttgaccctgggaagtcgaggctgcagtgaaccaagatcaagctactgaactccagcctgggtgacagagcaagactctgtctcaaaaaaaaaaaaaaaaatcctaataacacaacaggggtgggcttctgcttgtggcattatggtggtctgttattctgaaaaaacttcccactgccgaatacctggaatgctgatgagttgaccagcatccttctgatcaatcagaaggagaaacctaggcccacggaggtcaagaggggaggtgagaggttagagctctccagtggcccctgggcacctgcctgccttgatttcacatgggagacaaggcctttcttcttcttttttcttttttctttttttttgagatggagtctcgctctgttgcccaggctggagtgcagtggcgcgatctcggctcactgcaagctctgcctcccaggttcacgccattcgcctgcctcagcctcctgacctcgtgatccgcccgcctcggcctcccaaagtgctgggattacaggcatggaccaccgcgcctggccagacaaggcctttctttgcactgggtcagagcccacctgtaccagacccttcaaggcccctcctcagcaaaaagtgactgatgaggaaccttccactgtgcaccctgggaggtagtctgttttcttttagaatttcttttaaatcctctctcctgagaatttgtaaccatggtctgtcctgatgtacattagagcagaaagtcacataatttggattgatgagatacaggataaaaatagcaaggtaaagaggcgaaagggagaaaggacagctgctgcctcatcaagagaaaagagagaaacaagccaagtggtaaacaggaggtgaatagatgtgaggacagcgaggggtggcgcggggaccgcggggagatgtgaggggtggcatggggaccgtgagaggggcggtgaggggcggcgcaggggccttgaggggatgtgagaggcagtgcggggaccgcggggggcggtgagggccggggggggggacggtgaggggcggcgcagggacctcgaggggacgtgaggggcagtgcggggaccgtggggggagggggaggggcggcggggggacggtgaggggcggcgcggggacctcgaggggacgtgaggggcagtgcggggaccgtggggggagggggaggggcggcgcagggacctcgaggggacgtgaggggcagtgtgggaaccacgggggggcggtgaggggcaggcgtgcccagtgcagccacctctgaaagcccagcagcgagtgctccaggagagtgccacttcccaggcagtgctccgtgggctccgcagtgggctctctcccagtcctcagggctgtgtcaccccggggaaatgaagcaaaaaggacagtttccaatttttttttttttttttggagacagggtctcactctgtcacccaggctggagtgcagtggtgtgatcttggctcactgcaacctcttgcctcccaggctgaagtgatcctcccacctcagctcccagagtagctgcgaccagaggtgcccgccaccacacccagctaatttttgtatttttagtagagacggggtttccccatgttggccaggctggtctcgaactcctgacctcaggtgatctgtccacctcggcctcccaaagtgctgggattacaggcatgagccactgcgcccggccccaaattatttttgtgacctgagcatcaccacaaaagagatccagggaccagcctcactcagggtctgccctccccgtccatgcccctgctgctgaacccaagtcagagatggtttcaggtgcctttgctgggatacagtgacccttgatatcccaaaacttggaacgaagcagattcctatcacctcacataccccgctgtgatcgctgaccctaggaacaaaatccatattgcctggcatctcacactgatcgacataagaagggaaaccacatggccactgcccttgtttattcttattaaaaactcaggctaggccgggcgcggtggctcacgcctataatcctagcactttgggaggctgaggcaggcggattgcctgagctcaggagtttgagaccagcgagcccaggaggtcgaggctgcagtgagctaagttggtgtcactacactccagcctgagtgacagaccgagaccctgtcttaaaaaaaagaaaaaaaaccaaaatcctacaatcacccacacagacaaagaatggaagaaaccaaaggtttttggtcttcacttaataaaattgtttatataaaatcccaacacattcccacaaattattagaggtgacaagaatttagcaggatgctgttggaggatcagcagctgaagcttatctgcattcctgtgtactagactcagaggtgccagctcctctgtgaatcgatcatcacagattctggtgagcttctgatgagagtcccgcagggcctgagtcaaccattgggtttgcgcctggaggtgctggtgaccctgaaggcagtgctagaaggtggccagtggccccatgaaggggacgaggggtacaggtagagattttttgtctgggtggcgcttctcagggcctttgctcttgcagggttgctgcaggggttccggtggtctcagggtcctcttccatgaggttgtcagcccattgtgaggaggggtttgtggcgagaccctttgattcttacaggctgggtttaaagtgatttcttaagatacaaaaaagtataaatcacaaaggaaaatattaacaagtttgacatgacaaattaaaggaatttgttcatcagaagatctgaaaaaatgtacagaactgcagatgaacatcaccaagaaaaagaattaccaaagaagatactataaatacttttctctactttataagaagtggaaaggctcacccatggccctgggagcagcagtggatggggcctaaggccagtgggaactggcactcacaccccaacctggcc

SEQ ID NO: 3061 - DNA, 9663 bp, Homo sapiens
gctggtcttgcttgatcacgcaggagaacgtcccgcggtgcgtgagctgagccggccggatccgcgccaggtatccttcggcccgcggcatatctcggaaataggacaagtcctgagtccggagctgcgggacacgcgggtttaaacgcctcaactccggcttgccactgagtaacctacaagccccgccccccgagccagaccacgccccctggagtcctggccctgagccttgagcccgcccccgagccttctcgctcccctgccctaaacgcaccccttcccctcactccttaaacccttacgcataacctacccctagaaactgcttttatttatgtattttttttttcttccagacagggtctcgttctggcgcccaggctgcagtgcagtggcgcgatcatagctcactgcagcctcaaactcctggacttaagcagtcttcccgctcagcctccccagtggctgggactataggcgtgcaccaccacgccccggctgtttttaaaattttttggcagaggaggggtcttaatttgttgccgaggccggtctcaaactcctgggctcaagccatcctcccgccttggtctccaaaagcgctgggattacaggcgtgagccatcgccccaggtccttggtcctgcattctgatcttcgagctctcccctaaatcccgcgaccctcctcttgctgatgcttgtgtctagacggagattcccggagtcccgtccccgcaagctgactccccaacctctagtgaaggctaactcgcccgtctaaactcttcgcgccggccccgccccgactcacacctcctcctgcgaacttccaggaataggtgatctcctcctttggcagctggaagtttacgatgcaagaaaacatagcctggtcgccccgagtcactgtcacatcctgaactgaagacggagcagggttcactcgctgggccccgaccacgtctggcctcgccaccagcttatgcccctcggtgctctggtcccttttctcaggttggcctcctgcaccccgaggccccgccccctcacctgggcagtccagcgggaggtcgcagaccctagagtagcacccgctgcagaggaaacgccgggcgaactcctggagacctgtggagcgggaacgctgggtctaggcgccacctgcccttccaagcccggggcccttggcccatttgagatccatgcagcttcccggggtccatcggccaggtggcatcttgaccccgccctccctgctgtctttggccgactctcactcctctccgccctctaggattcctattggtttgcttcggctctcacacacaccttctgaggatttagagcaatacttggttttcttccttttctccagggatcttattggcttcctaaggatgtgaagcccacccgctttcccacacttgatgtcgtacgtttcgtccccgaccgcctcccttaccccgcaatttccaagttttagatgaagtccttaccgcagggagggatgcaagcctgggctgtggaggaagaggaaacatcactaccttacagtcatgggaagaacccttgcccgatgctcccctagctaatgttacaaggcccgaagcattgctccgagggggcggggccaagctttcgtcataacctgggggcggggtcaagccggctgggttccacctggggccggggccaagcctgagcattccactaggaggtcaggcccaggactgctgccagccttctacttggggtttagagggaaacacactggttttctgtaggccctgatggggatgggcaatccaggtgtattccaccgaggaggcggggctagatcctgggcgatccttgcaggagaccaaggctaaggtggtggcccagttagagaagaggcgtggccaggttagtagtagtcccggaaaggggctcagttggagacgaaacctttcatcgaaggggcggggccagatcaaaaatggtccacgcggggaaatagtcgtccctcaaggtctgaggctcagagatggggccaggggattgtacggggagtggatggggggtctcaggagtgggtttcgttttgagatggagtcttgctctgtcacccaggctggagtgccgatctcgggtcactgcaaccccgcctccagggttcaagcaattttcctgcctcagcctcctgagtagatgagattacaagcatgcgttaccacgcccagctaattttagtatctttagtagatatgggtatcaccatgttggtcagactgcttttgaactcctgatctcaagtgatctgcccgcctcagccttccaaagtgctgggattacaggcgtgagccaccatccccggccaaaagtggggttttctaattgtgtgtgtgtgtgtctggggaaggagagatggagtgtattttaccttctttaagctgtgtaatgaccttcttcattttctccgcagcatcagggaaggcaacctcaaaggatcctggagagtggaggggaggacggcctgtgtagtaaagcccttcccccagggcttggtccttggtcctgcattctgatctagcctggctagggctaggctggccctagctcacaggacgtactgtcatggtatctgcccttccctggcccctcttcacccctctcattaccatattctctgctcctcttctcatcacccgccctctgtagttgaaggctaacaagtccctaagtctcctttcttctgcctcctgaatctctccaggatggaagtcctcctggacatcacctgcatgtagcttgttggggggagaaggggaggataaagatcaaattcctcaccaaggcctattaggtcttacatggtttggcctagttccccctccctccctgtcccatccctactgcccacctttcatttcctttattttattttattcagacagtgtctcactgtcacccaggctggagtgcagtggtgcgatctcggctcaccgcaacctccgcctcctgggttcaagtgattctcctgccctagcctcccgagtagcagggactgcaggtgtgcaccaccacgcctggctaatttttgtgtttttagtagagatggggtttcaccatgttggccaggctggtctcgaactcctgacctcaagtgatccacccacctcagcctcccaaagtgctggggttacaggcatgagccaccgtgcctggcctcatttcctttaatatgaaaaccaccacattccctagcacctcagggcctttgcacatgctggcttgtttttagcacatttttccttctcctaatcatccttccatcaccacaaatctaaccaagttccctgtttttgtctctcatcgcaatcatttcattcctagctctcatctgtctgcaattacatatatttatatatagatgatgatcacttatgtctgtctcgtaagtaaataaacatgttcttctgtagcactgtgtcctctggatcctggagagggccctcagtcttagaagtgctcagtaagtatttgtacaatgaattccaggatccaacttgaactggagaccccagctggtggcctatgacccaaatccatccctgggatgtgttatatttggcctggaaagtgtttaaaagaaaatgaaccagttgccaacatataaaatttggaatgtcaaataaaacgtttggcatctcttttttacaaagttggaagagctgtaacacagagatcgcatttccataaggcagcaattagctggagatgggtagcagtcactcccttgaaatggggcacacaccggccacttctccatagtccccagcctctattcacttctatatttacccatcttttactcttttatgttccttgtctttgtaggtgtttgttttgttttgagatagagtctcgctctgttgcccaggctggcgtacagtggtgtgatcttggctcactgcaacttccacctcccaggttcaagtgattctcctgcctcagcctccccagtagctaggattacaggcacccaccaccatgctcggcgaatttttatatttttagtagagatggggtttcaccatgttggccaggctggtctcaaactcctaacctcaggtgatccgcctgcctcggcctcccaaagtgctgggattacaggtgtgggccaccatgcctggccttgtgttttgaccactgcaatggcctccaaattgtatgggtttgtggcttgttccagtggaataagaatagacagctgacttgatctcgtggtgatttgtggaaatcagtaatgtggcagggttttatcggctaaatcgtgccgcccaccccccatcccccgcaaccaaacttgtatgttgaagtcctaactcccagtacctcagaatgtgactgtacttggttcttaaagaggtgattaagttaaaatgaggtcattagggtgggctgtaatgcagtatgattggtgtccttatgagaagaggaaattaggacacagagatgcacacagggacatatgaaggaaggcatctacaagccaaagagagaggcgtgagaagaaactaaccctgctgacaccaaaaccttggtctcagacttctagaaggcagaaacttctgttgttcgagtcacccagtctacggtactttgttacagtggtcctagcaaaccaacacacaggaattgttcactgcctccaaatacctatatatctataacctatatccacagaacacagataaaaagcttcatctcccagccttccttgcagttgtggtcatgtgaccaagttgtagccataggatgcaaatggatgtgttatgtgagtcacaggaggtggccttaaaagggaggtggtaccgcacctggaatcacagctactcgggaggctgaggtgacaggatcacttgaggccaggagttcgagacaagcctgggcaacatatccagacaccatctctaaacaaatttttataaattagccaggtgtgatggtgtgcttgtagtcttagctactcaggaagctgaagtgggaggatggttgagcccaggagttcaaggctgtagtgagctatgattgcaccactgccctccacccagcctgggcaatagagcaagaccctgtctctaaaaaacaaagacagagaaggtggtgccatcttattgttcccctcatccatcctgctgcctgaaaatttgttttgatggttggagctctagcagccacacgggaccatgaggacaagggctactccctgggatattaagtcttgaaggagcttggatccccaagaaatggaggtgccatattagccttaagtgcctaccacaagacttactttatataggagagctaaacttcctacgggcttaaagccattgcagggacaggggaaagcgtcctctgtgattaaagccatacaaaaagggagggaactgaggatattggcaagaaagtgcctaaaacaatgatcactggatatacacttggagagaggaagcactgatgcccagaagtgggttccaaatgaggacccagtggtctctccttggccacagagcaggagtgtggtctcaagatggcaggatgatcaggagcatgtggtcagactggggtgcacaaatgagaggccaggatgttggaggagtcatccaaagaatttctatgtgccaaatcaaatgactcatgggcagggtgagcgtgggatataccaagtaagccatggtggccgggtgggcttatactccaccaggggagtataagtggagtgaaatgttccgaacaggccaagtggcctgggttatagcaagcgggccataaggcggcatgggtgggtgttgtaaagtctcccccagaggagttgcatatcgtcaggagctctgaccctggttcagatcatctgggtctgagtcctggtgcttccgtcttgagcacacctgtctcagatctgagtatcaatcacaagccctcctccccatgcgaccttggccaagtgacttcaccttcctgatcctcagtttcctcattcatcaaatgaggatgacagcagtgtctgtatcacagaattagcgggaggatgagacgccatacaaccatgaaagcatcctcatccccactcttccatggcatcgtttaatgattgtatgagatggtgtcactaagtgtgtagaatggctcctagcacgtagtgagtgttagagaaggctggcaaacttaggattgccatctccaagtttgaggtggggaaacggaggcatggggagattagagaagtggtccaaaatcacatggctacatttgaccctggtggtcaggctccagagcctccacacctaatcgctgcatacataatctccacacctaatactgcatccagtctgtaccacgtcatctactccatggtttatatatacatatatacaaataagatcacctgggatcaccaagaggcagtcagcctacatcagctcctccatctccctgctgctccctctggaggagacgcaaaagtcatccttgattcttcccattgccctcacccacctacatctggtccagtctatctccaaatatatcctgggcctactgttcttgtccagaagagcccagcgttcccttctgataagcggggctataaaacccagcctcacagggccggtagaggatatcctttaggaagatacttaatatgaatgactctgtgtatggcaaacacagccttttgcacgcatgggcaagcctggcacacggtcaaatccttatgcccaccccactctgctcagacctcatctgggcccccggaccactgtgactggtccaagccaccatgggccggcttctcactggaagtcttcctgcctttgtccaggccccatacagctgccagagagatcttgttaaatcccaggtcagatcctgtctctctgtgtaaagtcctccaacagctcccccatttcaagagcaaaaaacaaaagtcattccaagggcctacaacagtgattctcaaagagtgttcccggagcagcagcatcagcattccctgggatcttgacagaaacgtccatgtctgggccctaccttggacctcctggtcagaggtggtgaagcccagaaatctgcattttaaataagctcccaggggattctgatgtatgctggggcttgagaaccccctgtctatgaggatctacaggaggtggccccttgctatctctctgatttcacctttactccagccccacgggccccagggtcttgcactggctattccctgtggcctgaaaatctctttccacagattatctgcatggctgtcgctgtcactgtcaccttgctcaggtctttgctcaactggaccctgtcatttccacctgccctgaccaacctatttaaaattatcacccagccaggtacggtagttcatgcctgtaatcccagcactttgggaggctgaggtgggaagatcacttgagcccaggagttcaagaccaacccatgcaacataacaagacaccatcattacaaactatttaaaaaattagccaaagatggtggcgcacacctatagtcccagctacttgggaggctgaggcaggaagatcgcttgagcccaggagtttgaagctgtagtgaggtataatcacatcactgcaatccagcctgggtgacaaagtgagaccctatctcaaaaaaacaaaaaaactatcacccctttctcttccccttctctgttttcctccatggcagggatcaccaactgacatactaagatactaagatattttatcgattatgtttattgtctatctccccagactccaccccaatataagcaacccgaggacaggtggtttgcagttttggtcacagcggttgttcctggcacattcagtaagtataattgaacgtattgcaccagcttctcccggcctccagactctccctctggtccatctttgacacgaccccagagggttctttctacacccagagctgcccctacttcttcactgctcacactcctgctgcagctccccagcgccctgaggaaagagactcaacactctctgacttttctgctgaactctgcacctaggtatctagctgcctcctaaacgtccctgggacccctcaaagtcactgccttctaacccagcttatcatctgcccccggctctttctctcaggctccttatttcggtgatgacccaccgcccaacaggcacagagcaggacctgtctcagatgctgttctctatgcttcccaaaacagcccagcagacctaactctctggccctggcccttctccaccttcacggccccagcccccactcgggcctccgctctggcctggaccctcacccagcctcttctctctcccctccaagtttgtcccccatgcggccccacagaaggcttccattcccagatccaaaggttcctcatcttttcaaaagcttctgtaacaaggcagcctatgtggggagaaagggcatttcttggaatcctgcacacccccacatggagaggtttagggcctcaggtctccctttagggtggagatggggagagccacagctgaggccttctccaggctggccctggatgccccctgggtggatgggaaccttccctcttccgggattgttgacaggacgcttggagggcaaagcaggaagcaaaaggagcgactgtgggtgtgggaataagccctgagctcctggacctaagaggaagccagtttattctatagcgcagggctctgtaactcctgcaactccgagcctccacagttccagggtctggcacctcgtggggatcatggccatggtgatcaggcatgattaccgcccatgctgcccatcggcattgcgtggcccccagccctgaggtctcttcgcacagccacacacctcaaggctgtcacatgtgcctgtctcaccaggacagtcacaccttgtctcttttcactgctgtcacctgagtgatccactctgctgttcctgttttcccgccctctaattgcctcacacctcaaaaatgtggaatcactttataagaaatctgtgtgtgtgtgtgagtgtgagtgtatgtctctgagcgtgtctgtgtgcgagtgtgtgtgtgttctatcctagaggaagatgccttccctaagatcaggctcatcaggcagccccaacccctgcactgagctccatggccatcctaggaggcaagaagattgtcccactttacagatgggtaagttgaggccaggagaggggcagtgacacacccagaacttcatagccagtaagagtgtgagccatgcagccatggcagaacctatgcctacccgaccccatctggacttccagctctaggcaatttctgcagcgtcccttccccctcaccaccttcagcccctggctcttagagctgccttcagccttcgtttggacaagtagctgagctcaatgtcttcccagctttcccctcccggatcactgcccaactctgggggcctccttcctctgccctgggccctcccacatacccatttcttaggggctccaagtccacatctcccatctccccatccccacacactcaccctgggcagcagccagctcctgcagggcatgggtcatctgggtgaaggtgtcatgcaggtggctt

SEQ ID NO: 3062 - DNA, 2212 bp, Homo sapiens
ctcgcccagcggccgcgacgctatggcgcactggagtaccctgttcctggcaggtcccactccattgcccaagctgaagttcagtggcacgaacatgtttcactgcagcctcaacctcctgggctcaagctgtcctgcctcagcctcccgtgtagctgggaccacaagcactcgccatcacacctggataattttttgatgtttcatggagacagtgcttcactttgttgcctatgctggtcttgaactcctggcctcaagcaatccttctgctttggccttccagagtgctgaaattacaggctccagtctgggccacagagtaagactctatctcaaaaaaaaaaaaaaagattcttgttatgatgaccaggctcgtctcaaattcctaggctcaagcaatcctcttgccttagcctcccaaagtggttggattataggcatgagctaccgtgctggccaaaatagaatgttagtgacacaccctacattgaatttacttggaaggctgattcttttcccatgccctccctaaattcatcctctgaatcctttatcagaaccacttcccacagacttggtgttatggtaaactgaggaacagagatactgatatgggaacacaggaagatattcattttaagagaatcagtgccgcggtcccttgcttccctcacctactcttatcccaagtggcggtggcggcagcgcagagcagcttctgaaggtccaggagctcttttgttcctcctctgcaaagcaaaggtgccacagggcgcggctttccgagaaagcgtactccgcacggtgcacctctccgtctgcaggcgctgagcccccggaggaggagggggcaggctcgcggagcccctaccctggggcggggccaaggcgtcctcccagcccggctttgcagagcagagatctggtgtctccagtttacggaggcactttcagaactgatcagaagccaccccgcttatcagcagatctcaggagagtgttcagtggaggccctgccggtctgcacagctcacctccctgggaactgctcgcctgagcgtcggagccggccctggccccctgcagccagaaagttgcagccgcaggagccccggaggcccaggacgcagggggaggaacaggaagagaagagtgtggcctcctagaaatctagcacggagaaagtagacaatgatggcatcagagtgagaggctggatgaggatgtgtctgggggagcttcgaggtgctgtgatgtgtaagagatcattaattccaggatgccaccccaaggagaatatgcatggaccaaagatgaggggtccccaggagggtgaaccaatagtaaggcccccagattccatccctagccaggctccctgctaagtggcaattagaaaaattcctctttacagaaaacagagcatcaattaggtccccaattacagagccagtcctctaccctctagtgaaagcttccagtggacaagaaaagcttgagaaagccagaaggaataggaacccacagctcaggccgggccgaggcttcataaatcaaaaggacattttttttttttgagagataaggtctcactccatcacccaggctggtgtgcagtgacccaatcatggctcactgcagccttgaactcgtgagctcaagtgatcctcccagctcagcctcctgagtagctgggaccacaggtgcacaccaccatgccttgctaacttttatttttatttttgagacacagtctcgctctgtcacccaggctggagtgcaatggtgcattcttggctcactgcaacctccgcctcctgggttcaagtgaccctcctgcctcagcctcccaagtagctggaattacaggtgcatgccaccaggcccagctaatttttgtatttttatagagacaaggggttaaaaaaaaaatctccccagtgtcacttctcccaggaacgtgtgtatgtgaatggcttaaaaactgttgcccttgacaaagaaatgtaccaatctccaatgacagaatatttaatcgaggaaaggtctcattaacagatgttaattaatctccgttaacgacatggccacagatgatagcctggctgcacaagtgaacactctagggtcacggaaacgactccagactctcttacaattggcaataagacaagttaaattacatgagtgtctcaatccctttctgtaa

SEQ ID NO: 3063 - DNA, 2948 bp, Homo sapiens
accactactagctggggtgaccagcttttattcccttatttggccctgctcatgtcctgctgattggtccattttacagagcgctgattttccattttacagagtgctgattggttcgttttacaaagtgctgattggttcgtttttacccagtgctgattggtgcgtttacaaacctttagctagacacagagtgctgattggtgcatttacaatcctttagctagacaaaaaagttctccaagtccccacccaacccagaagcccagcggtcttcacctctcaatagtagctaatggttaatacttacaagaaccctatcagtaaattaaggcccagagaatttaactgattttctgaagatcacacagctagaaagtggaagttgggcaagatggctcacgcctgtaatcccagtttacttggaggctgaggtggcagggttgcttaaggccaggagtttcgcaccaacctggacaacatagcaagaccctgtctctaaaaagaaaaaggggatgggcgcggtggctcacacctgtaatcccagaactttgggaggctgaggcgggtggatcatgaggtcaggagatcgacaccatcctggctaacacagtgaaaccccatctctactaaaaaaaaatacaagaaattaactgggcatggtggcaggcacctgtagtcccagctgctccagaggctgaggcaggagaatggcgtgaaccccagaggtggagcttgtgagaggtgacagcgtgctggcagccctcacagcacttcctctgcctgggctcccactttggcggcacttgagaagcccttcagcccaccgctgcactgtgggagcccctttctgggctggccaaggccggagccgtctccctcagcttgcagggaggtgtggagggagaggcgcaagtgggaactgaggctgcgttccgcacttgcgggccagctggagttccaggtgggcatgggcttggtgggccccacactcggagccgccagctggccctgccagccccgggcaatgaggggcttagcacctgggccagcggctgcggagggtgtgctgggtcccccagcagtgccggcccactggcgctgtgctcaatttctcgctgggccttagctgccttcccacgggaaagggcttaggacctgcagccctccatgcctgagcctccccccgcctccgtgggctcctgtgcagcctgagcttccctgacgagcgccgccccctgctccacggagcccagtcccattgaccacccaagggctgaggagtgtgggctcacggtgcgggactggcaggcagctccacctgcagccccagtgcacgatccactgggtgaagccagctgggctcctgagtctagtgggaacttggagaacctttatgtctagctaggggattgtaaatacaccaatcggcactctgtatctagctcaaggtttgtaaacacaccaatcagcaccctgtgtctagctcagggtttgtgaatgcaccaatcaacactctgtatctagctactctggtggggacttggagaacctttgtgtcaacactctgtatctaactattctggtggggacgtggagaacttttgtgtctagctgaggaattgtaaacgcaccaatcagtgccctgtcaaaacagacccctgggctctaccaatcagcaggatgtgagtggggccagataagagaataaaagcaggctgccctagccagcagtggcaacccgctggggtcccccttccacactgtggaaactttgttctttcgttctttgcaataaatcttactgctgctcactctttgcgtccacactgcctttatgagctctaacactcaccaccaaggtctgtagcttcactcctgaagccagcgagaccatgaactcaccgggaaaaacgaacaactccagacacgccgccttaagagctgtaacactcaccacgaaggtccgcagcttcagtcctaagccagcgagaccatgaacccaccagaaggaagaaactccgaacacatccgaacatcagaaggaacgaactctggacatgccacctttaagagctgtaatgctcccgtgagggtccacggcttcattcttgaagtcagtgagaccaagaatccaccaattctggacacacttgcagtgagccgagattgggccactgcactccagcctgggcgactgagcaagactcctcagaaaaaaaaaaaaaaaaggaaaagaaaaagggagagggttcatacctttgaaatctgattctcaagcctgggctctgaacaactatgctttaactgtctctcacatgatgttgaagaagatttagaaaagaaactcatatattgatgaatgtataaactggtatgaccttttcatggcaatcagtgcaaaaatacttaaaagatcccttctctttgactcagctccacgtctaggaatttcttttaagtaaaccttaatgaatgtgtgtaaatatttggctacaaggatgcttatcatatcattttaatagagaaaaaattagaaacaagtgagcaatatgaatttggtttaaccagtttaattgtgatgtcataaatgaaatcagtgtagacatctaaagttatatagcagaagaatatatgatgagcatttttccatcacactgatgaaaaaagcaggttagagaacagtataaatatattttttaccaagatattaacattttttaaaaagactactgaaacaatacaccagtagctgggtgcagtggttcatgcttgtagttccagctgttaggagggagtcctaggcaggagattgcttgagcccaggaggagttcgataccagcttgggcaacagagcaagatctcatctctaaaaaaaaaaaaaaaaaaacaaaaaacagaaaagataagacatgaaaattaaaaaacacacatctaactatttcaa

SEQ ID NO: 3064 - DNA, 2047 bp, Homo sapiens
agttctgttctaacttccttgccatttgctccggggcttgtcagctctgggagagaaggtgcccatgccctctcctgggccacctggcagctcaggtgtgtgagccatcagcacccagaggggcctccagtgagggccgggatctgtctcccactatccaggtaatggagctaatctcaaacacaaacctttgtggttcgacagaggacaaagcctactgaagtgagagaagagtttcatcagggacgtgttcagaagagccctggacagacgggcaccaggagggcactggcaatcccgaggctctgaaaacgaagatgggcggaggccgagtgtttggatctgacaggggcctgaaggcggcgggaatctctggggttgccctggcggggtcacagccacgcgcaggcccctcccgtctgcccagcctcagtctggtgggaagaccccgggggcctggaaccggaggaggctgcacacacaggggtcgaagtccatgtagagcccctgtatccccaagactgcatggccccccacccccgagtcccagcggacactcaggaccccagctcagggcagcaggcccgtcccccacctcactccttatccacaaaccccacccttgcccgcccggtccccggaggcctcaggatgcccacgcaaagccaggctctggaagcagcagctgggggaaaagagcggaacagctgtggccgtgcatccatgaaacccgccggctgctcccaaagaagtcaggctccagaaaggagagttctggaattaaacagaccgatggcttatacttaaaaaaagatgagagcaaaaaacagctgtgaagcaaatgagtcacctgaggctaaccaagaggcttctggctgtgaaaggaatggggtcacacagagaaggtggcagatgcagggactgcgggaggcagaactgagaggagaaagaacgaccagggacctcaggagggaacagcaagggcagtggaagaggcggcttcgccagtttccaaactcccaaggtcaagtgtgggaaacgccattcacctgtgcagggggcaccatcttccaggaggatccccatcccctccctcggaaaacagaaagaaaggccccgtcaagtatttttggtttagaagacatcgttgtgagtaaataaacccgacacgcttttgcgttgctcagcgatgactaaacttgcctctctcaggaagattcagaggagccaccagtcccaggaggcctgtgccttgaggctgagtgcccaccagtgggggtggcagcgagggggcctgcgcccgtcagatgatggagaagaggtcggctgtgaagccagcgcggccggctgatgccaccctgagcctcggctgctctgagttggctgctgaacaaacctagagctggagcccagccaggggtgggagggccagagcctccaggcacaggcacagcatccacagcttcatgccctttggaggggccaccgggggagggcacaaggctgagagcagaaacatgggcctgggtggcaggtgcttccctcatatgtttttttttttttaatgcttagtattaaaagcacagaatttaatcagttcatccgagtgactgaggagggcttaagagttaagagaagaaacgactgtctctggtgtgagggggacaacacacagcccgtgaccggcaggagctcaggggccaccgcactgggctcagaagtgacgtgcggacgtggcgaagcacaaatccaaacacaccaggaagacaccagaaacggccacaaaacccatgcaacctcccgttaagcctaaataactataacgtcgcatcaaaacttcagtaagatgaagaagcgattcctagaataaaattagtgtgaaataaaattttaaaattacccaaaacaatctggaacaaaccctcggatgacttcccaagttttggaagacggagatcaggaactcatcacgaagttatagacgcggataatcccacaaacggacacggaatccaagtttaagggcagccacaagaagaacagaaag

SEQ ID NO: 3065 - DNA, 16352 bp, Homo sapiens
agcattgcaaacacgctcccccccaaaccacaaacgcgcccccacacactcgcttactttccctcacaaagatgcccgcttacacggccacagcaggcacgctcagagacacgcagttacacacacacatcgctgtacacaaccccacatacaatcaaaaaacaaaacacgaaacgttcccctgggcactaaatcctcacgttaacgtacacacacaaacacacgccctcctctcccacttcctcttccataccccttcctcgaggccccccacccctgattttcggcacccccagtcccaatcataattggcgcccgcgcagccctctttggacacacacgcgccgcccacgcacgcgctcccctccccggcaggcgggggcggcttcggccgggagccggcggagcccgcttcggattccaggtgtggcagtgactccgcgctccacgttttgcaggctgccaccgtgtcggaggcgaggcgaggaagggagctggaataacaaaggcaagtaatggggtagattggatacctctggggtcttggaagaagctatgacttatttactgtctactatgtggtgagtactgtggtgggtcctcctaggtattgagaattcagttccctgattgaactgtcacattgtcttaagttaggtgccgctaccatccccctttcagaggaaactcaactgtgaatgacttgcccaagattggtcaggatgggaactcgggcccccatgaacagagtttcctgttgtcccctcagccctggctctgttcatccatagactgtgtagccccaagcaagctgctttccccctctgagcccctgtaaggtccatggtgccatcaggactcactgggaactgtgtgtccaacaacctcacccccaaagtctcagcctcactgggcctggagatctgctggtgagacaagagaggacagtgccatcacttcctcgtggcccagagctggaagatgcatcctgctcagcccctgcaggcccagaagtcacctggctccactaggagggcatgggcagtgtggggccgccaggttgtaccaaccttcagagcacactcaagtgctgttaatttccctgtcctgtgggagccaccagcagattggggagaggaccattgctggggcctgggcccaggtttcaggaggcagaaaatctggaggccagcaggatggtgggggtgggaggcttgaggtccctgagggaagcaaaggacttgtgtagggtgcggcgagtatggcctcctaggctgggctgggatgggggcgggtacacagtggggattcccacctgtccaggagctgccttctctgtccccactctccacctctcacttctggaacttaagggagccagggaacatctaaaattgagactagagaggtgggaagaaaatctcattcattgagtacttactgtatgccacgcactttggaaacattcgttgtattctctccacaagccaggtgtcattccctgctaagggaagaggctcagagaggttaagtgacctgctcaagatctcatagctggctgagcatggtggctcatgcctgtaatctgtgcactttaggaggccaaggcagggtagatcacttgagctcaggagttcgagaccagcctgggcaacatagcaagaccttgcctctacaaaaaatacaaaaattaaccaggcatggtggcacatacctgtagtcccagctatttgggaagctgaggtcggaggatcacttgatcctgggaggctgaggctgtagtgagccatgattgtgccactgcactccagactgggcaacagggcatgaccctgtctcataaaaacgaaacaaaacaataaagatctcagagctgctaagtgggtggagccgagattgggctccaggttgggctgggccttgaggttgagaatagggacttgccctcatctcactgccaggttatggtgcagataaggtaacctaccaggtactttggggtgaagtaaagactctcacccacttgccagggaatgaccagggtgcctcccatggcagtgaggtaatggagattacatttagagttcaccccttggtggatacaggaagcatttgggccctgcccagctctgagccctgtgcctctaagaggtgagtggttgggtcaagcagggaagatctatgtccttcagcgaattaggctcccctgctctgcctccccctcatttccaatcagatggcccctccattctctgagcccacaccttcccatcctccaaggcttgactctccaatgtccttccctcaagccagccgtcttctcactttctaccatggagttctgccctatggttcgagacccagttcaaccaccaaccccttcttcagatgggagtcacaagagaataggctgggagcctgcctcaggagccgggacacctatgtgcccagcccgccattgcctgacttgctgtgtggcctgagcacatcacaaactctccctgtgcctgttccccatctgccaagtgagagagtgtgggatatccaccagcacttttgcctctgattgtcctaagattctgtaggtctgagcctttaacccttggactgagctacagttcactttagagtttgagggcggccctgctttagggagggctttcagagggggccatttagtggagtagggacaagaaaatacctggagggagctgctcagaactgtgactatctaggactgtgaataggtaatgaccctaacgcctcccttcatgaggcacctctcaccctctgagcctcacaacagcccttttgtgggtgactaagctgagccccaaaaggaggtgatggctttccctgactgcaccactgggaagcaccagagctggaacaagagccaggtctcagccaggcatggtggcacatgcctgtagtcccagcaactcggtggggggacaagagggggtgcaagagccacatctcctcatgcagtgtcccctcacctgcgtcagggcccctccagaggagcaagtacatgcggcactgatgaggaagtctgggacaagcgacctgaggaggaccatgcctcccacttccttcctgatagctcctgcaccccgagaggggtgggggaaggtctcagatcctcagcatctctcctccttctggctgtgcagtcctccagcctcaagactcatgcttccttgccctcacctcatcctgtggccatgcagggtgacttccagaattgccagcattatgtacatactcttacctctgtgccattgctcatgctcttcctacctcctgggacacacccctcccagtcaccaaggccacatctgcaaccacttgcttggaagcctaccctgatacctccaccagatgtgccgtcttccttgtcttaacccccatatgctgctctcccagcctccaacatcagcataaccataggaattacttgtgaagttcctgctatgttccaggcattgagtagctcatacacatgaactcctcccatcctctgagctattagtattctcattttacagatgaggaaactgaggcacagggagtttcatttcctagtatgacacctcacaggctagggaggtattgtgttacatggccctcttctgtcaaggctgcaggtcataggatggctcactgctacatcccatcacccagtgcaaggccttgggggctgacaggccatccggagcaggggaggtatagaggcccacaggatggaggatgaccagaaccagccctctgggggctcacagtctctcaggaaggactgcccacaccaaatgccattcttttttttttttttttttcttgagacagagttttgctctgtcgcccaggctggagtgtgcagtggtgagatctcggctcactgcaagctccgcctcccaggttcacaccattctcctgcctcagcctcccgagtagctgggactatgccaccatacccggctaattttttgtgtttttagtagagatggggtttcaccatgttaaccaggatggtctgcatctcctgacctcattatccacccgccttggccccccaaagtgctgggattataggcatgagccaccgcacccggccacccaatgccattctaagagttcggggaagaagaagagttggcattgagtgggtcctggaaggcaagctctggtggggctgtggggaagccagagtggggcatggacctgcctaaggtcacacagcaagcaagtatgagacagcagcagggctgggacctggagctcccagtgtatcatgccttcttgcaccttgcagccagctgtggggcccctgcgactgtgctgttttcaaggacacacggtcccagatgcctccacaattctgagctgttcaatgagtggctctggtccttctcccccctctattaaaatggaaaaaagaaagaaagaaagaaagaaatccaggcattgttcctgactgcagctggtgccaaccagaatcccactgaacagaatggagccgagagcccggctgcccaggggcctggctgctgacacagggcctttctattttgctttccactgggggcccaggctgacggtgcagcccctccacggacaccctctccacctgcctccctggccctggctctgagcctcctgctgccttcaccctctttgcaaaaatcagatggcacttgggggagggttggaggagcacccccaccccctgctttccttcttcatccactcacagcctggggtgcgctgggcctccctccccgccagcctgtcctcccaccctaccaggaggggacttgggatgcttgtctgggagagcgacacaaatccctcttccaaaatcgtttgaaacacttgtctgattctaggacatatgaggattttccaccccacccccacctgacttggcaggtgccagtcctcagctcacacattaaggcctcttgcaatagtgaaggtcttgtgggggaaaggggaacatgatgaacagctctacagagacaaaaacagttttttaagttgctagtttgccttctgcctttggtcttaggaggaaaaaggacttctccaactctcccttaccatcttcatttcatcctctgcttcctgcccctttcgtgagctgtctggtactcagacctcctctccacaggctattggctagtttgacccagattaccccaagcagcagttctaagagagcagcatcctggccactgtccagtgtccaccagggacccttgggttggcactgccaccacagccagctctcctggcacccccttcctcctgtggacacagctctttagtttgtaaaaagtacttgacgtctcacgcaagtgccacagcagcctcaagaggcaggcagggattgctaacccacttcgtagaagaataaactaagggttcaggaggcataatggtttggccaaggtcaaaggaggtgacagagttgggatttgaaccctggtctcttgattccatgtcactaagctgcagtggggactcaggaagtgacggtgtcagaggatgacattcccagcccccaccacctccacccgaccaaatgctgccaggagacaggatctcagacacatcgattcctttaaggaatatttattaaatacttgctgtatgccagatctccaacagtgaacaaaacagatttggtccacactgctgcagagcttatattctgagacagacaccagacttcgtgcagaaagatccccctcttcctagttgcccagcccatatgtcctagaaggaaccgtgagatgggcagccagagacataagttctagtcctagcattgcccctgactctccatgtcaccttggaccgagttttccacctgagaaatccaagcatgtggcccctcacacattttctcaggtctcttccctactcccagtctctgggtctagtggttcatgatttcccggcatgaattatcctgatttagttttttttcttaaacccgacttttcctaggctcttagagccagaacagggcttctgagatcatttgctctgagcccttcactaagaaagaaccccttagcctcgttcctgccaggaggagactgtctttgcttgtactcttccagggacgggctgcttgctccctcacatagcagacctctgccagtggtgtgctggtaaatgtttaacagctggctccccaaagtggggagaacctggtttgtagtatttgccgatgtctacggtgtaaatacccccaccatggccagtttcaagctgccgaccagagccagctggcacagctggttggttccatcaaccagctcgcgcagttcctgaaaatttaacaatcggcccttgtgagccatatgaacaggctccaacacaccatttcccctgccccgcagagaagtcttgtctagctttactcattgggaagttctttctggtattgagcaaaacatctgattgtcaggaactctggcctgaaagtcctgaactacttctctggggtgtcacaggacaatggggaccccatgaaggccttctctaattggtggcagctcttgactatgtcttcctgtgagaggagcaagttcctgggccaaatggggtcagagcatagccaccctcccattctgcctttctctctccctcttcacctcccttccttcctctctttctttcacaaatatttcctgggcccctgtgacaatgtcagacactgctagatactgtggattcagcgacccatgtcttagcttgcgcagagatgctgcccactctgtgaagcctgtcctgacccccaccctagcccctcccgcagtgggcagtctcctcccctcccagagcctttatcgcccctgtttggcacttatcactttctacctgggattgcagctatttgtgtacacggcttatctccctgccagactgagaggcaacgtgggcctgttgaaagagcgtggactttggagccgcatgacctggccctcaatcccaaccctgcgactcagagctgtgagccctcggggagctcacaacacctttgggagcctcagtttccttatctgtaaagtggggatggtgataactacttccaatgtggttttgagcaactggtaggattagaaatgtcaaccccatttcctgctcctgtctggactcccatcctcttggggacagagattgtgtgcaatacttctctgtagcctcctggtaataataacataacaatattaataacaatgaccaacacttacacagcaataccatacataaggtaagagcttacatatgttagctcattcattctcacaaccttgtggcattggaagcattattcccattaacagatgagcaatctgaggcacagaggggttaggtaacaagcccaaggtcacacagctagtgagtgagagagctgagatttgaatccaagaaaatccacctcaaagccttagctattgaatagtatggcttctggaggggtgtgagtgtatgtgcccatggttcactgcagcctttgagcatccttgccctgacctgcagggtgggggtggagtgatacaaggaagaccctggtctgcgcattaggacatcctaacaggtgagtggttagtgctgaagaaaggagtgtccccaggtatctggaggccaggggactagaaggtgataatcaataaggcaatcagaggaggcttcccggagaggtggcgcttgccaccaaatgaggatggacaaggcagggcgaacaggaggaccaaaattgtagacatgggagaggtatattagggtttcacctaggtgtcagactagacatattcactggttctggtgggtgggatggagcagagactgtgaacttggggaggggcatgttggtttcccagtctgtgattcaatagggaatggaggacattttcaggggccttgagagccagtgcaggcccaggagagctgagagtcacctgtgctgccctcggggccatattggcattttgcttctctgcaagctactctgagattccaaagtcctgggttcccgaattcagctgtgccagtcccatccctccatttcttcaagcctcaatttctccagttcagaatgggcataaagggtggaccttgcatgccgattaaaggatgagatagggctgtgtggggatgggcctgacgctcctggggcaggaaatgggggaaaggtactgcggggagggagagtgggaagctgggagagaaggaggtggtgcgaggagccctgtgtgcttggccagtgaatccaggtctgctaagctggccctagctgggattcttccagcaccccatactgcattttcccaaggctgcctgactctgctgcctcaaagcagtcttcctcctgggcttctgcaaggatagttctgggttagatcctgttcctctggccaacccagttgagcccagccatgtcccttggagagcactcttcatgttccaagggctgttttaaatgctcttccctcatactaactagttcagtcctcacagccacgctgtgagttccctcatttcacataaggaaactgaggcacagagagggtaagccaggtgttccacagggttccacggcagggaaggcgaagtctaagggatgggaatagcccatggagccaggaaggcgggcccaagggatgggcctctgaaccgccttctcaccctttctgtatgggaaattatgaccattgtgagtcgtccctctcacacgtttcttttctgctcatctcaaggttctcaggtagctgcagaaccacaattgacatccctctgcccatacaggcgcctacatgtccacacactcaacaccatggctgcccaacgtctcataggcacaaggctcacacttttgcacacacaaccatcaattcagagccacaaatgcatctgcaggcaccacacccaccctgccgcagatgcacacatagggcacgtgtgggctttgggcctcagactgacaaccaagcaccaacaagtcccattcccagaatgacggatacacacccacgcgttcacacgggctccagtgtgcctgacacgacatggtggggtctgtggactcacagtgcaccccctggacccatgtccaggctccagcctctgcagatgtcccttctgcccaggtgccttcattcctatcccttcaagactacggctctggaatgtgtgcacagcggatccgcttctcatggcaggtccctgccctgccgtcttctgtaagaactgggcctcaggtgtgtggtaggggattggggtaaaaggtgacccttcctgcaaccctggcaggctccctgggctgcagaagggacagcagggagaggagagtgaattaatcctggcctcccttcttgggttcactgtcatgctaattttctccgcctttgatccatctctctagccccagcccctaactctgagcaggagcaggcgctgggtctggcctgagattaggggctgccttggtgaggcctggggcacatccttccatgtggcagactggggtttcgcccttgggaggggcttgggggattatagccctggttactgacctgctgtgggcaacacactctccttcaccagactcatcctctttcttcctgaccgaccttctcctctccaaagggggctctgctgttcccattttgcacaagagcagagtgaggcccagggttgaaaggtctccggaggcttctggccactgagaggtggagccaggctgggagcacacatcttccagactccaaccccgccctgtttccgtggtgggtcttcgttctggtgatttttttgaaaccagcatctacggcgtattcatgacatgccagggactgcgccttaacatacattgcctcatgcagtcctcagcaatgctcttatgagtcccactttataggtggggaaagagtcctgtgtaactatctggtgagtggtgaagtctgaccaaatccaggacacaggtggccaaagtcccctccctgtagggggtgacactgagacccaggcaggggaaggacatgcccaatcccacacagagagggaattggctggacatgcatctcctaccttcctgtatgctccatctggttccagaaatgactggactcttctatggacccagtggagctcagacaagggtccaggccctgacactgccccagagcaggggtgccagcacctatgaggatgccaagctcaggtcatcgccctgcggtgtctcagccaactgggcctcgaacagccccataaacttggacataaacacaattaaagttttttattacattatattttgtacatataaaagactatttgtaagccatgaaacattacaatgaatgctcatgactactctgctgaagaactagagtattagggacacttgtgaagctccgaccttcccagccccctacttcccagaaggagccactatcctaattgtcattactctctgctgtttttgtttgtttgttttttaaggagtctcattctgttgcccaggctggagtgcagtggcgtgatctcggttcactgaaacctctgcctcctgagttcaagcgattctcctgccttagcctcctgtgtagttgggattacaggtgtgcaccaccacgccaggctaatgttttgtatttttagtaatgatgagggttcaccatgttggccaggctggtctcaaactcctgacctcaggtgatccacccacctcgcttcccaaagtgccgggattacaggcatgagctaccacgcccagcctctccctgcctctttttaacagaaagttttagcacctgtgtggagaccccttcactcactgcacttttttttttttaagaggtgggatctcactctgtcacctacacccgagtgcagtgatgtgatcctggctcattatagccttgatctcctggctcaagcgatcctcccacctcagcctcccaaatagctgggactgcaggtgcatgccaccatgcccagctaatttttttttaatttttatgcaaagacagggtcttgctatgttgcccaggctggcctcaaactcctggcctcaaacagtgctcccgtctcagcctcccaaagtgctggcattacaagtgtgagccaccacatccagctgctaactgcacttttgagatgttgcattctattctgcactcccaattattcattcccaggggaagtgcattatttaaagggatagagagagaacttggaggagccacttgcaccccatgtgcctcttcgcttcagtgctgtgagtgctctgtttggccccctcattccagtgagtgccctgaaacaggacatttcttcctggtacggccagtagaaggagggtgggggccttccggcagctgggcattctctgaacatggcatgctgccttgcatttgcgtaagccattcctccacctggaattcccttcgctagactgttgtgggaacccagttccttcttccaggtccaactccaaggtttcgttctggagatgccttccctgtgaccccttgcccctctcccccagcagagctggatctgtcctcttctcccctgacagagttttgggcatccttctatcagcccttatcccagggcaggaagaacagccttgatcctggatcccaggcacagctgggtgtcagacctggaggagaagctcccagagtgaccaagatagaatcggcatgcaggtgacagcagatgggcatccctgtgaaaccccatgggcctggacctccagggtcctagccagtttgctccaagttctgtgtggactggggatttggaggcaagtctgtggggagactgcctggggcttgtgcctgctgtttacctgtctgctgttcaggcacatgatcaggccagtgggtgtgcccaaaggtgggcgtggttgcaggagtgctcacgttcatacacgtgtttacacacacgtgtgcatacacggggtgccaaggctataggtcttgcgaagcatgcagggccactgccttttcctgcttttaacccccctcctggacaggcctgtgttctctctgaacatctcacagtgcacatttatggagtgcctgctgtgtgcaagacctgaggggttggggcagagcagtgcgcagggcagctggcccctaggggacaggaatgactgagcactcacacagtgtctttctgtcctggtccccctgcacaggagcccccaaggccaggcacccccgcctctacttcccagaggaggactttgaggtcctgatgcctgagaggggcacctgttgagtcaacagaggggacggacaatgagaccagcagtccggtgctcaattctccatcctaagtgccagaaacccctacttcaagagaaaactggcattgacagggcccacccagaatcctctcctgcaccctcctttcccctactggaaaccacactttttggggggcatttccctgggcatcctgtaggagggcatcacagctgttagcagcaggaggaattaagggaagctctgacctgagttagactggaccgtgtaggacagcactaccccatgtctgaactggggaccgggccacccctcccccaacacacataccacacacacgcatgcacacatacacacatacacacacatgcacacatgcccagagaggtgatgggagttgcctaaggatgcccatggcgagtgctggccctctccctcccagacccagtttgttcctttaactcaggctgcccactttcctgtctcttcttgccctccccgccccccgccccccgagtctgagaattaggaccctggtggctgaggaggatgatctgaggcatgatcaggtgctcccttctgggccactattggcccacccttaaggtggcaggatgacatggagtttcggccagcgtgaatataggggctggaggatccctgtctttccttgcctggcacccaaatgcaacctggaagaccctgagtgaaggcccctttctgggaagaggatggcattatggcatggccattagaatctttggctatggacactgtgacagcccagggcagaatccaggattcctcacttctagctgtgggctgtgggcaggaggcttcatcctgctgaatcttagtccctaacctgtaccgaaaagatgaacatacttcatgatgtttggagagggaggcattgtctcggatcagggcccaggaaatggcagttggggtggtcagtgcttattcttgtaagcaagaatgtgtggccaagccaagttgtgtccagaacacctggacccacaggatttgggcctgcctcgtggccccaggatttcgaacccaaattccagtcctgacattgcctcaccagctggttggccttgggcatgtccctggctgcctctggctgcaacagcctcagccccaaatgagcacatcaatcccagggtcacatggaggacagaataaccaatgagacatcagaagggccttgcaaatcacaaggcttgtgtcccttttggggatgctggagggaggaacaggtacctaccaactctcagtgggtcccttgtgcactcacacccagcgttctggcctccagtcaggctgagaggtgcacttcccccatacaggggagagctgcactcatttggggaccctctcccgagccctgcccctgccctccccgccaggcccccagcagccaggttggagagctctcactcagggagtctgagtcccctttgaagctgggaagtttgcactggaggggcaaaggcagcctgcattcaaagcatctctcctggcccttaattacccttcttcacccataggtggaatttccactcaaagagctaagaaatgcacccgtgctgccgccagggactgggtttccctgctgcctttgtgtagcagccgccagcgcggcagtggcacacagctcgggtttctgattttaatgatttcctgaattcattccgtttcctacctcagggaaaggagaagaggtgatcctcttggaaattcacataattgcttttatttgatttttattaaaatgcattcaggaataatgtgattgccccctttattagattgttcatcaagctggcatggggaatcagcctagaaaaaagtggtgggcacaggagcctggtgtgtgatggggagcgggcacagtcccgcggcggccttgggggcttgcctctcactgggggagtcacgcctgcctctgagcctcccgctgctcctgtctggggaggtgggcccactgcagggcgtgttggaagaatgaaagctggcagtcagtgtggaaggccgtgagcaccgtctaaatcccctccacatcccaacccactcctcctctgttgctcctctgcccacctctgaggccacacacaggctgacacggagacccgtggtgatctggcatagcagcactgaccccacactcgcctccgcactcccagttgcctgtacttctacgatggcctttttgccagtcttgctgtcctcaggctcaaggtcctcagtgcagttttctgtggcccacctaatcacaccactcccctgttcagaaacttggtggctcccaaagacccctttcttgccggagacttttgctttgggttcctttgcacgcgctggaaggtgaaaataatccagacctcttagacctagtttcagtgcttgaattgctttgcatggtgggatgtgggtgaagctgccttgcctctcctagtctcagtttattggttcaaataatgggaactccaagaccttccgtagggtcagtgagaaaatggagtacagggggtctgtaactcaggcggcatgtacgtgtgtgggtgaaatcgtgccacgtgaccctgtgttgcaggaggctgaagatgcttagcaaatatgtggggagaaggcagggcaggtccagcgctggccccagcagaggccacagaccagctgagcagccactgtgacagggacagttttattctgagcacccctactcccattttctgtagcccctcccctcctcccaatgcaagagtggagctgactttcactgcgctcagtgaatttgcctctcaccttctggggggttttgcagtttccagaagaggggcacaaatatgttcactgggcttccaggaagtgcctcaccctctgagctcaccatgtctccagactgcccaaggcatgttttattacccttgagatatggtgaaatacatatttgtttccccctcctcccatcccatttcctggcataggactcctaaaatccttggactctccaaagtgataagtttctttttgtatgctaatgagttgattgctggctggctgctcctaggacacttcaggatgtgggctggtcaccagaaagaccaaggattagagggttggggcttccagccccacctcccccatctgggggtgggtggggagaagggctgaaggttgagttgatcaccaatggccaatgttttaatcaatcatgactacataatgacatcgccataaaaacgcaacaaatctgggttccgggagcctccagacagctgaacgtttggaggcacttggaaggtggcactccaagagagggcatgggagcaccccttccggacctcgccctgtgcctctcttcatctggatgtttatttgtatcctttaaaatatcttttgttataaaccagtaaacatttttccaagagttctgtgagccgctcgggcaaattaatcagacccaagcagggggttgtgggaaccccgattcatagacgaacggtcagaagcacaggcagaataacctggggtttgcggtgggcatcagaagtggggctcagagttaggggactgaatcctcaccctgtgggatctgatgctatctccaggtggatggtgtttgaagtgaattgaattaggggacacccagctggcatctgctgcagaactgatgactcgcttgctggtgggcagaaatctccataatctttctttagcagatgaggtcactgaggctcagagagggtaagtgacttgtttagggctgtctagctaggatgtggaggcttggggacaaggcctcttgggcacatacaactaggatgggcaggtgactccctgccaccaggggagttggtgaaatgcttcgcagggctgaggttgagcaagtgggcagtgcctggagaagccaatctgcatccttggtgtgggtaggccttgagggtatttgaagcaggccctctgcctggggcggtctgcccctgctggctgggctgcacagagagtcagggaggcatgggagcatagccatccactttcagagccccatct

SEQ ID NO: 3066 - DNA, 1952 bp, Homo sapiens
cacacacattccatacacatacacagacacacattccatacacacacacacattccatacacagacacacattccataaacacacacacattccatacacacacacattccatacacacacacattccatacacacacacattccatatacacatacacattccgtatacacacacagactcattccatacacacacagagacacattccattacacacactcagacacattccacacacacacattcatacacacacacattccatacacacacacagaatcattccatacacacacagacacattccatacacacagacacacatttgatacacacacacattccatatacacacacattccatacacacacattgcataccaacacacacacattccatacacatacacagacacacattccatacacacacaaacacattccgtacacatactcagacacacattccatacacacacacacattccgtacacacacacagtcacacattccatacacacacacattccatacgcacaaacacattccatacacacacacatattccataaacacaaacacattccatacacacacacagactaattccatacacagagacacattccatacacttacgcagacacattccacacacacacacattccatgcacacacatagactcattccgtacacacacatagacacattccatacacacacagacacattccatatgcatacgcaggtatgtccccaaagaaatagattgtctccatcatatgcacattaacccaacgaaatacttttggagctctgtaacacccaaacttgactcacaacacacatgaacactgaaccacacaaatgaaacctacactacccagacatacccattgtttgaagacttgctgcaaaatacccagccttacgccatgatatacagacttggcccattgacctatacctaccttgaatcacagggactgatagagcaacactcagatgtggcccacaaccacagatatgccctaccaaacaactttttgtcttcataacatgaaggcttacctcacagaacacagaaaggatgaacaacacagacaaatcagacaacgcagaaacacatcccatgacacccagacttgctgcacagcattcagactcacactatgacactcatactcactcaataacactgattgcttcacaacatacgcacatagcccaaaacacacaaacatcatccacaactaacagacatgtcctacaatacaggggcatgccacacaattcacaaactttttctacactgccaacacttgtctcacataacacacacaaataaaaaaaaaccacaaagacatgctccatagcacccagactcgcttcactactttcagacttaccttatggcacccacacgtaccttatatcatacacatttaccctgcaacactcagcctggccacagaatatatttacatgtccatgccccacaacgcacgcacatgccttccaacacatggacacacccaaaatacacaaacgttttacacgacatacactgaccccaaagaatggcatcataatgcacaattataaccaactcagatctaccctacagaacaaagactcacctcccatacttatcacacaattcctaaatttacaccaaacactcacactcatcccaaaatgcataaacccaccccagaacacatgcagcacaacacgtagatttgccctcacttagaataaattcacagctcacacttgtcacccaatggccagacacaccttacaatgtacagacaactctttcacaacgtagacattgcctaagcaatgcacagaattccataacatcacgagctcttcctacaatggcgacttacctcacagcaccccagattgcatcagagcagacactccacccaagatatac

SEQ ID NO: 3067 - DNA, 789 bp, Homo sapiens
ggccacccacatagaagagacatagaagatctcccagctcttcctgggagcaaagctgtgcaacccagagcctcaagctgccgctttggcaggaaagccaactcccgcgtgctgaagtcactgaatgcacaccagagagaaacccacttcgcaggaagcaaatgctttgtctcatttacatttttcgcaggtgttctgggatgtgaaggggacgtgtccaacgtccaggtccttcgtcacagccataaaggaggccatgcgtgggacacgccctcattccaggcaatgtgagagacgccttcaccttgaccgtgttgctgcctctcgttccaaccgtgctcagaaccaggagccggcggggacggagccacagagcagccgcttccccgtgtccgcgcccctgtactgtcttcacactcgccatcaccttgcacaccctgcggcaccacacgaccgccacggagcctgtggggccctcctgtgtctcaaacccgagcccttccccggcgcccacatccaggttgccaactaggaggaggcaggcctggggcactggcaggaggacgggtgggcacaggaaaacctgcctgaagatgaggtcatgaggaaggcagcacagaaggatgggagaagaggccttaagacacataatgtgagcacctggatccagctgtgcctgaagccccttggacttccaggttatgtaagcccattccttacaaccctttgcatttgttttctgccccttgcaaataaaagaccatgacctttcacgctatgagcagctga

SEQ ID NO: 3068 - DNA, 5896 bp, Homo sapiens
gctcacacctgtaatcccagcactttgggatactgaggcaggcagatcacctgaggtcagtagtttgagaccatctggccaacatgcggaaaccctgtctctactaaaagtataaaaattagttgggtgtggtagtgtgtgcctgtaatcccagctactcaggaggctgaggcaggggaatcgcatgaacctaggaggtggaggttgcagtgagctgagatcgtgccactgcagtccagcctgggtgacagagtgagactctgactgaaaaaaaacaaacaaaaacaaacaaatgaaaaaaaaaaggtggtttagttttgggaagggctactatcatccttgctttaaggttaaactgtaaactaaattcttcccaaagttagctcggcctatgcccaggaatgaccagggacacctcagaggttagaagcaacatggagtcagctatgttagaatttctcttactgtcgtaattttgcaaacgcagtttcactcactcacctgtagaccaggccaccataaactgcagtccctccctatggttagactaccatgtgctctgaggcttaatgcctctttcctagactgcagctattcaaagaccatgcagctgccaagcttaaaacattctgcctacacactaaagtccactaacacctctaaatttatatagctcctctaagttccgagttttggttttgatttctcagtattcctcaacattcatccaattggaagtcttcagacttcagagctatacttcctttccaaactgcaggtttctcttgtcctgcagggacagaggttgcctcatgtgcaccttatggccaggaaaagagcaaataagtccagactatgtgaatagtctgaaggctaattagaaaatgttggtttattctacacaaatttaccaatcaagtgaatcactccacttctgctaagacagagtgactatagaggcacagaggcaaagaattacattctttggccaggttcaagtgattctcccacctcagactcccaagtagctgggactatagggcacattccaccacgcctggttaattattattactattagtttttgtaaatatggggttttgccatgttgcccaggctgatcttgtgaactcctgtgttctatccactgagaaatgttccttctacatgggatgacggaagagtacaggagaagcattctctgctagcaaggtagcctctgtcttctcagtgaagtaggagacaaagttgtgtcaaaaaaatatttcaggcaggctgggcatggtggctcatgcctgtaatcccagcactttccgaggctgaggcaggcagatcacctgaggtcaagagttcgagaccagcctggccaacatggtgaaaccccgtctatactaaaaatacaaaaattagccgggagtggtggcgggcacctgtaatcctagctactcaggaggctgaggcaggagaattgcttgaatctgggaggcagaggttgcagtgagccaagactgtgccactgcactccagtctgggcaacagagcaagactccatctcaaaaaaaaaaaaaattcagacagcaaaagatttgaggactcgaggaaagtaggggtggttttgaatactattgtggggaatgaaataaggagccaaacagagattaattatttgaaaaattcctggctggatgcagtggctcacacctgtaatcccagcgcttttggaggccaaggttgacagatcaccttaggtcaggagtttgagcccagcctggccaacatgatgaaaccctgtctctacttaaaaacacaaacaaacaaacaaacaaattagctgggcatggtggcacacacctgtaatcccagctacttgggaggctgaggcaagagaagcacttgtacccaggaggtggaggttgcagtgagccaagattgcatcactgcacgccagcctgggggacacgagtgaaactctgtctcaaaaataataataataataaattcctgagtgtccctgatgatttagagttagagtgcagttagagtcaggaagaaatcaaggcatgaagtaatacaggagctgggatgaaaaacatgaacaatggaagggtcttgtttcaactggaatggaagagagccaagctgagcacagtaaccaggctacaaggaggacaaatgaatctaaatggaatactgatactaactggctaacacttatcatgtacttaatttgtgctaggtttatatgaattatctatttaaaccttcacaggaagtctttgagaaatttaagggaaagaggaattcagtaacctgtccctggccactcagctagtgaagggcagtgtgagtttaaacccaggcagtttgaccctaaaatctgcagctttaacctcagtcctactggttgaattcaaattactcttagaacaaataccaggttcagtagaatgggaaaaatgataaaacaagaggttatgggtaggaatgggcatttacatttaaaatcttggaggttgagcagatttgatatcctaggaaggtggatggtaacaagtcaataaagctgaaaaaatgtgagatcagcctgtcaaaaagtcatgaactggccaggcgcagtggctcacacctgtaatcccagcactttgggaggccaaggcaggtggatcacctgaagtcaggaggtcaagaccatcctggccaacatggtgaaaccctgtctctactaaaaatacaaaaattagttgggtgtggtggtgggcacctgtaatcccagctactcgggaggccgagataggagaattgcttgaacccaggaggtggaggttgcagtgagctgagtttgtgccattgcactccagtctgggcaacaagagttaaactctgtctcaaaaaaaaaaaaaagtcatgaaccatttaccctgatgggattattgtacattgtatgcctgtatcaaaatatttcatgtgtcccataaatatgtacacctaccatgtccccataaaaattttttttaattaaaaattttgataggaaagagaagagagtggtgttagtgtttggattaaatttcaaaggaaactatgtaatccattataatctctctccttcctccacttcggtttctctttttctttctttcttttttttttttttttttttttttttttgaggcagcagagttcacctcagcctcctgagtagctgggattactgtcatgcgccactacacctggctaatttttgtattttcagtagagaccaggtttcaccatgttgcccaggctggtctcgaactcctgatctcaggtgatctgcctaccttggcttcccaaagtgctaggattacagacctgaactaccacacgcggcccctccctccactttggactgcacatgcctcctttattcacttaagagaaaggtgaggaacaaagaaaggctaaaagacacgtcacattattaataatcttggctagttgtaacaaagtaaaataaaatgtctcaataaatttttaaatctttgttgcttggcttgtctcattttagcattgagaatcaagcttaaatatccaagtaatcagttataagaatacacaggaaataatataacacttttattcccagaataaaaatagaatgctttcagtcccgggagctccttttctgtttttcattaaatttttttgatgttgctgacacatcccatttaaacgtaatttttatttccttagatatttttgaataaaacgttctctctcctgctgttctgtagcagaaataatattcattggcactgtttgatgacatttcaaaagtgtctcttgcttccattcttagatttgtgttacattttcctccatgaatacacagcatctttttgtagttctctctcataataatagggagaagatgactctgatatgcatttattaatctcttttaaagttacagatatttaatgttgtatcttgcattttggggaacctttttatttctactgattgccctttccctagtggaaaatggtctgtgtcatttagcaataagcttttctattagaaacaacaaaagatattctgacaaattgggacacatcagtgtattttcagccattttatattcaaatcttttttggtgtatttttttttttaatctaatctttgtttctccattctagagcattttcttcttgagtagctcagtaagttatcttgtcacattcataaatgctttcagagaattttatttgagttttaaatggtttcaagtctcttctagcttttaggttgtctaccttggaaagttttttaacttgaactgtacctatgaacatttctgatttaaaatactcctggggccaggtgaagtggctcacacttgtaatcctagcactttgagaggccgaggttggtgaatcacttgaggtcaggagtttgagaccagcttggccaacatggtgaaaccgcatctctactaaaaaaacaaaaattagccaggcgtggtggcgtgtgcctgtagtcccagctactcaggtggctgaggaaggagaaacacttgaacctgggaagttgaggttgcagtgagctgagactttgccactgcattccaacctgggcaacagagcgagactccgtctcaaaaaaaaaaaaaaaatactcccaggctggacatggtggctcacacgatcacttaagtttaggagttcaagaccagtctgagaaacatagcaagacctcgctcctatctactaaataaataaataataaacattagccaggcatggtggcacatgcttgtagttcagctactcaggaggctgaagccggaggatcacttgagcccaggaggttgaggctgcagtgagccatgactgtgccactgcactctagcctaggcatgagcaagaccctgtctcaatcaatcaatcaatcaataaagcattttgtatttgtctctctgctctccctatgctgactagaagcatgacactctccctcttggtacagcactgaggccgtcagtcaccagaatctggtgactcctctatcctcagctcctctgttactcgtctgatctacagtcctttaatccatcatctctgtctggcgcgggttgtttcccaagcctcccagttgcttggccagctttggcactcctacccctatcctctttctcaactagcagccagagttttcctattaaaagctaagccaggtcaagtcactcttggcgctggagtggcttcccatctcgttcagagtgaaagctggtgttcacagtagcctacaaggccctgagtgctctgacctgtcttcttctctgatctcacctcccactctccctctccctctgctctagttacgccagctcttagctgttccttgaatatgccaagatgctcttacctcaagacgtgcactgtcgttgcaggaaacacatttcgcagatatatctatctgcatgcatgacacggtccctcaccccttcaaggttttgctcaaaatgtcactttctcagggaggctttctctgagctccttttaaattcaactctccccacctgcccccaccccccgccccagcttccacatcctcagcaatttctgttcccttcccctgccatgttttggtcaatataacatttaccaccatctaatatgtgtgtgtgtgtgtgtgtgtgtgtgtgtgtgtgtgtgtgtgtgtgtgtgtgtgtgtgtgttttgagacagagtcttgctctgttgcccggctggggtgcaatgtcacaatctcggctcactgcaacctgtgcctgccaggtccaaccgattcttctgcctcagcctcccaagtagctgggattagaggcatgcactaccatgcccagctaattttgtatttttagtagagacgcggt

SEQ ID NO: 3069 - DNA, 2960 bp, Homo sapiens
ggagagtcagataatacagagaggccataccatgaattcttagtcatacctgacctggccactccaggagcgccagaagagttgctggaagcccacatagacatatggtatatgataacatttttttttaaagagatataattcacatgtcatatgattttcccttttaaagtgtacatttcaatggtttttggtatatttacagttttgcaatcatcgccacagaccattttagaacattttattaacctaataagaaagcctgtacccatttgcaatcactcctgctttttcctgcaacatccctagcaactgaaactgtctttgcaaaaattacagcaatgagaaaattatcacagtgaaagagatccgacctaattgactccatcttgcttctaatctccaagctgcccttgttcattcctgggcagaggctaaactaactttgggaggaattcagcttataacttaactttgaagcaaagatgaaaacagccttttcccttaacacagccccttcttgcttggggaccagactgcttgtgtagcactaacaaattagcctcaagattaatgctgacagtccgggcgcacagtggctcaggcctgtaatcccagcactttgggaggccgaggtgggcagatcacctgaggtcaggagttggagaccagcctgcccaacatggtgaaaccctgtctctactaaaattacaaaaattagctgggagtggtggcgggggcctgtagtcccagctactcgggaggctgaggcaggagaatcgcttgaacccaggaggcggaggctgcagtgagccaagatcgtgccactgcattccagcctgggcgacagagtgagactcagtctcaaaagattaatgcagacaggccacgagattttgaacctcccccattgctccgaaagataacatcactattgtaaaacctaagatcagtgctccagacatttttcacactgcattctgatgcaccagctggccccacccagatcggtaatctggctcaaccagttctgggatctcacccaggaacagaggacaggaagaaaaatcccactttgaccccctatgatttcatcgctgacccagccaatcagcattccccacttcctggccccctacacaccaaattatccttaaaaattccagtctccaaattttccaggagactggtttgagtaataataaagcttctatctctctttcaccaagtttttgtaaattaaactcttcattgcaattcccctgtcttgataaatctgctctgtctgcgtatcaggcaaggagaagccattgggtggttacacaagtacttatccactttatgtttctataaatttgcctgttccctgttccgatttttttttttttttttttttttttgagacagggcctggctctgtcacccaggctggagcacagtggcgcaatcacggctcactgcagcctccacttcctggcctctagcaatcctcctgcctcagtaccctctacccccttgcccagtagctgtgactactacaggtgcaggccaccaagtctggctaatttttatgtattttttgtagagatggggtttcgccttgctgcccaggctggtctcaaactcctgaactcaagtgatcagcccatctaggcctcccaaactgctgggactataggtgtgagccaccgcgcctggcctgaacatttcacataaatgtaaccatacaatatgtggtcttttgtgtctagtttattttatataacttaagggaaagcttcctctttgccctctgaaggatcactgaaaaaacaactgatgaaaggcagattaattggagacaaggcatataaatttatcaacatgcacgcgggggagtactgcagagttaccctaacctcccagtggggtataggagcttacataccatctttttttgttgtttttttgagacagggtctcactctgtcacccaggctggagtgcagtgatgcaatctcggctcactgcaacctccacctcctagattcaagcaatcctcctgcctcagcctcctgagtagctaggactacaggtgtatgccaccatgcctggctactttttgtagtttttggtagagatatggggtttcaccctgttggccaggctggtctcaaactgctgacctcaagtgatccgcccgcctccgcctcccaaagtgctgggattacaggcatgagccaccattctcggcccataccatcttgaggttacaaaatgaatggggactcagagcatggccaaaaacagattatagtggtaagcaggttttagtggcaagacaccttatgggagggggaaaagatgaggcctggctagcataagtggtcttgttaggtagatgaaatctcacaggtagcagccctcagaaagaattgatggtaaatacttcttttcgacctttaaaggtgtcagagcctcagttaattgttcctaaatctaaagagaagccccacataagtgaagattttatccactgatgcaaatctctcccaccaaagacagctttgcagggctacttctgtttgcaaggccctttgaacagctgtctcaaaatatgtcaaagaaggatattttaaggtgaaatatttttatttctttcactaacgtgtataaatacttcattccttttttattgccaaataatatgcacggacataggacattttatttataaagtcatcggtgctgggtaaggtgtcagagccccgcgtcgaatagtggttgactcgccgctcgcaatggctcacacctgtaatcccagcactttgggaggccaaggcaggtggatcacctgaggtcaggatttccaaagttccagaccagcctggccaacatggtgaaaacccgtctctactaaacatacaaaaattacccaggtgtggtggtgcgtggctgtaatcccagctactcgggaggcg

SEQ ID NO: 3070 - DNA, 3665 bp, Homo sapiens
cagttcaagaaatttatattcaaaaattttcttaagaatacacatgattttacaagatcattcatcatagcaccaagcctaatattccttaatagaaaacagtcaaataacaaatactccagttaattcccacaggtataaattattcaaatagccatttatatcttaatttacagtaatcaataaataagacggcacattcatatattgtttataaagatctttttttttacaaagctacagctatgtatatcctaaatagacaaaaataatccttgtactacaaaataacatttcattttcctcaatagttttcttagagctctcagtaaaaactttcagacatagtcaattaagccctgcacaataaggaaacattcaatctgctcaatagaccagactcccccaaaataaaacaatgatcaccacccactacaatatggtctgaacaatctcctgtctccaagtttagttaagtctgtcctgaggatgtacagtagggaacgaccatttttccgtgttcacaatttgtctttggcggatagtatcagcaccactgtgagtgacataggcagcatcttatggtgcaatttcaagggcagagggcaggtgtcccctgcaccacattccctccccacagctaccgcccctaccccagggacattctacacaaacacaccagcatttggcttaagggatccttgttggaatgcaaacggctccgattctgagtagaatttcagaagcctttttgagtcgttactcggggaaggggaaaagatgagggatgggaagatctagtcctgtacagctatttattcctgcagttgaacttttgaatttaaaagaaattcccttaggaaactgcctcagatgctgacgtaatttaaggagaccaatttccttctaacagccctaggaagcagatttcccaggttctacttcaaacattcatctgaaacctttaagattcagactaccttctgtctgaccaaactcttcccaaaggcacctttctcagatactaaagccaagaagcactgccctaagctttgggctgatatacagaggtacacttgctttaagcaaataggccacttattgagataaataaaaactaccttcgtaacctttggatttttaaacttagaaaggacttttaaaagaagtcttcccacttccaacccagagaggtaaattcaaggcatctgcaggtgagccacagctaggacgtgggttctccatacccataccagtgttggcctgctttggacaatgtcaactctccagacaacaggcactcccagagtttcctttaaaaaagtgtctaaatccttgcatgacatttagcaatactggcattctggcacagcatgggcttgtagagaatacacacctattgatttttgctggggctaaaggaagtggtagctattgcaaacagaatacaagtatcaaatgatattttgctattttgttttttgtaacaatgcaaaaatcactacttttaagcttaaaatacaggaaaaataataatccctgcctcagagaccaaccagttatgaattcatccaagtaattcgtggtctctacttctccattttaattacactgccctcaggccttctctacttttctttttgaaggagaaagcccaatttcctactctgtgaagtacgtgttagaggtgcagagatgagcagctgggggcaggatgtatagttaattggaggccctgaagaactgtctttgatgttggacactgagattttactgcaaaagaccctttcaaggcggccattttggttgcaaatttgcaactgcagtgaagtttagagtgtttgaaaataacagtcctatgttcccagttctgctacttactagttcacgctatgaccttatttttctgtcctgtgctttagcttcctttccgaaataaacacctcccacgattgttctaagggtcaagtgagttaatgagtaaacaatggcttaaacttcctcttgcaaaaaggcctgagttagatttgagacagggtagctcagaaaaaagtaatggattggagagaggttggaagaagctatggtacactaagggttagggaaagaggtatagtcaacgcttgcttcaagaggaaggaaatagagaaaagggggctgctgggcatcctacaacttcataaactttcaagaaaagtatttttcatccaacaaatatgtgctgaatgcctataatgcacagaagctcagaagttagtttgccaagatcacccagagatctggtgacagagctgggactccaatctaaatctggctgactcccaaacctgacttctttctctagcccacaatacctcccagagaagaaggcagtgattaaaatgaaaacaaaaaaaagggttcctttaaagagaacactgctagatgaagctattcttgacatctgagtgtcagggatttaaacaaattagcagtgcgattgaggccgtggattgttgaggcatgtgtatatttaaaaacaacttggtcaaacagtacaaaatactggttgtctttttcccatagacaagaatgttttttggcatgttgctccagccctggctgggaggaactgcttgcttgatgtgttctcatcaaggttctcagaacaagttctaaacacaaagaagccagtattcccagcattgtggggtctggcaactgcagaacactcagctcagaaactctgataacttttgtgggctcttggggaaccagcagctctgagtctccaggcttttgacccacacctgaccaagctcaccccatgccctgtctcacacacaatggtagagaagtgacaagacctgaaggtcctgtaggactcttaagaaaaatcagagtgaaggccaggcacagtggttcatgcctataatcccagcattttggtaggccaaggcaggagatctaagatcatttactgacaataggcagcaaaaccagggggaaggaaggaaggtaataactaatcatggcattcaagcagagcttagccatgctatgtatccctctcctgcacttggcacagcattacacaaaatcacttagcagaccacagctcaacaggatggatgttgctgcagtcccagctggactcagggcacgttcacaaaccagtcagagcagcaagccccctaagcaacctgtgagataactcaaatggggtttatggatcaagatggtatactgaacacatgagcctgtttcttccctcatgaaaccccatgaaaataggagcagaggaatgaaagttatattaatacaaccatgaacacagaatacagaagagaacagtaagcaagagctagcaacctatttatgcaggaatggaactgatggaaaagtgagcagggagggggatcctaaaaccacatgcctgcagaggggaggccacagagtggtcagcagagatgccctgtggcctccaggagaggcttggggattggaataggagggatggggtgagacatggggctgaagaccagggcatttattggctctgaggtcccctgtccttcccatgcagccagatgaccactgtgctcctactccatggagaaatcagagcagctccaactcagggacaccaggcacagcaaaggttgaagcaacttaatgaaagtcta

SEQ ID NO: 3071 - DNA, 4289 bp, Homo sapiens
ctcggtgcggcacctgagtaacttgtccactgcctgaatcccacactttcttctgtgggagggaagtggcaagtccagacctccttggtaggtacaggagtgtgagctgcagcctggcagcttccctggcatcagatcggctgatttccaggcttgtggcccagcctcctgctgccaggtgtgacgagcgcattggcacggtcaggaagcagcagagcctgcctctgctctggggctcacggacaccagctcgtgcccccttcacacatctgcagatggggagaccaaggcccagagtgggcaggggtgcaccctgagctaatgcagaacaatgtcttctcattcctatgcctgtgcttctcccagcccgcctcgcagtgttggggaagaccacactcgtacacacacacacacacccctaccaccccacccaccctcccagacacacacacattacacactcccccatacacacacacccacactcccctcacatccacactcccctcacacacacacattacacactacatacactcctactctcccctcacacacccacactcccctcacacactccccccacacacagacccacacaccactaccctcacatacgtccacactccacacacacacacacacacccctaccaccccacccaccctcccagacacacacacattacacactccaccatacacacagacccacacacccacactcccctcacatacatccacacttccctcacacacacattacatactacatacactcctacacacactcccctcacacacactcccctcacacacacccacacacacagacccacataccacactaccctcacatacatccacactcccctcacacacacacattacacactccccccacacacagacccacacagccacactctccttacatacatccacactcccctcacacatacattacacactcccctcacacacacagacccacacacccacactcccctcacataatccacactcccctaacacacacgcattacacactcccctcacgtacatccacactcccctcacacacactacacacacattacatacactccccccacacactcccctcacatacattcacactcccctcatacacacacattacacactcccccacacagacccacacacccacactcccctcacatacatccacactcccctcacacacaccacacacacattacatacactcccccacacacacagacccacacacccacactcccctcacatacatccacactcccctcacacacacacacactcccccccacacacagacccacacacccctcacatacatccacgctcccttaacacacacacactacatacactccccctacatacactcccctcacacacccacagtcccctcacatacatccacactcccctcacacacacgcattacacactcccttcacgtacatccacactcccctcacacacaccacacacacacattacatacactccccccacacacactcccctcacatacatccacactcccctcaaacacaccacacacaattacacactcccctcacacacatccacactcccctcacacacacacattacacactcccccacacagacccacacacccacactcccctcacatacatccacactcccctcacacacaccacacacacattacatacactccccccacacacagacccacacacccacactcccctcacatacatccacactcccctcacacacacaattacacactcccccacacacacagacccacacacccctcacatacatccacgctcccttaacacacacacactacatacactccccctacatacactcccctcacacacccacagtcccctcacatacatccacactcccctcacacatacacacattacacacactgcgctcacacatatccacactcccctcacacacaccacacacattacatacactctccctacacacactcccctcacacacaccacacacatattacacacactttcctcacatacacactccccttacacactacacacacacacttcccctacacacacccccacactacacacactcccctcacatatacatacactacacactcccctcaggcacacacactacacaccacccacactcccacacacactacacaccacccacactcccacacacacacctatcacccacactccctcccacacacacaccacacactcccttcacacactacacactcccctcacacattccacacacacaccccacacattacacacactcgcctcatgcacacaccccacacactacacatagtcccctcatacactacacaccacactccttgacacacacacactctccctacacacacatccacacacccatacccctcagcacacacacacgcccccatacacctacatacaccacacacattcattcaccacacatacacactcaccccacaccccatacatacatacacacacacacacacacaagctgtaaagcagtgggactttcacatgtgagatgcccacataagtgcccctgagaggcagctgcatctcaacaccgcggaccctaatgacctggctccctcccctgcgtgcccctccagaggaagcctggaccttgtcacgcacacactccaccaccgcgtgattgtggctaaactccttggcttggcattccaggcccttcctggcacagcccaagcctcccatcccggcagagcccaggcctcccttccattcacctgctcagcactccatgggcatctctgtgcgccgtgtagttactgggcacagagcgggagtcgcatgcaatccctccccacaaagagcccacgagctagtgagggaggcagacccgtacgcaggcactcatcgcacacccggcgggcacccgatggcaaggggggcccaccacccaaggggagtgctgccgccgagggcttcagatggtgcctggccttgtttcacttaatccccgtggccaccctatggggagggaccgggagcaggcttgtgagaatgcctgagcccccgcgtggggaatgaggtggggagggtgcgccacaccgagaggtgacagtgctcgtagctgccgtgcccatgacggggctggagaagggctctgagcagaggacaacccatgacttccagcctccccggcccctcctctgcaacagacctgcccctcctcaacatgccaggcctggcccagcccttctcttctgtggggcacctaggaaggagagaggtgccacttctctcttccctccacaccagagcatagtccagcccaccccagccctttccagctcctccccaaagcacatgcttcatcttgtctgttccaatttttgcagatgctggtccgctctggaacacttgctgggccaggacttatttctggatcagggctggagggggccggaagggcgagtgtaccatgtggctggcctcctctcgacccccattcctgggtcccatctgtctttgccctgtcttttggtcccttggtcctcacatttgtctttctttctctacgtatctctgtcttcactctctggttgactttgtgcagctgtggaaggtgaggctctgcctttcaccagcttgatggtcttggatgagccatttaggcccagttgccgttctcccacctgggaaatggggccgatagcacctgccttgcagggtgcccaggaagattaagttataaataatacattgaggctcctggcccacaataaatggtagctgttgacgtgttctctctttctgtccctcttccccccgcccactttccttctcccctctctgtctgcccccttcttctgctgaggagttgaaaacactctgcccattccccccgccccgccttcagtccacccccattttctttcttctctctgtctctctgcttaagtgaatcagaacacagaactggtttgttctttgttaaatctatcaaatgcctttacgtttccctgttgttaattttcaaagcctgggagcgaagtgttttctgtcttgcgtctgcggtgaagtgttcctcgggcaacccgtcttcctcctgggacggccctgggtggagagacctctggttcagccacagcctgtgaggccctgctccttggctggcccactgtccagcaggcagaggccaccagggcagagagggggtgttccaactcaattcttc

SEQ ID NO: 3072 - DNA, 3192 bp, Homo sapiens
aggtggggaaatggtcaaagagcgatgggcccagaaaagggtcagacccagatggagatgccactggctgctagcagacccccacgctgggtctagcccacccaatcccatggggatgctcctgtgctctgcagacatctgggtgctgccacaggggcccgacagagttggcatctgggtggatctgagccaagtggtgcttctgggcctcagcaagtagctggtgctgattctgggcagccaactgtggcagcatcttcaggtgcgagtgctgctgggtgaagctgcgtgggcagtccagaaagtgacgtgacagtccacagggaccgacgtagggtttccagcccctatctgtgcagatgctgtcctccaaaccatcacggtccctctctggctggggacgtgcgcctgccactgctggcttgccagcatgatcattggttgtgacctgttgagcccatcttgccagcctcacaaaggacagtactagctgcttatgacaggaaagtggaagaacttggcctggatatttctggagaattaccgtgtgtgctagtcagtctttcgtgtcaaccaggccaggctgtggggcccagtgatctcatcgagaggggccgaggtgttgctgtgatcgtgtgctgctggaatgtggtgaacacctacagtcgatttcacctaaagatcatccttgagaatgtgggtgggcctcatcctatcagctgaaagctttaagagcaaaacccgaggtgtcccagagagggaattctgccttgagacggcggcttcccactcccactggatgtccagcccgcggccccacggctgggtgagcccgtcctctcctcgtttctgtctccggacccaccgtgtggccccagaccctccagtgaggacctcccgtatttcttcagagcagcccttgcgtgctggaggcctgggcttcagtgtgtccctgggtgccctggggcatgttctgtgacctcccagctcctcgcctcatggggccgctgtatcaagtgacacagtttgtgtgctgcgtaccatgcctggcacccatttgaggtgttgcaaggaggccatgtttgctcgatgagagcagcctaagatctacaaactgttgttcgagtggatgggaacttgatgctattttcaggctgaatgacaagactccgcgatgcttctcggcctgggctgcacaacggaatctaccagggaggttttaaaaacactggtacttgctggaggtggtggcgcctgtctgtaattgcagctgctccagaggctgaggcggaggattgcttgagcccaagagtttcggtttatttgctttttcagagtcttgctcttgcccaggctggagtgcagttccatgatctcggctcactgcctcagcctcccaagtagctgggattacaggtgcatacaaccaggcctggctgatcttcgtatttttagtagagatggggtttcaccatgatggtcaggctggtcaagatctcctgacctcaagtgatctgcccgcctcggcctcccaaagtgctgggattacagacatgaaccacaacacctgccgagcccaggtgttttgaatccagcacgggcaatggcaagaccctgtcccaacaaacaaaaaaacactggtgcctgaggcccaccccgagagattctgattgagttgatttggatttgaattatctttaaaattttggatgtgaattttttttttttttcttggaatggagtttcactcttgttccccaggctggagtgcaacgggacgatcttggctcaccgcaacctccgcctactgggttcaagccattctcctgcctcagcttcccaagtagctgggattacaggcatgtgctaccatgcccagctaattttgtatttttagtagagacagggtttctccatgttgctcaggctggtcttgaactcctgacctcaggtgatccgcccgcctcggactcccaaagtgctgggattacaggcatgagccaccatgcctggccggatgtgaattatcttaaaaattttcaggtaattctaatgggccaaggttgagaacccctgctctgggcccatccgagcaccaggctgtcacaaacgcatgcatgcactcacgcccgtgggcttggggggcttcggaaatgtgcttctgcttttttgagatggggtctttctgttgcccatcccggagcacagtggcacgatcacagctcactgcagcctcgacctcctgggctcaggtgatcctcccgcctcagcctcctgagtgtctgcttctggttttcatgatgacctggggcccaggcatactacacttgtgctgttcaggggccagtcctgcaccaggagcccatcagccacagctccgccgagaagcactgatatgcagagctaagcagctttgtttccacgtggatcctgcgtaggttttcttggtccatccgtagacaccgcactcctgcagaggatcttctcgggatgccccactgtctctgttttccctcttcactgaacactcagtcggggctcgccatgatgcctctgtgtctgctggcttctcccccattggaacagccttcttggcacgccacactgctagctgctgggcactgtgctttctgcctttaccgttctgccgtgatgttgccaaaatagcagcaacaacaacaacaacaaaggctgggcacctggctcatgcctgtattcccagcagttcgagatcagcctgggcaacatgccccaactggaccctaggcaaaagtgagtggcactcctctgccaggactccaggcaagccccggcatcttcttgctgccgtcccagacaacagaagttaccagatgaacagacttggatgggccacgggggtggagagctggaaagcttggctgtgcctctcgatgatgattaagatttcaatatttacagcaaaaccacaaagcaaatgatagaataaagcaaaacaatggaaaatctgagttcactcgtgagagaggtacgtatgtgagctctgaggaaattacagagggaacgcatgcagcgggacagctctcccaatcgcagcgtgcaaagtagacatccatagtgtcttttgaaaaatgaaaaacacattactttgaacagccaagaaaaaaattgcaatttattaagattcaataaagcgttgtactttcgaaagca

SEQ ID NO: 3073 - DNA, 4682 bp, Homo sapiens
gactcagtgcatcaaaggctggagaaagaatcaccctagaactgagtgccacaggcttcggaagctgcacaagactgcaacacggtgacagcttctatttctaacagcaaacctaaaaagctcaggaaccaaaataaaacggatagaaatgaaaccactcagagtatgacgacagtactcaaagcaactcacgagcatttccccacgctgtcttccaaaatgtgaaaaatgtgatttttttttaatggccacattggagaactgctatgagcagacctcatttatataacccttcccagcacctcatgtatcatcattattaaaaaacactatggggatcatgctttcacataactttgtcttatttgttatctacatagcctaagcaaatagtaaatgatggagaatgaaaataattgtcaatgtttagggggaaaaaaatacctgcatttcaaattttttaaaaaaaccataaaatctatcttttaaaaaaggaaggagtaagctggaatccacaattgttagaaacccaaaagtgatacagaggggaggcaaaaaaaaaaaaaaaatactatattctccacactgaaacaatgtatctttctcaacagcccagtttcatctgtagctgtattttccccactgaaatgccaccattaatcataacaacagatgagtaaaaatcaattaatattccttcagcatctcttaggtgtcttcaatcctgtgcgctgtcatccctttaaagaggaaggaaaagatccacagccaggaaacagactcagaaactcaaacccaggtctctggaccccacagggaagtgaggcacagccaagagcaatctgtgtccattactggcctcaaatgaccacatggaaacactgtgtgcagagccagccccccaagcccgtggcggtcctccttggagatgatggggtctggggagaggtcagagtcaggctcacgtgaacttcagaaagccactgcccaggatatgggtggaccgcaagtctaccatgggctgtcccagctccaaagacgtcagaaccccacagcgattgttattcccaaagccctttacgcttggctccacagcacacggcagagaaaatcgacagaaggaaggatgttcacaggtgtccacccctacctatgccccagtgacctggaaataaaatccatcaagagcaccggggtcagccagctggggtacgctggagagtatgggtggcagagggaaccccgctgtggattgatcatttgacactgtgttcagcataccttttaaaaaaatgttggtaccatgtaaaaatataacctaaataacaagtacatttttaatgctgagatggagaatttagcacctataatccttccagagatgcacaccacgcaaccacgtgagtcccctctggctctgaattccgagagcagctaccaacacaggcctccgctgcctgcactcagcacacctatcggaaagcgccagtgctggcatgggctttccctccctggcggctgctcctcctgcacccccatgcccaggcactccggccagaaacaagggaggagtctggggactgatcctccccctctcacctcccacatctacccaggtaccacaccctgccatctgtctcctgctgccctctgtcactgcaggagcccctggagagcacatcacccctcactaggctgcagccacagcccctctcagaaaaccctgctgtctgctttccagtgcagccctgtctaatcaccctccatgtatcctccccatggctcttcccccatagcctcaggttggagcacccagctttcgcctgcagaagcccctccatgcccccgacacagcaccccatgaacaactcacctggcaccgctactctctccagcctggtctctcactagccccctcaagcctggggctgtagcctttccaagccattggcagccaaaggacccccttccccagctgctgtgtgtggccctggccatgctccttgtctgtaaggccattctaacacctcgcctcctgccagcccctacgcccagtttattccatgtcaggaggtatggcctccatcccctgatggcccactcctccttacatgcccagccttgcgtcctcaccactcccccacagctcagacaggcctgccctgcccctgggcttgggcatccccacggtttccctgccagtgggcatccccacagttccttcgcctccagaggcccagcacccagttctgcctcggccccaggcacatggaccttcccttgggtcttagtgtctctttctcagacttgccttttcttggtggtttgatggtcacccacccaacctccttccctgaaagtctggtgcaggaaggggtaaaaacacatatacaaaggtcaccagcaagccagccagcaccagctctggagaaaacacggacagaaagacgtatgcccaccattcactcattcgcaagccgggagaacttacttacttccttgcctgcttgagaaacagccgccgcaccagagactgggtttcatagtgtctgaattctcaaggaatgtggatggaggacagtgaatctctaactggctgctgcacttctcacacttacagcttgctcattcgcactttaaagtcaaacctcgagtcccctcatgccagcagtcaccttctccccgatcttttacagtaactggggaaaggcagcccagagaacaggccagggcagaggtcaggctgcaaaacatgcttccctaaggacgtccaggctggagggggcccggcagcaggtgggtctttctttcagggtcttcctccaccaaattcaggactattccagaaagaggcagtgagtccctggatggggaaaccgctcctcctgagccttccccacagattggatcggagtggaaggtgcccccaggtgacagcacctagcaaggctgatgcaggccttctgcctggcccacaggagagccccagccccactccccagatcacagacgaccaaggctcctgtgtacgggggaagtaatcatagtgccgtgcttggcacttggtcattttagcaactaggtgttttagaaggaagcacaaggacctaggaactgggttgagctctgtcaggccttgcctctcagttaggatctgttgggtagatgggctcattgccactaaccagactcgtcttccagggagccttcctgatttaccaggctgcgtgagggccctcctctgtgcctgtctggtgtccctgcctaccttggccactgtctgcagacatcacagagagttgaaggggcctggcttgggcctgtgtgagcccccagcacctggggcctatccatagcaagtgtcggggaaactgctgcatgttactgcgtcccatctgcacggcctggctatgaggggccctcagctcagcactcagtgagaccaactcaacactgaaatggtggagtcagggtggcccgtgcgtccagcattcccattaccatactacagagcacggggctgaggaaacaggcacttgccaccatcaccatcatgacaagtagcctctcaagacaggaggtagagagcatctggtcccacgacccttactacactcttcccttgtcctgcagcccaactccctgctctaaacacaaagtaggacatcctcttcttctgagctacctgggtcctggctcccctgcaacttcctttcctgcctgagcagccctgagcagacagtgctgtgtctttcatgatcatcatcacgtggcccaacagaccaggtctgcagacaagtccactgccaagcaagtctcggagcacagttctgggccccagagtcagcccagtccagcccagccccatcagggcctctggacagcctgagagcaaggcctcgtgctgtccctctccgaggaaggatttgcctcaggcctggttctgagaagtaaacagggtaatgttctgaagcagtggacttcaaaccaaacccccacaaaataaatgtttaaaactacatatctatttgcacatttttaagttgatatgaaaaatttctcatcataagtctaaatacttgtagaggatgtaatttccaacatactgtaaatattaacatttaaaaataaaactgttaatgtttctcttttaaatggatccaatggtatctaaataccacggcgattagagattcgccatcatccatttttaaattacataatcaagctcttctttaaccattggaaatttaacagtgttccttttttcctccacaaactctgatctccctcagagatgtttatactatcacagtgtattttatgcttgaaagccttatactgattatcctattatatactatagggccaaaaaatacaaaaatcaatgttttaattttttttaatttcctgtgatttcctgtgatcataaagctctgtcagaagttttctcctggactgaattattataacaattactataagtatacaattgatcaataagacagaaatatattgcaaaattgtataagaaataacctttaaaaataaacttaattaggccaggcgcagtggttcacgcctgtaatcccagcactttgggaggccgaggtgggcagatcacctgaggtcagcagttcaagaccagcctggtcaactggtgaaaccccatctctacttaa

SEQ ID NO: 3074 - DNA, 4701 bp, Homo sapiens
gactcagtgcatcaaaggctggagaaagaatcaccctagaactgagtgccacaggcttcggaagctgcacaagactgcaacacggtgacagcttctatttctaacagcaaacctaaaaagctcaggaaccaaaataaaacggatagaaatgaaaccactcagagtatgacgacagtactcaaagcaactcacgagcatttccccacgctgtcttccaaaatgtgaaaaatgtgatttttttttaatggccacattggagaactgctatgagcagacctcatttatataacccttcccagcacctcatgtatcatcattattaaaaaacactatggggatcatgctttcacataactttgtcttatttgttatctacatagcctaagcaaatagtaaatgatggagaatgaaaataattgtcaatgtttagggggaaaaaaatacctgcatttcaaattttttaaaaaaaccataaaatctatcttttaaaaaaggaaggagtaagctggaatccacaattgttagaaacccaaaagtgatacagaggggaggcaaaaaaaaaaaaaaaatactatattctccacactgaaacaatgtatctttctcaacagcccagtttcatctgtagctgtattttccccactgaaatgccaccattaatcataacaacagatgagtaaaaatcaattaatattccttcagcatctcttaggtgtcttcaatcctgtgcgctgtcatccctttaaagaggaaggaaaagatccacagccaggaaacagactcagaaactcaaacccaggtctctggaccccacagggaagtgaggcacagccaagagcaatctgtgtccattactggcctcaaatgaccacatggaaacactgtgtgcagagccagccccccaagcccgtggcggtcctccttggagatgatggggtctggggagaggtcagagtcaggctcacgtgaacttcagaaagccactgcccaggatatgggtggaccgcaagtctaccatgggctgtcccagctccaaagacgtcagaaccccacagcgattgttattcccaaagccctttacgcttggctccacagcacacggcagagaaaatcgacagaaggaaggatgttcacaggtgtccacccctacctatgccccagtgacctggaaataaaatccatcaagagcaccggggtcagccagctggggtacgctggagagtatgggtggcagagggaaccccgctgtggattgatcatttgacactgtgttcagcataccttttaaaaaaatgttggtaccatgtaaaaatataacctaaataacaagtacatttttaatgctgagatggagaatttagcacctataatccttccagagatgcacaccacgcaaccacgtgagtcccctctggctctgaattccgagagcagctaccaacacaggcctccgctgcctgcactcagcacacctatcggaaagcgccagtgctggcatgggctttccctccctggcggctgctcctcctgcacccccatgcccaggcactccggccagaaacaagggaggagtctggggactgatcctccccctctcacctcccacatctacccaggtaccacaccctgccatctgtctcctgctgccctctgtcactgcaggagcccctggagagcacatcacccctcactaggctgcagccacagcccctctcagaaaaccctgctgtctgctttccagtgcagccctgtctaatcaccctccatgtatcctccccatggctcttcccccatagcctcaggttggagcacccagctttcgcctgcagaagcccctccatgcccccgacacagcaccccatgaacaactcacctggcaccgctactctctccagcctggtctctcactagccccctcaagcctggggctgtagcctttccaagccattggcagccaaaggacccccttccccagctgctgtgtgtggccctggccatgctccttgtctgtaaggccattctaacacctcgcctcctgccagcccctacgcccagtttattccatgtcaggaggtatggcctccatcccctgatggcccactcctccttacatgcccagccttgcgtcctcaccactcccccacagctcagacaggcctgccctgcccctgggcttgggcatccccacggtttccctgccagtgggcatccccacagttccttcgcctccagaggcccagcacccagttctgcctcggccccaggcacatggaccttcccttgggtcttagtgtctctttctcagacttgccttttcttggtggtttgatggtcacccacccaacctccttccctgaaagtctggtgcaggaaggggtaaaaacacatatacaaaggtcaccagcaagccagccagcaccagctctggagaaaacacggacagaaagacgtatgcccaccattcactcattcgcaagccgggagaacttacttacttccttgcctgcttgagaaacagccgccgcaccagagactgggtttcatagtgtctgaattctcaaggaatgtggatggaggacagtgaatctctaactggctgctgcacttctcacacttacagcttgctcattcgcactttaaagtcaaacctcgagtcccctcatgccagcagtcaccttctccccgatcttttacagtaactggggaaaggcagcccagagaacaggccagggcagaggtcaggctgcaaaacatgcttccctaaggacgtccaggctggagggggcccggcagcaggtgggtctttctttcagggtcttcctccaccaaattcaggactattccagaaagaggcagtgagtccctggatggggaaaccgctcctcctgagccttccccacagattggatcggagtggaaggtgcccccaggtgacagcacctagcaaggctgatgcaggccttctgcctggcccacaggagagccccagccccactccccagatcacagacgaccaaggctcctgtgtacgggggaagtaatcatagtgccgtgcttggcacttggtcattttagcaactaggtgttttagaaggaagcacaaggacctaggaactgggttgagctctgtcaggccttgcctctcagttaggatctgttgggtagatgggctcattgccactaaccagactcgtcttccagggagccttcctgatttaccaggctgcgtgagggccctcctctgtgcctgtctggtgtccctgcctaccttggccactgtctgcagacatcacagagagttgaaggggcctggcttgggcctgtgtgagcccccagcacctggggcctatccatagcaagtgtcggggaaactgctgcatgttactgcgtcccatctgcacggcctggctatgaggggccctcagctcagcactcagtgagaccaactcaacactgaaatggtggagtcagggtggcccgtgcgtccagcattcccattaccatactacagagcacggggctgaggaaacaggcacttgccaccatcaccatcatgacaagtagcctctcaagacaggaggtagagagcatctggtcccacgacccttactacactcttcccttgtcctgcagcccaactccctgctctaaacacaaagtaggacatcctcttcttctgagctacctgggtcctggctcccctgcaacttcctttcctgcctgagcagccctgagcagacagtgctgtgtctttcatgatcatcatcacgtggcccaacagaccaggtctgcagacaagtccactgccaagcaagtctcggagcacagttctgggccccagagtcagcccagtccagcccagccccatcagggcctctggacagcctgagagcaaggcctcgtgctgtccctctccgaggaaggatttgcctcaggcctggttctgagaagtaaacagggtaatgttctgaagcagtggacttcaaaccaaacccccacaaaataaatgtttaaaactacatatctatttgcacatttttaagttgatatgaaaaatttctcatcataagtctaaatacttgtagaggatgtaatttccaacatactgtaaatattaacatttaaaaataaaactgttaatgtttctcttttaaatggatccaatggtatctaaataccacggcgattagagattcgccatcatccatttttaaattacataatcaagctcttctttaaccattggaaatttaacagtgttccttttttcctccacaaactctgatctccctcagagatgtttatactatcacagtgtattttatgcttgaaagccttatactgattatcctattatatactatagggccaaaaaatacaaaaatcaatgttttaattttttttaatttcctgtgatttcctgtgatcataaagctctgtcagaagttttctcctggactgaattattataacaattactataagtatacaattgatcaataagacagaaatatattgcaaaattgtataagaaataacctttaaaaataaacttaattaggccaggcgcagtggttcacgcctgtaatcccagcactttgggaggccgaggtgggcagatcacctgaggtcagcagttcaagaccagcctggtcaactggtgaaaccccatctctacttaaaaaaaaaaaaaaaaaaaaa

SEQ ID NO: 3075 - DNA, 2602 bp, Homo sapiens
cgccccccgctgccctccgcgacccgcgctgacgtcgccgcgcagcccgttacgtaacccccctccccgcctttcctcgcgggcccggcctcctcctccagcgccgcctcgcctgccgcagcgcctccgcgttccgctttgcgcccaaagggaaactgaggcccttctccagcagagcacggcgggtagtgcccgcgggagtggctgtgaccgtcctcgttaggattcttgggtccctaggggagcccagactgcgaagggagccccagctccgcctgggggactcggcttcctcctgtctaccgcgttcttccttcctggcctggactctgggggctctggagtcttctgtggccgctccacccacatttgtgcctgggccaccatgtgccttaaattataaagtcgggcagtgacgctcagtaggggttggtttctccaccttcctctgggtgaccttaggcagattttgcctctccgaacctcagtgtccccacctgtctaaaatggccccttccttctagtgtggtggggaagaacagcagcatgtcgacacccggtgagtacttagccaggtagctgtgaactctccttatctaaccctccctgccaggggcctgccacagcgccagacctgggcctggttaggtggtgcccagctgggccagtcagctccctgtggaccttggcctttgccctgggagcatgcggtgcaggcctgccctgtggctcagcagctgcagaatggctggtgttctgtggcctggtgatggtggggagtgggtgcttccctgtcaccttccttacaagaccctgggagcacctgagggtcccttgcggtcccattcatggtcttactaaggtagctcacccagaacctgttttgagcatctaggaagagcaagctgtgagatgaggaaggtatctgcccaggccttctctgagctcctcagacactgggaacctcagtctcttcatctcttccttgggcatagatatcatacctccttcccttccctcctgcttggcccctgccagcatgagatgaaatgtcactttccctactcccacaaattggcttggacataagcccagggctttatgctcattttacctttttttttttttttttttttttttttgaggacagagtcttgctctgtcacccaggctggagtgcagtggtgcgacctcggttcactgcaaccgccacctcccgggttcaagcgattctcctgcctcggcctctctagtagctgggactataggtatgtaccaccacacccggctaatttttgtatttttagtagacatggggttttgccatgttggccaggctggtctttaactcttgacctcaagtgatccacccgcctcagcctcccaaagtggtgggattacaggcgtgagccaccatacccggcctcattttacctttgagcaaacatatgagaggagaattagtgtccaggccacacggcaccagcctcgcctttgacaattgaggaaaccaagagggggagtcgctcttccaggcagggtaaccagtcatcctggtttgctggaaactgaggggactcaggctttactgggaaaactgggagttaccctatctccaggatacacacctggcaagtgacagtgtcttatgttcaaagtctggttgccgagcctgtgtgtggcaccaaactattgccttcaattttttgtttgctgaattaataaatgcaaatgaatgaatgaatccttccctctcactgcccttctcagtcctccttgggcaccttggctcatgtgccttggtctgagtctagactgtgccagcagcatcctgtgggaggccagatggctggttccgctgctgagttccaagaaaccccttggcccctgcttggttcagcctcagccttcaggaaccccccagggtccacccaacaggcttgtaccgtgtgcctagggaggaggctgggttcccacctggtgagccactcagccccgtagtattagcggtttggcttcagacttgtcactttgcttcttggagctcagtttcctcacctataaaatcacagtactgggggctgggcgcggtggctgacacctgtaatcccagcactttgggaggccgaggcgggcagatcatgaggtcaggagattgagaccatcctggctaacacggtgaaacctcgtctctactaaaaatgcaaaaaattagccgggagtggtggcgggcacctgtagtcccagctactcaggaggctgaggcaggagaatggcgtgaacccgggaggcggagcttgcagtgagccgagattgcaccattgcagtccagcctgggtgacagagcgattctgtctccaaaaaaaaaaaaaaaaatcacagtgttggttgggcgcagtggctcacacctgtaatcccagcactttaggaggtcaaggtgggtggatcacccaaggtcaggagttcgagaccagcctggccaacatggtgaaaccctatctttactaaaaatgcaaaaattaggccgggcacagtggctcatgcctgtaatctcagccctttgggaggccgaggcgggcggatcacctgaggtcagaagttc

SEQ ID NO: 3076 - DNA, 2372 bp, Homo sapiens
ctgtactgttggatttaacacccaccccgctgaggcaagagggtcctggcttagagatggcaaagcccgccttctgggcagggcagaaggtggctgtgcagcctcctggagctccagcaggaccggcagagccctgagtcagcctcgtaaattgtgtgacaggcaagaccagaaagggctgatgttgaaacctggagaggagccctgcaggagctctccaggagggagggccctctcctaatgatgctggcctgaaagggcctgaggccgaaaggtgagggggcggggctgttcaggacacctggtctgtgtactcacggcctctatctaccctgttcaggggaaccccaaacctgcttttctttctttctcagcctctcctccctcctcacaccctggatgctgagagcagggcccagctctgctctttccacaacatttgggccatgttggcacagagcgggggcctcttgggctatggtggccacactccccgggctaactgagttacctgattcccagcggaaaggtcaggaagggagggaagaaacttgctgagctacaaattcgagactgctggggctttctaggacaggccaccttcctgcaattgtccctctgtgtccccaactccccgcagtcccgcaggccaggaggtgggtgcctgatgagcggtgcttccctcagatgatatgtgggcaccctgaagctctcacgtaatggttctgctgtgccgggttgtgacccagctgtccttggtaggctctcctgtttaatgagcaactgctatatgccaggccctgttctagaaacagatgaggcccctgttcccatggaacttagatctgagtatgtggacagagtgagtaggttgccagataatgtcagaggtaagaaaaaagccaggcagaggacagcagtgctggtttagacaagggttggcaaggcctccctgataaggggacgtatttgcgcagacacggaagcagtctgatggaaggcttgccctgtagggacctggggtgcagactgagctgggagggctcttggcttgctccaatgaggtaggggcgaagagagggcagaatggcccccgtgctggtccagatgtggccagcgccagatcgtatagagccgtggaggcacggtaaggacttggggtttgagggagatgagggccctgagcaggggtgccatgatctagcctctgctccagaaggatctgtctggctgccatgtgggggacacggagtggagcaaagacgggagcccagtgagagtcgagggagaggtgacctcagcttgggctgcggtgcaggccatgggactggcaggaggtggctggggttacgctgtcttttctaacattcagcattggctcaggggccaggtcagggctcacagactgttgctataaagggctgggtggctttcttccccacagctactcagcctaatgccattgcagagcacatgtagccatggacaacacaaggggcgtatccgtgttccaggacagccatattgacaggaataggcaggaggccagatttggtcctcaggctgtaatttcttggccccttgtctagggagaggtaaacgaggggaggagagatcagtcaaggatgacgtgagggtttgctgggagcaccaggaatcctggagaaggtagtggcaagagggtgcagcaagctcagctgggcggggatcaagtctgaggacttaatgtctcctctgatctccagacccataagggagatgctgagtagacaactggggcttatgggtctggagttcagaggagagatcgggaaggtgtccatttggagtcatccacgcagagatgtgtgaaggctgctcaatgattttgaggtttaaagaaaaaaagagatgtgaaaccaggggccctgatgaggctgcccaggtggtaaggaagacagaagagaagccatgggacagctgagcccgggcaccctcaagccttggaggcatgaagtttggtggggatctggcaaagaacacctgggagcagccagcgggcagcagaccccagagtagcagggaagacaagcacttcaaagaggcagcgtcagccaggggcagtggctcagctgtaatcctagcactttgggaggccaaggatggcagatcacctgaggttaggggttcgagactagcctggccaacatggtgaaaccctgtctctactaaaaataaaaaattagccaggcattggtggtatgtgcctgtaatcccagctactcgagaggctgaggcaggagaatctcttgaacccgggaggcagaggttgcagtgagccgagatcatgccattgcactccagcctgggcaacaagagcgaaactccgtctc

SEQ ID NO: 3077 - DNA, 904 bp, Homo sapiens
cggtggatcccctaccaactgcagcttggctgcggctgtgaggatgagggcagggctgagcccaccgtggaggaagtacagtgtcacatggcaggctgggaggggcctctgccaactccctgtccctcaactcccaccaccaagcccaggccacgaagacaccgtcctgggcactgccagcagctttattagagagccctgtcccctgattaaaagtggacacgtgcccacgggggtctcctccttcccggtgaggggctcagctggggtgcccctgtggcaccactcacaggccaggagccagggaagttctggggaagcactttcccagaaacccaccccagaccccaaggtagctcagggcttctcagaggcaggcccagatccggtcccaccgcagggaccaaccatgggccccgcctgcctgaggcctgcagcgggccaagccggctggcatgggctggcctattctgttgggtgggttcttggcccaccagagctggacaggcaggtgatcaagccacgttgggtgtgctgggggcctccgtgggcactcactggggctctggccagaagacctgcatgacgctctgcttcctggaggcggtgtggcaggcttggcagcgctggaagtcacaggcagggcactggaagggcaccacgtcctctgccccacagccctggcacacacagcctgctgagaggggcccgcccggagctcccgtggcctgctgcccagcgatgtctctcccatgaggctcaccccactcagatgctgcaggcccgtggggaggtcctgaggactggctgggacctgcatcctcaccgcccgcccccacagtccctgctggcctctgtctaaggaaggacgagatcttgctctgggtcttcccggtcttctcgg

SEQ ID NO: 3078 - DNA, 2239 bp, Homo sapiens
atggaatggaatggaatggaagacattaacgtgtatcatacatggtaagagtgagtatttgagaaattggtttcaataatgtgtgtgtgtgtgtgtgtgtgtactgcgacacaaagaaacatattttggactgtgagttgtggtcaaaatagccttaaaataattgaactaagccagaggcattcctatctcctttatcagacactcactttcccagcctttcttgcagttagagtaaccacagttgtgcaaatagtaaaaactgaagtgtacagacaggttctgctcagtgagactttcagggaaagttttccttccagaatacaaagacagagtttctccagaaagacagtcttttgctcctgcttccagttttgaatacagttgagatgactagagctgtggcagccattttgcaaccacgggacaacaaacctgaggctgaaaagcccaccagcagaggatggttgatgggagctgacaaaaagaccgtgttcttttttttcttttgagacggagtctcgctctgtcacccaggctggagtgcagtggcgcaatcttgactcactgcaacctccgcctcccaggttcaagtgactcctgcctcagcctcctgagtagctgggattagaggcacgtgccaccacacccggctaatttttgtatttttagtagagacagggttcaccacgttagccaggctggtcttgaactcctgacctctagtgatccacccgcctcagcctcccaaagtgctgggatttcaggcgtgagccatcgcgccggcctgactgtactcttcataactcttcatgggctgcccgcctccaaacttgttaatccttatggtttaagccactatgtggtttcccattatttgcagacaaatacaacctgacgcaaaaagagctcccatttctggattttctttgcaacccatggcaaggcctctcacatgggtcaagggctgttctttgtgggtcactgattaagaagagaggtcaaacaaaatgtgagagggctggtggaaaggggatctgaaacaaaggccactgtggttgattgcaaagtggccagaaattctcctccctcgtcccacactctttgcagctcctcctattaagaagtggggtctatgacttcagcccttgaccctgggctggcttcttgacttgctttggccaacagaatgtggtgaaagtgatggtgtgtgattctttttttgagatggagtcttgctcttgttgcccaggctggagtgcagtggcatgatctcggctcactgcaacctccacctcccgggttcaagcgattctcctgcctcagcctcctgagtagctgggattacaggtgcgtgccaccacacccggctaatttttgtatttttagtagagacggggtttcaccatgttggtcaggctggtcttgaactgacctcgtgatctgcccgcctcggcctcccaaagtgctgggattacaggcatgagccaaggagcctggccgatggtgtgtgattctgagcctggcacacttccagtctttgcccagctgccaggtgaagaagcccaggctggcctgcaagaggatgagagccacgtgcccatcaccccatcaccccagctaacagccagccaagccctagacgcagtcaccagctgtccaacagctgactacagacacccagcccaggccagaagcacctagctacgcccagtccaaattctaaccgttgggatcatggttttcttttttctgtttattattattttgattttctgagacagggtctcgctctgttggccaggatggactgcagtggtgtaatcacagctcactgcagccttgacttcctgggctccagggatcctcccaccttagtttcctgaagagctgggactataggcgcacgccaccacacctggttaattctttgcagagacggggtcccactatgttgcccaggcaggtctcaaatgcctgggctcaagcgatcctcccatcttgacctcccaaagtgctgggattacagacatgagccactgtgcccagccagggctgtgtgttatgtagtgacagctcactgatacagctctctctggggacttaggaaccaagtttgaccccacatctgactcatccaagttttatccatcccacctcccatatctctccagtcagtgccctcctgtccatgaccactattctggcccaaatgtagtaaatgtattttctcatcacc

SEQ ID NO: 3079 - DNA, 2033 bp, Homo sapiens
agtatgatgttagctgtgggtttgtcgtatgtggcatttattatgttaaggtatgtttcttttatgctcagtttgctgagagtttttatcataagggatgttaaattttatcaaatgcttcttctacatctattaagatggtcctgtggtttagttgttcattctattgatatgatatatcacatttgttgatttctatgtgttgaaccatccgtgtatcccttgtataaatctcatttgaccatgttgtattattgttttatatgctgttggattcagtttgctggtattttgttagaggatttttgggtctatgttcatcagagatttgggtctgtaatttgtttttttgttgttgcatccttgtctgttttcggaataaggataatgctggcctcatagaatgagttagggagaattcccttccctttaatttgtttaaatagtttgaagaaaattagtgttagttctttatacatttggtagaatttagtaggggagccatccagtttgggacttttctttgttgggagactttattactgattcaatctcactacctgttactggatacctgggcttcttaagctgcttcaccatctcttcctgcctccttcctgtctcctcttttacttcttcttcttctttttttctcaccacttggtaaagtggctggtatggcaccaataggacacaaagatgctattttagaataacatacggagactaatatactttacctagccttgcaagattactggctcaggagaagccacaccagggttccccacttctcccctgtgtttatgcagatgggatgcgagccacttgcaggcctggcctataaaagattcccatacatgctttccattctcagctccctttccaactgactgggatctcaatgcccatggagcccttggaggccacatactgaacacagacaagtctccttcagtcagagtctctgaaagaccgtgtcagggagagctgctccaccaaccttgtagcaaaaaatgtgtttttattatgttaagccactagaattttgaggtctatttgtttctacaagttaatgcaatccacttagcagatggctgcatggcccataaaagagatgatgaggatttggttcagggatgaggccacagggaataaaaatgcaaagataaactgtggctcaagccatacaagctttcctcacattgctcagaggaatggagaggagttaaaggagtccattggagttgaatgaaagctctactgcctggaaggaactcctgcaagcaggtagccaaatagatgatgaagctgatggtggaggtgtcagtcaggaaaagtagtagccatggcaacagacttggtagaaaggccaccaagaggcagtacagagcaatttggccgggacaaaacagcaggaagatatcaataacagagatggaaactgttgggactcgggaaggcagaggtggaggccctgggtttagctcagggggtttgtgctgtctttctccttgcctcgctctccctgccataacacactgaagagagtgttcagaagcccaagctacagagggagagaggaggatgaataggtctggaagaaggaatttgcttgagttctttcctcttccacttttcctgtccttttcttcaacacttatcacagatcctccctggttgcttccaagcagaatagagcccaggctgccatgctaaacacgactaaaacattccagagatgtcatcaagccccaaacacttgctagcaacacattttaagagtgtatgtggtatgggggcggagtaaaagaatttattagggggataactaatgattttggcgggtctcaaagataattgttttgagctgttatttatcctgttttacctctgcccgccttttcccatcctaccccaattctcaaatcctttactaagtgtttaagagatgcaaatgcccttccccccttccctatcctgctttcttttgctgtcagagtctctatttttacttctattttttcccccag

SEQ ID NO: 3080 - DNA, 12269 bp, Homo sapiens
aagccaggacccatggagtctgatctacaacacaagcagtagcagttccacatctccctaccacctcttatttcctacgaagtctttctgcctgaaactggaaaacccgaactattattgaggaagtgaagcccttccatttgaatcctgagaaagacgcgctcaaagaacccagcgaacaaaggagagggttggagcccacgcaaaacatgggtgtgataaagccacacgcgacctgagcccccaccctcagtaactactctccagcgcccaccgggaggaggggtccggggaaaggattggcatcctctgcttctgcagaaaacatggctaccaacagcttctgtatccacctgcggaggagactgactgctctgttattcccccagcatctgtgaagaggctctgactggctaaagtgttggaaggagtctgtagctttaggggaagacagagccacaagatggaaggagcttggatgtctgaactattccatggagaaaagctgcagccaacgaagaacacctgcaatggactcttaacctgggggtgacgacaaccactgaaatatgctgcatcttagtccagggatttttaaagtgtggttcctggaagagctggatcagagtcatctgtgttgatggtttaacataaagattttcgagccccaagactcaagtaggacaaggaatttgaatttttaagcagctcacctgacttgtctgtcctctaatgtctgaagacatctgacctctgctctttcagtaaaagcaacaatggttttatgagcattgtcgtcacatctctccactcaagggatccttctcatttctcccagctgaggtcacccacagctgctgcttctaactgctggcttccagcctgctgtctgccagctggctctaccctctcctataacacggcagagagtagctgtggtctcctgcgtgctcaccctctgctcccttggtcctgctccatgctttggtcctgcacttaaattttacaagcatactctctttctcttaagaatgattttcaatgccatttagaggaaatcttgggatcaacttgggaaaagacggaggctcctggctctgatctttggggacttcagattttctggatcaaggtgagatactacaaatttgtaagaagaaaagaaatgttttctcttttcagcataaaagccataatgttaaggatattaaaaaatatcatgtaatgtgcactttgcataaacttatctgaaatttagcatgaaaattgttttttactctgagctacagggaaggtgtcccagaagaaatgaggcttgctcactccatgtttccatcaccaggggattgtgtcctgcagggtcactctgcctgcattcactaggcctgttcagtcttagggatttgcaaaggttctcctatccttcaggacttctgtttggattgttcggaaatgtcctttgtgattgatggctcttgcctcatcacccattcatgatgaaggggaataagctgattaaacacgacattttgtgagccctccatttcctcttgcttcttgtattagttttctatggctactgtaataaatcaacacaaatttagtggcttagaacaacatgaacttgttatcttgcatttctgtaggtttagaaatccaacacaggtctcaccaggctgaaatcaagttgttagcagggctacgttcccttctggaggccctgggggaaagctgtccccttgccttttccagcttctaaaggctgcacacattccttggcttctagccccttctttacatcatcaaagccagcattgttgcatctccctgaaggtccttgaagtgtaaacccattcttcagttcttatcattccactaactgccccttactgcctcacttttctacctttaaggacccttatgattacatcaggaccacccagataatccttgatactctcctcatctcaaggcccttaacttcatcatatctgcaaagtccctcttgcaatgtaagctaacatagtcacatgttcccgagattaggatgtaggtatctttgagggagggcattattctacctaccactcttcttattaagattatgtatttctttaaaaattaagaaacataaagtttattgctatattataattttcatcatgataaagtcaaggttgaagtgcaatagattatttgtaaaaatggtcacaataatttcctgtcttattgggcatggcagctcatgctgaggttgggggaaggattgcttgaagtaaggaattcaagaccagcctaggcaactaagagagattccatctcttcaattttttttttttttttttttctgagacaggatcttaatctgttgcccaggctggagtgcagaggcatgagcttggccttctgcaacctctgcctcctagtctcaggtgatcctcccacctcagcctcctgagtagctacaggtacatgccaccacacctggctaattttttaaaaattcttttgcccaggctggtcttgaactcctgagctcctgtgatctgcctgcctcagcctcccacagtgctgggattacaggcatgagccaccatgcctggccaaaacatttttaaaaaaatgatttcctttcctttcctgtatccacacccttatgaaatcccctctcatgtggactttgagcttggccatatgacatactttggccagtgagactactgcaaacatgatggaagcggatacttaaaaagtacttgcacactgggacttgccttctcttgctactcttaagccctttctgactaccatgtgaagaggcctggtgcatatactaagtgagaagatacatgtgacctaggcacctttgtcatcaagccaacagctaacactgggaggtagcaccaatcactaagcagcacaagccaccagacatttagatgaggccacctgagatcatccaggcagcagctgacccggcagaaaccacaggtatgtgaaagaggccagcagagggaagacaagctgggccagaacagaagaattgtccagctgaacaacagaattgtgaactaaattaaattttggggggatggttggctgtgtggcaaaggttaattaatgtgggaagggataggtaaactagaaaccaaagttgagaataaggttgaataaacgaaagtttagttgcaagggagtggtgacaaagaagagcccttaaaggcaaaatcatagacaacgttttttggagagatcatttgcacaagtacagtagaggcccctccttcctcctccaccttcatgccctgactctgtggacgttcagtgtcacaagaaatgctccaataatccctttcatggaatgatataatgtcataagaaggagcataaaaattccctgttctgattttcctatttaatgggaagctcaaaaagacaaaatggcttgcccatttcatcctgaaagtttagcttatacagtgatatgccacataatgatatttttgggtctacaatggacctcatatatgacaggtggtcccataagattgtaatggagctgaaaaattcctattgccttgtgacctcgtagccatcataatgttgtagcacaatgcattacatttgtggtgatgctgatagaaacaaaccaactgtgctgccaggtgtatcaaagtatagaacatgcaattatgtacagtatataatacttgacaatgataataaatgactatgttgctggtttgtgtatttactttttatcattattttagagtgttctccttctacttattaaaaaaaaataactggaaaacagccttaggcaggtccttcaggagtattccagaagaaagcattgttatcataagagatgacagctccatgcctgttattgcccctgaagaccttcccgtggaacaagatctggaggtggaagacagtgatattgatgatccttattctgtgtaggcctaggctaatgtatatatttatgtcttagtttttaacaaaaaaagcttaaaaagtgaaagaatgagaaaatttagaagtagaaaaaagcttatagaataaggatataaagaaagaaaatatttttgtacagctgtacaatgtgttgtttgtgttttaaggtgggtgttattacaaaagagtcaaaaagaaaaaattaaaaattttataaaaaattacagtaagctaatgttaatttattattgaagaaagaaaaatattcttttataagtttagtgtagcctaagtgtacagtgtttatatataaaatctacagtagtgtagagcaatgtcctaggccttcacatttactcgccacttactcactgatgcctacagcaatttccagttctgcaagttctattcatgataagtgccctaactgtacaggtgtagcatttaacaattttttatatatttgcactgttccttttctatgtttagatgtgtttagatagacagatctttatcattgtgttacaattgcctgcagaattcaatatagtaacatgctgtacaggcttgtagcctaggagtgataggctataccatatagcctaggtgtctagcaggctataccatccaggtttgtgtaagtacactcttatattgttcacacaattacaaaattacctaatgatgcatttcttagaacatatgcctgtcattaagtgatgcatgactttatttgctttatttgtaatgaaatgaatatgtttcctggctttttttttttttttttttttgagaacactcaacacctatcttgcaggagaatattgtgtttgtttttcttttcattcctatgtctcctgttatagtctcaggatgggtgaagttttagtgagaagctcagtggcaaggagacaatatgactcttccatggtcagtatacccacagaaacactttttcctcaatctcaggagaaaaatgagccaaatatggaggatcccatcagctgcagcaaagctactggccatgaagggaagtgagagaagcaaagagaagagtgaagcagaatgggaaggaaaatgatgattctatgggcaccaatcatgtgattttttttttttctctttgaaagataaccttcggcttattaattttatcatctcttttccaatattgaaccctcagcctctaaggatcagccgggtgtagactcagcatgatggcctggcctgctatctagcagggtcccctcaaggctatggtggaaggactcgctcagggcctaggaagctctgttgcagtttccattcttacattccaccttctcttatgacctactctccagctatactggatatgctagtctttttcacactttgtgcttttgctgtattgtttccctcatcctagagtatgcttttcctgtttgtctgcctggtgagatattatgatcttcaaatgtgcctcatggaagccttctctgattcttccaggctgagttatttatttatttctcctacagtttctgaactgtgactcactagttctacttggtatggcaacatgatcatctggcgttgctagagagtctcacctttaaagagtcatattaagtttatttacaggacctagtgttggattacctgatcacgtagcaattacaacttcttttataatttacgcccaaacctttaggtgagtcttcttgaggctttaccaaggaaacaggcagttttagagttggccttaaggatgttctctggtgtcatcaaagaaatggaaatgcaaagcagagacatgtgcatttagatatgtgtaagggccagaaggactccaccaaatttcaacactaagataaccacctgttaccagtcatcaacaaatagttactgaggacctgccatgcatcaggaactgcagatgcaggaaataatatggacaacagacacagattctgcctcattacttttgtagttttctagtgttcaactcttgatatacatataagatccgcatcatctgttaaacatagagcttagatcctctcatgagagttcaggcgcattcagggtgatgtggctgtagcctctgattctcttagattggcagtgaaggaagaatcgctacaaaggcaggatccgctgcacttcagaatctcacctcctggccctaaaatccaccttgaagagtccttgcctcctgcccaagtagccacaaactactctccaaaaagcacaactcttccttcaacaagactcttttcttcaaaaaccacatgcaaagtgaagtcttcactgggtatgtttagaccagacattactaaagtaactacttgtggtgagacatgagctggtagctgtgcgtttacgtggggctgtgtgctcagaaaggccctgtgcttggtttaatgctctattgtcgctgtcttagaattctctgcatttttattttgccctgggccccataaattatgtgcctgattctgcagccagactttttggtctttgaggatagattacttgtgtggggactatggctcttcacagtggtacctcctttcttcttcagatactgaactttaagagacagacactgtcttaactccatcacacaggaacacaacccttcacatcttcttacagagctgggattttcactcccttttatttctccctctcagttctgtggtcgtccttgaggctcgtcttttccttgggtaaccaacactgaaaatggtgtctgccttcaagaacgtggtagctctccacaaagccttagagtcctaagaacaataaccatagcagagtatgtgccacacaaggtagtgctgtgagatacacacacacacatgcccccagaagaaagggtttcatcacaatagattactgagggaaatcctgtgaggtgaagaggacagtatctctatcaaacaggtaagaaaaggcagagacttgaggacatctgctccttctgtggggcaggaaattatttctccatttcatgttcccttcaagggaaaaacaaaacaggaagctcaaactaggttaccctgctgctatgtgactttgtgtaaaccacttaaccccctgatcttctgttttttcctagaaacaaaggcctgagaagggatgagttcagcaatccctctgggccccaaattctcttattctaggaaaaaatgaatgttcttataatgagagattaatgcagaaggaagtaaagacaactgcattgtggtgggaaatttatgcctgaggtacattttaatttttaatgtcttaatagcccccagttttaaatagtcctgacctctttaaagatggctgcaccacatcatactgcctattactgggagaaacaatcctcttgtcctaagacataacatttcttagaaaagataccgatcttaagaaagattctactgatgagctttcaatttgctctgttgtcagggagcccatagagatcacattttgaaaaaattaaccaagggcagctgaggaaaattgtcataaagaactcgttttccttctgtaataataattacgtaagagcactgtaatgagaaagaaacaaatgaagaggggcacaggaacagggcacaaaaagcagtgttgtgcacgtgtcaagtcgaatgggagatggggtagagattaagaggaaaatggacaccatttgttagtagattaagcagaaagtgtatcagtcaggatgctcataattgctctatcaaatggctaaggaagctatttagctctttgtttcttcagttaaccatgaagggtgaatgttagaaatgaaaaggaaaaaggttgataaattatacagaactgcagggtggaatactgcttatcttccctggagttatggtgagaatagctttgagcaaattccaaattttcatatgggttcttcatttctgtcctccattcagctttccataacaggcatagattatttatcacagctcccgttattgcatcagcttgagtagtcctctggctctgtctgcaggaggatactcattttgcatttgtaattaccaaacttaaaaggagccagttaattctgcttctgctcaggggtctcatttagtagaatgatgtcttaagaaaaaatatgggaactgaattttgtttgggcctggaatcccaattactcttaatcccagtatctcactggtataggtaactaatgtttatagaagggataaactaatgtttatccactcttcccccaaatttcttttcactgcattaaacaattgttagtttagtaaatttgacctgctagggagctcagaagcagaatccttccttctttaatcttgcatttatatagaaaagtgtgagttggagaggtaacaattatagttaattaagttaatatacatggtccaaacatcattctagtgatataggctcctgcagttaaagagttccagttaactggattaagctcctccctctgttccatgtagcaaatatcagttttatagtaatattagttctatttgtcatatctgttaacagttgaaggtatctattttaaaatcaaaggtagtattcactaccagacagaaagccaacttttaaattttatttacctcaagttttgtttttgtttttaatgaagaccaaagaaatgtgtatataaatggcttttaatgccatagatacattaaaagtataatggtatttttatcatcaagcttcatttcattgtagttttcattatcctctctctgcagtgacttttttctcctttttaatttccataacactatgccatgtatttctttcataatgactgatgatgaatgctgatttttaacattaaatattttatgtgaagaattaaaccattagcagactgtgcagaaatatgaatgtatcatattcaaattaccaagttagatccaaaaatttaacatgtttgatataaaattttagcaaattcgtgtaagtataacctcctgaaaactttagagacagataacccactgttcacttaagaaacataaacatacagttttctttttctttttctttttttttctgagacggggtcttgctctgtcatccaggctggagtacattggtgcgatatctgctcactgcaacctctgcctcccaggttcaagcaattctcctgcctcagcctcatgagtagctggaactacaggcatgcaccaccaagcccagctaattttggtattttttttagtagagacgggttttcaccatgttggccaggctggtctcgaactcctgacctccccttggcctcccaaagtgctgggattacaggcgtgagccaccatgcccggcaaacacacagttttcaaaatactatccatttgtatagtgctttttcagtttttaaagcacaagtttaaacattttattggactttcacaacaaaaatataagagacacaagatattttattctccattctatagatgaggaagccaagacctcattaaagtgtggtgccccagtctacctagcacctataactagcagagttcaaaatacagtctagctgtattgaccttcagtgtttgtgctgggtaaattcatcccctttctatgaagatttgtcattatttggttctaggactggatatgcattcattagtgcaaatctaatccttgagtagtataggcacaccttggagatgtcgtggatttggtttcagagcacttcaataaagcgaaaattgcagtaaagtgagtcacacagatcatttggtttcccaagcatataaaagttatgtttacactatattgtagtctattaagtgtgtaatagcattatgttttaaaaaacaatgtacgtgccttaattttaaaatattgtattgctaaaaaaatgctaatgatcagctgggccttcggtgagttgtaatctttttgttgatggagggtcttgcttcgatgttgatggctgctaaccagggtggtggttgatcaaaattggggtagctgtggcaatttcttaaattaagacaacagtgatttgccacattgattgactcttctttttatgaaagagttttcagtgggatgcaatattgtttgacagcattttaaccacagtagaatttatttcaaaattggagtgtgtcctctcaaaatgtgtctctactttatcaatgaagtttatgtaatattctaaacccactgttgtcatctcaacaatgttcacagcatcctcaccaggagtaaattccatttcaagaaaccattttctttgctcagccataagaagcaactcctcatcctttcaagtttgatcatgagattgcagcaattcagtcacatcttcagattccactaattctcttgctatttctaccatgtctgcagttacttcctccactgaagtcttgaagttcccaaagtcattcatgagggttgatatccatatctgccaaacatctgttaaggtcaataatttgaacacctttcatgaatcacagaagttcttaatagcagctagaatggtgaatcttttccagaaggtgttcaatttgctttgctcagatctatgagaggaatcacaatgggagctatagccttatgaaatatatttcttttcttttcttttcttttttgagacggagttttggctcttgttgcccaggctggagtgcaatggtgcgatctcagctcaccgcaacctccacctacctcctgggttcaagcgattctcctgccttagcctcccaaattcctgggattacaggcatgtgccaccatgcctggctaattttgtttttttttagtagagatagggtttctccatgttggtcaggctggtcttgaacttccgaccttaggtgatccgcccgccccagccttccaaagtgctgggattataggcgtgagccaccacgctcggcctgcaatgtacttcttaaataataagacttgaaagttgaaattactccttgatccatgtactgtagaatggatattgtaatagaaggcatgaaagcaacattaatctccttgtacatctccatcaggactcttgggtgattaggtcacccaagattactgtcagtgaacagtaatcttttgaaaggagcctttttaaataaacagtaggtctcaacagtaagcttaaacacattcaataaacgatgctgtgaacagatgtgatatttacacatatgtttaaaacgctttttatttaaagtgagagacatcacagaacataaaacagaactaccatttgacccagcaatcccattactgagtacatatccaaaagaaattaaattgttctaccaaaagaaatgtgtactcacatgtttattgcagcactattcacaatagcaaagacatggaatcaacctaggtgcccatcagtggtggactggataaagaaaatgtggtgcatatacactatggaatagtatgcagccataaaaaatgaaaccatgttctttgcagcaatttgggtgcagctggaggccattatcctaactgacttaatgcaggaatagaaaaccaaataccgcatgtctcacttataagtgggagctaaacattgagcacccatggacaaaaacataggaacaatagacactgcagactactagaggtaggagggagagaaggggcaaggattgaaaaactaactattgggtattatggtcagtacctgggtgatggtaccatttgtaccctagacctcagggtacaatgtacccaggtaacaaacttgcacatgtaccccctgaatctaaaataaaagttgaaattacaacaaaagtaataaaaaataaaatgagagatgtgtgactctatcttgaacacttagaggccattgtaggactattaactggtctgcttgcaatattgttgtgtctcagggaatagggaggcctgaggagaggaagaaagacaagaacagctggttggtggagcagacagcacacacacttattgatcaagtctgctgtcttatgtgggtgtagtttatggtgcccgaaataattacagtagtaacatcaaagatcactgatcacagatcaccacaacagatataataatgaaaaagtttaaaatactgagggaattacccaaatgtggcacagagacacgaaatgagcacatgcctttggagaaatgctgctggcagacttgctcaatgcagggttgcaacacatctttaattaaaaaaaaaaagcagtatctgtgaagcagaataaagtgaggcacagtaaaacaaggtacgcacaaattttaaaagagagctgaagtaatttttgtaaaagtacagaacttagaag

SEQ ID NO: 3081 - DNA, 5243 bp, Homo sapiens
gccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgaataacatcttctgagtcataaccagcctggcagtatgatggcctagatgcagagaaaacagctccttgacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctaacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaatagcctgcagctggtgttttg

SEQ ID NO: 3082 - DNA, 1487 bp, Homo sapiens
ctgcgtcagcttgtgtagctggttagtactggcttagaggaaaaagaaaacgagtcacttcctgagcacactggagtctggaagcttagaggaaaaggaggaggagcaacttcattagcacagtggaggctggagcctgccgtggctcacctcgctgctgccgttggtgcgggccagggagactagagcgcagccagaatggctttcttggctttgcctgcccagttgtttcatgccaggaggaggagccgcctgctggaggctggagcttgtggcaccaccgctcgcctcgctgtggttggtggcggccatggagactaaagactcagcgctggagtggtaggagggcggcaatgaaaactgaagagcaccagagcgaaaacccttttgctgtgcctcaggatgggggagatgagatctgaaatacccagtgcagcctccgagaaggacaacttctacagagatgccagggacagccgaggtggtagagaagggaatgctgcctgtgcccaaagcccccttctgcggacttctaagattacgagcaaactcaggggtaggggctgggggtgcaggggaggggattctgagccacctgtccacaagcgatagtcctgttttgggctggtggcttctgagaggtgactcattgtggcctcaggatgaccaagacaaagcaactctggctgattccagccaggaggattgaggcctgtgagttatacctgtggttgaaaaccgaagcttcccttgcccctgctccctccaatagcggccccttggggctatttgtgtcagaatattgaatgtgcgtgtgtgtgtgtgtgtgtgtgcgcgcgcgcgtgtgatttggggtgttcttgtttggttggttggtttttattggggcttcccccctcaagttctctgatgggcgcgggttaccttctggctgggggttctcatccgtgtcaatgttcaggctgcaagcttcttgctaagcacagggtacagcccctctgtgtctcagggagcactggggatttgaaaatgccagtcagggttggttcttacagaattcattcctgtaacaaaaatactcagggacgcatctcaggctgaccacagggcaggtaccaagttaagtgttttcatgcactctccctctcaccacgtgggaggcaggtatgattaaccccctgcagaaaaagctgcagaaaaagctcacagtggggaaggggggtgcccaggcgccacatggccaggaggagaccaacccctcgtttgacctcaggggtgcaggaacccaaagtccaggctccaactccctggacatgacgtgatccccagccagggcacaccctgcacaatgccaggagcatctccttgatgcctccacaggctgtcgccctgagttctccaccatcaccgccgagagcgctgatccactcagcacattctggctaagcacctgctgtgcgccaggccccatgctgggcagtgatggg

SEQ ID NO: 3083 - DNA, 6012 bp, Homo sapiens
atccctcacctcctcctgccaagatcaccccaagcagaaaccaggatcataacaaactctacctcacggggctgacccgaagggatgatgcatagcagaacacatggctcagctggccagccggcaggtcttagcaggtcatagtggcggaatgaccagcccacaagtcttagcaggtcgcaatggtggatgcaggatgtttctgcctgaccagcctccattctcacttccgtttctgcctggatatgacaaatgtcgacctggagctgttggggccatctgggcagaaaggctgtccgggaatgaagtcaaagagatggaaaaagagaaaaagaggccggcgtctggggtcatggtttgagcccccgaatccaactgtacctgaagccctgtctgtttcagaaacagaaggcaataaattcagcctttgccttaagcccgtcaagccagtctggggtgcctcttttttttaatcaaccaaacaaatactggttaataaaactccctgctcaaaagctcctggcggctccttcatgcctgcagggagaggccagcaccctgggctctgggccccacttgccttcctttttgtcctgaactctggccctcatccctcccagacaggtatcacccaagactgctgtttcccaaacacaccatgaagactcgacctacagtttctacccaaactctcctccactccccacttgagcagtgcctgctcactagagcttgcctcctcctggaagcctccccacacttcctccaccactctgagtgtcagtggcatctacctccagcttcccatcactctgcttatttccccagagtgaaattcacttttttttttctttttcctcttcaaaaaaactttgtctcactgtatcatttaagaaatgaacatcctggattgacttgggatttgacaaattcaaacttggttttaacacaccatgtgcatttcctgagccccaggcgtaccagcagacacagggctgaaagacccagggcctacccgcaggggcttagaggctgaaccaaaccgtttcccatttggctcaagacaatggatgcaaaaatgaccatttttaaaattttaaattcaaatttattttacttggggataatcatcactgacactcactgagccattgctaggtcattgtctatgggcaggtccatgcataatgttatttaatcctcactctgggaaatgttatcctcacttacagaggaggtcactgaagctcagagaagtaaagggagctgcccagggggttacagcaactgtagggagctgaccctatattctagcccttgttatcctccctggcctttctcaactgtgtgcgaatacactggggccagcttcgaagtctttttaacattcactgtgtaaactcggcaccaagctagcttcccctggttgctcacaggcaggtggctgtccacacccacttctgtgtgggggcctctggcgtcacatttcacacccctgttctgtaggcatcgggtttcagatttgctgtatttgcttccgctgccactaccggtagatcagaagctggggaggtgtttcaacacatgattgttttgaatatggtgacttccccatctatccctgccatgggtaacatcccagcagcctcttgatagcagaacagaggccattgagcctggccaatgagtgagtctcaaattctaagttcgtgggggactcacttaagaagggtggtttgttccagcacctgatcagaacctgtggctcatcctctgcaaagtgggcatgaggcaccaccagaggctgcggagtggccagaatgaggcaacatatggagggggtgtggcacacggtaggtgtacactaagtgctcattccctcttttccttacagccttgctgctggggctacctttcacccacatgcaggcttacttgcctgcacccccggcatggcccaagaaccagttctctgagttcagccaggacttccaagaacctagcacagccaggtcagctccactgtgtatgagtcctgaacccgaccctaggcccctgctccctcagttgccatttgccaggctacctcctccattgctcctaaaatctagctcatctgccacctcctccaggaagcctttggggaactcctccagataaaaactccagtgtccctcctctgggctcccacaggcctcagagctcacccccttctcagccctgagtgccatgtgtagtcatttcctcttttctagtcccttctcccacagagcactgtgaacatccccaagacagaaacgatgtgttgctcaccacagcctgggccctacagctggcctgtcacagggctggtgacgaccgaatgaaaggaaatgcctaatgttttctgagcacttgctacatgccgggcacagagccagggatgcccacatggagagggcctgcctcacagtgaagacagtaggaaggaaagcagaggtaagagttgaaaagtccaaatccatatatgaacactgcgattccgccattcccgaagctagttaccctccagacttttcagttccaggaggcaatgaaaccccttttctgcttatgcccgttaggtttggattttctgtcacttgctactaagacagccctcactgaccaagtgaagctcagagatgggacccaacacacccaaggtcacatagctacgaaagcagtggaacagaaactcccatgaaagtctgggcttttttttttttttttgagacagtcttgctctgtgtccaaggctggagtgcagtggcacgacctaggctcactgcaacctctgcctcccaggttcaagcgattctcctgcctcagcctcccaagtagctgggattaccggcatgcgccaccacgcccggctaatttttgtatttttagtagagatggggtttcaccatattggtcaggctggtctcgatctcctgacctcaagtgatccgcccgccttggcctcccaaggtctgggctcttaaccacagcctgaccacaccccaggcccggctgatagccacttcaatgctcccacacgctgagtacagtccagatacccactctgccggcggagtcccctcacctctttcccagaagccactggagttacactggttgggatttttgggcattggtttgcaagtccatcagatggggctaatgagctcacccttgcatgcaggtcagaggacagctcacactggcctagcccacaagggactcagggaatgaaggccacagtgtggaccctccaacctgccctcagctgcctgatggcctacaggtgttttctaataggtgacatgtgtccattaaaataaaatacaaccaaccgcttacccctccttgcgcccatctccttcctctgccctactctccttcacagaacatgtcatccccatgacctatcatgcatgcattgcgttagtcatatattgcttgactccccaacaccaagaagggaagggatggtttatctgatttatcacctttgtactctcagagacaagacagtacttggcacacagtaggtgcccaataaatgtttgttgaatgactgaattaacaaatgaatgatgtgcatgaaactctgcacagagtcatggagtgcttaaaggctcctggttacacctggccatttcacaggtgaggacatgaggcctcaggatgggctcccctgaagtccccaggcaggcagcaggggctctgatctgctctgtgcctctgctgggctggaccgaaatgggccttgaacacaggtgtgggcagccacctggccaggctccccagcttgagccctggcgcccaacaaaggcaggttgctgctggaggtagctgagctggaggccagagccctgggctctgagctgtaacccctgaacctgacctcttggggtccttgggccaacagcccctggctcactggggtcatcaagcctcccctaaccagcctgaggggcactgtgccctggtaaatctctcagtgagatgggaacccagagtcacctacgcccacagggagattccccacagaggcctgcttcaccatctaagcctcacaacaaccccggaagggaggactttcgctatgggttatatggaaacccaggcccagagatgttgggacatctgtcccatgtcacatggctggggcacactggggagctgggatttgagacagagtgactgacccctcagggcactgagcagccttctgtctgcagcgtgggggcaggggtgaaggtgcccattgcttccttatcactgggcctcactttttccatctgccactggttgggctccagtcctaaggaaagggctatctgtcttgcctgcccccaagagccagggctggggtgggggaggcttggctgggagtgagagctcccaggctgctccctgaggctgggtcggtaaaagcttcctctgacccatctgttgaactccctgatgaccccagtgagccaggggctgttggcccaaggaccccaagaggtcaggctcaggggttacagctcagaacccagggaacatcccccaacacgctcccagccccagggatctacagatcctcaaggttccactctggatcatttcagaaagatactgaacttgtcagtgggtcaaggggctcctggggggacacatactgggctactgccagatgggaaatggccccagcgagcctggggcagggaagacttctgcaaggcagtgtctcctcaacacagcctggggaagccttgtgttccctcagccataaacctccatttgctcaaagtttatgcaccatagggttgaggggggcagcagtgtgggaaggaaacacaccaaatatgctccaggagccctgggccactgtgtgacttctgagggcctctgaggacttctgacttctgtgtgacttctgagggcctcagtttactcggctgtaaactgggcattgtcaagagtccatctttctcagggtggttgtgagggccgtaggcagcgacccaacactccctgccatccaggtgggctgcggggccctggttctcaaccctaatggggcctggggctggtctaacgcgcaggggagctaaagaacttccccttgcggctgtggggaaacacctggtgttcctgggcccagggcgagcctgtgtgcattccaggcagtgagaaacgggtcacagaatacagctctgagaaacagtgaaaactctgacgacagcccccaagaccctcaccacggcaggctgccctgacagtcgccagcccctcacaggtttctcagggctgctgaggtcccctccccgggccaggtgggtggtactcacagtctcaaagtggagggggcggaggtgtccctggaaccccagtgcctggcctgcctctgcggccccgggggatgagctgtgggtccatccccacagcaggtcctgacgtctgacttcctccctgctcagtcggcatccaggaaaccacacccaggggagagggtgccaggcaccctggggcccccgcccacctgccctccaaaaggcccccaggcactgctgagggggctccttccaggtctggcaaacccaaatggcttcactgggcaggccccagtcaataaataatacacccacctccctggacagtctctggtgcctgatcgtgtttcagggccacttaagttccaggcagactgctttgttcagagtgccgggccccttctgggtctctggccacatgggcactgcactgtcacggagggccagctggagccagcagcataaagtagtgtgacaggggtccctggagagagggtgccctacttacttagcagcttgggcccaaaggggacccaggggtggtgccagggtagggtggccagtctcgtctccccatggccaggcagggccccccacatcccccacaggggtgccatctggagagccgccaccagcccatcctgacattgccagtgtccgggcccaggcccctcctccagga

SEQ ID NO: 3084 - DNA, 6028 bp, Homo sapiens
atccctcacctcctcctgccaagatcaccccaagcagaaaccagtaggcataataattaggatcataacaaactctacctcacggggctgacccgaagggatgatgcatagcagaacacatggctcagctggccagccggcaggtcttagcaggtcatagtggcggaatgaccagcccacaagtcttagcaggtcgcaatggtggatgcaggatgtttctgcctgaccagcctccattctcacttccgtttctgcctggatatgacaaatgtcgacctggagctgttggggccatctgggcagaaaggctgtccgggaatgaagtcaaagagatggaaaaagagaaaaagaggccggcgtctggggtcatggtttgagcccccgaatccaactgtacctgaagccctgtctgtttcagaaacagaaggcaataaattcagcctttgccttaagcccgtcaagccagtctggggtgcctcttttttttaatcaaccaaacaaatactggttaataaaactccctgctcaaaagctcctggcggctccttcatgcctgcagggagaggccagcaccctgggctctgggccccacttgccttcctttttgtcctgaactctggccctcatccctcccagacaggtatcacccaagactgctgtttcccaaacacaccatgaagactcgacctacagtttctacccaaactctcctccactccccacttgagcagtgcctgctcactagagcttgcctcctcctggaagcctccccacacttcctccaccactctgagtgtcagtggcatctacctccagcttcccatcactctgcttatttccccagagtgaaattcacttttttttttctttttcctcttcaaaaaaactttgtctcactgtatcatttaagaaatgaacatcctggattgacttgggatttgacaaattcaaacttggttttaacacaccatgtgcatttcctgagccccaggcgtaccagcagacacagggctgaaagacccagggcctacccgcaggggcttagaggctgaaccaaaccgtttcccatttggctcaagacaatggatgcaaaaatgaccatttttaaaattttaaattcaaatttattttacttggggataatcatcactgacactcactgagccattgctaggtcattgtctatgggcaggtccatgcataatgttatttaatcctcactctgggaaatgttatcctcacttacagaggaggtcactgaagctcagagaagtaaagggagctgcccagggggttacagcaactgtagggagctgaccctatattctagcccttgttatcctccctggcctttctcaactgtgtgcgaatacactggggccagcttcgaagtctttttaacattcactgtgtaaactcggcaccaagctagcttcccctggttgctcacaggcaggtggctgtccacacccacttctgtgtgggggcctctggcgtcacatttcacacccctgttctgtaggcatcgggtttcagatttgctgtatttgcttccgctgccactaccggtagatcagaagctggggaggtgtttcaacacatgattgttttgaatatggtgacttccccatctatccctgccatgggtaacatcccagcagcctcttgatagcagaacagaggccattgagcctggccaatgagtgagtctcaaattctaagttcgtgggggactcacttaagaagggtggtttgttccagcacctgatcagaacctgtggctcatcctctgcaaagtgggcatgaggcaccaccagaggctgcggagtggccagaatgaggcaacatatggagggggtgtggcacacggtaggtgtacactaagtgctcattccctcttttccttacagccttgctgctggggctacctttcacccacatgcaggcttacttgcctgcacccccggcatggcccaagaaccagttctctgagttcagccaggacttccaagaacctagcacagccaggtcagctccactgtgtatgagtcctgaacccgaccctaggcccctgctccctcagttgccatttgccaggctacctcctccattgctcctaaaatctagctcatctgccacctcctccaggaagcctttggggaactcctccagataaaaactccagtgtccctcctctgggctcccacaggcctcagagctcacccccttctcagccctgagtgccatgtgtagtcatttcctcttttctagtcccttctcccacagagcactgtgaacatccccaagacagaaacgatgtgttgctcaccacagcctgggccctacagctggcctgtcacagggctggtgacgaccgaatgaaaggaaatgcctaatgttttctgagcacttgctacatgccgggcacagagccagggatgcccacatggagagggcctgcctcacagtgaagacagtaggaaggaaagcagaggtaagagttgaaaagtccaaatccatatatgaacactgcgattccgccattcccgaagctagttaccctccagacttttcagttccaggaggcaatgaaaccccttttctgcttatgcccgttaggtttggattttctgtcacttgctactaagacagccctcactgaccaagtgaagctcagagatgggacccaacacacccaaggtcacatagctacgaaagcagtggaacagaaactcccatgaaagtctgggcttttttttttttttttgagacagtcttgctctgtgtccaaggctggagtgcagtggcacgacctaggctcactgcaacctctgcctcccaggttcaagcgattctcctgcctcagcctcccaagtagctgggattaccggcatgcgccaccacgcccggctaatttttgtatttttagtagagatggggtttcaccatattggtcaggctggtctcgatctcctgacctcaagtgatccgcccgccttggcctcccaaggtctgggctcttaaccacagcctgaccacaccccaggcccggctgatagccacttcaatgctcccacacgctgagtacagtccagatacccactctgccggcggagtcccctcacctctttcccagaagccactggagttacactggttgggatttttgggcattggtttgcaagtccatcagatggggctaatgagctcacccttgcatgcaggtcagaggacagctcacactggcctagcccacaagggactcagggaatgaaggccacagtgtggaccctccaacctgccctcagctgcctgatggcctacaggtgttttctaataggtgacatgtgtccattaaaataaaatacaaccaaccgcttacccctccttgcgcccatctccttcctctgccctactctccttcacagaacatgtcatccccatgacctatcatgcatgcattgcgttagtcatatattgcttgactccccaacaccaagaagggaagggatggtttatctgatttatcacctttgtactctcagagacaagacagtacttggcacacagtaggtgcccaataaatgtttgttgaatgactgaattaacaaatgaatgatgtgcatgaaactctgcacagagtcatggagtgcttaaaggctcctggttacacctggccatttcacaggtgaggacatgaggcctcaggatgggctcccctgaagtccccaggcaggcagcaggggctctgatctgctctgtgcctctgctgggctggaccgaaatgggccttgaacacaggtgtgggcagccacctggccaggctccccagcttgagccctggcgcccaacaaaggcaggttgctgctggaggtagctgagctggaggccagagccctgggctctgagctgtaacccctgaacctgacctcttggggtccttgggccaacagcccctggctcactggggtcatcaagcctcccctaaccagcctgaggggcactgtgccctggtaaatctctcagtgagatgggaacccagagtcacctacgcccacagggagattccccacagaggcctgcttcaccatctaagcctcacaacaaccccggaagggaggactttcgctatgggttatatggaaacccaggcccagagatgttgggacatctgtcccatgtcacatggctggggcacactggggagctgggatttgagacagagtgactgacccctcagggcactgagcagccttctgtctgcagcgtgggggcaggggtgaaggtgcccattgcttccttatcactgggcctcactttttccatctgccactggttgggctccagtcctaaggaaagggctatctgtcttgcctgcccccaagagccagggctggggtgggggaggcttggctgggagtgagagctcccaggctgctccctgaggctgggtcggtaaaagcttcctctgacccatctgttgaactccctgatgaccccagtgagccaggggctgttggcccaaggaccccaagaggtcaggctcaggggttacagctcagaacccagggaacatcccccaacacgctcccagccccagggatctacagatcctcaaggttccactctggatcatttcagaaagatactgaacttgtcagtgggtcaaggggctcctggggggacacatactgggctactgccagatgggaaatggccccagcgagcctggggcagggaagacttctgcaaggcagtgtctcctcaacacagcctggggaagccttgtgttccctcagccataaacctccatttgctcaaagtttatgcaccatagggttgaggggggcagcagtgtgggaaggaaacacaccaaatatgctccaggagccctgggccactgtgtgacttctgagggcctctgaggacttctgacttctgtgtgacttctgagggcctcagtttactcggctgtaaactgggcattgtcaagagtccatctttctcagggtggttgtgagggccgtaggcagcgacccaacactccctgccatccaggtgggctgcggggccctggttctcaaccctaatggggcctggggctggtctaacgcgcaggggagctaaagaacttccccttgcggctgtggggaaacacctggtgttcctgggcccagggcgagcctgtgtgcattccaggcagtgagaaacgggtcacagaatacagctctgagaaacagtgaaaactctgacgacagcccccaagaccctcaccacggcaggctgccctgacagtcgccagcccctcacaggtttctcagggctgctgaggtcccctccccgggccaggtgggtggtactcacagtctcaaagtggagggggcggaggtgtccctggaaccccagtgcctggcctgcctctgcggccccgggggatgagctgtgggtccatccccacagcaggtcctgacgtctgacttcctccctgctcagtcggcatccaggaaaccacacccaggggagagggtgccaggcaccctggggcccccgcccacctgccctccaaaaggcccccaggcactgctgagggggctccttccaggtctggcaaacccaaatggcttcactgggcaggccccagtcaataaataatacacccacctccctggacagtctctggtgcctgatcgtgtttcagggccacttaagttccaggcagactgctttgttcagagtgccgggccccttctgggtctctggccacatgggcactgcactgtcacggagggccagctggagccagcagcataaagtagtgtgacaggggtccctggagagagggtgccctacttacttagcagcttgggcccaaaggggacccaggggtggtgccagggtagggtggccagtctcgtctccccatggccaggcagggccccccacatcccccacaggggtgccatctggagagccgccaccagcccatcctgacattgccagtgtccgggcccaggcccctcctccagga

SEQ ID NO: 3085 - DNA, 37245 bp, Homo sapiens
atcccgactaagtggccgtcctgggagttatagtgccactagccggcctcggctgttccctgtccgaggctcttgtcatttccgcttatttcctccacgggtgccgatttcatgtgtgtgttcccgagtgcctgagccggctcccgaaatgagtactcgtggtttccgcgtgggaaccaacctcgagcgccagtggcccgccctctccgggctgaggtggctgctgaggctggggctgctcctgaggcttcagggccgcccgctgcacggctttctaccttcccaggttagccgcggtcaacttctgccaggcggagcgagaaatcgcattttgtcaggtgaggattggagggagtgagagagatgtgaggggaaggcttcgggtaggggtatagggccgataggggacgaccagggccgagagctcatggacttggacccggaatgccattgccttccctgtgggtatgtctcaggggctttcaatctcggagtctcccacttcgcggatctttcccgccctctcagtatctcctccttcctcacagttcctccccttcctcttctttttctgctccctcccttccctctcatctcgtcttcttccttctccctctcggctccaacgcctactgtttcggccccaccttcttatcttggctcctccccttcccccccttatcgactccttacccagtctctttttgttctgccagtgctctctcggctcctccccctcctcctttctcctggatgctacgccctctcccatctccttctctttcccctccctctcggctcctctccctacccctccctctcttctcctttaccttcctcctcactgctgctttttctagtctcttcccctctgctcttctgttttcctttttactgctcctcctccttcctctaagtccttcccacttccctccctattggctgctcctccacctcccttttggcttctctcctgcctcaactaactcctcccctcctccccaacgccttcggttccctctcagcatctgtaacccttcccttccctccaccctttccctcgtgttcttacacaatcttccattctggacacatacactcattgtggtctttcttaaatacatccccaccatgctgtgttacccctcactcatatggtctcacactcttacccccctaattcttgttaatccacttgggtctcctgggtcctttctctgcaaacatagtgttatttacttctagagatttgtgagaataaaatgagatagtacatgaaaagcacttacgacggcaccttgcacatagtaagctttcaataaatggtaactgtcatcattattacttttctttagccagggattcctggcacaattcctcttcagcgtgtccctcaaccaccagtaatttcttggctcccttccttagtagcctcgttgttttcattgtaagctgactcaaaaggaatttttcttgcaagtaatcaattcaaaaagtattaataaataagacttatgttctgatctctagttgcctaatctagggtgtaggggggtattctggtagaaggcatcacaaatgcacacaaagttgagaatggtgctggtgccatctgactatagacttagccaactttaaggttctaggagtttttaaaggctagttctaggtgcagcatgtttacttttcaaacctggagcttgcctttccctgtgagaaatattgatagcagtgttttgagcaaacctcttgccaaacacatgtaagaaatagcatcctttttatattttttatttgccttttctctgactgtttatatctactccttgctctttattctttatttcagcaggctccctaacaaagaaacatgattagtaacatctggaacctttcctttcctttccctttccccttcggcttcccctcttctttccttccttcctccctccctccctctctctctctttttctttctctttctttctcttccttcctttctctttctttcttttctttctttcttttcttgctttctctttctttctctttccttccctttccttcctttctttttccctccctcccttcctcccttcctttctttccttccttctttcttttttttgagatgaagtctcactctgtctcccaggctggagtgcagtggcacgatttcggctcactgcaacctccacctcctgggttcaagtgattttcctgcctcaggctcccgagtagctgggattataggcacccgtcaccacgcccagctaatttttttttgttgttgttgtatttttagtagagatggggtttcaccatgctggctaggctggtcgaactcctgaccttaggtaatccacccacctcggcctcccaaagtgctaggattgcaggtgtgaaccactgcacctggcaacataaactttctatactgaatgagacctgtttccggtatttggggttcacacatttaagtctgtgatacattttgggttttttgttgttggaagatgtgaaaggttgagattaacttttttttttgcctatagatatctaatttctttagcatggtttcttgaaaagactatctatccttcctccgtgaaattgcttttgcaccttttcaaattttttttggcagaggcttgctctgtcccccaggctggagtgcagtggcaccatcttggctcactgcagcctccacctcctgagctcaagcgattcttctgcctcagccttcttcttcttcttctttttttttttgagatggagtcttgctctgttgcccacgctggagtgcagtggtgtgatctcgagttcaagcaattcttctgcctcagtctcccaagtagctgggattacaggcatccgccaccatgcccggctaatttttttttgtatttttagtagagatggggttccatctctactacatggttccatctttctacatggttccaacatgttggccaggctggtttcgaactcctgacctcatgtgatccgcccaccttggcctcccaaaatgctaggattacaggtgtgagccacctcacctggccctgcctcagccttctgtgtagctgggaccacgcccagctaatttttgtagttttagtagagacggggccagtctggtctcaaattcctgacctgaagtaatccacctgcctcggcctcccaaagtgctgggattacaggtgtgagtcaccgagcctggcaactttttcacctttgtaaaaaatcacttgggcatagttgtatggctgtatttctgagttttctgttgtactgttacattggtttgtgtgtcaggcattagctttttgatgattaaatttgcatgcaatacctttgtggagtgccattgttctaacaggaaagtgtaccttatcaagaaatgctatcccttggactgaagaaacttggcagtgtagtacaactctgctgccaataagattcttttttggttcatatttgtattatttcaggacagtaggtgctaaaatatgactctgtttttcattgtttactcatgctcattatttcctgattcataacattggcacatttcatctgaaggctctggaagaaaataataataataataataataacactgggccaggtgcggtggctcatgcctgtaatcccagcattttgggatgccgaggcaggcggatcacctgaggctgggagttcaagaacagcctgaccaacatggagaaaccctgtctctactaaaaatacaaaattagccgggcatggtggtgcatgcctgtaatcccagctactcgggaggctgatgcaggagaattgcttgaacctgggaggcggtggttgtagtgagccgaggtggtgccattgcactgcagtctgggcaacaagaatgaaactccgtctcaaaaacaaaaaacaaaaagtaaaaaaaccactggcactttaccttgataatcctccatagctagaccttgtaaataagaaattttgtattaaaagtatcaaatattttatgatcacattcttttggtaacagtgttattcagagaaaaatcacgtaccatataattcacccacttaaagtgtctaatttagtgttttttagtatattcacagagttgtacaaccaccactaccatcaattttattgtcacttttaagtgaaggattgtatatcagggtagttcttaggaagctagggtggatttcatatcccaccttgtatgttattgaagaagacaaattcttctcttcagtgatgacagcattgtgtgtgtgtctagttgtaatcatttcagttacaaatgaaaagtagaagaggaaaatgtagagaataatggcatactgaagtctttgaagaagttttacctgtaagataaattgcttatttcatatcccaccttgtatgttattgaagaagacaaattgcttatttcatatcccactttgtatgttactgaagaagacaaattcttctcttcagtgatgacagcattgtgtgtgtgtctagttgtaatcatttcagttaggaatgaaaatgtagaagaggaaaatgtagagaataatggcatactgaagtctttgaagaagttttacctgtaagataaattgcttatttcatgacatttgaattataaactttagccaaatctcttaatattttcaatttttttcttaacagttttaacaaaacagaaatgtgtaaaaatttgtgtaaaatcttacgatcgagaccaaatggacaagctggctttttttgaagaaagtaatacgactgaattactagcatcattggtaggtttggcatctgaaataacatgacttggctgggtgaggtggcgtgccacctcagcactttgggaggccaaggtggacagattgcttgagctcaggagtttgataccagcctggccagcgtggcgaaaacccatctctactaaaaatacaaaaattagccgagcatgatggcaggcacctgtaatcccagctacttgggaagctgaggcacatgagaattgcttgaacctgggaggcggaggttgcagtgagccgagattgcaccactgcactccagcctgggtgaaagagtgagacgctgtctcagaaaaaaaaaaaaaaattaacatgactcaattaatttttcaattcctttcagaagttttttgtttgtttgttttgagacagggtattgttctgtggcccaggctggagcaaagtgatgtaatcatagctcactgcatcctcaaactcctgggctcaattgatcctcttagcctcctgagtagctaggactacaggcatgtgccaccatgcctggttaagttttgattttcttttttgtcttttttttttttttttcttgagacagagtctagctctgttgctcaggctggagtgcagtggcgtgatctagcacactcgaaatctccaccacccaggttcaaacaattctcctgcctcagcctcctgagtagctgggattacaggcacccgccaccacgcccagctaatttttgtatttttagtagagacggggtttcactgtgttgcccaggctggtcttgaactcctgacctcgtaatccgcccgcctcagccttccaaagtgctgggattacaagtgttagccaccgtgcccagcctttgttttttcttttttgctgtcaccttattttttttttattatttttattttctttttgtagagacagggtctagctatgttgcccaggctggtcttgaactcctggcctcaagcagtgcttccaccttggactcccaaagtgagtcaccacaccctgccaaaaaagtattctttattttttatattttattttattattattttttggatatagggtttctctctgtcacccaggctagcgtaaagtggcaccatcttggctcactgcaaccaccacctcccgggttcaagtgattctcgtgcctcagccttctgagtagctgggattataggtgtctgccactacacccggctaatttttgtatttttttttttagtacagatggagttttaccatgttggccaggctggtcttgaactcctggtctcaagtgatccacccgcctcggcctcccaaagtgctgggattacaggcgtgagccactgcacctggcagtgtttcttatatttcagtcatttcacataccaccttggtaatttttgctatatgtcaagcacctgtattattatttatctactttaaaaaaatccgttatttaaggccaggtgcagcggctcatgcctgtaatcccagcactttgggaggctgaggcgggtggatcacttgaggccaagaatttgagaccagcctggccagcatggcaaaactctgtctctactaaaaatacaaaaaaatgagccaggcatggtggcactcacctgtagtcccagctacttgggaggctgaggcaggagaattgcttgaacctgggaggcagaggttgcagtgagcccagattgcaccactgcaccccagcctggtcaacagagggagacccttactcaaaaaaaaaaaaaaatccatgctgtatttagaaaggaaactataataccctaattatagatttactctactacttatcttttttattcatctaatttcaagtaaatatgtaaaaggtaaaattgtttttccatctactacctaaaatcatcttgtatatcttcagtgctatgtatttttcacaatgggaagcagtgagataaagaagtaaagaaaatgggaagagaagcaacaaacaactgcttaattgatagttctttgaaagcaagggtaaactggcagaagaaaggagttaatgaacaggagaaatgttcattaatatggtctgtgtttgagaccatatatgaaagtgggttcttagggaacatttaacgacgacatctttcaagatcaagtctgggaagaagaaagggaccaataggatgaaaaacccccagttggcaggagtagcaataactttaccaacatttgtaggttgtcaacataaaattaccaaggttaagtaaaagcttaaataaggccgggtgcagtggctcacgcctgtaatcacaactttgggaggccagggcaggtggatcacaaggtcaggagttcgagatcatcctggctaacatggtgaaatcctgtttctactaaaatacaaaaaaaaaaaaaaaaaaaaaaaaattagccgggcgtggtggtgcatgcctgtagtaccagctactcgggaggctgaggcacgggaatcacttgaacccaggaggtggaggttgcagtaagcccagactgcgccactgcagtccaggcgtggcgacagagtgagactctgtctaaaaaaaaacaacaacaaagcttaaataaaaccagcagctactttttgctatttcttttatatagtgatactctttcttgtgaatttcctcttcctcctctccttctcctcctcctcctccccctcctccttcttcttattcttcctcttcctcctcttcctcttcctcctcttcctcttcttcctcttcctcctcttcctcttcttcctcttccccttcctcttctccttctcctcctcctccttctcctcttcctccttcttattcttcctcttcctcttcttcctcttcctcctcttcctcctctacctcctctacctcttcttcctcttccccctcctcttctccttctcctcctcctccttcttcttctttctcactttgtcacccaggctgagtgcagtggcatgatcacggctcactgcaacctcgacctccagggctcaagccatcctccttcctcagcctcctgagtagctgggactacaggcgtgtgccaccacgtcaggctaatctttgtagtttttgtagagatagggttttgccatgttgcccaggttggtctcgaactcctggactcaagtgatctgcccgcctcagcctcccaaagtgctgggattacaggtgtgcaccactgctcccagcctatttttattttaaagatatttattttagatagatactgatgtcctcctcccttcaccctgacacataggctccttttcgttgaaaaatgaaagtttcaggcaagtttcagaaaagtttataggctgggcatggtggctcatgccagcactttgtgaggccaaggtgggcggatcgcctgaggtcaggggttcaagaccagcctggccaacatggcgaaaccgatctctactaaaaatacaaaaaaattagccaggcgtagtgttgggcgcctgtaatcccagctattcgggaggttgaggcaggagaatcacttgaatctgggaggtggaagttgcagtgagctgagattgctccactgcactccagcctgggcgacagagcaagaatccatctcaaaaaaaaaaaaaaataataagaagttgtttatagtgccattgatcatatcagtgggaataattataccaattattttcaaagtgtggtctgggggcctctgagaacttttcagggagtctgcaaggtccaaactattttcatagtagtactaagctgttacttgccttcttcactctcattctttcatgagtgtacggtggaattttccagaggctacatgaagtgagatgatgatctcaacttcttgggaggctgaggcaggagaatcacttgaaccctggagacagaggttgcagtgagccaagatcacgccattgcactccagcctgggtgattgagtgagactctgtttcaaaaaaaaaaaaaaaaaaaaaaaaaaagttaaaaaactccttttttggtctaacacactaaaagtcaagttttgataatttatttgaagaactattagataaatatagtagcagagaacaatgggctagaatagagtccagaaagagacataaatatttatggaagttatttatgggaatttcagtttatcataaaggtggtgtttctttcttttcttcttttttttgagaccgagtctcgctctgtcgaccaggctagagtgcagtggcacacgatctcggctcactgcaacctccgccctccgcctcctggattcacgccattcttctgcctcagcctcccgagtagctgggactacaggcacctaccaccatgcccggctaatttttttttgtatttgtagtagagacggggtttcactgtgttagccaggatggtctcgatctcctgaccttgtgatctccccgcctcagcctcccaacgtgctgggattacaggcatgaaccacggcgccctgtgtttttttttgagatggagttatggagtttcagtcttcacccaggctggagtgaagtggtgcgatcttggcttactgcaacctccgtcccccaggttcaagcaattctcctgcttcagcctcccgaatagctgggattataggcgcccaccaccatgcccggctaatttttgtatttttagcagagacggggtttcaccatgttggccaggctggtctcaaactcctgacctcaggtgatccacccgtcttggcctcccaaagtgctaagattacaggcgtgagccaccgtgccccaccaaaggtggtgtttcaaattagcgaagacagttcaataaatgatgtggggactgacaactgtttcaggacaggaataaaatgatcttggtctatacttcagtccttatacccaaatgaactacaagggaattaaaactttaaacattaggaagatagaagaaaacatggaatgaggaggcaaggtactgtataagctccagaaactataaaggaaatgacggatgaatctgactatgtaaaaataaaaacaaaaaatccttctacatggcaaataaaataaatagcaaagtcaaaatgcaactgatataccaagaaaaactatttgtgatttgggggtgatgaaagattgatttctttcatccagagcccatatgcaaaccaatcaggaaaaggcaaacagaccaaaagaaaaatgggcaaaggctacagtctgctttacagaaaaataaatgcaaatggacaaagaacatgaacctatactcaactgcagccataattaaagagatacaaattaagacaacactgaaaagcatttttttttttttttctgagactgagtcttactttgtcgccaaggctggagtgcagtggctcgatcttggctcactgcaacctctgctgcccgggttcaagtgattctcctgcctcagcctcccaagtagctgagattacaggcacctgccaccgtgcacggctaatttttgtatttttagtagagacggggtttcgctatcttggtcaggctggtctcgaactcctgacctcatgatccactcgcctcagcctcctaaagtgctgggattacaggcgtgagccactgcgcccagccgaaaagcaatattgttcatctgttggatctacaagcatattaaagggtgatgcctagtgctggctaagatgtaggtaaacacactattatagtaaattgataaagtcttgctggaggacacttggctgtagctagtaaaatagaagaaatgtgtgataatgcgtagtaatagcaaaacttatgaaataacacacaacaataatatatatatatgtatatatatataacaaaataaaaaaagatacatatatttgacctggtaattccactgctaggaattcattctccagataacctgcaaaggcttgccaatatgcacatcctgtgagtgtgtttagatgagagagctcttggcaaggctcagttggtggagtcccactgtgaccctcagctgactatgttgtgttagtaagacagtgtgtatagaacaataactatggttaagtgaaacctctgcttgtttttctttttgttttttgtttgagagggaacctcactctgtcacccaggctggagggcagtggtgtgatcttggctcactgcagcctctgcctccagggttcaggcaattttcctgcctcaggcttcctcaggcgtagctgggattacaggcacgcaccacctagccccggttaatttttgtatttttttagtagagatgtggttacaccatgttggctaggctggtcttaaactcctgacctcgagtgatctgcctgctttggcctcccaaaatgctgggaatacaggcgtgaggcaccgcacccgaccttctgcttatttttctatattgatcatgtaccactttagcttatggaattgtggcaatacaatttcagtttgtacatctactttgatttgctgtttctgcattcttgttttagcactgtattagaggtagttttttcaaaattcatgccaacataaatagcttcatccccaggagatgatcagtgcaaaagtttcaattactcctgtcactttttttttttttttttgatggagtctcgcactgttgcccaggctggatgcagtggcatgatctcagctcactgcaagctctgcctcccgggttcatgccattctcctacctcagcctccctagtagctgggactacaggcgcccgccaccatgcccagctaattttttgtatttgtagtagagacggggtttcactgtgttagccaggatgatcttgatctcctgacctcgtgatccgcccgcctcggcctcccaaagtgctgggattacaggcgtgagccaccgcacccggcctctcctgtcacttttaaaaaagttactcctcatatctattggctgaggagatggaagtgtttctggggatttgagatgctaagatgatgatgttttaggcccacggccatggcacctacttttgttctattcagcctactgagaggtgacagtgtgctggcagccctcacagccctccctcgctctcagcgcttcctctgcctgggctcccactttggcggcacttgaggagcccttcaacccgctgctgcactgtgggagccccttcctgcgctggctgaggcaggagctggctccctcagcttgcggggaggtgtggaggagaggcgcgggcaggaacagcagcagtgtgacttccgggtgggcgtgggctcggtgggctgcacactcagagcggccagctggctccgccggcccggggcagtgaggggcttagcacctgggccagcagctgctgtgcttgacttctcgccgggccttagctgcctccctgtggggcagggctcgggacctgcagcccgccatgcctgagcctccccccgccatgggctcctgcactgccggagcctccccgacgagcgccgccccctgctccatggcacccagtcccatcgaccacccaagggctgaggagtgcgagtgcatggcgtgggactggcaggcagctccacctgcggccccggtgcaggatccacggggtgaagccagctgggctcctgagtctggcgaggacttggagaacctttatgtctagctaagggattgtaaatacaccaattggcactctgtatctagctcaaggtttgttaaacacaccaatcagcaccctgtgtctagctcagggtttgtgaatgcaccaatggacactctgtatctagctactctggtggggacttggagaacctttatgtctagctaagggattgtaaatacaccaattggcactctgtatctagctcaaggtttttaaacacaccaatcagcaccccgtgtctagctcagggtttgtgaatgcaccaatcgacactccgtatctagctaatctagtggggacgtggagaacttttgagtctacctcagggattatagatgcaccaatcaacaccctgtcaaaacggaccaatcagcgctctgtaaaacagaccaatcagctctcagtaaaatggaccaatcagcaggatgtgggtggggccagataagggaataaaagcaggctgccggacccagcagtggcaaggcgcttcggttgtcttccatgatgtggacgctttgttcttttgctctttgcaataaatcttcctgttgctttctttgggtccacactgcctttatgagctgtaacactcaccgtgaaggtctgaagctttactctggaagccagtgagaccaggaacccaccgggaggaatgaacgactccagacacaccgccttaagatctgtgacactcaccgcgaaggtctgcagcttcattcctgatccagcgagaccatgaacccaccagaaggaaaaaactccggacacatccgaacgtctagaagaaacaaactccagacacaccgcctgtaagaactgtaacggtcaccgcgagggtccgcggtttcattcttgaagtcagtgagaccaagaacccaccatttctggacacactaccatgccagagatccaggggctgcagcatgctgaaagaaaacagaagcctgtggagtgagccaagatcaaccaggaaataaaccctttcccttgcgatgtctctccagcgccctctactgacaaacctgctttagtgccagtttgtagaggtaaactatttaaagggtctgaattattttcatggggggcaaaactcatgaatttggagctgagaggcaatatatcaataacagacacaccttacacgcatgtacggaccagataaggaaaactctacatatttccagaaacttatctgtgtgcagctctgttctctctggtcctctgctccatgaattctagtgcctttggcctccctggactttgaactttgttttctcaaccctaggagactgcagggctgtgcatggataccttttccctgtgtcacagcctggaaattttatctaggaagtaagctggaggcaatagtagggcttatcttatttgttccccttccctaggtgatcactcttatatttcttgtccaatgtttggaaactgttgctttacatattttactcatttttaaagttgtgtaagtaggagggtaaatctggtctttgttattctaccatgtcttgggccaagaaggaagtcccacctccttattttcttttttaagaaacatatttttatttatttatttatttatttattgagatggaatttcgctcttgtcgcccaggctggagtgcattggcacaatctcagctcactgcaacctctgcctcccaggttcaagtgattctcctgactctgcctccagagtagctgggactacaggcacctgccaccatgcatggctaatttttgtatttttggtagagatggggtttcgccatgttggccaggctgatctcgagctcccgacctcaggtcatccacctgccttggcctcccaaagtgctgggattactggcgtgaactactgttcccggcctgttttatttttaattttaatttttacttttaaagttgacaaagtgtttatatttacggtgtacaacatgctgttttgatatatgcttgcattgtggaatgactgaatcaggccaccttttttttttttttttttttttgagacagagtttcactcttgttgcccaggctggagtgcagtggcgcaatcttggctcaccgcaacctccacctcctgggttcaagcgattctccggcatcagcctcttgagtagctggaattacagacatgtgccaccatgcttggcttattttgtatttttagtagagacgggtttgtccacgttggtcaggttggtcttgaactcttgacctcaggtgatctgcctgcctctgcctcccaaagtgttgggattataggcgtgagccaccgtgtccggccttgctttctttttgtatgcatttgcttggtataactttgcttatccttctatttttaagttttcagaatctctttgttttagatatgtctcttgtgtacaacatattgtttgtttgtttttgagaccgagtcttgctctgtcacctaggttggagtgcaatgccatgatcttggctcactgcaacctctgcctcctgtgtacaagcaattctcctgcctcagcctcccaagtagctggaattacaggcatgcgccatcacacctggctaatttttgtttttttagtagaaacgaggtttcaccatattggtcaggctggtctcgaactcctgaccttttgatccacccgcctcggcctcccaaagtgctgggattacaggcgtgagccaccacactcagcctatgtctacactttttatttattttttaattttactattattttttgacagagtctcgctttgttgcccaggctggagtgcagtggcacaatcttggctcactgcaacctccacctctggattcaagtgattctcctgcctcagcctctcaagtagctgggattacaggcatgcgccaccatgcccagctaattttgtatttttagtagagatggggtttcaccatgttggccaggctggtttcaaactcctgacctcagataatccacctgccttggcctctcaaagtgctgggattacaggtgtgagtcattgtgcccagcctatatccacactttttaggaacctctttctttagatggtctcatgcagtttcattatgtgtttagttatggatttgttttcttttttgcttttaatcctgtttgtaattccttgggtttcctttattactgtcttctatcagttctggaattctcagccattgccagatattttcttctttccttttgagactccatttaaagctatgttaaatgctccttattttctgccccatatataacttctcttctatgttttccttttttttctttgtgttatgttttcctggcctatcatccagtctgtaaattctctcttcacctgtttcttattttctgcttttgtttttttttgagacagagtcttgctctgtcgcctgggctggagtgcagtggtgccatcctggctcactgcaacctccacctcctaggttcaagcgattctcctgcctcagcctcctgagtagctgagactacaggtgcccaccaccacggccagctaatttttgtattttagtagagacgggggttttaccatgttgaccaggctggtctcgaactcctgacctcaagtgatccacccacctcggcctcccaaagtgctgggattacaggtgtgagccactgcaactggcccttgttttctttttcatgcatatattttcacacttgcttttttatttcttttaaatatattaactttagttcatttaaaatctgcctctgataattgctgtatctgaaatctttgcaggttttttctagttcttgctcatgatgtcatttttccttttgtgcctcattattttgagtacatactcattgtccttgaaaatcatttgtggggtttctttaagttgtagggtcaaagtacattgctccagagaggactttcgttgacttctccaaagtgtctttggggattaccagtctgggaccatcttaaaacaaattcacaacttgaaattcctgggctacctaggtgatatgaatccagcctgtaaatttgttacaggcggtctctggccaaaacttttcttttttttttttttttgagacagactctctgtcacccaggctggagtgcagtggggtgatcttcgctcactgcgacttctgcctcctaggttccattgattctcttgcatcaccctcccaagtagctgggactacaggcacacgccaccacgcctggctaattttagtgatggggtttcaccatgttggccgggctggtctcgaactcctgacctcaagtgatctacctgcctcgacctcccaaagtgctaggattacaggtatgagccacagcacctggcctggcgaaaatttttcaaggccagttttattcctccacctgttcccggccacccccttgtttgtttagtatcagggcagtcttcctaagtttgttggaggcatggagcaggtttacttctggctcacctttaccttgagggtgtggccttttgggggaggtgggtggtctcagcttcacgtacagagggtctcatactagccttttcatctgggagggccctgggccctgagttctttcctcctcaacccatgaggccaccaaaactgaggtccacgtttgtcctgatcagcagttatcctcagggcaatagcagcatcagtgctccctaccaagcttacctcactggtctgctttcctttagaaatttgcatggtagttccttattttcttgtcagctgatgttgcttttagggagatatgtgctgcattttatttagcacttgtagttttcagcaggagatttggcccaaataagattgaaattggaaatctagttaaattttaaagcacacacctactataggaggaaggaaattaacatttatttactctcttattctgtactaggagctgtgttgggtcttctcatatcatacagccaaaaaaaacgtaaggtcgagaaagattaattgacatacaaaagattgcatgtggcaacttttcaattccagcccaatattttgtttttgtttgatacaggatctcactctgtcacccaggctatagtgcagtggtgcaatcatggctcactgcagcctccacctcctgggctcaggtgatcctcccacctcagcctcccgaacagctaggaccacgggcacgcactaccatgcccagctaagttttctatttttttgtagagacagggttttgccatgatactcagactggtgtcgaactcctgggccttggcctcccaaagtgctgagccaccacgcctggcccagtccaatgtttttctatccggatttcgctttcttttctttttgacggagtctcgctctgtcgcccaggctggagtgcagtggccggatctcggctcactgcaagctccgcctcccgggttcatgccattctcctgcctcagcctcctgagtagctgggactacaggtgcctgccaccatgcctggctgatttttttgtatttttggtagagacggggtttcaccgtgttagccaggatggtctcgatctcctgacctcatgatccgcctgcctcagcctccaaaagtgctgggattacaggcgtgagccactgtgcccggcctcttttcttttttcttttctttcttttctttcacttacttttctcaagacagggtctcaccctgtcacccaggctggagtgcagtggtgggatctcggttcactgcaacctcctcctgggcttaaatgatcctcccatctcagcctcctgagtagctgggactacaggcgtgtaccaccacgcctggttctgtttgctttctactatagcaaactatgtcttgtattttttgagtacctacagggtctcagctttgaggatacagttaagaagtgcctgacgtgtatggtagatcaaaaatatttgttgggctgggtgcagtggttcacgcctgtaatcccagcactttgggaggccatggtgggtggatcacctgaggtcaggagttcgagaccagcctggccaatgtggtgaaaccccatctctactaaaaatacaaaaattaggctgggtgtggtggcccacacctgtaatcccagcactttgggaggccgaggcaggcggattgcctgaggtcaggagtttgagaccagcctggccagcatagtgaaaccctgtctctactaaaactacaaaaattagctgggcatggtggcaggcacctgtaatcccagctacttgggaggttgagccaggagaattgcttgaacctgggaggcagaggttgcagtgagccaagatcacaccattgcactccagcctgggcgacaagagtgaaactccatctaaaaaaaaaaacgtgtatatatgtatatatatataggggtgtgtgtgtgtgtgtatatgtgtgtgtgtatatatgtatataaatataaatctataaatataaatatattaaaaaatatataaatatatatataaatatagaatgagtaaaagtgagtgaatgaatgacttgtagcatgaagagctgcagacaaaactcctcagacaccagattaaagaaggaagaggtttattcggctgggagtgtcggcagatttgcatcttaagagctgagctccctgaaaaagaaattcttggcctttttaaaggcttacacaactctaaggggtccacgtgaaaaggtcatgataaattgggcaagcatggggaacgtgactgggggctacatgcatcagctaacagaacagaaagttttgcaatgctttttcatacaatgtctggaatttacagataacacaagtagtttaggtcagggattgttattattattacttttttaacttctagggccgcggtggtggtgccaaggttgtctggctgtttatcttttgtttctttccaactttttgctttctctcttttctcctgttttgtgaactaggcaaggtggggggaggagggcagcaggaatagtagtggtctccttccttatccccctctttgagaatttcactaattagtggagttctcacttttatttttactttgagtctctttgcgagacagagtgatagtgttttatgtaatacacttgtgctgaagttttttgacaaaccatggtagctacaaaaccttttatcatttgaaggagcaagcgtaatacacaggggagcagcaagcaagtttctattactagtaatacacttacaatgagggttttaaattcgcttacagctagaaactattttctaaatatagacctaggatcaaacctgtgttaaacctgtacaggcaaatgtaccaactttgtcatgtcctaagcaggttagttcttttactgggttttaaaagctttttcgtagcgagtaacacagtatttcttaataatggaagtttttaagagccagatgcttgaaattgtggcgtctgtttggggaaagagttagttaaagtaaagttatcttgaggcattaactcttttgcttctcaaggccattggtctcttatgttagcctttttataaacataacatgaggaaacgtctaggctgccggcaatgttttcagccagctgagcaaataggtgttttttttttttttttttttttttttttgctaaaggaggatgctctggtaaacttctggtttatatgttgaaagaatgacttaaagactcggaattgttgctgggtgggatgggcctgggtttcctgactaagtagtatgtgtacagtggggataccttatataggtgtttcttctagcatggttatggggggtaacaacaacaaaacaatgtacagcatattcatatccagcaaagacaaaagaggtccttacctgggaaaaaggttgaatacagagacagaacaataggaaaacaggtagtattacaggaaaactactagtcttaagatttttaactacatcacttggcttggtaagtccttaagctttggctgtgagtagactagtcagctgccagtgtgactagagcagggcttgtttcaagcttcagccatgcatagactggtcagcctctggagtgaccagagcagggctatcgtcctcagcagcagcttggtctcatctcaggatcagccgggttggatgatctgtgtcctgctggctggtctgcttgtcctgagctgccagtgttagctgactgggatggatctgagacacaacacctgcaacttctaacagcagtaggagtagacaagattacagtatagggcccatcctatatgggtcctagaaaaattagattttacttttttactttaaacagagtcactagatttaaagcggtgtcaggcttataggcatttgtatgtatttaattatgaacactttgtatggctatttctaaaaactgcatttgctttcttaaggttaattcctttagttcctggaggtcacctctaatttgacctgtaatttgggggtggctgaccgaacaaaatcttacagaacaaatacctagtttgtttggtgggggtgcacctgactcggaggaggaccataggcaaaaacctgattttatcttaaatgtatttcctggcaatattttttcagtagctgctcaagtgtccagttcatgcattccaccttatcttgaactttgcggccaataggctgtgtgtaacttccattttaacagtcttgttaaatcttgcactagttcagctacaaatgctggcctattgtctgactttaaagttagaggcagtctaaacctggggataatgtcttttaaacagtactttagttactttttgtactttttctgtcctggtggggaaaactttaacttaccctgaaaaggtgcaaacaagcactagcatgtaccgatagcctccagcatgggtcagttctgtaaagtctataagcaagttttcacaaggtatggctctttctcctgtttaagtttcttggaggggttctttttcttccccccctttataactctatctagtggcttagccatcagtgagaaattggagtccaaatacggcagaatcctgctgcttttaacttctaatgtgaccatgggctcctgggagcctaaagagaaggtgcctagtctgccctagtctttacattcttcagctcctgccagcctgatcagatcagtatttggttcctccaaggtgcggcagcccttggccgatggcctctttgtcttgccgccttggccatttcctttattgccttctgaacattcacccttctagtgtcctttctttttgcatctcgtacattaatccctctctagccttgtccggctcttgaatccttgcctaacgtgacttcttccacgtctatgtccgcatccacgtcctctcacattgctaatctctctttttataagagctgttgctaacagattggcttttttaagtctttaatttatttatttttttccttcctgagttctcctgctcctacggccagctggcagggccaggcaacagcacgggccctgcccccgcgcactgctgtctgtctctcttgtttacttctgattctctttttcacacttagtcttagtctttctttttcttttggtcttttcccggcgccagtccctggctccttctttttttagatagagccaggctggggagagggacttaatccttggcgtgcctagctgcttcgattgttgcttttgctctttccctttttgttccttggtcccagttaacatacaccttggtggccacttttatagactgggtggtattcatgcctgcagcttctgcttgatgttattctgggcttgctttacaaatgaggtattcactatatactgatttttcagcagcctcagggttaaatggggtgtaaagccagaatgctttatagagtctcttataaaactgacttaggctcttgtcagctccttgaagcacttctgaaatcttttttatattaattgctttttttctaccaactgtttgcctctgcagaagtgcttctcagtatctctgcaaacgctgaagctgagttgcattctctgggtctttttcctatttttcctagagtttaacaggcccttttctttatttaattatccatgcacttggagggttaaacaggcataccgagagtcagtgtaaatgtttacagtcttaccttcactgagttctaaggcctgaattaaaggaatgagctcagcttagcgacaatgtccagggttatcaccatgtatcctgcacatctgtctccttgtgggttgatgaagctgttcccatccacgtatagctcccagcctactgatgcccaaggctggtcctggaggtcaggtctgctagagtaaacttgagtccaacacctctacacagttatgctcgacagggctctagttgccaggagcaaggtggcgggttcagggtgtttccagtttagtagatcaatggttgaaaagggctgatagatgaaagtctgttgtccccccggatgtgggcctggtcattataaatagacaggtcctcacctctccctgagaggcatttgcatagctcgagcaagaccagatctgagatggcccacttgactatcttgacttccttccttggcctctcgaggttccgattctccccttcgaggtgagacctggggtgtgttagctcctgaatctggtttctgagggggctgttggcctcggtaaaggggggtaggctaggacatatggagaaagaatttctgtttatctctggcggcttctgcaaaactggcttctcttgctgtttctgggactccctttttaactctgtgtctgctggcgaagctgctcttacttttacttttggcttttttgcaataagctgttaaacagggctaaatttatgccagttttgtctatattatatttaaccatgagtcaatataaaggaattgctacaggtacactggctgtcctccgacccctgtcaccaccttaaatacatggccaattgttccctgtctgtagttcctttggtgggccatccaacaccaaaagagggcaattctaattcacccagagttcttaacctctggggggttaacttaactctataatcccctgcaaaacctttcttaaggttttgtaacatgcattttaatagagtaagttttgatgattactttccttttatttttcttttcttggaattttttttaacacagtttctagcagagtgggcttactttgtgtctgacctatttttctctcgagacaaaacaacattcacactacaagaaggaaagggtaaaaggtcactcactcgtctatttcacactaaatcaaaatcaaaactaaaaccaaagtgtcgttaaaggcacctctgttcgtcaagcaatttaagccaagtcaaaatcagaaccaaaaccaaagtgccaataaaggcatgcctgtttatcaagcaattcaagtcaagtcaaaatcaaaactaaaaccaaattatcaagcaatgcaagtcaagtcaaaaacaaaacccaaagtgccggtacaggcacgccgtgggtgatcatgccatgcttccactcaaatggagtgggcaagttccaaagaccagtcttaccaagtttcagatgtccagacttaaagtgccagttccttcccagtgttcagccactgcattggtccttcatgtgggcttgccatgcaccgctctgatgaggcgttgtaccggggcaaatgcctgcctgggagcgctcatcaggatctacattgctcaagctggccggagtcccccacagggatgctctacagggcaggcataagctgcctaaggggctgtgtcgaccgtccattaatcacctcgcttcccggtcagggaaccaagaaatgtagcaggacaagctgcagacaaaactcctcagacatcagattaaagaaggaagaggtttattcagccaggagcatcagcagacttgtgtcttaagagccaagctccctgaaaaagaaattcttggcctttttaaaggcttacaactcttaagaggtccacatgaaaaggtcatgataaattgagcaagtgtggggaacgtgactgggggatacatgcatcagctaacagaacagaaagttttgcaatactttttcatacaatgtctggaatttacagataacacaagtagtttaggtcaggggttgatgttgttattattacttttttaactcctagggccgggtagtggtgccaaggttgtctggctatttatcttacttttgtttctttccaactttttgctttgtcttttctcctgtcttgtgaactaggcaaggtagggggaggagggcagcaggagtagtagtggtctccttccttagaatgacccagacagagttcttaattttgtgatgtactggggaacacaatttactaggggatataaatgtgtaaatacaccaactacaatttgatgtaagtgacaatagagatatgagctgagtgctgtgagaacacagtacagaattctctttagtaatttagcaggttagaagtagaggctgtcgcgtgtgatgagtctggagagataggtgggatccagatactgaaggacctttacctattacattgagtacttagtttatgccgagcagtggttgatatactttgcctgagttgatttaatcctcacagcatcctgtgggtactgttaccatctttacattacaggtacagaaactgatacactaagaggttacaacatggcaaagatcacacaagctagtacagaacatatctgagctttgaatataggtagttttatttttttcttgtttttttttttttgagacctagtctcactcttgtcacccaggctggagtgcagtggcatgatctcactcactgcaacctctgcctcccgggttcaagcaattcttctgcctcagcctcccgagtagctaggattacaggcatgtgccaccatgcttggcttattattttgtatttttagtagagatagggtttcacaatattggccaggcttgtctcaaactcctgaccttgtgatccgcccgcctcagcctcctaacatgctgggattatgggcgtgagccaccacacctggctttttttttaaaaattgagacggagtcttgctctgtcacccaggttggagtgcagtggcgcgatctcggctcactgcaacctctgcttcctaggtttaagcaattctcctgtctcagccttctgagtagctgggattacaggtgcatgccaccacgcccgactactttttatatttttattggagagaaggttttgccatgttggccaggctggtctcaaactcctgacctcgtgtgatctgcccccctcggcctcccaaagtgctgggattacagctgtgagccactgcccagccgaatatatgtaggttgactatggatctacatccctaaccactatgctgtgctttttctctctagtagtatggatatactttcttactagcgtatgcaaatctactagctgtattttatttctctgtgtggttttactataatttatttaactggattgatagagattgttggttgtttctagtttttagcagttacacatagtgctttagtgaggagtatttacttcccacctcaagctgattggggcacactctcacatgatcactcttcccttcttcatcattactgtattaaatgatctccaaaattccttcagggccatcaccctaaattctgagatttgcagagccataattcttaatctcaagagctgtatatattgtagattacttaatgtggtaattgtcaaggctcgtttgtactttttttttttttttgagatggagtcgtcttttgttgcccaggctggagggcagtggcacgatctcggctcactgaaacctccgcctcctgggttcaagaaattctccagcttcagcctcccgagtagctgggactacaggcacgtgccactgcgcccagctcatttttatatttttagtagagaaggggtttcaccatgttggccagactggtcttgaacgcctgacctcaagtgatctgcccacctcggtctcccaaagtgctgggattacaggcatgagccactgcacccagcgaattttcgtattattattattatttttattttttagtagagacagtgttttgctggtctcgaactcctcggtctcccaaagtgctgggattacaggcatgagccaccgcactcagctgtactcattttctaaggattgaaggcctgggtgacatattagttaacatgtattgaaggtttcctataccaagcattctactaagtactttacatgcattattctaattgtctcagcaatcctgtgagcaattatatatattgtccctcttcttaaaatgaagaaactgctgggcgcggtggctcacgcctgtaatcctggcactttgggaggccgagacgggcagatcacgaggtgaggagatcaagaccatcctggctaacgcggtgaaaccccgtctctactaaaaatacaaaaaattagctgggcgtggtggcaggtgcctgtagtcccagctactcgggaggctgaggcaggagaatggtgtgaacccaggaggcggagcttgcagtgagctgagatcacgccactgcactccagcctgggagacagcgagactctgtctcaaaaaaataaaaataaataaaaaaataaaaataaaaataaataaatgaagaaactgagacttgatgtgtctatggtcatatagctagtaaatagctcactgattgcaaagcatatatatatatatatatatatacacacacacacacacacacacacacacacacacacagagagagagagagagagagagagagagagagagagagagagagagagagagagtgagacagtctcactgtgtcacccaggctggagtgcagtgtggcatgatcacagctcaccgcagcctctatctcctggctctaagcaatcctcctacctcatccccccaagtagctggggctacaggtgtgcatcaccacacctggctaatttttaatttttttgtggagatggggtctcgctgtgttgcccaggctggtcttggactcctgggctcaagcagttctccctcctcagcttcccaaagtgttggaattacagacataagccactgcgtccagccaatgcttgtatttttaaccctggtattaattattttgctagggctgccagaacaaaataccacaaactgggtggcttaaacaatgggaatttaaggccgggcacggtggctcacacctgtaatttcagcactatgggaggccgaggcgggcggatcacgaggtcaggagttcaagaccagcctggccaatatggtgaaaccccgtctctactgaaaatacaaaaaatagctgggtgtggtggcacgcgcccgtagttctagctacttgggagcctgaggcagaagaatcgcttgaacccgggaggcagaggttgcagtgagccgagatcacgccgctgcactccagtctgggcgacagagcgagactccgtctcaaaagacaaacaaaaaacaaaacaacaaaaaacaatgggaatttgtcactttgcagttctggaggctagaagtctgaaaccaaggtgttggcagggttgattccttctgagagctctgagggagactgttcaatgcctccttctagcttctggtgatggccagcaatccttggtgttcctcagcttgcagctgcatcattccaaactctgcctctgttgtcatgtaggcactgtatgtctcttattttcttttctttttttttttttagatagagtttcattcttttgcccaggctggagtgaagtggtgtgatctcggctcactgcaacctccgtaccccaggttcaagtgattctcctgcctcagcctcctgagtagctgggattataggtgcccgataccacacctggctaattattgtatttttagtagagacgaggttttaccatgttggccaggctggtgtcgaactccttacctcaagtgatccacccgccttggcctttcaaagtgctaggattaaagatgtaagccaccacacccggccttatgtctctattttcacatggtctttttctcttcttagaaaggcaacaacgatattggattaggaccaaccctaacagcttcatcttaacacgattgtatctacaaataccctatttccaaataaggtcacattcataggtactggaaattaaaccttcaacatctctttaggggacacaatacaatccgtaacaactcttactgcaaaactgtcctcaaatccccatggaaaaatagttgttgactcttctttaaccactcccaccgaaaaagaacagccgaagagttcttttgaactggagcaaagttttttttttttttagacggagttttgctcttgttgcccaggctggagtgtaacagtgtgatcttggctcaccgcaacctctgcctcccaggttcaagcgattctgtctcagcctcccaagtagctaggattacaagcatgtgccaacacgcccggctaatttttgtatttttggtagagacagggtttcgtcatattggtcaggctggtctcgaactcctgacctcaggtgatccacccgcctcggccttccaaagttattggattacaggtgtaagccaccgcgcctggcctggaggaatagttcttgaagtgtgttctgagatcagcagcattgatatcacctgacatacagaatctcaggcctcatttaggatctaatgaatcaatctgcattgtagcaagacccctgagtgatttgtatgaactttgattttttttgtttttcaacgtattactatctttattatggtatagagtagtattttatacatagctcattttatagcaaaaacatttatgtacaactgtagagaaaccactacacagatagctccaatttaaattagaaaacattttgccgggcgtggtggctcacacctgtaatcccagcactttgggagtccgaggcgggcggatcacctgaggtcaggagtttgagaccagcctggccaacatgatgaaaccccgtctctactaaaaataaaaaaatcagctgggcatggtggccgtgcgcctgtagtcctagctactcgggaggctgaggcaggattcatgccaatcgcttgaacgtgggaggcagaggttgcagtgagctgagattaagccactgcactccagcttgtgcaacagagtgagactctgtctcaaaaaaaaaaaattaaaaaaaaattgcagcttatttatctctacaaggtgttgccaacgagaaataaaagaggaattaaaaggtttagggcatatttataaataacaggagtaaacatagcttctaagagatgccaggaaatgccttaccaatgtcaaggacaatcactcatgcttttttatgtcacttctgatatttggaaacagaattaaggtgatggactgtgaggtctgactcaggctgcttgctcatatttgaatggatttggttaaaaaggtagtaaacaaagtgtgatcatacaggaagctaatctcaccagctatgtgaaaatcaagcttaatgctttgtagtcacatctcatattctcatactcagaggaaaaaagccaagaaaataatcttctacagttgtatttattctacactgcctacagaaatagtttatgtgtacatacaatcaaacttttatctaatcgctgtaaaggtcatttatataggccccccgagggcaaggactgtgttataatttatctttttcagaattaaacaagctgcccaaggccatggaagtgagttagacctagctgtttgctaggtctacagtcttgtgttttattttaggcactgtggctggctaataatttccctgacttttaccatagttaatcatctctttttcttttctttctttttttttaagagacagggtctcactctgtcacctaggatggagtgcagtggtgccatcataggtcactgtagccttgaactcctgggctcaagtgatcctcccacctcagcctcctgagtagcagggactacaggcatgcaccaccatgtctggctgtatttttatttttatttgtagagatggggtctcgctatgttgccctggctggtcttgaactcctggcctcaactgatctttccacctcggcctcccaaagtgcggggattacaagtgtgagccgctacacccgacgtcttattcttaaaatacttgcttcatttgagttttaggttaccaagctttcctggtttcctgtctcactggtcacttcttactggtcacttcttaatctcctcctcatttttgtaaactcctaatgtgggagagccctcagactcaactcagtctttgaactttttatcttctttagttatactcatactttggtagtcttacctgtctcatggtgttaccatgatgactgttagatctctagacttgtatatttatctgtctatttgacatgtctgcttgtttttttttgtttgtttgtttgtctttttttttttttagacagagtcttgctctgttgaccaggctggagtgcagtggcgtgatctctgctcattgcagcttctgcctcctgggctcaagtaattctcctgcctcaggcccaagcgattctcctacctcaacctcctgagtagctaggattacaggtgcgcaccaccatacctggctaatttttgtattcttagtagagacggggtttcagcatgttggccaggctggttctgaactcctgacctcaaatgatctgcccgccttggcctctcaaagtgttgggactacaggcatgagccacagcgcttggctaggacatgaccacttggatgtgcttcccctgttgtttttcccatctcagtaagtggcaactccatctttgcagttgctcaggccacaaatcatggcatcacccttaattcctctttttcactcttcactcataccccctattcagtccaatcctttgacagaccatgtggctctctccctttgaaatatttcagaatccaccacttctcaactcctctaccactatcatctggtccaagatatcattttacctcacttggactattgcaaaaacctagccagtctccctgctgctacccttattttctaggggtctgttctcaatacagtattcagagcatttctttggaaatgtcagctcttttcaatcctctgcttagaatcttccattgacttctcatcttacttagagtaaaagccaaagttctgaaactggcctataaagccttgtgcagcccatatataaggccagaggtttataataaaatagtgcttctacttcggtgagagctcttaacatgatctttgctgcatagtctttctcatatcaaatgaagatttttctgtactgggttcgtacttacacagtaaaccttaatgtggattatcacgcagtaatttaattgttctctttagtgttacattttgatctgtagccttaagaatcattttttttcatggttataaagctaaagagaattaaaaacaaacaataaaaaacaaaaaaatcataactttaaaaatttatagttgttttaaaatgtgttctgggccgggcactgtggctcatgcccataatcccaggactttgggaggctgaggtgggcggatcacctgaggtcaggagttccagaccagcctggccaacatggtgaagccctatctctactaaaaatacaaaaattagtcaggcgtggtggtggatgcctgtaatcccagctactcgggaggctgaggcatgggaatcgcttgaacctgggaggtggaagttgcagtgagccgagatcacgccactgcactccagcctgggtgaaagagtgagactccatctcaaaataagagactctgtcttaaaataaaataaaacaataaaataaaaagtttttcagctttaaatagaatttattcattctagaaacacttaaaagggcatattatgtaccaggcactagggttacaaaaatgaatagaaagagatgcacatcagtaatttttcccaactgtgagtgaatggttttattatgcatacacatgtatagacaattccataaagattacctattattcattacacagaagccaagggataaattgtatgctgagtaagtaaatcaaaagggaagcatcactgtttctcctttttatttttctcctatttttcctttattcctctttacattttgagtagtaagtctccacatccctgaccaggcatttgctagctgcatcactcctctctgatttcaaacttctctagtttgtttccatcttctatttttaaagtttttttcagacaaaaaggtcatgtagattatatttttggtatctttcatttctaagcatgctgctttatacacagtaggccctcaaatctttgagtgcttataaatatgatttttgcttcatctaattctctagacatgcagttaagattacaggatgggttacttagtatattgaaaaagaatgatatgaaatatgaaaaacaaagccatttaaaagatattcatgacactctagtgctttacttgcccctggaccagatgtttgtgttcatgggtcagtgactcttagctccggactgtattagtggtgcttcaccaaaggactgatttcaggctattcttttaatagggaaaaccctttatgactatgtagatctatgtatttccatttttagtcttttttagactgtgtatcatatatatatatttgtatacgtgtgtgtgtgtgtgtgtgtgtgtgtgtgtatatatatatatatatttattttttttttgagatggagtctcactctgttgcccaggctggagtgcaatggcatgatctcagctcagtgcaactctgccttccgggttcaaatgattatcctgcctcagcttcccaagtagctgggattacaggcacctgcccccatgcctggctaatttttgtatttttttttttagtagagatggggtttcaccatgctggccaggctggtctcaaactcctgactttagaggatccgcccgtctcggcctcccaaagtgctgggattacaggcgtgagccgctgtgcccagctggatatcatatttttgatccaggttttgttacactcagtttcatctaaggcttattttttatagcttcagatattctttcctgagaccaaaccctaattactgtatttggggctaggtctcaaatctcgaaaatttacaaattgtgcttggtttgtgtcatttctgtagatggcctgacagccattataaaatgattcttcctaatctcattctgaaagcaattccacattaggaatacctcgcttttgtccctatgtatcacctttagtggttatctccattttataaatgaggctactgaagcccagcaagctcaagtaattttctcaggttcacagctagcaggtggtgcaagtgatattcaaaaccatgtctgtctggcccccaaactcagtttttctactataccattctggctttctttcttaagggtctattatattttctgcctcagagtcactgtaaagaaaatgagaaccatttatgttagaaatgtgtgtgtgtgccttgaatcatctagctagaggtcaggattacttgatcctacatcctgtagtttacccaaagtacgattggtgaaaacaggcaatttactagtccaataagtatagtccagtcttctaatctttggatgaaatacagaagtgtaatctgaggaaaggaatgaaatgcactctgaaggggccgggcattgtggctcgtacctgtaatcccagcactttgggaggcagagacgggcggatcacctgaggtcaggcgttcgagaccagcctgaccaacatggtgaaaccccatctctacttaacatacaataattagccaggcatggtggcaagtgcctgtagtcccagctacttgggaggttgaggcaggagaatcgcttcaacctgggagacagaggttgcagtgagccgaaatcacgccattgtactccagcctgggtgacagagtgatactgtctcaaaaaaaaaaaaaacaaaaaaagtgaaatgtactctgaagacatttaataaacctttcttcagctactgagaatagaatactattcaaagtctaagctattatcataagttgattgaaagctgaggtccttatacatttttgtcagttatcaatcagttattaaacatttaaatgtaaggacttttattcttatagtaaaaaccacaggaaaacacatctaaattgaagttcggattcatatcaggaacctacataatatggtgctagtggtctgtcaggaagcaactgtagccatcaaaaaaagccataccaggccgggcgtggtggctgacgcttgtaatcctagcactttgggaggctgaggcaggcagatcacctgaggtcaggagttcaagaccagccaggccaacatggcgaaaccccgtctctactaaaaatacaaaaattagtcgggcatagtggtgcatgcctgtaatcccagctacttgggaggctgaggcaggagaatcgcttgaatccgggaggtggaggttgtagtgagccaagatcgtaccactgcactccagcctgggcaacagagcgagactccgtctctaaaaataaaaataaagccataccaaatgggaaaattttggaaaatccccttatttcaggttaggtctcaaccccttgttcctcaacagtcaagtctaattctggaagcaattccagaagagggaattttcttttcccattgaaacttatttagtgtacctagaaggcccttggcttccagaggtgttacactggaaagaaccagacacagttgaattagaatcttggctctgccatttactgctgtatgaacttggttaggttactttgcgcctgttatttccgaatttgtaaaatggagataaaatattaaccccatttgattgctgtcagggtgaagtgagctaacatgaaatatttagcacagtgcctagcaagtagtacacatttaatgtttcctattcctccttctctccaatataggttctccaagacctagggagcagttgatttataaatgtctcatacaacattagctcatgcatgcagagagatgattatgcagtgagaacatactaagctacgatattctctatctgagtgccaaaacgtggctgttctagttagggggagggtgcaaggaagagtaatgacatatatctctaatagtgctctttctttattttcttgtcttgggttgaaaaatgctttatttttgtttttgattcccaagttttattcaagaagtcataaaatattccagataagtgaattttaatcctcatcttcctcctcttctgcatcctggttaatttgggagtaatgtaattcctgactctctgctgttagcaactatgtgcaactaatcaagtaggtgatttcttcttcagatattttttggtgagatatttaaaatatcttttggtaaaaagcacctcagaagtcacagtaatcttgctcttgcttattttgatggtcataccccctccaccgagactctcagcttttctgctcactttgatcctttcctgtaaaaattgcacaaaattggcagtatcatgattccatcttctacagagtgggtgcaatcaagagtgaacttgagaacctgcttttttttttttttttaaaccctcctttgccataagcttctttatgggcactgtggcggcagcagaggcagaaagggaggtgggtgaactatgcaggccggaaaaatgcttttttttttttaataaaaaaaaacaattataatggtgcatatcaacatttcccaaagtgcattgtgtggaacactagtctagtcaaataagtttgaaaaatgttactttctactgcctcctttctcagctttacaaaacacattagtaaagtgtttaaaagtctcctaatctcattcatagtaaagaaatgtcttgactgagcctaagttagcattttacaaacgtgttcgactctggagttcctttccttcctttccttcctttccttctcttcctttttttttttttgacagagtatcgctctcttgcccacggctggagcacagtggtgggatctcgcctggttgcaacctctgcctcctgggttccagcgattctcctgcctcagcctcccgagtagctggctaggattacaggcgtgatccaacatgcctggctaatttttgtatttttagtagagatggggtttcattgtgttgaccaggctggtctcaagctcctgacctctggtgatccacccacctcagcctcccaagtagttgggatcacctggcttcccccccctcccccccgtatttttagtagagatggggttttgccattttggctaggctggtctcaaactcctggtctaaagtgacccacctaccccagtttcccagagtgttgggattacaggtgtgagccactgtgccctgcctggagtactctcttaggttagggtagcatttagatcccactgtggatgccattttggctaccccaggtacccatggtggttgtgtcttagagtagctcacaaaatcctacagaacctgcaacatacctcaaactttcagtgtacaaatgagaagcaaagcttcgtatcttggtaactgtaagtataaaagaactggccgggcgcggtggctcacgcctgtaatcccagcactttgggaggccgaggcgggtggatcatgag

SEQ ID NO: 3086 - DNA, 3837 bp, Homo sapiens
ggtggtgatggttgcacaacagtgaatgtgcttcatgccactgaactacacccctgaacatgggtaagatggtacattttcagttacatgtgttttatgacagtctaaaaaaattgaggggaaaaaatggacctggaaacaatggggacctcctggctcagtgcaggggagaatctggccttggccttggttgtctgtttctgaactggaactgctctcttgtgggtatctagtcatctgcagtcctgagttcctgggcaggtccttgcactgggcccctccctgtggggattcctcagggctgggcagggaaaggaagggcccaggcttcctggctttagctgccttccctaccccagccccaacccacatccacctgaaactgctgctggcctctccaccacaccgggggcccacgccctgcagcaccccaccccaccttgtcccctttcaggtgctctctgggagagactctgagtgtatcgagtcctaacaattgactcttgtcctcaaagagaatctggcttcactaggtgctgaggaggtggaagaaagattataccagcctgggctgactgcgccccactctgcacaaagcactttaaaagcatttgggggctggacgcagtggctcatgcctgtaatcccagcactttgggaagctgaggtgggcagatcgcttgaggtcaggagtttaagaccagcctaaccaacatggtgaaaccctgtctctactaaaatacaaatattagccgggcatggtggtgggcgcctataatcctagctactcaggagactgagggaggagaatcgtttgaacccaggaggtacaggttgcagtgagctgagatcatgccactgctccagcctgagtgacagattgagactccgtctcaaaataaaaataaaaataaaagcatttagttcctaagacttgctgggtgcagtagctcatgcccgtagtcccagctacttaggaggctgaggtgggaggatcactcaagttcaggcgtttgaggccaaatgggcaacatagcaagaccccatctctcaaatttttattttaaattagtccagtgtgaggcccagcgcagtggctcacacctgtaatccccgcactgtgggaagctgaggtgggcagatcatgaggtcaggagctcgagaccagcctgaccaacatggtaaaaccctgtctctactaaaaatataaaaattatccgggcatggtggtgcacgcctgtaatcccagctactccagaggcagaggcaggagagttgattgaactcgggaggtggtggttgcattgagccgagatcgtgccactgcactccggcctgggcgatagagcaagactccatctcaaaaaaaacagaccgggcacagtggctcatgcctgtaatcccagcactttgggaggccaaggcgggtggatcatgaggtcaggagatggaaaccatcctggccaacatagtgaaaccccgtcttgactaaaatatgaaaaattagccggccgtggtggtggcgcgcctgtagtgccagctgcttgggaggctgagtcaggggaattattcgaacctgggaggcggagattgcagtgagcccagatcgtgccactgcaccccagcctggcaatagtgtgagactgcctcaaaaaaaaaatttttttttaccctagtgtggtgctacatgcctacagtccagctactctggaggccaaagcaggaggattgcttgaggccaggagtttgagaccagcctggacaacatagcaagaccccgtcccatttaattaaaataattccatggcctcctcccagcagccctgcgtggtatcatgcccaccatgtatgtgaagaaactgaggctgcaagcagtgaagagcttgtccaaggtcccacagagaggctaccagagtccaggcccacaccttggtactggcttcccctcttcatcctcggcaagagccgtgtgggagggagcctgcccctgtagggggcaggcaggtggctctgaccacccggctggctcctgttggggtggggctcctttccccacacccttgggaactcaaccctggatttggtgcctgcaccctctttcctgatctcccccgaagccccatcagagaggggcagtgacttttccagaatcacacagcagaggacaaggaaacgggtgcagctgggggtgacccctccagacaggttacccttaccaggggtaggcccaggcaccagccgggccaggcctgtgagagactccagtccaggcccttctcagctctgcagccagccccaggctctgccattggaaccccagggccctcctccactccccagacacactcaaactggagagaggaacctgaagcagaagtcccaccttgatcatttttttttacccccgctggacctagccaagggctgaacagagtccggatgttcccagaccaagcacggagttggggcgggtggtcagaatcagacctgattgggacggtgtttcctgccttgggcaggtggttttgcctctgtgagcctcagtttccctcacctgtgtgactgagctgggaacacttcctgcctcagaaggaggagtctgggtggtacagacaagccccaggtcggcggggctggggcggctcctcgcagaggaagcaggtgtttctgtgagcgaacacaccccactccctgaacacgagggaggtgttgcagtatcattgtcaccacatcctgcccgctcaaacagccgcgcccgccctggctgtctcattccagacttgggggcaggcaggctgctgcatgcaccgggctcctctcctccctcttctgttccccagtctttaggtcctggccctggatggggactccaggtgtccacatgtctcagtggaggcagctgtgtgattcagaagctctcccagtgccactttctttcccagcagtgtaggtggtgcgtggacccacctggtcattagagggcccgggccttcctgtggggcgggtgcttgccctggcccgtgagtcctggcatcactaggaggactgacttctggcctggagctgccagcccagggcgggcggtggtgtctgctggcccctttgtgacctgagcgctggtaatgctgaggggcggggaagctgcactcccagtcctgtttctcttggcaccgcctgggtgagaccttgggcaggcggagggcaagtcccacatggtggcgaggacctgagcccggtggtagagggacaggcctgctgggtttgttcttactctactctgccccttaatagcagggggatgttggcaggtgatgtcaccttcctgagccttagcacccccatctctgggatggggctatagaggcctggcctcttgggcatcaaggatgaccctaggagggcctgcaggggaggcctgcctggtgcctggcacacttccaggccctcagcactggctgtggccatcatcacccttgctgagtgccccattccacctgcctcacatggggtcctgctctgccttcctcctgtcctccccatccagcatagcctagaaagattggggctggggagtgtttggcatttgcagagaggtgctgttcttttttttttttttttttgagtcggcaagtgagactgtctcaaaaagggaaaaaaaaaaagtttgttactattctggttattaacattatcagtaatcaaagaaaggtggcccatcatctgggcacccctgttcctctcctaagagagacagacacatttgacacaggcatttaaaacttggtttagataaaaatctaggttctgggttacagtgtaaagtaaaaattgaatgta

SEQ ID NO: 3087 - DNA, 389 bp, Homo sapiens
ggcttgtgtgaagcggccgccccaagctgagcctgcagctgataaccacagacaccctggcagggaaatctgtgatcggaacaacaaaatgccaaggaaaacaaaacccatttgcatttgtagtaagtaagtgctgctccaccaagctgagaagaaatggcccttggctgtcctcggggccagtgctaggaactctggaccagccgtctgtagtggggcatgacttcgtgctcgggcaagtggagggcgaattccaaggccactaacaccgggaattcaaaggcaatcagttctcgcctgttcagccggaacttctcttccagtttctgcaacaaaaagaaaatcaaaagcatgttcattttgaaattaaaatcctagtctttctgcaa

SEQ ID NO: 3088 - DNA, 451 bp, Homo sapiens
attttatctaaagagagaggctgaagcattccttaaaccacagaagaaaacagtgaaagtacaaaatgacaacagccgtcttcaaatactgcttgtcagagggacaagagagaacagaggtgctgtgctgctccacaaggcaaaacaagagcaaacaagtctgtctgagtttcaagaggctggccctgaggctgcactgtggcagtctaggtgaggatacaactagaagccagcagtctacaggctggaagaaggccctcaccagaacccaacccttggacttcagcctccagaactgtgagaaatacatacctgctgtttgtaagacaccagtctatggaattctgttacagtagcctgaactcagacatagcccttttccatttataagattcattcagcttttccagaccaggcatcaccgagcggagagaggggaaacaccctggct

SEQ ID NO: 3089 - DNA, 14071 bp, Homo sapiens
ctctgcgagcgagcgcccgcctgcgcgccccgggggagggagcgagggctgcgagctgcgcgcccggccggggagggcagcgtcctcccccgcgccggcgcccgggccccggctgctgtcccgggaaggcggccccgcgagccgccgcggcccgctggggctcgggactagacgagcctccggctccgacagcgtgcccgttcagaagcccgcgcggctggtccccagccccgaccggtcccgctctgcccctccccgtccctgccgggcccggacctgcgccgcccgcgagggctggaaggcactggaagcgccgccggggctgcccagaggccgggtccccgctccactttgcgcaaacttgtttttctaaggtcctttgagatacattatctcactgaagcctcagcaactccgcggtgttcccagaggtgaggaaacacactgagagacagaacacgacttgaccagggccaccctgtggggcacgctggcacctgcacagcccagcttcacctggttccagccctgcccgcgctctgctccccacttcccgtaaccctgggctggcgtcagcaggcaggcctgccaggaggctggagctgccaacgacctatttttctgggcaagaagagccatttggagttagaggtctcagctgtgaagccagaacaataaaaataaaaacagcacggactcctgggcagcctggaccagggaaccaactgccccaagagttgctgctcaccaggctggaaggcaagtggggttggggggatgggagatgggagtgaccttaccgagcccctgctatgtcctccggcccttacagagtaagggtaatctccaaggttcacaacaggccctttgtctgggtggccagaccagtcaggatttgaactcagttttccaaacagtaacaattcccatctgttcagcagctactatgctttacagacttgtgacattcataccacacctgggggggtgagctaatcattccctcattctacagatgaggcagctgagacttcaggaggcctctgctcacacgccacctccttgagaggccttgccagaccaccctgttaaagtagtcaccctcacgcctgcccaatatgccctaccctcttccctattttatcttcatagcatgcatcacgacctgctaatattgtgtgtctccactgcattttgtctgtctccctaactagctccaggtcagtttatcctagtggcttgcactccagcggtctctcagactagccccgtggggcaagttattttgatgatctgtgcttccttcggggtaatgataggaccttacctgaaaggtttcttgtgagggttaaatgagttaatatcggttaagtgttggccgctgccattgttttgtcccagagctgtagctccagggtctttaacagtaaacaataggttgtcaataaatatgtattaaatttaaaaactgggctgggcatggtggcttacacctgtaatcccagcactttgggaggcagaggtgggaggattgcttgagcccaggagttccaggctgcagtgacctatgattgctccactgcactccagcctgggcaacagagtgagaacctatctctaaaataatagtaagtaaaaataataaataaatgaagctctctgcccacgatccaatctcagggtaaggaattggcacagcctggatttgaaggtgggtctctatgaacctgtgcttcaatccatcccacttcataatcgcctctccacaggcctccatccaaccacagctgcacaggcatcagagctttggttctacaacgtgagctgataccaatagcccctggagggattgttaaaacactgattccagggccctagccatggagtgtctgattcagtaggccttaggtaaggtctgaaaatctgcatttctaacaaggtcccaggtgatactgacgctactgattcagggatcacactttgagaaccgctgaatagactgccattcaagccaaggtgagactcctttgtaagcctggccccagtttccgtgttggttagtctgtccatccctgtggtttctgtcctccccttagggcgaaggcagagggcaggacagcgcttgctgtagagactgtagccagtgctctgatgcctaggggctgtgacagatcactgaacccaggggagctttgctgtaattagtgctttcctggggaagtcagtgattgagcaactcggcaggcaggcaggcagctcataggagcccataaggggtgggaccacactgtcgggccctaaacactgttctcaggctctggggatctagctccacccagagctgagccctccccaacacctctgggtgggtgtactggtggtgttgcaggggcagagagctgattgcctcagccatcacggagagacctgggtttgagtgctgactgcctaatagtactaatcacaggtaaacataggagtgtgtgttaagccccaggcctgaagggtttcagcacattatctcatgatgcctccctgtgattatcttacgtggacacaattcttatccccatttcacagatgagaaaactgaggcacagagaacttaaggagcttgtccaagagcccacaccttgagagctccagagccaggctttgaatccaggagctctcattccctatcccctgctcccgacctctgcacattctgacttctacttgcttaggatgagcttgggatgccccacagtgccctctctgggtttccatcactactgaggtgttggcttgatgatttccaggtcctgatggtttccacgtccttctcaggtgcccagcaccagacctgctaaaaggtcttagacacacaaggatctggtggatgaaataaggaatgaacagatgaccctaactccagttctgatgggacagtgtagctcagtggctaagagatatgcatgcaattccaggcgctgcccctcactatgtgtgtgatctcgagtgggtctcagcctcagttttctcatctgaaaataggtgagggcaggattaatgcataaagaggagagcgagagacagagacgagagagagagacagagaaaatatgcaccaacgcatggcagctgagaatgatgtttgttgcctgctccatctcagtctgttcgtgcagttcctcaggcaaaataccttggtgccctccttgacttatctctttctcttccttccctgccagccaatcctcttggctctaccttcaaaataaacccagaatccaaccactccttcccacctgcatcacactccggtcccagtaccttcatttctcacctggattagtgcagtcacttcctcactggctccgtacttcctggactccccaccttgttgcttcttcaataaaagcctcccaatggccttccactccttctcttggagtaaaacctgaagttctcagtgcagctcaaaaggccccctgtgatcccctgcttcactgacccggtctccccacactctcccccttgctcactccactccagttaattcaccatctcagtattccttgaacatgcccagcaggtgcctacctcagggcctttgcacgggctgttccctgtgccaagaaccctcttccccagctagctgcctagtttgcccctgactcttccttagggtctatgctcaaatatcacctctgcagagaagcatgtcctgaccactcagctaaaactgtcccatcacttcctattccctactccactttattttttgatagcatttccatttcttgacagcatatcaatgttatacatttgattggttgcgtggctctcctactgatctttgagctccatgtgagctctttgcctttgttccctagcacctggagctgagcccacacagagtagggcctcaggcagaaactactgatagagtgaaagaaggagcaggaagcaggaaacaggaagcaggatgcagctctgtccatgagggcactggcagctggatccaggggctcaggctccgccacccgagggcctggcttggcttgggtttcctgaaggaacaggtgtcctcgttggactcccccggctgctttcctgggcagggaagccaagactctagttggcctcattcctgtacccgagaaaggaagtgtccatccctgggcaggaactggtttggctctcagggaaagcctaaacaacacataccactgtctttgctgctgcagcttccgattgggaccatgccctctgggtagcagttggccacaccagccttcatgctgccactgctgctggagcaaggagggaagtggattgggaagtctcccagagccctttggactgtatctgatgggagcctcatagccgtgccatacctattgtacagatgagtaaacagaggctctacctgaccaacatattgacttagtggcacagaaaggccataaacccagatcttttgatagcaaatcccttagtccccctccttactcccaactcacaccctgctgccccaacgcctacaaccctggctggttcatacttgaaattccaccattatagttttctttctcactgtgtctcattccctcttcagcaaaaaaggtggtaactatccccatgaatctctgggaatagatgaggagactgaggcgcagaaagggaaatgggtggcctgagctctcacggcctgtaggcatgacaggccaagttagaaaatgttagtctgtttttcctctttatgtttcttctcttcagcttcaagcaaatagttgggcttagtaaacaggcactgcagggatttaggcagaaaaatgaactccccttagtctttagtaaagtctaaaaccaaagagattcccaggaaagactgggagagattgggggcaagcacactggagaagctggagggggtcaggctgacagggggtgctgcccccacgccagcaggattggggaggggacaaggcctccagggcaggcctcacggtggctccaggtagccataactgtgtctcaagacctctgccctcatggaagaccccacagccccacagggtgactgagatgggtgtcccttagggtgggacaatgggcacggcctccatcagccaacagatatttattgagcatctactatggccaggggctcagctggatgctggaaatgagatagtcacagttcctgcactcaaggcattcacattctagtggaggagatggaaagataaatgtatgaattaggggggaggggatgctattctatgcagtggaggtctcactcagggagtggagtttcctaaggaaagtatgaaggagagccataggaacaccaggtgaaaggaatggccagtgcaaagaccccgggaagaccctgggatgacaagttcaagggcagctgggcagccaggcaacgggaaactagccaggagtgaggcgggagatgaggttagagaggaagcagggtccagtctgttgggccgtgcaggccaaggtgaggccttcagcttttactcagaaccagatgggagccactgcgggattaggagccgaggagctgcaggcaagcagtgtggacagattcctggaagccacctcaaatgtccagagactctctaagaccctgcatctgagcaggctctggagaggagagagccccaagaatgaccaaggttgggcttgcttcacgtcacccccatgggatacattcacagaccagatgagtttaagtaatttgaggcttctcaaactttattcttgctaaatgcagattctgacttagtaggtttgtagcggggccaagattctgcatttctgataaacttccaggtgaggttgaagctgctggtccctggactgcactctgagcagtgaagatttaaaggaaagaaatggccacatctggcccaactgtgcctgtggtttgagaatcatacctgctgcttggcttcaaggccgtcattcagggctcttgacaaatcgtgcagcccctccactcagcctgttgcccccaaaaaccaaatgggtctttccccagctccatgcttcctgtatgacataggagtggtcagggtgggcagtgggctccggagccagcttacttgggtccagattccagccgtggcagctacaggtggcaagactgtggggaaatgattttatttgtcttgccatttagtttctcatctgcaaaatggaaaactcatgacagcttctttacagagctatttgaagattcaaaggcataatatatatcaaaagtctggcacacaggagggacttcataaatgttatatcactttcccttcagtttcacctgtcctttaaagtagtgatctatgtacctttatctcatttttcaaatttttctattttgtgtatgtgttctatgaagtacataacaaagaaatatacaaaaatttgtaaaaagtatcaaatgtacatacattgaggaatacatgttttaaatgtttttactgatagggaatatgatacaaaaaattttgaagaccactgttttgaagcccagtggaattgatagaaatagactctcagggctggaatagattttaaaggccttcaattcccctggcacccactctcccatctgatgcccaaaacccttggttgcactagattgcctccaggggtggggagctcactacctttccaggcaatccattttgtacagctctgggaatggtttcctgaacccagtgcctatctgtattctagctgcctctgagttcccgggggctgactgaactgctcctccccttactccactgtgtcagagccctgggatctcccaggggcccagtgccaggttgtgtgcagagtgggcctaaataatgtcccatgaatgagagggagtgggagatggggatgagaagggggattctgacaactctcatttggaggtatgttaacagctgagtgctgttgtccccctgggagtgtgttgatctgtgtaactctggatccgtatctattcgtttggatttatttgcatgggtttgtacatttgagtgtgtatgcatgcattgtgtgttttgctgtgtggctatatatgagtgtgtgtgtatgtctatgttgcaccgcaaatatccacgtgtgctgtgcatgtctttctctgtttttctgcatgcctgcgtgtccaggtgtatgtcactgtggggttgtgtgtctgtctctggtttgtttgcatgtgtgtgagtgctgtacgcatgtgggcgtgtgctgtttgcactgtctgtgtgtgcgtgcacatctctgtttctttgtgtgtctgtgtgcctggggccctcctttgtgtgtctctgtgtgtgtgtctgaatctgcaggagtgcgtttcccttccctgctcagccctttcagggagctgaggtgattcgctgcagcctggtcgacttaaggccgtccgactggcaggcagcatggcttccacaccctcctctctgttctgctgtgctaatcactgggttatatgtagatggcaaatgtgtggctgccaggcttggaggagggactgtggaggggggtgtgcagatgagcagacaccaaagagtgaaaagacaatttaaaggcagaaagggggaaaacaagcctgcttggctttggagttacgggtgtggggttcttcccagaggcgtgaattttattaaggggatgtgatgactacgatgtcttccttcccctaatcaagtaagagtcttagaatcacaggattctaaaatcttggaattgtcgaactatagaattctagaatctcagccgaatgcaactctagacgcgtagaacctcttcaaggaccctaatcctcctgggattttagcatcttcacatgcacatgcagttcttcttgtcccccttctctttgtatagaatcatggccagaaaatgaccttgaaagttcatccagtccaccccaccctggctccgggcagggcagtggagacagaggtccagccagtgaggacattcttggaagtgttgcactggaatcttccctggctctcttgctggacaaggacttgttgcctgaagggtctggggtctcatattactctccccaccgccacctgccacagggactgagttcctggcgaagacaaaggcacctatgttcctaggatatgttcttagcagttcaggagctgacacaggctgcaggtgtggggagagtaaaggggcagggctctgtttctctgagatcctccctcggtggagtctcagtaacctagcctggggtgggggtgggtagctaaccaggcaaccacactcatgccccaggatattcagtggggtgtcttcttcctcttattgcttcctcttactgcttaaaagagtagactatatccggtcgggcacggtggctcacgcctgtaatcccagcactttgggaggcccaagtgggtggatcacctgaggtcaggagttcaagaccagcctggccaacatggtgaaaccctgtctctactaaaaatacaaaaattagctgggcttggtggcgcatacctgtaatcctataatcccagctaatcaggaggctgaggcaggagaatcgcttgaacccgggaggcagaggttgcagtgagccaagatcacgctattgcactccagcctgggggacaagagcgagacttcatctcaaaaaaaaaaaaaaaaaaaaaagagagtagactgtgtcctatctcaggaatcctgggagccatggactatccctgagggagggcattgcactgtactttgaaaccctccaggactcacctatactctttaatgtggcagcttttcaggctctggctactagccatcccatccctccctccctccctcccttgctccctgcctcactccctccctttcacacatgtccagccgcagtgaactccctattcaccttgaagctacttgacttcatgcctctgaatgtttgcacaggctcgctctcttctttatctcttcttcttggtgcaaaccttgttcatccttggaatacaagctctcactcaattgtaagcaccatgagagagtttggtttatttaatactttatttccctgaatctacaacatttggcacacattaggtattgaaccaatgtttgttaaatgactgactgaatgtacagttcaaagtcagctcatttccactctgaagcctcaattctccaaccccttctagatatttccctggggcccgcaccacgcccgagattacctgtggttgtgagcccttgcttacttcttcagcggacagggaacctcttgaagctggagtcgtgtctggttaatctttttacacgtagcatccagttcagggcctggtacccagcaggtgcccagcaaatgtggggcccttgccagcagcctggcttggtgacttgaaatcccctgttggtcccaactgcatgcaccggtccaagctgttggcaacatctgcctcagagtctcatttgcaattatacattctcaggctcttgccacttaatatttaataaccaggcgggtggccttctctggcagccagttaagtccctgattgcctcttgtctgaacttggccccaagtgaggcagggactgctttggggttaagtgtaaagtctgtgtcctgagttgggggctagcataaggccagaccgttggagatggaggaaggaacggctgctggctcaaggcttctgggtgaccttaccaggcaagaggcaggttgggtatttgctccaactggttccacctctcctccccttccatgtaggtcgacgcccgctcctggcctcataacaggggaggaggaagggaggaaatttgttaatgagagggtccctgactcacatctgattggtccaggagaaagaaagggggattccgcctgggctgtgtcccagcaggaaaggtggttctatcctgtgtggtttggccaccaggagccagggcagtccctgtgagggcctatggcgccacggagtggggctctggcagccgtgccagcctctcctggcacaaggctggggaatccttccaagttggctgtggaaggagatgaggcaaatggtgatgacctgaccctaggggtaacccaagctgctgccgagctctgtgaaaccctgcaggcccagggaggcgtgggtcagttctaaaggctgacctctgcagaactgctggggtgagagggcgcagagaggccaagtgacatccaaaggtcatgggaggctccaggaaggggaacagcaagcacaaaggctctgaggctggactctgctaccgaagcccgaggtccagagaaggactcacacctgggaatctcagactttagatcccagaggacattttacagggtcaagagatcccactctgcccctaacaagcccagtgacctgggacaagtcaccctggtgtttatgctgtcaccgcacatgttgggcaacatgactgcctgaacccttcctgcgtggagtcctctgttatcccctcagaggtcatttggtgcaatccaggaatctgagaccagaaatgccgctctgttgatcaacagggctggttcctgtagaaggtggtgcttagtgtagaacactatgctttcccaatgggcagtgtttaccagcacttactgtatgcaaggggccacgctcaataaaccctctgctaacatacatggtctcaatcacctgtgccatccttgtcccttccctttccctctcctgctcatcatcctcagatcctgtgacagtatctttaaaacccagcccagccctggtccactgtctcgtcccacattcccctgcactaccttcttagaccacagctgctgtcatgcccatggctgtaccagcctcttttcagctcccctgcaccaccctggcctctgcaatccatcccctaccagcagccaggaggcctttgaaccatcaaaatcagatcacatccctcccctgctctgaacctccagggactgccatggtgcttccagtcaaaatgaatcctgcagccatgctgctctacgtggccagtccccactcttctccatcctgaggttgtccatctttgctgcccactctgcttcagccacactggcctccttcctctcctcaaacgtgtcccttgaggccaacctggggcccttcaaggctgttgatgtcacctgcgccttagttcaaatgcctccccccagagtatccttccttcattctctaaaagaccgctcctccttacatctggccccttgttatcccatttccaagttttatagcacttatcactttctcatatttctcttatttatttatgtgcaccctcccccacctggaatgcaaatttcgtcagaacaagacttagtccctgttgttccctgctggttcccagtgcctagaaggcaccagcacgtggcagggactccatgggatttgtcagaggagggatgacatggcctcgagggatgagtgtaatagtagtatcccatttaataggaagcccagcaatgctaggtgcctgtgcaacttaccaaacttgtgaagggtggagtcgggattcaaacccccatccagggggctccagcatctatgcttttgttcaggaggctgcatgctgtggtcatggtcagagcccctgagccccagggactcagaggtcaattaggggtgggggagggggaggcactggtgctggtggtgcctgggatgtacttttcgattttgcccccagctggggccctaccttaaggttagggttctggaacgaggggcagcctcacccatacccctctgcccaaaggctacccctgtagctcctgttgaggctgctgggccccctggaagtccctggcttagctgtgggtcagtgagctcatcccctgcccaccctacggctttccaacgctccctccctctgccgcagtcgttgctacacaagttaatggaataacaagacactttacctattatctgatgcaaatacctttcctcgccagcaccagctgtacagctcagatcttcctgtaacccagcaaacaggccttcagctccaggctccagctgaagaggcctgagcaccagccaggcactgacaaccccctagctcgagccctggaaggaggggtcaggggtgttgtgctgatggggttgtggcaccaatcttagtacttttcaccggcgaccgtacagtgaggcccactgtgcacaggtagtttgcatatttcaccttcacgtgattacatacaattctgatcctcactaggcagatgtgaggatgaaaggctcaggcaagtctgtgtagcgctcaagtggtggatccaggtgggtttcacacccacatcctaaaacttgacccctctcctatccacttcctaagggctttgtctgagtggctccatttagacccgatttctctaatagctccatagtaggagttctacttatagacaaagaagacgaagggggtagcaccttgctcagccacaccagggtaagtaggactgtatgcccaggaaggtggatgtgtgtaggggggtgcagttgggtcaggagagttcccaaagcttgccccttgggaagctctgtcctgggacccccgcaccaccaaaacacacctggcctagttcatattcagtgctgcaggcatgtacagggcatgtacgcaggcatgtacagggcacctagcaggtgctgggatcacccagatggaaggtggacctcctccaaacaactacatgaatctcacaggatggcaggacagacttaagctccctgtgcctcagttttctcatctctaaaatggggaagataatactgttacttcttctgtagagttgtgctaaggatgaaatgagaatgaagcacttaaaagaggaccgagcacatactcagtgaccaatcaacagccgtttttattgtcacctccagatcccacataggcagctcttctcgaggtctatcgtcctgacaaataaagcgctagttctgtctaggtcagaattgcctctaagccagtggttcttaaactccagtgtgcgcttcagaatccagtagcatcatgtgaaaaatgtagccacagcaggtctgaatgggctttctaggaagctgcctgcatcccattctgacacaggtggtttgcagcagggctcagacccattgctctggggggcaccaatgagactttgtcatgggaacgtgactcctggtgaccagcccctcctcatcgccatcaagggaggtttaggatgtagcatagtggtcaaggccttgccaggagacctgggttcaaatcccggcttccctcttctgggcaaatggcttccctcatttccttttctgagacacagaggttccacagttcccatctccctgtctgagggttggatgaatgcctatccagagtgggcctgagacatgttgcacacccagcaagcaggagtggctgccaccttcgccccgcagcagtttgtcttctgaggcttctgtccctgagtgttttattttctgttgatagattccagctcatgttcatgggtctgcacctgcatacaaatgccaagaggactggcccacccccgggatctgtcctcacccgctcctcaccaagcacccggctgcaagttcccagcagggctcggaagtcccggggcctcctgtgaagctgggaccaccatgctggtccagcctccttggttgtggtcgtggccggaagcagccagactgctggcccctttgagagcgggtgtctctgtgagagagtgactgctgggaggtcttcagggaacttgggcgccgctgggacaattggtcgctgtttgggggagtgaggttggcaggcccttggccctcggcactgagcctctgccaggcccctgccaagcctggggctggtttcccactgcctgctagtttcagggccatttggggagggggcccaggggaattcattgcccctctcttcagcgtctttgctgtggtccaggaagcccgggcagtgtctgctctcagacagcaggtcagcacagcctcagacatgttctgatgatgcccgctgtgtaccaggctaggggcgggatacttagaaccagcctccca

SEQ ID NO: 3090 - DNA, 4913 bp, Homo sapiens
agaacttctagtgctctgggcagctgcgaggggtcaagaaaccacatccccaaatccagcgggtgagtctcattcctttgctgagtgggggcctaaaatggggcactgtggctgcctgacaaaggaagagactgatggctgacccttagatgtgggctaggggactgtaattgatttcccttcacatttctgtcagcaggaggaataacaggagggctaagcgggaattgtggtgttcaaagtcaaagaacattaacctgcggataactctgggcctcattagcaacccagccttctgatgttttctctccacacacaggatctcagagagaaaggctgatgggaagctgcccagggctgacctggcacatgctgggaaaacccctcggtgccagggcaggaggcagagcgtctgcagctcctccctccccaacacagggggtaaggaatacagcagaacgggaatcgggcgccttcatgctgctgttaccgcccttggttcatggcttctttcacttggaaaccccaggaggtgggcattgctgtaccgcatgtgctactgaccaaaacaggccaaagctcagcgaggggtgggatcacctaaggttgtgcagcacctacgtggtggagtgaggatccgagcctccatctttcatgcattaattcattctgtctctggattcccctagaagcagaccctgaggcaaggatccacatgtaagtagcttatttagacagagcagaaaatatcaatgggagagtgaagaagtgagacaaggcagggaaggtggctcataaagggtatgttttcaagacagctgctcctgtgggcaactggagcttaatccccccagggaatctgggagccagggtggaacaggcctcagagtgactgcaccaatggggcccgggagttggggtataaataccaactcccaatgttggttgagtgctgctcctggggggcttctatttctctctgtatggaaggtaaagcgggccctggaggccacaaaaagaatcctccaggaaagaaatctcagtgctgccattcagaaaagcagtcagcatgccctgaagtgctagggcaaaagggtggaagcaggcactgacatatctactccataacttgcccaacaaacactgtacagggtccctcctaggagactgatgctgagccagacccggggcatgtgcaagggaacctgacccaccaggtcctagcagctctgtgctatgagggaaggcaaacaggtaatgtttccaagaaaaaaaaaatcaagtagggacacattctaggaaaaaaataagagagaattattaatggcccatggaacagctattttagaatgaatggttaaagcaggcttctctgagcaggtaactttctaactcctaaaccaaaggtggctttttaactccagtattaacataacactgaatagcaacctgcagggagatactgcgctgccctcagaagtagctccaatttaataaattattgcattaaaaaggaacaaactattgacacacacaacaatttggaaggatgtcaagggcattacgctgagtgaaaaaagcgagtctcagaaaggttaccaactctggtaatgacataaatgctacataaattggctgggcgcagtggctcacacctgtaatcccagcactttgagaggctgaggtgggcggatcacgaggtcaggagttcgagaccagccgggccaacatagtgaaaccctgtctctactaaaaatacaaaaattagccgggtgtggtggcgccgcccgtagtcccagccacttgggaggatgaggcagaagaatcgctcgaacccgggaggtggaggttgcagtgagccgagatcgccccaccgcacaccagcctgggcgacagtgtgagacttcgtctcaaaaaaaaaaatgctacgtaaatggtatgattccatttacgtagcattcttgaaacgacaaaatgtaggtagaggaacagatcagtggtttccattgtcaggactgggcatggggaagtgtggctgtacaagaggagcccaagggaactccttggtggtgatggaactgctctgtatctcaaatgtctgtatctttagaaagaaatctacatatgtgataacactgcatagaaatatatacatgtacacacaagtgaatgtatgaaggtctgtacattataccaatgtcaaggtcctggttttgattatgtactacagttacatagaatttaccactggggaaagctgggtaaaggtgtgtaagatttctctgtcctttttttttttaattgagatataattcatatagcataaagttcgccattttaaagcgttcagttcactggtgttttagtatattcacaaggtttttcaaccattaccattatcttcttccagtacattttcaccaccctccaaaagataaccacattcattagcagtctctccccattcctgcttcctcccagcccctggcaatgactaatctactttctgccttcagatttgcctattcgggacatttcatataaatgaaatgaaattatacaacatatagccttctgtgtctggcttccttcacttggcataatgttttcaaggttcatccaggttgtagcatgtagcaatagttctttcctttttagggctgaataatattccattttgtggaaatactacattttctttattcatccattgatggacatctggctgtttctactactttttggctattctgaataatgctgctatgaacatgcatgtacaagttttttttttttttaaataaatgtatgtttttagttatcctgggtatgcacctaggaatggaattgctaggtcatgggtaaccctacatttacctttttgagaaattgctaagctgttttccacaggggctgcaccattttacatttccacaagcaaagaatgaaggttccaatttctccacatgctcaccaatacttattttctcttttcttttttaaaattacagctgtcctagtgggtgtgaagtgatatctcattgcggttttgatttgcatttccctaacaacttatgatgttaagtatctttaatgtgctcattagccatttgtacattttcttggagaaatgtctattcaaagtcctttggccatattttaattgggttgttcatctttttgtcattacggtttttttctttgtatattctgaatattagacccttatcagatatatgatgtgcagatattttctcccttttgtaggttgtatttttactttcttgacagtgtcatctgaagcaaaaatgtttttaattttgatgaagtctgacttatccgttttttcttgtttttggttgtttgtgctttggatgtcatagctaagacttcattgacaaattcaaggctatcaagatttacacctttgtcttcttctaagagtttgaaagttttagctcttacatttaggtctttgatccattgagttagttttgcataaggcatatggtggaagtccaccttcattttctcgcatgtggaaacgcatttgtcccaaggccattttttgaatgactatgcttctcccattgaacagttgtggtatccttgttggaatcaattgactataaatccatgggtttacttatggatgctcaattctatttcattgatctatatgtctatcctatgccagtaccatgcagtctttattactgcagagttggcgtatgttttgaaattgaagtgtgagttctactttattctttttcaataatgttttagctttccaagtcccttgaaattccctataaattgaagaatcagcttgtcaacttgtacaaagaaatcagcagagattctgatagtgattttgctgaatctgtaggtcagtttggggaagtattaccatctcgacaatgttgtcttctgatccatgaacaggggatgcttttccagtttcttagatcttaggtttctttcaacaatgttttgtagttttcagagtaaacattttgtacttcttttgttaaatatatttctaagtattttattcttttgatgctactgtaaacataattgtttcttaatttcattttctcttgtaatcctttttatttctgtaaggtcaatagcaatgttctctctatcattcttgattttagtaattttaatcttctcccccatctttttttggttagtttagctaaaggtttgccaatgtgttaatcctctcaaagaaccaacttttgatttcattgactttctctattgttcttctgttttctgtactattttacaaattcctgtgagtctataattatctccaaataaaaagtttaaaaactgtaagcttaaacaacaaaacaaaaaaactgtaagctatgtttctgtttaaaaaaacaaaaaaatatatatggcacatttttatgtactggggatatagtgtaaacaggacagataagaattttcagataaactggggagacataatatacatgtaaacaagatcatttcttacagtgagatgtgctctgaagaaatgaaaaaggatgatgtgatagtgactggggtgggagggaacaggcctcctccagattgttgggtgagggaaagtcttgctgagaaagtgacattagggctgaaatctgaatgtggagaagcaatgtgaaaaactggaggaagagggttttggagaggtaggaatgaggttggtggattggaaggagagggcaggcccaaggctgctggagcctgggtgtgaggcgggggtgtgtgaagcagacagagttggggcggaggcctgttcacagagagcctccaggccatggggaaacaccagggctttatttccaagggtaaccagaagtcacagtgaacatgtttcaagtaggggaagggcacaatctgag

SEQ ID NO: 3091 - DNA, 2235 bp, Homo sapiens
gacccgcctcactaagacccgcctcactacggacccgccccactacagacccgccccactaagacccacctcactaagacccgcctcactacagacccgccccactacggacccgccccactatggaccctcctcactgcagacctgttcgctcaagtggaacaggccggtccgggccccatctgaggctgcgagggccgcggagatacggatgctggtcccaggtgccttcggagctggcctaaggttccaccctggccctcccaccagaccccgtgtgacacagcctccagccctctgtcccctgggggcccttcagctctggtattcagtcagaaatcctaacacacctttcttttgtttatttatattctttagttttgtgcacactttgaggaattgatttaggacaggttcatactgaaaaaaacctcagctgatgttatctgtgggggctggggagggtgtcagggacatttggtggctgaggagagcgcgtcactgctattgaatagctccatttaacaccagccatgtctccgcgtctcaggcacttctgtgaaatgttctcagaaccctgtggtgactgcggcacacccggcaggccttgctagcacacgccgcccactggcagggcccggccaccctggctgttgccattctttcgtagggttttgttcattttactatttgtcatttttctaggaaacatctgtttttgtaaaacaaacaagggggaatcaagtattttaaccacaaagtataaatactggctctaagctttcatcacttcattgacaaactgaatgctgaggaggctgaaggcgaggaggcttttgcggatgtggaccttgagctgcgtgtttgggagacgcacaggcctcggggagactcaagccagatgccagccacggggaccacagccttggcccaagagtggcatttgtgggaaaaaggaaacttcaagaaaaacacccctcctgcttctcttccagcagctcgtctccttctggaaggatgtggggagcgtccagggtaactaagtgctctgcgtccaccagagtcacgtctccccaggagggctgggccgcctacgccagcacctgctgcacccccatgtggtccggggagcagtgccggtccccgcagggcagctttttcatcagccgttggagcttgctggggaagctctggttcatgtagcggtagagaagtggtgtcacaaagctgctggagaaggccaggagtttggagaaatccttcacaaagtgcagtagccccaggtagtgtgcgtccacgggcttccctcgcgagatgatgaccgtgtgccccagcaggatcagatagtgtggcgtccagagcccaaactgcgtgcacacggtggccaccagcagcctgtgtgccgagggctccagccggcccgtgtcccggtccaggggcgtgtcctccctgcggacgcgggagagtagcaccagcgcgtagagggtggccagtgctggcaccacgtagccgatgaacaccagcgtggcgtcggcagcttctgcgttctgcatcttggcgcactctagcgcgcgggtggacacatggctgcagatgtagaagagcagcgaggagaagctggtcagcagcgcgccaccccacacgaagccgcacacgtgccgcgtgttgtacacgctggccatgtaggtccgcggcagtgcacgctcgatgtagtggtcgaggctcagcagggcggtggagtacatggccaccagtgaggacacattgaaggggatctgcagtgccacgtggacttcgccgcccacactccacagcgcccaccgggagctcggggggccgagcaggtgcacaggggccagggcgctgagcaccaggcctgccactgccatgttgacaaagtacacgtccggcatggtcatgctggccttgctgtgtaggttggccagcaccagcagggcgttgtagcacaggcagctcctccaccagccctgtgccgttgaaccagctgcagctccacatggcggccggcgaggctccgcgaccctgcggaaagaaggaacaggtggtcagctcgcgtcccgtcccaaagccctggcccagaagtgctgcaggtacaggggtgccttctcctggtgcagtaatcgctgcagaccacagagcgaggctgcctttggtgcatttctgtgaaagtgaagttgagcgttgaaaaatggccgtctcgggtcgtgaccgggg

SEQ ID NO: 3092 - DNA, 1395 bp, Homo sapiens
cactgcccccggcagacccttcatgcagcttctcctgtggggtcttgcccttgaagtgccacttcccccagccccacctctggtcccttccagagggcacccttagccttgtaggtccctgggaagctggcacagcatcaaccagaagtgatgcctcagccaggccaccagtcgctccccgcctgggagctcagctttcctcagaaccaccccccctgtctgaagctctgtcctgggtcccaccagacttctgcccaccaggcctacctacagcatccacatggggcctcaggaagggccccgggggcccagggatgggcaggggcagggtttccaagcgcctggggctccattctcctctgtccacccacccacaccccttggcctcagcctgccctgtacccaagcttccctccccctctcctggggatcttaacggccttgttctctctccctggcacccacccccagggcgggtgatgccgccaagagagagggaggccgttgctaggtgatggcgccgccatgcacacaccctttgtgctggggagtgacacccacccgtttctcagcagacctgttgccacggtgactgaagcccccagctctgtctgtagaaacttcagatgggtgggggagcaggttggagaggggaccaaaggcaggcctgtcgtgctgaagctcttggggaccgtttcctcggcatttccccaactccttctccacccccctgccaggcccggaagtaccaccagcttcctaagggatgcaggaaggggccgggtgaactgaggtgaagtccagggcaggggagtcagacccctcaacatcctgtttaggggtcctcctccacaaagggtgccctccacctctccctcctgctggttggccggctcagagatgaagggggagagatggtggctccaaggctctgccaccgccacctcccaagcctgccaacgtgaatggcttgcagaatcagtcagcaggccagcggccttgggaaagagccactgtcctcgcagcctgggccagctgggggaacaatgtagggtttgttgcttaggggtcccaggcttgcgggggggttggcacatggtgggcagtggacttgagctgggatggtctgagggggcactgacacgctcacccgagggcagacttcagaccagccctcagatcctgatgccaggttacagggctgaggggagcctgaaatccactgggtctccctgctccacttgggagtcaccttctcatcacctatcctggaactgaatgcaattacttaaactcagtctcagcttcctcatctgtaaaatgggaataatctgtccttcacagaggattatggtcatttaatgagacaagatacataaagcactttgcatggtg

SEQ ID NO: 3093 - DNA, 3140 bp, Homo sapiens
tccatggccaggcactttttaagataatttacataaattttaaaagtagtattagtaaaaaaagaataatattttaatttataaaacattactctcattttataaattagaaaactcaggccaggcgcaatggctcatgcttgtaatcccaacaccttgggaggccgaggtgggcagatcacaaggtcaggagttcgagaccagcctgactaaactgtttttagtttctactaaaaatacaaaaattagccaggcatgatatcatgcgtgcctgtagtcccagctactcgggaaaagaaaaagaaaaaagagagaaaaaaaaagaaaactgaggcacagagagattcagtaccttgcccaagagtgcccaagtatttgtgtacatgactgagtcaggctgtgtgactccaaggtgagtaacctatgccagttactgggaatgggctgaaagggtttgcaaaggaagctgaagaccattctcaccctgccctgggggaatcatggaatggtgccaaatagaaaaggcaagtttaggctgttctaggtttccccttccagaaatgacgttggcctaaaaccatggtcgtcaaatgtttttgttcttatattttgtaagagacttgaaaaaccatgtacccccttgtacgttttaaagttagcaactgacatttttcattgtaagtttaaagagctgtaagatagaattactggctttttgtgattaatataataaaactatgaaagcactttgttttgttttttggagaaggagtctcactctgttgcctaggctggagtgcaatggcatgatctcggctcaccgcaacctccgcctcccaggttcaagcgattctcctgcctcagcttcctggctaatttttgtatttttagtagagacggggttccacctggctggccaggctggtcttgaactcctgacctcaggcgatctgcccgcctcgacctcccaaagtgctgggattacaggcttgagtcactgagcccagccgaaagcacccttttaaaggaatctacaggaatataaatatagtaatttgatattaccatcatcaatttagaaaattcatgactacacttttttttttaaatttttatctttatatatttatttgagacaaggtcttgctctgttgtccagcctagagagcagtggcacatcacagctcactgcagtctcaaacttctgggctcaagccatcctcccagctctcatatcacactctttaattttacattatttcttttttttttttttgaaatcatattttgaatccatttctatgtaatcttgtactaatataattagtgattaaaaacattttatggccgggcacagtgactcgtgcctgtaatctcaacactttgagaggccgaggtgggcagaccacctgagatcgggagttcgagaccagcctgaccaacatggagaaaccccgtctctactaaaaatacaaaattagccgggcatggtggtgcattcctgtaatcccagctactcgggaggctgaggcaggagaatcgcttgaacccaggaggcggaggttgcagtgagccgagatcgtgccatcgcactccagcctgggggacaagagtgagacttcgtctcaaaaaaaaaaatttggaattgtccctttgatgccttacatgcttttttcaccccagagtaatgcatcatttgtcaggattagggaagagtaagagataaactttttttgataaagtgagaagagggcaattgagaaaatgagatgggaaaagaaaatcagggctgcagatgtcctctggggcgcatcaaattgaggatctagaaattgatttctttgaaactaaccactgccctgtactccttggaaagtatttacatacctaccctaaccactactggcagccctaatgatctccatgttaaatgtgtttctcccagccacacctgcccagagggagaaactgggtcatggtagcagtaaccaagcagtgctctttgttccttaccccaccagatttacacaacctataaccctctcagtgatcttctgagtcattctggagtctctgggggtagatttcatatgctcactaattggtcttcttggcctcttggtggtttctgctcatttcattcatctcctatagcttggcacagtagaactgctagcctcttagctgccagagccaaacagactgttccatgtgagaaaaccaacctccagattcctggggcgtttctggtgtagtgaccttccagagggaaatctacccctactcctatccagtactcttccctgccatgaggggatttagaagggaaagcactccctgctgacagttcttacaggggtttgtgaaacaaataatcccatttggtcacccttttggttgagaagtggtgataaatgctcgaagtggtctgaagtgccaggtgctataaaagaacagaaaggggcctgtgatccctgactgcactttatatttcagcattacccactattttttcatatcccacgactcaagattccctctcaagtctttgctctttgatctccttgatgaactcacattcacccttcaaatctcatctcaatcccttctttcaggatgtgttcccattccgctaatgcccttgagggttttctgctatctccatgcttttactacattttggtttatttgctcttactatatattttcttgttagtctttgtatccagttaaactatgggctcctgagggtgttgggactcaggagataccacatttaagtatgactgtaggagacagaaatatgccaccccaaaacatgcctttttggcatattaataatttccggctggttattttgagaaattgcagacataggagtagctttggaaagttactcttgtaagagaaatgtgcagttgacccttgaacaacatgggtttgaactgcacaggtccacttatactcagattttttcttttttttgagacaaagtctcactctgtcacccaggctggagtgcagtggcacgatcttggctcactgcaacctccacttcctgggttcaagcgattatcctgcctcagcctcctgagtagctgggattactggtatgcaccactacactggctaattttttt

SEQ ID NO: 3094 - DNA, 1733 bp, Homo sapiens
caggcaggagcagagcccagagagaaggcaggagccgacttcccagcagcagtggcaacagcaagtgcccagctgtgcacaccggctccgtctcccgctccgctatccccatcgcctcttagctgccagacgggctaccttgtccttgcccgagactcaagagcaggaaccgggcacagaggagctgcggaagctgggctggccgggccaacccggaaacagcctgagccctggggtcccgcaagaccctcagctgcccctccttgctcctctgggccttctcctgggtcccactcccttggagagcagcacggtgccccacgcccatgcctggcaggagccctgcgagcacccccagctttccgggtggccgggcctggcccctgctcaccatgccttgtctcaccatccagtcactgaggcttttcccgcagccgcctcccatctgggtgagagagagtcacgctgatggcggagggacggcagcgccagggccactggagggcgcggcttctaacaggggtgcgcctttcgggtcaggaggcctgctgccactttgggaggcgtgtgtgtgtaggggtgtgtgtaggtgtgtaagggtgtgtatgtaggtgtatgagtgtaggtgtgtgtgtaggtgtatgagtgtaggtttgtatgtgtaggtgtaggttgtgtaggtatagatgtatgtggtgtgtgtaggtggtgtgtgtagatgtgtgtggtgtgtgtaggggtgtgtgtgcaggtgtgtaggtgtatgagtgtgtaggggtggtatatgcaggggtgtgtatgtaggtgtatgaatgtaggtgtgtatgtgtaggtgtaggtgtgggtaggtgtaggtgtgtggtgtgtgtaggtgtgtatgtgtaggtgtaggggtgtgtgtgtaggtgtggtgggtgtagatgtgtgtgtggtgtgtgtgtaggtgtatgagtgtgtaggtgtggtgtgtgtaagggtgtgtgtaggtgtatgagtataggtgtggtgtgtgtaggtgtgggtgtagatgtgtgtgtggtgtgtgtaggggtgtgtgtaggtgtatgagtgtaggtgtggtgtgtgtaggtgtgtgtggtgggtgtagatgtgtgtgtggtgtgtgtaggtgtatgagtgtgtaggtgtgatgtgtgtaggggtgtgtgtaggtgtatgaatgtgtgtgtgtaggtgtgtgtggtgggtgtagatatgtgtgtgtggtgtgtgtagggctgtgtgtgtaggtttatgagtggaggtgtgtgtggaggtgtgtggtgggtgtagatgtgtgtggtgtgtgtgtgggggtgtgtaggtgtatgggtgtgtaggtgtggtgtgtagggctgtgtgtgtaggtgtatgagtggaggtgtgtggaggtgtgtgtggtgggtgtagatgtgtgtgtggtgtgtgtaggggggtgtgtgtaggtgtatgagtggaggtatgacgtgtggaggtgtgtgtggtgggtgtagatgtgtgtgtggtgtgtgtaggggtgtgtgtaggtgcatgagtgtgtaggtgtggtgtgtgtgtaggggtgtctgtgtaggtgtatgagtgtaggtgtgtgtggaggtgtgtgtggtgggtgtagatgtgtgtgtggtgtgtgtgtaggtctatgggtggaggtgtggtgtgtggaggtgtgtgtggtggatgtggcggctggtgtagagggatgaggcaggtattgtggtacccaccgg

SEQ ID NO: 3095 - DNA, 1526 bp, Homo sapiens
gggttttgtgccagacaggccgtttccagggacaggcagttcccagcctctgcctgtcagaactcagggcctcagaggaaggcccgttttgttcagttctaaaacaaaacaaaacaaagcaatggggggcgcggtgtgacttagagagccaggaggcgcgcctttggtgacaatttctgcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcatgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctg

SEQ ID NO: 3096 - DNA, 2899 bp, Homo sapiens
cagggttgacgggagccccagcatgtggcggggccgggcggggggcgtggggtgctgcggggagctctctgaggatggcgagcggctgcccccatcgttggccagcgggagctgcagggctaggggggtgagaaccagtggcagggaggggggtcagcgcccagctggtgtcagctccacatctggcactccagggaggggtcgggaccctcaccttcccctcctgggtttcccgagctaggctggcacagccccctgccctgctgggctggaggagctggggtctccctcccaccccagactgttctcagggtcccttgtctcatcccctgacctggaaagagatggaggaggctagcaggggagagggagccccaagtctacgctgacggagaaacgagatggggacctgaggtgtccctcggccagggggcctccctgacaggtgtgtgcacttcctcccacttctgcccaggaagcaggcccagggccacagcacccacaggatggataggccagggcggagtgcctgccagggctggcccaggctgtggctctgctggtagcactgaagttggctcccagacaagagcgagcagggccacgctggggaggcagcgggcacgagacccaggcttcaggctgccttgccctatcttctgttccggggtcagggagggcccccctcgggccagtgggctgacatgagggcctcctggcctggcctgcagagctggggcccatgggggcaggacaggacctcagggggcctgcatcctctgggaggagagctcgggggaccaggcaggagcaggggaagggctctggggaccttgggacacagccaggcccagcgttcatgactggcctagaggcctcacctcccgtgcccctcccgctgtcctggccactgccgcctctgcagcaccacgtcacctcccactgtttttttttttttttgagataggttctcgctctgtcacccaggctggagtgcagtggcgtgatctcaactcactgcaacatccccctcccaggttcaagtgattctcctgcctcagcctcctgagtagctgggattataggtacacgccaccacacccagctaatttttgtcttttgagtagagatggggtctcgctatgttggccaggcttctccctctgcttcttcaggtccctgcgcctctgctctgtccatggcctgagccacagccccagtccccttctggctcccgagggcctgtgctccccccaacccagcccccaacccctgtgcacctggcatctcttgagacactgcctagttcccgccctcagagagtatccgagtcccgctcacaccctgcactcagcggttgacgaccacagccctcgaggagtcctgtgggccccttccctgacagagcccaccaggccttccgagggtggccccggagcctggggaggaggctgccggaccacagactggagcatggggggatggaagggagggttcaggtaggcactgggggaaggaggtacacaaaggccctgagaacagaggccacagaggtggtgatggccacatggcagctcaggagggtggagtgagagcaagagggtgaggatgagaaagagaacggatgagagagagcgagaggctggagggcacgtgtctgccgacaggagccacaggtgcaccggctgccatgtcaacatgcacgcacatgccgtgcaagtgcacgcacgcacaacacacacccggggcatgccgtggacctaacacccatgcagccgggacagagtcccccttgccctcggacacacatactcacaaccactcacagggccaggcaccccatctactctctctcccaacacaggcgtggggcacagcctgcatgccccacacaggctggcgctgcgctcagagccctggcggccctgtcttctctccccccccaactccttcaagacgctttttaaattttttttttttttgagacggagtcttgctctgttgcccaggctggaatgcagtggcgcgatctcagctcactgcaacctccacctaatcttttatgttttttttttttttgagatggagttttgctcttgttgcccaggctgaagtgcaatggtgcgatctcagctcactgcaatctccgcctcccgggttcaagcggttctcctgcctcagcctcccgagtagctaggattacagcctcccgagtagctgggattacaggtatgtgccaccatgcccggctaattttgtatttttagtggagacggggtttctctatgttggtcagggtggtctcgaactcccgacctcaggtgagccacccgcctcggtctcccaaagtgctggaattacaggtgtgagtcactgtgcctggcctaatctctagtatttttaatgcagacagggtttcaccatgttggccaggctggtctcgaactcctgacctcaagtgatccaccctccttggcctcccaaagtactgaaattacaggcatgagccactgcgcctggcccagtttttaaatttttgagacaggatctcgctgtcacccaggctggggtgcagtggtgtgatcatggctccctgtagcctcaacctccccgagtgttgggatcacaggtgtgagccaccgtgcctggcctccccagaggctttgttcaattcccaccgtctccagaggttcccccaggctggccccctgcagggccgctcacccagctagaatgttctctctggtgggaatgtgctccttgtccagtgggcccccctattgcagccccccgctacagaggagaggggctccatctgttctattcactgctgtgtccctggcgcccagggctggtatggaacccggggggtgctatgtgttcacctagttgttgagag

SEQ ID NO: 3097 - DNA, 18568 bp, Homo sapiens
gcatccgctgctctgttaagtgatcaccacattcattgttctcgtttctattatttctgaaaaaaatcttcaggattctgcttgtgggagtggatgacatttttacagtgtttacaggctgaaaatttttcgagcttttatgctctgcttccgttataaggaggaggcctcacaatcctggtggaaggcaaggaggagcaagtcacatcttatgtggatggcagcaggcaaagaaagcttatgcagacacaaaatgaacaagatgtctgtggcaaccctcagaccattgacgccttctctcctatgtatcaaatcacacatttggacgttgactgaaccctcacatgtcagatgctcaatattgaggtatagtaaaagggagcatgaacttgagaaaatacgctttcaacacaaagctgtaataatataaggtcaaataagattctgcattggagatagaaaactctgtccatagctttatctattccagaatgtcatatagctggtataaggtatgtactcttttcagattggcttctttcatttagtaacatgcatttaaagtccttcaatggcttgagaactcatttctttttagcactgaatagtaatagttcatattctagaagtaccgtattttatgtatccattcatctcctaagtgtatctttgttgccttcatgttagggcaattatgaataaaactactataaatatccatgtgcaggttttgtgtgaacataagtttgcaactcctttgagtagacaccatagagcacacttggtggactgaatgctaagagtatgtttatttttataaaaaactaccaatctcttcaaaagtgactgagccattttacattgcgaccagcaataagtgatgcttttgttccacatccttgctagaatgttgtggtgtctgtgttctagattttggttgttctaataggaatgaagcaatatctcatggttgttttaacttttatttccctttattatgacataaggtgggaattatttcatatgtttatttgctacctttatgtattttcgataatatgtctgtcaaggcccgttttttaatcaagtgtttttgttttcttattgttgagttttgaaaactcttggtatcttttagataacagtcctttattatatatttcttttgcaactactttttcccagtctataatgtcttcttgttctcttgacattgtcttttgcagagcagacatgtttaattttaatgaaatccagcttatgaattattttttcatgaatcatgcttttgatgtagtatctaagaagtcattaccatatctaaggtcatctaagtttttctgctatgctatcttctaagagtcctatagttttgtgttttacatttaggtgtgtgatctattttgagcctgttttggcaaaaggcataagatccgattaattttttgcatgtggacagccaataagtacagcacaagatcctgatcttttaaaacgtactcccatgggttatactatttttgaaccaaaactatttagcagatacaatttaaccccactgtataaatagattgaaaaagtaaaccaacaaaccattttccacttttttctgttttctctctgcttctaatgctgtacttgaattgctttgctactcagcatcctttgacttatcattaatcagttccaatgaagaagctcatcatggtcaggttttagtcagaacttaatgcccttgtctaccaagtgtaacctgaagtcttatagtcacatctctcctttatatataaactatcatctaaagaaaacatcactctatatgtgaatttatgtgtctatctagttaattcaaaataaattagaaatatatgcatacattttatggatcacacataatatttatcaaatcaatacacatttaacaaaatgactgttagtgagattattcataacatataaattgccagaacaaaagaaccatgtcttaaaattttctgacagaaacttgacaatacatagcatctagcaaagttgtggtctcttgaaagcatttagcaacacttgttaaacaatctgatctttgacaaacctgacaaaaacgagaaatggggaaagggttccctatttaataaatggtgctgggaaaactggctagccatatgtagaaagctaaaattggatcccttccttacaccttatacaaaaattaattcaaggtggattaaagacttaaatgttagacctaaaaccataaaaaccctagaagaaaacgtaggcaataccattcaggacataggcgtgggcaaggacttcatgtctaaaacaccaaaagcaatggcaacaaaagccaaaattgacaaatgggatctaactaaactcaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaacctcatcaaaaagtgggtgaaggagatgaacagacacttctcaaaagaagacatttatgcagccaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaagaggaacacttttacactgttggtgggactgtaaactagttcaaccattgtgaaagacagtgtggtgattcctcaaggatctagaactagaaataccatttgacccagccatcccattactgggtatatacccaaaggattataaatcatgctgctataaagacacatgcacacgtatgtttattgcagcactattcacaatagcaaagacttggaaccaacccaaatgtccattgacgatagactggattaagaaaatgtggcacatatacaccatggactactatgcagccatagaaaaggatgagttcatgtcctttgcagggacatggatgaagttggaaaccatcattctcagcaaactatcacaaggacgaaaaaccaaacactgcatgttctcactcttaggtgggaattgaacaatgagaacatttggacacaggtaggggaacatcacgcactgggacctgtcgtggggtggaggaagggggagggatagcattaggagatatacctaatgtaaatgacaagttaatgggcacaacacaccaacatggcacatgtatacatatgtaacaaacctgcacgttgtgcacatgtaccctagaacttaaagtataattaaaaaaaaaaaaagaaaacttgaagactttgcctctgggtctaaatcctggctctaccatttacctattagctatgagacttggtgaaattacttaaattctttgttcctcacttttaaatgtcaataatagtattcatggtgttgttgccaagtgttacataaaacaatatatgaaagtgcctagcacagtgcatagtgtgtcataaacttagtaggagttagttctttttattttgtaagtctgctgcttgtatatctcattatctgtcatagcatatattatgtccaacctataatttaatcacagaaaaattaaaatgtgagattcaaaactcatcagataaagtgttagtgcagagaaaatataaagttaacaatgatgatgaaacttttaaagtcttagcattttattttaaaatatctgcccattgtagccttttgctttcttgataccattttgataggtctgactctttttgaatgttctgagatatgtaagattttgtatatattggacatcttcacaactctattgagctgtttcctttatagacagagaccatgggatcttatttctcagcttctcagaataaaatttaggtaaaatcactgaaatgccaagggaaaagttaagagatgctatagttagagctgtactgtccaatatgtagtgtttggcagcatttggctatttaaccttggaatatggccagtccaaattcagaggtactgtaagtttaaaatgtatgtgagttagtatgaaaaggtatgaaaaaattaatgtaaccacctcaataattttatagtaattatatgtgaaataatgcttttgatatattgggttaaataaaatacattattaaaattaaaaaaaattaactaatttagaatgcatggggggaaaagcaaatattgaaatacaaactgagtaaaaggaataaaaagttctaaaaagtactaaagcagtattgttcgatagagctatgatgatggaaatgttctagtggctaatagcatttgtataggatagtgcaaatcaagggttcatgaactagaattgattatcacgtcactgataagactgcagggcaattttaacacttaaactcattataactgtttgaatttacttcctgattgaaatatttagcatactgtgttgataaccatgtaactaataatttaaaagaacagaaaaatcatattataaaactacagatggataggctcagtggctcacacctgtaatcccagcactttgggaggccaaggtgggtggataatctgaggtcaggagttcgacaccagcctggccaacatggtgaaaccccatctctactaaatatatataaaactagccaggtgtggtgatgggcgcctatattcccagctactcgggaggctgaggcaggagaattgcttgaacccaggagacggaggttgcagtgagtcgacacggtgccactgcactccggcctcagcaacaaagtgagacaatggggaaaaaaaaacctacaggaataaagattgaatggcaaattttctagactcagcaattaatatcactgtgatcctttcctctttagaaattgagtataaataacatttcagaaattatggatagtatttatcattctcaatcacagatatacaaataataagcctttccaattctttttgtgttttttttttttttgagacggagtcacccaggctggagttcagtggcgcgatctcatctcactgcaagctgcaagctccgcctcccgggttcacgccattctcctgcctcagcctccagagtagctgggactacaggcgcccgccaccatgcccgtctaatttttttgtatttttaatagagacgtgttatccaggatggtctcgatctcctgacctcgtgatccgcccaccttagcctcccaaagtgctgggattacaggcgtgatccaccgcccccggctaagtctttccaattctattgagtataaccatgtggttatgaaaatgtactctggtgacagactttcttttaacccctatactcatctatatatagtttctagttgaagctatattttaaaatgtaccctctgcacattttaacaaaataacgcaatctggttataagttgcattacttaatgtgctttgtcatttcaatgacacaaaaaagggtaactgtacttatttagaaaatatcctccatatgaattttacaagaaattgttccctttgcccatccaaggaacatctggagcagagcgccccttgtgcatgagaatttgtaaagtttatgagatatgctccagagaagcagttcttaagttgtgatgtatacatcctagagtgtattcattggtataacaaacagaaatttggggaattttatgtttttttttttaatctcatgctcttcaattactatatttttgttttaaaagcaaataataaatttgtttactgcatatcatgtaatttacaaacgtaattaaatacacgtatattgagatacaaactccaaaaatttagcttatgaaatgtgaaattttgaaatcattgaccaatatcactccattgagatagcacaagccttctagttattaatactttggtttggtaacaggaaacatttgtttttcttctatgttcaccaagccaaatttacacacaaaagcctcttgaacttttattattcaatttgggtatttttcagtctctttctttccatattttgtgtttcagtgttttacatctgaaaaataaaatagaagatactgaaaaactaggcatggaagcctacaagccaaagaacagactataagccaatagtagaatttctaaggtagcatattctctaaactgtcactcaaagtttccactacaaagggacacattaatctgaaacacaattctatatatttctaaagagcttcctcaaatttagctatttatttatgtaatggtccccaccacttatttgcctcatgtgtccaaattttttagttctccagggatgagttcacattctacttttccagaaaaagttactttagtgcttcctatcttaggccatggtattgaatatttttgactaatcatcaaaacaagatactattgttttccagcaaggcataatagtgtgaaaaaaaaatttggaagaaaaagcaacaaatattactttcacttctgccacatattctggtatttggcaattcagctaatatgagtctcaaaattctagttatttatatgttttttagttattatatactaggattcttttgtttcaccaaattttcaaaataacaataaaataacactattcatgtgtgtaatcagtctttgcaatatatcagcaatgcagatccaattataatcaaccactggagtgtcatgtgccaaatataactttgaaatattatcatgttttacgtttactgctgaaagagattaatctggactaagaattctgacttcatagctgcagtctcctgagaggctctgtcagaaacagactaatttagtttactgcaatcaaaaacaaattatgtcatctctaaatttgtcttccaaatgaccatgaggagaagcagcattgtttctaaaaacactagggactgaaactccaaacaagagaaagttggtatgctgcagaaagaagaatgtttagtttcaacagtgcaattaacacccaaaccttaggcaattatgtagcaaaataaatatgactatatgcaaatataaatatgactataacttcatagctaaacactagaaatatccaaagaaaataaagcggctaaccagttcaattaatcaaggctctataaccaattttaacaatgtttgcaaatgaacactctctttttggtatatcattgcaataaaaatattttaaataaaaacaaaattaggctttcacaggtattgttattttcacatagcttgtatttttcataaaatccaaaatattttcatatttcttatcaagccattactcataatttttatactcctacaaaaagcacaaattattattatgttatagaaatacatttttttaaacgtgatgcctcatgataggaaaagtaaataacttatgaattaaaaacatgaaaggaaatcactaagttaggagtaaagcaaaatttcgtatctaagttcttgggatctgggctatatcccagaaatataaaatattgaaatcaagatgtgagttcaaacaaaagaaaaaaataaacgtctagcagttttgggaaatgtattactgactcctgtaaaatggaatgcattttctaagagaagtcataagctatcacagacatagaacatatttatttatcaagtatggaaaatatgtgaataatgatgcaagaacatgggaaagcagatattgctttgacatactgatttcatttcctttgtgtaactacccagtgctggggtttctgggtcatatggtagttctacttttaattttttttgggaaccattatactatatttttcataatgattgtactaatttacattatgactaacagttttgtatatggattctcttttctctacatcctcttctaacttgtaatcttttgtcttttggacaatagacattctaacaggtattaagtgatatctcattgtggttttaattaggattttcctgataattacttatgttgtgaatttttttagataccttttggccttttgtctgtcttctttggataaatgtatattcatgtcctttgctcatttttaaatcagattgttttcttggtattcaattgagttccctatatattttggataagaactaattaccagatattaactaatttgtgtggtttgcaaatattcccccccaacagacttatttattaagtagaggaaatatctagatgttttctaaaccacctactaactgttggatactatattaatataattaatttttgatctttttataaaacttatcttactgtttttcaaggtaattgtagcctcttgtctttagaatgagtcattaaacacacacaaaagttaaaaacaatcatattttttatacaattaattaagtgtctttgaaacacgtctaacaataaatgatagaaatatgaagggaaaagatttatgtgacagtaagtatggctgtagaaaatctaaaatggcttgattgcgaagtgtaaatagtatgcaacaaacaaagctaaaaatagaaatttaattttaaatgatgagggaaaagtcatattattagttttcaaaacgtatttgagagtcacagtaaataaaactgcatgattataatacaataatacacaaatagaaaagggaagtgagttttgtgttctttaaaatccatggggaatgaatatattgcttagatgttgtaataaactgagactatttcttacatgttcagaaacattcaaaaacttactaaaatcaggttgtgtgatgcctcccaatttgttctttttgtttagtcttactttggctatgcaggctcttttttggttccatatgagttttataattgttttttctaactctgtgaggaatgatggtagtatttgatggagattgcattgaatttgtggcttgcttttggcaatatggtcattttcacaatattgattctacccatcagtgagcatgggatgtgtttccatttgtttgtgtcatctattatatcttttagcagtgttttgtggttttccttgtagaggtattttgactcctttgttaggtatatgcctaggtattttatttttatttttttggcagctattgtaaaagaggttgagttcttggcttgattctctggtcactattgatgtagtagaagagctactgatttgtgtacattcatcttgtatctggaaactttgcagaattattttgtcagttctaggagctttctggaggagtccttagggttttcaaggcaaacaatcatatcgccagcaaacagggacagtttgactttctctttactgatttggatgccctttatctcattcttttgtcagattgctctggctaagacctccagtactatgttgaagatctgatttcaaactatacaataaggccatagtcaccaaaatggcatggtactggtataaaaataggcacatagaccaatggaacagaatagagagcccagaaataaacccaaatacttacagccaactgatctttgacaaagcaaacaaaaacataaagtggagaaaggactcccttttctcaaaatggtgctgggataattggctagacacatgcaggaggatgaaactggatcctcatctctgacattatacaaaatcaactcaaaatggattaaggacttaaacctaagaactgaaactataaaagttatagaagataacatcatatacatcatatatatcatatatgtgtgtgtgtgtgtgtgtgtgtgtatatatatatatatatatctcacagttaggaatactactcagccataaaaaggaatgaattaacagcatttgcaatgacctagatgagcttagagactattattctaagtgaagtaaatcaggaatggaaaaccaaacattgtatgttctcactgatatgtgggagctaagctatgaggacgcaaaggcataagaatgatgcaatggactttggggtcttggggaaaagagtgggaggggggtagggataaaagacaacaaatatggtgcagtgtatactgctcgagtgatgggtgaaccaggttctcacaaatctccactaaagaacttactcatgtaacaaaataccacctgtaccccaataacttatggaaaagtaaaattaaaaaaacttactaaatattgagcactagaaggatgcttaaaatatctgtggccaatttagacaatttggtattatagaaaagattaaaataataaagtatgtctttgtgcttcaacctagaatatcttcaaaatataatgttaactgagtaaaagaaaaagtagaacacaatgaaacataatttcattctgaacaaataataaatgaatcaaaactattttatttgtatgtttgcatgtatgtaaaaatattgaagtaattctaataaataatcatcaaattttgagtgagagtgaaaaaggtggttgaaagattatttaaaatttactccatagattttttttaattgttcacattttaaaacaatagtatatgtaacaaaagagattttaagtgctgtggtgagctactggaaaaatactggaggacattagggcggagcttgttcaaagtgatcaggccatctatattgtgtaatggctgattgtttacaaaaggcttctacactcccttgcataattggcgacaggggctctttctttcttagagctttgttgagctgtaatagattaaaaaaaaaactgcacatatttaatggctacaatttgataatttgaacatatgtatatacttatgaaaccattaccacaattaaggttataatcatatccataacctccaagagcttctctatgctctttcttgtgtaagtattttttcttgttgtttttgcatgcctgtgtgtatatgtttatgcgtgtgtgtgtgtgtgtgtgtgtgtgtattacaaacacttaacccaagatcttccctcttgacaaagtttttaagtgtataatatagtgttgttaagtatagtcaccaggctgtacagcagatctctagagcttattatcttatctaactggaactttatacccattaaacaccttccactttcctcctccctcaagcccccagcaacaaccattctactcccttctatgagtttgactattttagatatcttatataaagaaaatgtagcatatgcatacagtgaaatattattcaaccttagaaagaaggaaattcttccaggtctgacaacgtggatgaacctggagaccattaagctaagtgcaataagccagtcacaaatgacaagtatagcagtatcttccttgagaaaggggtttctgggttgtggaactggccagagactagaataagatgtacatcttaaaggggaaaagaaagtgttcataattgcaagttttctgcaagtagatgtttgggagttcaggggcgtacagtcaggaagaaacctgtctaaagtttagccaaactgagagaaacaatgttaaggccttcttggtcaatactatttgtgtcaacattccaaagtgaggttttgacttgaaaataagcaaactttcccatgaggaccttacacaatatttttctcactctactcttttctccatctctccgtaacagagaaaaacattgggaaattaatctactatcaatgtacagaaagtcaattcttaaatataagctgtaacaataatgaaacataatattgtttaagtttacccaggttaagaaacattccacctaagttatctgatcagcagttttcaagcttgagtccattattatattaaattgcagagttaattgttgcgagtttttctaagtgtttttacctattacctactgtaaggaatccattatttgtattaaaaaaataaaaagaaaacattgatttaattctgttatatctatgtaactttgaaaagatatgctatacagataatttgtatgtaagaataccctgacatatataccctcctcagtagtatgtaggtcatggacaatgcctttcatttctataccacaatgaattaagtcaatgcctcacaggtagtgaaaactccataagaaatggctgaattcacaaatgaatgaatgataaactggatatttggtgtgatattagttgtaggaagattattattaactctcatagtattagttaaaagccttgttattgtatgaaaaattatatctcttgatttaacaatttaaagggttggaaaatcctctttagtgtttatttaaaaagctcctttgtacaaacatggacttgacctttaatagtgtaggagtcaattttatgagaaaaaaataagtgatcattagattagaatattcttttacttctaaattatagccttttcctctattattgtgttggatattatttaaattcctctttagattaataggtggccatttgcaatagaaaatattttgacagattgaaagagctttcgattttcttttggtaacaattttgaaaggacttttttttagaaaaaaatgcatatagtcccccacttctattgcaacacactttgctaaacatattatgagtaacaatcacgtggttgtaagaacacagcacatatgtttatttcatatgtaatatctgatacgttaccaaacagcagttcctgagagatacctttttatacgttatcatattccattatcacaattaacagtatctgcattttaatggaagggaaaactagttcaaatatgtcattttactgtatccaggttacaaagctattatgtttcggagctaagatttgaatgcaaagcagtttgttccaagactgtgccattccttaaattacctatctctactcttggttttgttcatgaaattattgtgagaaaatagtgcagatactcagatttctcttctgtttgtaatcattaagaaataagtggttatcaaagtctgtatgtttcccaagcacttcggagaaaagaacttacatgaaatctctctgatctctatcttcaataagtttataatggccagagaaataaggcaaaaacaaatgtaagaggcctatcaatattttaaaactaaagcctatagtggttagtttcacaggctcaaagaacaataattaaaatcaagttggagaagaggatccaaaatgaaaaacacacaaaagcaaatgaacctaacatagtacaaatgcatatcataattgcacacaaaagagagtggaggtagtgaagaaaagaactaacttaagtaactttggaaaatggtattttctctatatctgataaaactaaaagaaagaactataagcaactgtgttgttgcagtaagtagcttgctttgcatggggtatagattagcaattccacaactatttaatctatattctagaattaaacaaacaaaatgtggataataagaggtagatttttcactgtcagataaagcagataaaaatttaaaaatgaaggctaaaataaaccttgtggaccaggtgtcagtgtgaactcaggtggagggaggggaggtgggggagagagagagagagagatgtgtgtgtatgtgtatgtgtatgtgtgtgtgtatgcatgtgtgatgcatttatctctattccctgagaagaccgataagtagtgacaactcaatgagtatatctaagacctggatattattttgtgaatttccatctccagaattagaaaccagactcattggagaaatggataattgcaggagtagcatacaaatgttcaaaatggaactagaaccaatataagaatggtcccaaaacgtatgaaagtattcaaagcatgatgaagttgtgtaatagatagaaaatcaatttaagaggttcataatgtccaaccaaacatgagacaatatgagccacaaaagataatggtccatactagagtattacacaaaaaataaaatcagaattcatgaatctacactaatgtacatgagcaatgtaatgcatactttttttaaaaaataagggaaatttctttattatagtagtattacaactaatgtaaaatatagtataaattaaaaaccaccatttgacaaacattatggtaataggtataacatgaattttatcaatggatggtaaaaataattgaaaattatggtaagagaaaaatttcaaagaatctcagcaaaacatatttttagttaaagtagaaatgttgttaacagtggagaaacttagtggacaaccccataaccaaataacaaaattaacacaactaacaatggcacatctgatgccttgtgcctgctgatatgatgccctgagaaataataactaagaaatatcacacaagttcaaattctacaaaataagtggccaatattttcaaaaatgtaaaaatcataatattttttaaaagactgggaaaacaaaaaataaaggagaatgaaaaagcatgacaactagatttaatcctagacaacaaaaagtacacttgtaaaacaactattaaaagtaaattaagtctagagattatagtattgtatctatgttatgtttccggctttcatatttgtactgtggttttgtaataagtttttaaaaatatgatatacaagtaactagaactgtttctttttgttttgctttgttattttctttctacttttattttaaattccaggatatatatgcaggaacagaattgttttaattgattttgcaaaatttttgatcatcatctgaaattctttccagataaaaaacttaagaaaaaaagatctaaaataattccttaatatatgctgagtcacattttatctgcttcatgttaagaagagagagataaatacatagccattttgaaaggctttcataaaagaggtaggactaatgggtgccttaaacagagaaaatagagtatatatatggaatcatataatgaatgcagaaatagatatagaatatttgaagttgctgagggtacaaatggtatccaaagaataaattatattggtgagcataaagataacaacaaccaattgaccacctgtaacatttttaacttaatttgatagactgcttactatatatatatatatatttttttttttttttgaggcagggtcttgcactgttgtcctggctggagtgcaatggcacaatgtcagcttactgaaacctctgccccccaggttcacacgattctcctgcctcagcctcctgagtagctgggattacaggcacacactgccagacacagctaattttgtttttatttatttattttagtagagatgggatttcactatgttggtcaggctggtctcgaactccttacctcgtgatccatccatctcagcctgccaaagtgttaggattacaggcgtgaacccctgcatccggcctccttacaatattttttatggtcaaaagtgaatgtgtgtgtatacgttgttataaagaatgttttcataaatggttaatatttcgcatactcaaaaaaataactaaaatgcacaaggaagagatggaaatccaacatggaaatcaagtgagtccactgaattgatggaaaagaatggacaggatgaatctaagtaacttttgatcttgttttaattttgagttatttaaaaaaataaataaaattcttagccatctctatggcagacctagttagacatataatattaggtttgtcagtaaacttaggaggccatgtagtaatgaacataatcctgaattggtggttttaagaacagatttcatgttcctcattttccatacaggatatgacattggccggtgttttgatggatttgagtctctgttttttactaaaatgaaagtagtgtgacgaagtaataataacactgaatttagaaataaaaccaacatgcaaatatatgtatttgcatgtttcttgaaagttattgtaaacttatacttttattgtcagaatctgagtgactgtgtttgtaaatgggaatgattattatgaaccacaggaaattttttttagagtcaaataggttaaatgtgagattactttataatgtatgaaacaatatgcaaacatatatttacagcactggtgacttttcaaaaataagtcccctgactgcagaaaaaaaaaagcatcttacgttttttcctaactccagtactgatcacagtgcctagattgtagcatacattcaagtatcattgaactgcctgtacatattaaagcatggaattaggtatttcaaaatatagaaataatgtaaaaccttataggatgcatatactttttggctttagtgaatagattatgcttcaaaaagtattattaatattttatagacattttgttaaccagaaaactcttacattcttgcccatagcaattaaggcattgtctacttaaatcagtaaatgttggtacatcataactccacagtaagatggttttatttaatggttccgtcacactctgttgaatgtagtgctttttatgagattaccctatttttaattgtttcattcactcggatcttcagagacaatgtagataggaatttaaaaatcacagttaaatgaatatccttgtaacttacatttagtatgtgcaggtattcaatgtttaagcttccatttaaatgtctttttttggcaattctcaaaggaaatagagtatgtgacacatgtaagccagccacaaactatattagttttagaagataactataatatttatttgcatgattcatttttacttataaaatagttatacaattgtggacatatataatgctctagagacaagaaatagcttataagtatgttttcagaaatttgaatgtaatttcattttgcctagaccattttctgagctggcccatactgagaaaaacatatatgaattatttaatgacatgttttcaatactgcttttattacaaaacatgataaacaaattttacttcccgcaacaaataataacttgctcaatatgcttttgtagtagaatttagatatagttccaaacaaaaatttccaacttatttttgaatagtcaaatattgctaatataaattatgtatctgaaatagagtaagttgagattatttactctgaaatatagttgagattatttactaatttattattcttaattttccgcaatctagtaacatttgtgaaaaagtgaaatggtagttgctgggtataaataatgtattaattcaccaggctattaaatatgtcttaaaataaacatgtcattatttgatcagaacagttgctttactgttatttttaaacagtggcaagtaattttttattaaaagtataactcaaaaacattaactatatatgctgtttgcagatgacatgattgtatatctagaaaacccctgcgtctcagcccaaaatctccttaagctgataagcaaattcagcaaagtctcaggatacaaaatcaatgtgcaaaaatcacaagcattcttatacaccaataacaaacagagagccaaatcatgagtgaactcccattcacaattgcttcaaagagaataaaatacttaggaatccaacttacaagggacaaagggacatgaaggacctcttcaaggagaactacaaaccactgctcaaggaaataaaagaggatacaaacaaatggaagaacattccatgctcatgggtaggaagaatcgatatcatgaaaatggccatactgcccaaagtaatttatagattcaatgccatccccatctagctaccaatgactttcttcacagaattggaaaaaactactttaaagttcatatggaatcaaaaaagagcctgcattgccaagtcaatcctaagccaaaagaacaaagctggaggcatcacactacctgacttcaaactatactacaaggctacagtaaccaaaacagcatggtactggtaccaaaacagggatatagaccaatggaacagaacacagctctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaatttaagatggattaaagacttaaatgttaaacctaaaaccataaaaaccctagaagaaaacctaggcaataccattcaatacataggcatgggcaaggacttcatgtctaaaacaccaaaagcaatggcaacaaaagccaaaattgacaaatgggatctaactaaactcaagagcttctgcacagcaaaagaaactaccatcagagtgaacaggaaacctgcagaatgggagaaaatgtttgcaatctactcatctgacaaagggctaatatccagaatctacgatgaactcaaacaaatttacaagaaaaaaacaaccccatgaacaagtgggcaaaggatatgaacagacacttctcaaaagaagacatttatgcagccaacagacac

SEQ ID NO: 3098 - DNA, 2085 bp, Homo sapiens
atattgagtcttattttagctttaaagggaatgtcaccgggtgcggtggctcatgcctctaatcccagcactttgggaggccaaggcgtgggaatcacctgaggtcaggagtttgagaccagcctggccaacatggtgaaaccccgcctctactaaaaatacaaaattagccgggtgtggtggtgcatgcctgtaatcccagctactctggaggctgagacaagagaatcgtctagaacgtgggaggcagaggttgcagtgagctgagatcacgccagcctgggtgacagagcaagactctgtctcaaagaaaaaaaaaaaggaatgtctagatgcagtagctaagtacacagaagccatttcagtgtgggaggcgaggtgactgaatccagggactccaggtttctggctgtggggttgagaccgcccatggtcattgtgatgagatgaagacagaaaatgagttgggctgggggaaggtggtcatctctggaagtgattagtttgagactcctgttgggtagcccactgggcaaggtcagtaggcagttgaggagctgagagggtttggagctgagatagactccagcctcaccatgtgggcaatagtgggggtcacagagtgtaaagacggccaagaaagaggtctgggtgggggtctggggagtcagcagccaggcatgggccgtggagaaacagatgccggggaagaggaaaggggagtcagacctcaaggggaaaagagtcactggaaggaggggccagctctgtgtcacatccagcagagacaccaggtacagcagaaggaccttggacatgaccatgaggagggccttgttggccatgacctgggatggatgggggtgagagcctgggggaccacaccatgtccccagtacacgaaacagtgcctggtagacaggatggatttatggatggatggataggtaggtggatgaatggacagatgatagatggatgcaaagacagatgaatagatggacagatggatggacggacagacggaatgaatgatcagaaaaggcttcatgaacaaagtgagactgagctgcatctccatgggtagatacaaaagcagaggactctcctcttgagtcaggaatgacccaatgtcctggtccagggagcaagtcaacttggcttgactgcagacacttgtggcagatttcagaggcccttaaaatgaggccaagtgaggtggacaggtccgagccagctgaggactcctcagccacacggcacagctgcctgaggggatgtgtcactcagggagttgctgggacctactgggcccagcgttgccatcagcaccaacagcttcagagagggggacatatgctggggtgactccaaggctgtgggcggcacctgcctcagatagagaacaggcacagagacactactgggggacactactgggatactggccacccccctgccctgtgcctgggtcacagcctacacactgcagccctgtgcccctcacacccagcaggttcctgctccagcgtggctcctggactggcgccagatgctggccctgggggtttcaatccaagcataattcagtgaagcatgtgtttggcagtgggacccagctcactgttttaggtcagcccaagactaccccgtcggtcattctgttcctgccgtcctgtgaggagccccaagccaacaaggccacactggtgtgtctcatgaataactttatccgggaatcttgatggtgacctggaaggcagatggtaccctcatcacccagagcgtggagaagaccacgccctccaaacagagcaacaacaagtacgtggccagcagctacctgagcctgacgcccgagcagtggaggtcccgcagaagctacagctgccaggttatgcaagaagggagcaccgtggagaagtcagtggcccctgcagaatgttcataggttccagcccccaccccacccacaggggcctggagctgcaggatcccaggggaggggtctctctctgcatcccaagccattcagcccttctcgctgtacccagtaaaccctcaataaatatctttgtcagccag

SEQ ID NO: 3099 - DNA, 21238 bp, Homo sapiens
agtactgcagtgtgcggcgcatggctgcgagggcctgccgaggggcgggcgcgagtcggaaagacaccgaccagggaatgggcgacgaggcttgccttaattcggaggaaacccaggacttgagagagccatacaatttgaaagacgaagcaccgtgaaatgcagaaagttgtggttcggatagctcagctgattaatttcatgttgccacagtttgtcaaacatggacaagatggctggggtcctgtggagttctagtaatcttcttacgataataaagcaaccttatgccatatgatatgctaaggatggaggaagatagagtctaggtgcctgatgacaacatggagctgtcaagccctgcattgcctccccctggacgtctcattatgggagaaaatgaagcaatttgtttaagccacactgatcttttttcctatttttctttttcttttagagaatgtgtgaaatgtgggaagtttgtggagagagaatttgtgaaatagttatctctgaatggtagagtaaattaagtagggagaggtagtaggtcattcagacatctgtggttgtaaatataaaatgagatcagtcatctgggttgtatttttccctagtcaggtttacctgctcaggagaaggtataaacctgatagtgaattgggtttaaccaggatttatattttgctaaagccattgtgtcaccatttgtgaaatagaagaagatactgtagagtcactaagaagacagttgactgaatggatttataaaaacatgtagccgggcacagtggctcatgcctgtaatcccagcactttgggaggccgaggcgggcagatcacgaggtgaggagatcgagaccatcttggctaacacggtgaaaccccctctctactaaagaaaaaaaaaaaaattagccgggcgtggtggcaggcgcctgtagtcccagctactcagaaggctgaggcaggagaatgatgtgaacccaggaggtggagcttgcagtgagccaagatcacgccactgcactacagcctgggtgacagagcgagactctgtctcaaaaataaataaataaataaataaaataaataaaaatatatacaaacatgtaattgctggccaggcatggtggctcacgcctgtaatcctagcactttgggagactgaggcggtggattgcctgagctcaggagtttgagaccagcctgggcaacacggtgaaaccccatctctactgaaatacaaaaaattagccaggcgtagtggcatgtgcctttagtcccagctacttgggaggctgaggcaggagaattgcttgaacctgggaggtggaggttgcagtgagccaagatcgtgccactgcattccagcctgggcaacagagtaagactctgtctcaaaaaaagaaacaaacaaacaaaaaacatgtaattaataaaagcagtagacttgaaagcaaaactttacacatattttttgaataggtaaagttcccatggttcaaacattgaagaggtaaaaagatacacagacataccttactttattgcacttcactttactgaacttgttttgttttgttttgtttttcttttgagacagtttcgctcttgttgcccaggctggagtacagtcgtgtgatctcggctcactgcaacctctgcctcctgggttcaatctcttctcctgcctcagcctcccaagtagctgggactacaggcacttgccaccacgcccggctaatttttgtatttttggtagagacagtgtttcaccacgttggccaggctggtctcgaacttctgacctcaagtgatcggcctgcctcggcctcccaaagtgctgggattacaggcttaagccaccgtgcccggccctttttattttttttgagacagagtttcgctcttgttgcccaggctggagtgcaatgacgcaatcttggctcaccgcaacctccgcctccctggttcaaggattatcctgcctcagcctcccaagtagctgggattacaggtgtgagccactgtgtctggcccactttactgaacttcacagatgatgagagttttctctttcttttttttttttaaaacgtattgaaggtttatggcaaccctgcatcaagcaagtctgttagcaccatttttccaacagcatttgctcacttcatgtctctgtgtcacattttggtaattttcataatatataaaaatttttcattacaggctgggtgtagtggctcacacctgtaatcctagcactttgggaggccaaggcaggcggatctcctgaagtcaggagctcaagaccagcctagccaacatggcgaaaccccatctctaccaaaaatacaaaattagctgggtgtggtgacacacgcctgtaatcccagctacttgggagtctgaggcaggagaatcgcttgaacccagaaggcggaggttgtggtgagccgagatcgtgccattgcactccagcctgggagacaaagcgacatctcaaaaaaaaaaaaaaaaaaaagcttttttattattattgtatttgttatggtgatctgtgattagtaatctttgatgttactattgtaatggttttggagtgccacaaacataagatcacgtgacagtgaccttaatatataaatgtgtgtgttgtgattgttctactgaccagccatttcctgtctccctcttcttatgcctccctgttaaattagacacaacaacattgaaatcagaccaattaataaccctacagtggtctctgagagaggctaacagctaatcctcttgtgctaaacagccaaattgtgaatgcaaaggaaaagttctcaaaggaaattaaaagtgctactccagtgaacacatgaatgataagaaagtgaaacagtccgggcgtggtgggtcacgcctgtaatcccagcactttgggaggctgaggtgggtggatcacctgaggtcaggagctcaagaccagcctagccaacatagtgaaaccctgtctctactaaaaatacaaaaattagctgagtgtggtggtgcacacttgtaatcccagacactcgggaagctaaggcaagagaatcacttgaaccccagaggtgaacattgcagtgagctgagattgtgccactgcactccagcctgggtaacagagagagactctgtctcaaaaaaaaaaaaaaaaaaaaagtgaaacagccttattgatgctgatagggagaaagttttagtagtctggatagaagatcaaaccagccacaacattctcttaagccaaagcctaatccagagcaggacctcagttatcttcaattctgagaaggctgagagaggtgaggaaactacagaagaaaagtttgaagctagcagaggttggctcgtgaagtttaaggaaagaagctgtctccataacataaaagtgcaaagcgaagcaataagtgctgatgtagaagctgcagcaagtgatccagaagatctagctaagatcattgatgaagatggctatactaaacaacacatttttggccaggcactgtgcctcatgtctaatcccagcactttgggaggctgaggtgagagcattgcttgaggccagcctgagcaacatagcaaggcaattttttaatctctacaaaaataaaaaaattagccaggtgtgatggcatgctcctgtagtcctagctacctggcaggctgaggtgagtggcttcctgagcccagggttttgaggctgcagtgagctatgatcatgctactgcattccagcctgggcaacagaacaagaccctgtctccaaaagaaagcaaatcaacaaaaaatgagcaataaaaaaagattttcgatgtagacaaaacaacctcacattgaaagaagatgtcatctgtgactttcatagctggaagggacaagtcagtgcctaccttcaaagaacagcctgaatctgtcaggggctaatgcagcaggtgattttaagttgaagccaatgctcgtttaccattccaaaaatcccagggccctaaagtatcatggtaagtctactctgcccatgctctataaatggaataacgacacctggatgacagcatacctatttacaacattgtttactgagtattttcagcctgttgttgagatgtacttttcagaaataaagattctttcaaaatgttactgctcattgacaatgcacctggtcacccaggagttctgatgacatgtacggggagggagattaatgttactttcgtgactgctaacagcatccattctgtagcccgtggatctaagagtcatttttactttttttttttttttttttttttttgagacagagtcttgctctgccttccaggctggagtgcaatggtgcgatctcggctcattgcaacctccgtctcccgggttcaagcaattcttctgcctcagcctcccaagtagctgggattacaggcactggctaattttttgtatttttagcagagatggggtttcgctatgttggccagcctggtctcaaactcctgaccttaggtgatccacccgcctcggcctcccaaagtgctgggattacaggcgtgagccaccacactcacatggtggtttcttgagatggaatgtactcggtgaagatgcttgaacattattgaaatgacaacaaaggattttaaatatttcataaacttagttgataaagcaacaacagggtttgagaggattgactccaattttgaaagaagttctactgtgggtaaaatgctatcaaacagcatcacatgctacagagaaatctttcatgaaaggaagtcaatcactgcagcagacatcactgttgtctttaagaaactgcaggccaggtgcagtggctcacgcctgtaatcctagcactttgggaggccaaggcgggtggatcatctgaggtcaggagttcgagaccagcctggccaacatggtgaaaccctgtgtctactaaatacaaaaaattagccaggtgtggtagcacatgcctgtaatcccagctacttgggaggctgaggcagaagaatcgcttgaacctgggaggcagaggctgcagtgagctgagattgcaccattgcactctagcctgggcaacaagagtgaaattccatctcaaaaaaaaaaaaaagaaagaaagaaaagaaaagaagttgtggccgggtacagtggcttacacctgtaatcccagcactttcagctacttgggaggctgaggcaggagaatcgcttgaacctgggaggcggagattgcagtgagcggagatcacaccattacactccagcctgggcgacaagagcgagactctattgcaaaaaaaaaagaaaaagaaaaaagaaattgctccagccaccttaaccttcagcaatcactaccctgatcagtcagcagccattaacatcaaggcaatatcctccaccagcaaaaagattataactagttgaaggctcagatgatcattagcatttttcagcaatgaagttttttttgttgtttgtttgttttgttgtttgtcttgctttgtcatccaggctggagtgtagtgggcaacagggcaagactccatcccaaaaaaaaagatgtgtctagtgtgaataagaatttgaatattttactttattagattgtaattaatttacaattaaataatacaaatatatacaaaattagccgggtatggtggtacatgcctgtagtcccagctacttgggaggctgaggtgggggaaccacttgaacccaggaggtggaggttgcagtgagccgagatcatgtcgctgcactccagcctggcaacagagtgagactccatctcaaaaaaaaaaaaaaaaaattagccacatgtatatagtaactaccatgttgcacagatactcaggtcttctatacaaagaagaaaggaaggctcagttgtccttggataaaatgagaactggtgaaaaggcactttgaaagtaatgaaaacagctggacacagtggctcatgcctgtaatcccagcactttgggaagctgaggcaggaggatcacttgagcccatgaggtcaagtctgcagtgagccaagatcgggtcactgtaccccaacctgggtgtcagagcgagaccttgtctcaaaaaaaaaaaaaaagtaatgaagacaaagtgtcaataataactaaagatgattaaggagaagggttttttgtttgttttttgagccagagtctcgctctgtcacccaggctgtagtgcaatggtgagatcttggctcactgcaacctccacctcccgggttcaagcgattttcctgcctcagccttccatgttgccaggactacaggcatgcaccaccatgcctggctaatttttgtattttttagtagagatggggtttcgccacgttggccaggctggtctcaaactcctgatctcaggtgatccagctgcctcagcctcccaaagtgctgggattataggcatgagccactgcacctggccctctctacttttttatatttaatacttttcttccccctctatccctcccttcctgccatcctttctttctttttgtttctttcctttctctccccaccacccaccccactctctctctctctttcttctcttttaatacagggtctccctctgtcccccaggctagagtgcagtggtgtgaccatagctcactgtagcctcgatctcctgcactcaagcgatcctcctgagcagctggggctacaaatgtgcatcaccatgccctaattactattattattgttatttttgtagagctaggggtcttgctgtgttgtccaggctggtcacaaattcctggcctcaggctactgccttggtctcccacggtgctggaattacaggcataaggcattgtgcctggccaagagttttttaaaatctatttgcattacttttataattagaattaatgtttaaaaagtcaatctaaagtaaaatggtgaattaagactcatataagatataggagtattcatttttgccctttgctcactggtttttatttttaaacacctttatggagatttaattcagattccgtaaaatttacccttttaggctggacgcgatggctcacacctgtaatcccagcactttgggaagccgaggtgggcagatcacaaggtcaggagtttgaaaccagcctggccaacatggtgaaaccccatctctactaaaaatacaaaaattagctgggtttggtggcacatacctgtaatcccagctactcaggaggttgaggcaggagaattgcttgaacccaggagacagaggttgcagtgagccgcgattgcaccactgtactccagcctgagtgacagagcaagacttcacctcgggaaagaaaaagaaaatttacacctttaaagtgtacagttcagtggtttttttttttttttttttaatttttttctgtaacccaggacagtgccaaagttcagtggtttttttgttttttctttgtttgtttatttgagacagaaactcgctcttgttgcccaggctggagtgcaatggcgcagtcttggctcacagcaacctccacctcccggattcaagagaatctcctgcctcagcctccaagtagctgggattacaggcatgtgccaccatgcccagctaatttttgtatttttagtagagatggggtttcaccatgttggccaggctggtctcaaactcttgacctcacgtaatcctcccacctcggcctcccaaagtgctgggtttacaagcgtgagccaccgtgcccagccaagttcgtgatttttaacacatttatagagttgtgctaccatcatcacactctaattccagaacattttttatcatccctaaagaaactcattgcccaggctggagtgcaatggagtgatcttggcttattgcaacctctgcttcccagttcaagcgattatcatacctcagcctcctgagtagttgggactatagatgcgtgccaccatgcccagctaatttttgtatttttagtagagatggcgtttccgcatgttggccaggctggtctcgaactcctggcctcaagttatctgcccgcctcagcctcccaaagtgctgggattacaggtgtgagccatcatgcccaaccctgagatggcttctgaggggcttgatatggagggagagggcctaagtagcttcagaatgaaaagaacaagccaggattagagggttagaactttcagccccatcccccaagacctcagggaagggagtggtgactggagattgagtttgatcaccaaaaggtcaagccttaattatgcttatgtggtgaaaactccggccaggcacggtggctcacgcctgtagtcccagcactttgggaggccaagacaacggatcacctgaggtcaggagttcgagaccagcctggccaacgtggtgaaaccccatctctactaaaaatacaaaaattagccgggtgtggtggcaggcgcctgtaatcccagctagttgggaggctgaggcaggagaatcgcttgaacccgggaagcagaggttgcagtgagctgagatcttgtcccccagactgggggacaagagtgagacttcgctcaaaaaaaaagagaaaagaaaactccatgaaaccccctaaataatagggtatggaaagcttcatagttggtgaaaaaattggtgttaggagggtgccaaccaggagaaggcatggaaactctatatcttcctccaccttctacccccacccagggcatacttttctcggtgcatctcttccacttagctgttcctgagttgtatcctttacgatgcattgctaaatgtaagtaaagtgttttcctatattctgtgaattattctaacgaattattaaacctgagggagattggcgggtattctcgaatttacaactgttcggtggcaaacctggcacttaaaatgggagcaattttagggaactgagccaagagaattgaatttaattgtttgacacccaattcctgttagagaattggagaattggtgtttggtgtcagaaaaaaaccttacagaatagttatgtatggtatagtacaaccttgacataattaacttcatcttagaaaaagactccattttatatttatttatttatttttatttttatttatttatattttttgagacagagtctcgctctgtcgcccaggctgaagtgcaatggcgtgatctcagctcactgcaacctccacctctcaggttcaagcagttctcctgccttagcctcttgagtagctgggattacagcatgccaccatgcctggctaatttttgtatttttagtagagatggggtttcaccatgttgatcaggcggtttcaaactcctgaccttgtgatctgcccgcctggacctcccaaggtcctgggattacaggcatgagccactgtacctggccatttatttttatttatttttttgagatggagtttcactcttgtcacccaggctggagtgcaatagtgtgatcttggctcactgcaatctccacctcctgggttcaagcaattctcctgtcttagcctgttgagtagctgggattacagcgcaccaccatgcctggctaatttttgtatttttagtagagatggggtttcaccatgttggtcaggctggtctcaaactgctgacctcgtgatctgcctacctcggcctcccaaaggcctgggattacaggcgtgagccactgcacctggccatttttttttttttttttttttttttgagacagagtttcactcttgtcacccaggctggagtgcaatggcgcgatctcggctctctgcaacctccgcctcccgggttcaagcaattctcctgcctcagcctcctgagtagctgggattataggtgcccgccacgacggctggctaattttttttttttttttttgtatttttagtagagatggggtttcaccatgttggcctggctggtctcaaactcctgacctcaggtgatccacctgcctcagcctcccaaaatgctgggattataggcatgagccaccgcgcccagtctccattttatatttcatagggaactttgtcaacaagtataagatgctttgcttaataaacaaagttttttaaaagatgcatccaaccagttaaggacacaagcatgctcttccactatcagttctcactagaggattctgtgactataaaagatgaggccagccgggcgcggtggctcacgcctgtaatcccagcactttgggaggccaaggcgggcggatcacctgaggtcagtagtttgagaccagcctggccaacatggtgaaaccctgtctctactaaaaatacaaaaaattaggcgggcgtggtggcaagtgcctgtaatcccagctactcgggaagctgaggcaggagaatcgcttgaaccagggaggcagaggttgcagtgagctgagattgcaccactgcactccagcctggcaacagagcgagactccgtctcaaaaaaaaaaaaaaaaaatgaggccagctgggtgcggtggctcacgcctgtaatcccagcactttgggaggccaaggcgggcggaccacctgaggttaggagttcaagaccagcctggccaacatggtgaaaccctgtctctactcaaaatccaaaaaattagccaggcgtggtggcgggcgccagtaatcccagcaacttgggaggctgaggcagaagaatcgcttgaacccgggaggcagaggttgcagtgagccgagattgcgccattgcactccaacctgggcaacaagagcaaaactccgtctcaaaaaaaaaagatgaggccttcagcagctcaaaatggtcatcttaactgacaccgtcttgcagtcagtcactcgtgataagaacttgccatctgcctccgaaggctctgccacatcaaagactcttcctcgcaagactggcagaccaactggcccaaaacagaactccttttcttctttgttctgcctggactggttctttaaccctttctcctatctctttctcctcttgatgttaaatgttactttgtcatggaatgtttaacttgtaacatttatatattgattaattatactattatgtatggtttacaatattgactggcttgcgtgcccacagctctgactactgagtgaacaggaagtactgttagctgtggaaggtatacagatcatcagcagtaaatccatacaggcctgaagcaacctcaattcttgcctcctcagaagaaagaattccactgaggggcataaggcagaaggagaaaccgaggcaagttttaaagcaggagtaaaagtttattaaaaagctttacaccaggaacaaaaggaaggaaagaacacttggaagagacccaagtgggcaacttgaaggagaagtgccccatttcaccttggacctaggattatttatttatttatttaatgagacagggtctcactctgtcgctcagactggactgcagtggagtgatctcagctcactgcaacctctgcctcccaggctccagcgattctcctgcctcagcgtcgcgagtagctgggattacagggcgcacactactaccacccagctaatttttgtatttttattttatttatttatttatttttgagacagagtctcgctctgttgcccaggctggagtgcaatggcacgatcttggctcactgcaagctctgcctctggggttcatgccattctcctgcctcagcctcccaagtagctgggagtacaggcacccgccaccacccttggctaatttttttttgtatttttagtagagatgaggtttcaccgtgttagccaggatggtcttgatctcctgacctcatgatccgcctgcctcggccttgcaaagtgctgggattacaggtgtgagccactgtgctctggctcatttttgtatttttttttttttgagatggagtctcgctctgttgcccaggctggagtgcagtggcgcgatcttggctcactgcaagctccgtctcccgggttcacaccattctcctgcctcagcctcctgagtagctgggactacaggcacctgccaccacgcctggctaattttttgtatttttagtagagaccgggtttcaccatgttaaccaggatggtctccatctcctgacctcgtgatccgcccacctcagcctcccaaagtgttaggattacaggcgtgagccaccgtgcccagccctaatttttgtatttttaatagagacagggcttcaccatattggccgggctggtcttgaactcctgacctcaaatgatccaccctccttggcctcccaaagtgctgggattataggcatgagccactgggcccggtccagaccttggatttcatatgctggtctacttctagtattttgtgcccctttcccttcattcttgccttagggtgagctgcccacatgcacagtggcctactaacgcctggcaggtgagcatgcgcagtgtgtttactggagttgtaaacatattcacctgaggttttcttcccttttctggtggaatgccctggaaggtcatatgcctccattttgcctcttaatgtgcatgctcgagcccactcgcccagttccttagatcttacggaagctgctgattaccaatttcaggtgtttatctgttgggaaactgcctctccctggtactggctgtgaccaattattttagataggtagtgtgacaactgcctgaccattggtcacctgacattcctggtgggtgcagggagccctctcctgccctgctcttgcctgtctaactacctactgtaacagtactaaggagattgcccccttgggaactccgtgtagctcctggcttttgtgattgcaatagcatcagtaaaagcctgacactgtggaaagacacaaacatgcaaggacctgcttatctctaaccttgcaccactcactgaggcaggagaatagggactagaggcagggaacctaaggacttcctagaactaaatcaaatgaaaatgaaaacacttcagctatgacaaaaaatatcctcctcatttacatagggcgtacaccaagtaaccagtgggaacctctagaggggatgtaaaccccagaaaattcttttttcttcctttctttctttttttttttttttttttgagacagagtctcactctgacacccaggctggagtgcaatggtgcgatctcagttcactgcaccctccgcctcctgggttcaagagattctcctgcctcagcctcctgagtagccggggttacaggcacccaccacgggccatgcctggctaatttttgtattttttagtagagacagggtttctctgtgttggtgaggctggccttgaattcccaacctcaggtgatctgcccaccttggcctcccaaagtgctgggattacaggcatgagccaccacaccctaaacccaggaaaattctgtaactgagcccttgagcccctatgtttggcctgctcccaccctgtggagtgtactttcattttcaacaaatctctgcttttgttgcttcattctttccttactttgtacattttgtccaaatctttgtttaagacaccagggacctggacaccctccactggtaacatcatgacatgtatgcaaaaattgtccgcaaaatttacatataaacgattagaatttaagaattcccaaaaccccctttagacagggtttcaccacgttggcaaggctggtcttgaactcctgacctcaggtgatccgtccaccttggcttcccaaagtgctgggattacaggtgtgagccaccatacctggcagggaacttcattatttaaaggagaaagagcaagcaggagggggaaaacgggaggtagggtaggtagtgaggcgaattgttacattcttgtgaggctctgattagcctcagtaaattgacattttacatgtgaaaaggggaagtagaggaaatgaggctatggtacaggattgtgaaattacagctatctggtaacaaaaggaatgcagtaattcagctctcaagcttaatgtccctttggcatagtgagtttggggtcccaagattctattttctttcacactaacaccaacaacaataacaacaaaagaacaagacatctgcaagaaaatagtatctttattgagagatattatgaagatattatgattaatgtactgagagatatatcacgtattatttggaggtatcagattacaaagatgctaattctacttaaattgccctataaattaagtgcactgggaaggtggagtagacatacttcctaaattcctcccactaaatacaactaaaaaccctggacattatatataaaacaaacataagaagactgaaagaaaagccgggcgtgatggttcatgcctgtaatcccagcactttgaaaggctgaggcaggtggatctcttgaggtcagtagttaaagactagcctggccaatatggtgaaaccccatctctactaaaaatacaaaattagccatacatggtggcgtgtgcctgtaattccagctactcaggaggctgaggcagaattgcttgaacccaggaggtggaggttgcagtgagccaagatcgcaccactacactccagcctgggcaaaagagtgagactctgtctcaaaaagaaaaaaaaaaaaagactgaaagatggagagaaggcagcagacaagctagggatcttgggggtccaaggaacaacatagtgatgagtttcctgggttttcttcctaccttacatctcgaagccttggaactgaagaagctgacaatccaaaaatgccgaagggtgagacaaaaaacgaaaaccttctctcactagccaaagaaccaggaaagggaaaatctagcaagacagcaaactttatataacaactcctgtactccagccaagtgctacagaaagaactgtgaccctacccctacctgtatcaccaagactgagtggggagcctagacttccacccttgctaggctgtaacaaggtgctccaaaggatagtcttttctacaaatggtgctgggacaactggatattcacatgcaaaggaatgtagttggactctgctgtgtgaatagtgtcaccctatccaacattcagtgtccacttacaacctcagaatgtggccctctttagaaatagaatctttgcaaatgtagttagttaagatggggaattactggattagagtgggccctaaatctaatgactgtccttataagaaggccatgtgaagacacagaaacatagtgagaatgcccggtagcaacacaggcagaaattgtagtggtgtctacaaggtaagtaaggaatgccaaggattgtcagcaccagcagaagctagaagagaggcatgggacagattctccctcagagcctctggtaggaaccaaacttgccaacgccttgatttcaaacttctagcctacagaactatgaggcaatacatttcttttgttttaagccactcagtttgtggtttaaaagcagctctgagaaattaatacagactcctacctcacaccatacacaaaaattaaaatggatcaaagacctaaatataagagctaaaactataaaactcagaagaagaaaacagagataaatctttattacttttgattaggtaatgctttcttagatatgacaccaaaagcacaagcaacaaaagaaaaaaaatggtaagtcagacttttttttttgagacggcgtttagctcttgttgcccaggctggagtgcagtgttgcgatcttggctcactgcaaccttcacctcctgcgttcaagcagttctcctgcctcagcctccccagtagctgagattacaggtgtgccaccgtgcccagctaatttttttttttttttcttgaaacgcagtctcgctttttcgcccaggctggagtgcaatgatgtgatcgcggctcactgcaacctctgcctcccgggttcaagtaattctcctgcctcagcctcctgagtagctgggattacaggtggccaccaccatgccacaaggcccagcctaactttttatttattttactgttctttttcttacctcttaaatgagtattagttcttttttatgtatattttttcctattcattgtcaatattcaatataaacttaattctttaatgtctagcctttccatattcctttttttttttttttttttgagttggagtttcgctctgttgcccaggctggagcgcagtggcgtgatctcagttcactgcaagctccgcctcccgggttcacgccattctcctgcctcagcctcccaagtagctgggactacaggtgcccgccaccacgccttgctaattttgtttttgtattttcagtacagatggagtttcaccttgttagccaagatggtctcgatctcctgaccttatgatccccctgccacagcctcccaaagtgctgggattacaggcgtgagccaccacgcccagccagcctttccgtattctacttttttatttgtttgttttttagagacactgtctcaatctgtggcccaggctggattgcaatggggcaaacaaagctcactacagcctcaaattcctgggttcaagtgatcctctcacctgagcctcctcagtacctgggactacaagtgtgtgccaccacaccaagcgaattagtttttgtagagttagagtctccctatgttgcccaggctggtctctaactcctgcactcaactgatcatcctccctctgcctccctaagtgctgggattatagatgtgagccaccttgcccagtctgtgaggtttagttggagcctcaactttttgatgaggcaggcctcttattatatttataacttggggtgggccctggactttacctagcacctaggctgggcgtggtggctcacatctgtcatcccagcaccttaggaggccgaggcaggaggatcgcttaaacccaagagttcgagaccagcctgggcatcaaaacgagaacctgtctttacaaaaaaaaatttttaaattagccagtcatgatggtgctcagctacttgggaggttgaggcagaagggtcactttaacacaggaggtcaagtctgtagtaagctgtgatcgtgccactgcactccagcctgggtgaaagagtgagaccctgtctcaaaataaataaacaaacaaacaaataaaatactccagcacctataaggttgtagagaaaatggcattagtgttccactcccttctggtttaaaggttccttactatcttgtcacctttttaatgcttttaagaaaattattttatctagcaattttaatttttattggaaggcatatcaagatatctggcccaccatattattcaaaacccagaattctgtcattttttaaaaacagatgatggtaagcatcaagttactgtgtgtttagattacattagatgtaacagaatggtgtaagttttactgtaaaacatcaatatttacaacatgcttcttttgggggacgggggagatagggtcttgctctgttgcccaggcttaagtgcagtaattcaatcatggctcacttcagtcttgaccttctgggcttaagcaatcctcctacctcagtctcctgagtaactgggactacagatgcatgccaccatgcccagctaattttaaatttttttgtagatacggggtcttgctgtgttgcccaggctggtctcaaactcctgggctcaagtaatcctaccaccttgacctcacaaagtgctgggattacaggtgggagccaccatgcctggccacaatatgcttaaaattacattattttacactacgtatgtatatatctccacacatatacatatatgtgtgtgtatatatatatatacacacatatatatcctgggctcaagaggtcctcccacctcagcctcctgagtagctgggaagacaggcaaagctacttgttttcttacattttgtagagatgtagtctcagctggtcttcaactcctggcctcaagtgatcctcctgcctcagcttttaccgtatttaaacttaacttgaagaattttagatatcaacttaaaaatgactggagttacatagtttaatttcttttttttaggtgataagcaaaaatgtaaagaacactgatacagagaaatggtcacatagcccggacatggtggctcatgcctgtaatcccagcactttgggaggccaaggcaagtgaatcacttgtggtcaggagtttgagaccagcttggccaacatggtgaaaacctgtttctactaaaagtacaaaaattagccaggcatggtggcaggcacctacaggtgccagctactcaggaggctgaggcaggagaattgctttaacccgggaggcagaggctgcagtgagccgaggttgagccactgtactccagcttgggccacagagtgagactccatctaaaaaaaaaaaaaaaaaaagagatatggtcacataatccaatttcataagaaaatatgtacactcagctgggcgcagtggctcacacctgtaatcccagcactatgggaggccgaggtgggtggatcacgaggtcaggagatcgagaccatcctggctaacacagcgaaaccccgtctctattaaaaatacaaaaaaaatagccaggcgtgttggcggacgcctgtagtcccaactactcgggaggctgaggcaggagaatggcatgaacccggaaggcagagcttgcagtgagccgagatggcgccactgcactccagcctgggcgacagagcaaaactcaatctcaaaaaaaaaaaaaagaaaagatgtacaatcatctagtctcatgactttaaatatctatatactggtagctcccaaatttgtatcttctacccaggcctattttctgaaacacatatccacatgcctactctacatctctgattggatgcctaataggcatcctaaatttatcatgtccaaaacagaactcttgaattctactccactccagtccacacactcacatacagaccactcctttcttctcccaggattctccatctgagtaaatgttacctttattcacccagttgcttagcccaaagacctctgagttatccttgacttctctctctcactctcctgctctaatatttatcatctaacgcatcagcaaatcttgtcagctctacttaacaaaacataacctgaatgtctgccatctttctctcagacactaaaataatctacttcttactgctttccttgttctattcttgctgtctctttttaaaagtgatcctttttttttttttttgagaccggagtttcactcttgatgcccaggttggagtacaatggcgtgatctccagctcactgcaacctctgcctcccgggttcaagcgattctcctgcctcagcctcctgagtaactgggattacaggcgcatgccaccacgcctggcttatttttgtatatatttttagttttatttttttttttttgagatgaagtctcactctgttgcccaagctggagtgcagtggcacagtctcggctcactgcaacctatacctcccgggttcaagtgattcttctgcctcagcctcccgagtagctgggactacaggtgcgcaccaccatgcccagctaatttttgtatttttagtagagacagggtttcactatgttgaccaggcttgtcttgaactcctgaccttgtgatctgcccacctcggcctcccaaagtgctgggaatacaggtgtgagccactgcacccagcctatttttgtatttttaatagagatgaggtttcaccatattgtccagactggtctcgagctcctgacctcaggtgatctgcccgccttggcctcccaaagtgctgggattacaggcgtgagccaccacgcccagcctagaagtaaatcttaatgacgctaagttaggcaaaggcttcttaggtatgacaccaaaagcataagtaacaaaagaaaaaatagatacatttgacctcatcacaattaaaaacttctttgcttcaaaagacacactatcaagaaagtaaaaagacaacccacaaaatgaagaaaatatttgcaaatcatatatctgtagtgttatatattggttttcatctatggttcttggctcataacttccatatccctctttacagtcttttgttagaatgttgggtgtgttgagcctcagggcaggcatctgatgttctcctgccctctgttcatgctaatcttccccgacctttttttctttctttcttttttattttaagataggttctcactctgtcatccaggctggagtgcagtgttgtgatctcggctcactgcaacctctggctcctggattcaagcaattctcctgccttagcctcccgagtagctgggattacaggcacgcgccaccacgcctggctaattttgtatgtgtttttttaattagagatgggggtttcactgtgttggccaggctggtctcgaactcctggcctcaggtgatctgcccacctcagtctcccaaagtgttgggattacaggcgtgagccaccaggtccagcctaatctttcccgacctttctgattgtaggtcttaataccctcccatgagagtgtcccaccctataacctgggagaaggaatgctgatgtctttaagcttctgtaaaaacccaagatgacagggctcagtgagcttccagacagctgaacacatggaggttactggagggtggtgcgcccagggaggggatggaagctccacaccccttcccccatacctcaccctacctattctttttatcggtatcctttgcaatatcttttataataaactggtgaatgtgtctccctgagtgttgtgagctgctccagcaaactaatcgaacccaaagaaggggtcatgggagcgtcaacttgaaaccagtcggtcagaagtcccgggggctgaacttgtgactggtgtgtgtggggttagagtcgggggctggggcagtcttggggactgaaccctcaacctgtgggatctgacactatctctgagtgataatataggaactgaattagaggacacccagctggtatctgctacttggtgtgtggagaaatcctccacacatttggtcacagaagttgtcttctgtttgatgattgtt

SEQ ID NO: 3100 - DNA, 6111 bp, Homo sapiens
agttatacattttattctctaataggtacaatactaaaataaacacaaattaaaaaaaagttttattaaaacaaaactgtacaaaaaagcagtatactacattttaattacagaacagtctactgtccaaaaggcactaatccagaataggagatacaatgatacaggactcatttgaactattttattcaaaacaatagagcgcttgtttctttgaccatttacatctagaaacaagggctttttgctacagccattacacattgttataaatatgagtcctacgggtgaaggtgcagtatcactctccctagaggaggttcccattagtgggaccactgtggagctcagaggcggatggcgcagtgggtggggcctgggacctgccacatggttggcccgtcagcccctggacacccggagcttgtctttcagcctggcctctggtggttggtttctggccattactggcagccactttcaccccctcttgtgttttagcaccggcaaagtgggttctgagaagctccaggtaactggggctggaggtgtgggggatgaagcgtcagcagcggggaggcattgtggtaacctgatctgaagaaaggcagcaactactcggaagagggagacgaagcccagggacagccaatgagctgggctctacagccaggcagagccacctgctgctttctgggcaaacttctggccccagaatatgagggtctgttccaaagttcagagagatcctgtgtcccttcctggtgacccagaagtgacatcggatcatcttttgtcttggaagctgatttttacaagtggaattttgcttcccagagggaagtcaacatacagtgaccagcctgaagtgggggagccctttccctccctcagtcccaccccaggagtacaagtggctccaggccccaggtcccaccacaccacgtacgggagccgaactctgttggcttacctgtgtttggtggccaagacacctctaagccccatgtttattctttaatggcctctggacctcaggaagagagatactgcagctttccaaacagtgtcatacacatataagacaaagacaggcatctgatgttaacaaaaataagtaacaaagaaataggattaaaccaaatctcttctcacagcatcctatactacatcctccttctgcttagcagaaaattgtacgtacacaaaaatacaaatacacaattttgtagaacagtctgattttaatatatttatatatatttatatttatacgagtggcaggttagttcattatatagagctttttgcacttttggctcatatgcaacaaggcttataaattcagcttcagctttcattcaggttttatagcttttgaacaattgttttcacatttaaagcagcatccaatttgcactaggagtttgtggtgattataggaaagacaaggtcaggaggttatcgaaggggcagggcgggggggatacattccagtgtgtgtggtgatggacggaggatgccgtgggatagagcttaccatgatgaccccttgaggtagactgaacaccttacagcagactcaagacacaggtgtgactcgccctcagggacacatggtgcacaagatggacagggaccagaggagacgccaaggggaaacatgaagactaacacacacagcagccgaggcagggaggagcgcgctgcccccacacccgtgtggcagggatcccgcatggcccatcttagaaactcaactatttggtggatgctaaacacttcacttcaggcaatcccaaggcatttgctccagggtatccgatgagattacagctgttaagcttgctttccatttcataacttgctgtgcagctagttaccacccccatgctgaagagtaaagcaaagctgccgtggttcggcagtggaatccacccccagcactctgctcgcactggagcgttcaagtccggttatgtgagaacagactaggactctcttgctgcctctaattgcatttcactgtcaccctccccagtgctctgcactctcacttacattcatctcttccctagataattacaactagggtaatcaacaagcacttggtagaacctgcaaaaaatagcatctggagaactgagggacgacgaactgccaagggtccggtttggtttacatgctacagaaaagcctcattctcatgatcaccacagcactgttctcccattcgatcaccttcgtcagcctgccttcccttctctgtcaggtcacaattccattccactggcaagtttgcccatgtgtcaaatatgaatacccagtgtttgggttattacattgtctgaacaaaaatgctggattattaatgaaaataaagtgcctgggtatggattgttccatgatgcaaaaccttttaatgcaccaacaaatcatctcagcgctgcttagtgatgtgatttgaacagactgcagtcacaaaataatctgtcgtacacccatcacagaataaaggccccgtatttaggtcagacttaaattattttttaaaaaagaaacaaatactctcacactcatttccaaagacacacttgggatctgaacgcctgattgctggctttcccaagccctcccgagcagacaccctgatccctctagtctaggcagagagggctcggaaaggcagctggggctccggtggctcacgctggcaggtgagtcagcaggctcatgagctaggatgattcgacgcttcgccctcttggatgtggacacatttccaactcctaccaaagccagagctggaatgctgctctgaggctgtcttgctctcctgtcttcttagtggctactgagatttccctaagcagactcttaaattctctatgaaccaagaccaaaccacataaacagaaacggccctaaagaaagaaacgctggaaaacagtgacgaagccagcctgatatggctgtgaagcgatctctcccgctagcttgtccttgccttgttctgcctgcagaacgccagggacactggagaggggcagccgccctgtgcccaccctcaagggccagtgcagggtggggagggatggggacagggcataggccgactctctggcaggttccagaggtctgtatcttgcttaggcacttaaaaaacataaacaaaaatttatccttgaaaagtactgcatacccaacgtgaccatggccgtggaaggcagggcgagcccgggggggagatcatagaaggctgtgggctcttccaggggaggcaatgatgacgcacatggtgtctctcggcagggggagtgtcctgccttgcagccagggtgtgtctgaagacgccagtgctgtgatggctcagggaccgcagactcggcccagcagaggccttcctgtgaccgtgctctacagccccccgggaagtggctagaagaggcagggatggggaggctcctagggcctgatctagacgcccgccatgggtcggggaggcacaggctgcacacacttgctttctagagtcaccatgaggcaactactaggaaaagaggaggcccttccgagtgctccggcaaaactgaggggcagtcgggacgccctgcccaagctcccagtgcttcgaaagaaaagctccactcccccacatccagaactttggttttggtttcatggtgcccattttcagagatgcagtattaaggggatcaccgattctaacataatgaaatgtggttttcaaggcaaaaaacaatgctgcttgaaagcagccaccgctgagcacgtgtcttcctgcagcccactcttctaactctgtgcctgcccgccgtgaatctggtttaagaacaaaagagttcaatgcaacatcaccagagtggctgctgcttacattagtataacactaatgtcattctgtgttcgggcttaatagctccaacgaatgatgacgtggaaaaatgactctcacgagtttacgctgggatcttagttccagtaacggaagaaaaggagaggtttctgtgctcaaaggaagccacaaaacatgactgaaattgagactcagcccgaagtgacaggaagttgaaaaagtcttaaagggaagaaggaataagccttgaaacacaaattctgtgacttgtcactgccacagacactggtttgtgagagccatgagttccttccgagggaggaatcaaactgctcccattccaaaatcccaatggcaccccagccaccaccagatgcaaaatctggaccgataacaaaatgcaaggcacatataccttttctctttcaaattaaggaggctttttggggattggaggttggataataacgtaactgtgtacctattacaggtacagaggatccagggagactctcacgaggaccagtccacagctgtggccttgcttctgaggtggttccaagatgcccacgacggggcagagcagatcagaagagaaagaccatgagagagccaacccctagaggaccacttacgtttgacggaaaagaggtagacaagggaaggagggaagaaatgtggaactttagttagctgagtcctcaggtcagcttggtacccatgtcccttgttcaatgtccctgacaagttaccacagttccacgtgaaatgtggcaggacaggaaccagacctctacctcaaaggagctcatgcctttgctggattctgggttctagaaagttcttacgctgaccccaaatcaagatatgtctccagcaactgttatttcttggcagtcagggcccatgaggaggcagggaggcctgaggcagagcagacactgatctaattccagaaccccagacccccggtttctagagaggaggaggggccagctgagcaagatgctcctgaacacagcaggagccccgaaggaacggccagggtagcgctacaagagctggagagagaagatgggaagtgcaagagggtttcctggtctctgccttggctaactgcaggcaaggggtgccggagttcaagttcccctcggccacacaggcttcccaccctgtcaaccactgcggcacctccctgcactcctgtcatcatcactgaccagggaggaagactctggaggggccctcacgtccagaccctcacggagggagttcagctcacagaggcgggggcgatgccacagtgcgcctgggaggctacctggcactgctgcgtgagaaagcaaaccaggttagtgttcagagagggcagaccatcctatgtggtctgttctttgaagatgaacgtcctactgaaatgaaagaaatgaggggagacttgccttgccaagggcaaggtgacttgcttggtgtcgggtcatgaggcagcacacatgtccagcacggtgcccagcacacagtacgtgctcagaaaacatgggctgtattgactttgaggtggttgggagacctgtgcatttgtctctgtagtattatgatttacaatggtggcatctttagtttcctataagaataactaacttctggggtttttgttcaaaaaccacatatttcatgggtaagcactgtctcaattttcactgattttggtaagctgagttacggaaaagggtgggcgctgctggtaaaggaatatatggttggggttttctgaatcaccagagtggcctgcagaagcatttgggaagggaggtgtctctccaacttcagttcttttgaagtagcaccatccctgaagcagcacctctaataccttgatccctaagacaggggctccattagaaggttttaactgtggtgttaattgtgttttctttgagtgtaggtggatcatcagaatgttctgctgacggttttaatgcatgtctcacaaatcatagaattagactcatccagtcagctcttaccatctctaagcttaagacggattctaaattctaatggagacagtcatattttagcagctgggaaaataggaaaaggaatgctctactctttgaggtcataaatctacaatcattccagttgtcataaagataggatcccaaagaaaacagtttcaacaactgcatgcatggatcttgaattattacttttgtgatggttagcttctt

SEQ ID NO: 3101 - DNA, 7991 bp, Homo sapiens
aggccgctgccagtacccgagcgggcgggagggcagctgcggagtcagaagcccaccctgatgcccagttcgctccgagtgcgtcgtccgctttctcccggaggccgcggcgaccccgccgggatgtgcgacatgtggtgccccgacccccgacccttgacccttgacctccgggcagctccgaccctttcaacactctccggggtcgtgcgtcgggagaccccggcccctgcccgcgtgcacccggggggccccgcgcgaagcctgcggcggcttccacgtgggcgcggctcagtcccgctgccgatccgtgactccgcgccgccctccgcgcccggcctagagatggggttccatccatccattccagaagcatttggcaagcacatcctgggtgccaggcccaagcaggctggtctcaaactcctgacctcaagtgatccgcccacctcggcctcccaaagtgccgggatgacagctgtgagccaccgcgccccgcccagaagcagaggtgttttaacgggaagacttcaggcttcatcggacggccgggaaggaatcagagcaggggtgaggttggctttgtgcggggtggggtggggtgccaggctctgtgtcgggtgggggcagcagcacatcttttgtaattaatcattgccgaggctctgcctgtacgaagtgtggtccggggagggctgatgaggctgcaggatgagggggcttgacagacccctttccccagaagagggcccccaaaaggcattgcccctgaagagggctccccaagacctcatccctgaaaagggactcccagggtcacccccctgaaaagggctcctcaaaaggccccccgaacggggtccccccaagactgccctctgaaggaggcccccgaagacttcccccgtgaaggtgccccccaagacctgccccctggaagagggctccccaagacctctccccctagaagagccccctaagacttttaccctggaaaagggctctctgcaaagcttccctggacgtgcgccttcgagctgggcaggtagggaggagctgtgtactcgacatcatccttaggatctgttgtcctcccgcttcccctgccccggcccccagatgaatccagaggctgttttagagccagacggacactcctggtatgcaccagacactcatagtgcagtgctcgctgagtagaggaggagttagtgggtgaacccggcccgccaggctgccctgcacagaattccagccttgtcaccccactggtttttaaatcatcacaatcctcgggatgttctgtgcatgccacacacagactcttaagagtccagaggtcctgtttttgcacagttactccaatgaataaaaagacgggctgggcgtggtggctcacgcctgtcatccgagcactttgggaggccgaggcggggtggattgcctgaagtcaagagctgaagaccagcctggccaacatggtgaaacctcgtctctactgaaaatacaaaaaaattagctgggcgtggtggtgggcgcctgtaattttagctattgcggaggctaaggcaggagaatcgcttgaacccgggaggcggaggttgcagtgagccgagatcacaccactgcactccagcctgggcgacagtgagactgtctcaaaaaaaaaaaaaaaaaaaaatttctagcagacactgaagggagagggagaggaacaagccccagggaccctttatccgacttccttccacctgggggactccctccacgggcccttgctttaagggcaaatggcgagggcaccagaacacagggaggccatgccggaggtccctgctgcaaccatgcggccccccagctcactcccagcagccaagacgaaggggggcctgggctccccctagggcaggcgcctctgattctctccaccgagaggcacctcccatgccggcctcttcctggggtgactcccagaaccttcttggacccatgaacatttcaatctggggtggggccttccctgggcatccaagtggtgggaatctgtccctagcccctagaactcctggagggctgggcccacctctgtctgcatcccgtccccattccccgccccgggtggcaggggctggagaggaaggagcttcaggcttcaaaaccatcaaagcaggtttcttccgagatggccagtggtcacctgagatggagcagagagcacctgtggcgggcatcttctctagaagccgcctgtgagccctacggaggccctgggcttcgtgccgtaagacagacggtgtcctgcagcagcctgcagcactgggcacactcacctgctgtccaggtttgtagcccgggagcctggggccctgccgcacagcccaggtgagtagcaggctgtatgtgccacggcggtatgtgtgagtgcaccccgtgatgggcacacaaagagaattgcctaaggatgcatttcccgaaacaggtccctgtcattcagtgacacacgtgactgtgtgtgtgtgtgtgtgtgtgtgcgcacagatgggtgtgtatgtgtatgtatacacacctgaacactcacacctctacacacgtgcctgtacacggatagaacacataatttacagaatttatggaacacataatttatattacataaaatatatagagatcagttttgttttcttttatttatttatttagacggagtctcactctgtcgcccaggctggagtgcagtggcacaatctcggctcactgcaacctccacctactgggttcaagccatcctcctgtctcagcctcccccctgtagctgggattataggctcctgccactatgcccggctagtgtttgtattttgtgtagagacaggatttcactctgttggccaggctggtctcgaattcctgaccacaggtgatccgcccacctcagcctcccaaagtgctgggatgacaggcgtgagccactgcacccagcctatttcagctgttttcttaaagcacaaagcaacctacacattcttttgtgataccaggccactgtaagggtggagcagcatgtgactttggtgttattgagatcatccgtgaccattgcagaaaaccactcccatctgtgcagtgagcaccttgaaataggccgcccaggaggcagagggtgcaccttgaaattgggctaggaggcggggcttgccccttgaaataggccgcccaggaggcggggttgcaccttgaaataggctgcctgggaggcagagctcgcaccttgatataggccgcccaggaggcagggcttgccccttgaaataggccgcccgggaggtggggttgcaccttgaaacaggccgcctgggaggcggagcttgcaccttgtaataggccgcccgggaggcggggcttgcaccttgaaataggcctagaaggtggggcttccaccttgaaataggccgcccaggaggcggagtttgcaccttgaaatagactgcccaggaggcggaggttgcagtgagccgagattgcattattgtactccagtctgggtaagaagagctaaactccagagtctgtctcagaaaaaggaaaacagctgaaatataggagactgacgcccagcccaggaacaggtaagctgggtgcacgcgccgtgaaaacagcacctaggcctgctccggttctcgctttgcagatgcctcctgaacctcagtgcctcctaaggtcaaggctgtgagttaaagggctccaccccagcccagccccaggttggcccagccattccctggtggaggggccagggaggaaagggggctgtgtgggcaccagagggtgaactgaggtctgagggtcgggacacaggccgggaacagcagctgggagcggagcacgggggaaacgtggatgcgctgagctccctacaaccgcagtgagcatgtgcccaggagggcctcacggggtgggtgtgagtctggcctgcctgggctcggggtggggggtgtttacagacgcatttcagccccgcagcaggggctggggaggtcccgctcgtgacagtctctgcaccaaggcaggagagatggaagccgcccagagaactgccactccatagcctgtgggcatccaggggtgagcggcagcgatggcgccccatggaggaaacacactggaaatcgtgcagaagatgggaagatgcaggctggagtgcggagaaggactgagaccctgcctggtagacggcaccgtcacagcagccgtctgcctgctaggaggagcgtctccaccagcagcaggccggcccctgagggagacagcagagagctggagtcctggccagccaggcggggatccttcagcaggacacaggggacacagcaggcaacaggagctcagaacgctctcggcgaccctgctgagtaacttgtggactttgtcgtctggccagtcatgcaggatccggcacaggacgtacagctcagcgctggggagggggtccctgaaaaagtcacctggtttaaagacaaaacgagatacgtccgtcaggtatggaagaagcagtcctccccggacagatcctgggacggccacccgcatcctaaatcagggacagagaagagaggggtgtgggcgggaatgggtcttcctgaagtacatccccgtggggacttgaacagagctccatgaggagctggttagtgatgtcacgcccgtgcggtttgactcgggctgagaaaacgctggggacagtggctcacacctgtaatctcagcattttgggagcctgaggtgggcagattgtctgagctcaggagttcgagaccagcctgggcaacacggcgaaaccccatctctactaaaaatgcaaattagctggacaggggtggcgggcgcctgtcatcccagctacgcgggaggctgaggcaggagaatcgcttgaacctgggaggtggaggttgcagtgagccgagatcgcgccatcgcactccagcctgggcgacaagaaggcaagggaggaaaaaagcagggaattcaggggcagcacctgggcgaggcaggcagagtcggcgcacatgggcgtgtgccagggagagtcggggccgcactgccggtgagtgggcaatggcagggccttctctggtgatcccctgattcaggcgccccaggagggttgcctgttgcggggggcgcatgtagctgcacgcccctctgtaattgctgaaataaaaagatggtctgctgtagtgcagtgaatggtgtccccttaaaagatatattcaggtgctgaccctcagtcgctgggaatgggaccttatctggaaatagggtctctatggatgtcattgagtaaagaatttcaaaatgagatcatcctggagtagggtgtcccctaaatccaatgacaggtgtccttctaagagacagaagaggagacagacacagaggagaaggccacgtggagacggaggcagagactggagtgatgcggccacaagcccagggacgcctggagcccccaggagctggaagaggcgggaaggatcctcccctagagcctctcagaaagaatcaaacacaactgcaatgggttgggtggtgacgtccaaaagatctgtccaagtcctaagccccagaacctgggaatgggacctcatttggataaagtttctttgcagatgtaattaaggatctggagatgggatcatcctggagtagggtgggccctaaatgcaatggcaggtgtccttctaagagacagaagaggagacacacagaggagaaggccacgtggagatggaggcagagactggagtgatgcggctacaagcccagggacacccggagcccccaggagctgggagaggcaggaaggatcctcccctagagcctccagagggagcacagccctgagatgccttgatctcagacctccggtctgcaggacagggagaggataaatagcaagctgtgagttgcatgaggggaaagaaggggcgggagagtgtgcggtgggaagtctccagagctgttttcccccagctgcgaggagaaggtgctctttcagggctcatgattttaaactttagcatttccggccgggcggggtgtaatcccagcactttgggaggccaagacgggtggatgacctgaggtgaggagttcgagaccagcctggccaacatggtgaaaccccatctgtactaaaaatacaaaagttagccaggcgtggtggcgggcacttgtcaccccagctactcgggaggctgaggtgggaggatcccttgaacccaggaagtggaggttgcagtgagctaagatcacgccactgcactccagcctgggtgacagagcgagacaccattcaaacataaataaatttcagcatttctgtctctgcagatctggcaaatcagaagcacagctatcatgatgtcctgcaggaggagctgtagggtggttgcgttttgtttttttaaaaacgagaaaagcatccaggaacctctgggggagggttgtggaggtccccagcacctgtgcccacaggcctggccgctgtcggatggtgctgagttacagcacgtcagctgtctctttttttatttttttattttttttgagatggagttttgctgtgttgcccaggctggagtgcagtggcgcgatctcggctcacggcaagctccgcctcccgggttcaagcgattctcctgcctcagcctcctgaataggtgggattataggcacccgccaccatgcctggctaatttctgtaattttagtagagatggggtttcaccatgttgctctggctggtctcaaactcctgacctcaggtgatccacccgcctcagcctcccagagggctgggattccaggcgtctcctgtcaatccgtcctggcctcagcagctgccacctggaagttctccttcaagtctaacctaaggccacactgtgacggctctcgggtcagttccttccgtgacctcggcaccgtggatgcccatgaatgctgatctcggctgttccccatctccactcccctcacgtctcggctacttgcactgatgataacttcacacagtcgtccacctgtttatttttatttatcattattattatcattgtctttttttttttgagatggagtttcgctcttgttgcccaggctggagtgcagtggtgagatctcagctcactgcaacctccgcctcccaggttcaagcgattttcctgcctcagcctcctgagtagctgggattacaggcgcccgccaccacgcccggctaatttttgtatttttagtagagatggggtttcgccatgttggccaggctggtctcgaactcctgaccacaggggatccgcccgcctcagcctcccagagtgctgggattacaggcgtgagctactgtgcccagccttgtccacctgtttggagatgccctcgtgtctgtgtggacccgcagagagacacgcacaggcagacccacggacgcacagacacagacacaggcacacacacatatacccatccagatgcacagaaatgcagacacaaaggcacacatgcaagcacacgccacaagacatgcacacacggacacatgcaggacacagatacactgacaggtacacacatggacacacagatacagcaagacaggcacacacacacacacggacacagatacagtgacaggcacacgcgcacagagacagacatgcacagatgggcacactcacgcacggacacacagtgatacaccaacaggcacacacagacgcagacatgcacagatgggcacacacacatggacatacagatatagcgacaggcacacacagacgcagacatgcacagcaacaggcacacacagacgcagacatgcacagatgggcacagacagacacgcacggacacacagatacaccaacagacaggcacgcacacagacgcagacatgcacagctggacacacacacacacggacatacaga

SEQ ID NO: 3102 - DNA, 1358 bp, Homo sapiens
caccccccccacacacaccttatacaccccagacataacacacaccccacaccccagacatacacatacccctgacacacaccacaccccaccccagataccacacaccccacaccccgacatacccctgacacagctcaccccagatacacaccctaccccagatacacaccataccccagacacacaacacccccccaacacacaccatcccagtcacatgccacacatcccagacacacaccccacacgccacatcccacacacacacgcccgacacaccgcaccccagacacacaccacacccacacacatgccacaccccacacatacaccccaccccacacacacatcacacccctcacaaccacaccccacacacacaccacaccccacaaactacatagactatgctagccacataccacacaccagacacacacaccacacatgagcatgacgtataccgcacacatgccatgcactgtacccccccacacacatcccagacacacataccacacacactacacagaccacacagcagacataccacacaccagcaccacaccccctcacaccacatgccacacacaccacatgccagcatcacacacacaccatacctccttcatacacaccacacacacaaaccagacacacacctacataccacacaccacacaccagccacacaccacaaacacaccacacacaccacacgccacgcatatatcagatacaccacatacgtacagatacaccacaatatacaccacacgacacatgtaccacaacacacacacacgacataacacgcacacacatcacaaacacaatcatgtccaccacacaacacacacaccatgtgcatgcacacaataaatgcacagcacaaaacatcacatacaccaaatcacacacaccacacacacatcaaacaccatacacacagaccatgcatactcactgcacatgtgcacacataccaacacacaccacacacacacactgtacacacacctaaaaccacccccatacacaccataccaaacacaaccactcacacatgcaccacacacagcacagcatacaacacacatcacacacacaccaatcataccactgttacacacacaccaccacacatactgcacacaccaaagcacatacacaccacatagacacatgcacgctacccacaccacaccaatcacatccacacatacacaaccatacacacacacacacacattgttgacttaggatcgtttcaactcacagtgggtttattgggatgcagccccgtggcaagtggagcagcatgtgtattgacaaggggaggaaagccgtctgga

SEQ ID NO: 3103 - DNA, 2502 bp, Homo sapiens
gtggtgtgtgaggtctgtgtgtggtgtcaatgtgaggtctgtgtctggtgtgtgtgtgaggtctgtgtgtgtgaatgtggggtctgtgtgtgtggggtatatgtgtgtgatgtgtgtgtgtagtgtgtgaggtctgtgtatggtgtgtgtgaggtctgtgtgtggtgtcaatgtgaggtctgtgtctggtgtgtgtgtgaggtctgtgtgtgtgaatgtggggtctgtgtgtgtgtggtatatgtgtgtgatgtgtgtgtgtagtgtgtgaggtctgtgtatggtgtgtgtgaggtctgtgtgtgtgtggtgtgtgaggtctgtgtgtggtgtcaatgtgaggtctgtgtctggtgtgtgtgtgaggtctgtgtgtgtgaatgtggggtctgtgtgtgtgtggtatatgtgtgtgatgtgtgtgtgtagtgtgtgaggtctgtgtatggtgtgtgtgaggtctgtgtgtgtgtggtgtgtgaggtctgtgtgcagtgtgtgtgtgaggtctgtgtgtgtgtgtattgtgtgaggtctgtgtgtgtgtggtgtgtgtaaggtttgtgtgtatgtgatgtgtgaggtctgtgtgtgtgtggtgtgtgtgaggtctgtgtgtgtggtgtgtgcagtgtgagtgtatgtctgtgtggtggcatctgtgtgtgtgtggtgtgtggggtctgtgtgtgtgtgaggtctgtgtgtggtgtgtgtgttaggtctgtgtgtgtggtgtgtgaggtctatgtgtgtgtgtggtgtgtgtgaggtctgtgtgtggtgtttgtgtgaggtctgtgtgtgtgtggtgtgtgaggtctgtatgtgtgtgtgtggtgtgtctgaggtctgtgtgtggtgtgtgtgtgaggtctgtgtgtgtgtggtgtgtgcagtgtgagtgtatgtctgtgcggtggcatctgtgtgtgtggtgtgtgaggtctgtgtgtagtgtcaatgtgaggtctgtgtgtggtgtctgtgtgaggtctgtgtgtgtggtgtgtgaggtctgtgtgtgtgaggtctgtgtgtgaggtctctgtgtgtgtggtctctgtgtggtgtgtgtgtgaggtctgtgtgtgtggtgtgtgaggtctgtatgtgtgtatgtggtgtgtctgaggtctgtgtgtggtgtgtgtgaggtctgtgtgaggtctgtgtgtgtggtatgtgtgaggtctgtgggtggtgtgaggtctgtgtgtgtggtgtgtgtgaggtctgtgtgtggtgtgtgaggtctgtgtgtgtgagatctgtatgtgtgaggtctgtgtgtgtggtgtgtggtgtgtgtgtgtggtgtgagatctgtgtgtgtgtgaggtttgtgtgtgtggtgtgtgtgaggtctgtgtgtggtgtgtgaggtttgtgtgtgtgtggtgtgtgtgaggtctgtgtgtggtgtgtgaggtctgtgtgtgtgtgtgagatctgtatgtgtgaggtctgtgtctgtgtgtggtgtgtgaggtttgtgtgtgtgtgtggtgtgagatctgtatgtgtgaggtctgtgtctgtgtgtggtgtgtgaggtttgtctgtgtgtgtgtggtgtgagatctgtgtgtgtgtgaggtctgtgtgtgtgtggtctgtgtgtggtgtgtgtgtgaggtctgtatgtgtgtgaggtctgtgtgtggtgtgtgagatctgtatgtgtgaggtctgtgtctgtgtgtcgtgtgtgaggtctgtgtgtggtgtgagagctgtgtgtgtgtgaggtctgtgtgtggtgtgtgaggtttgtatgtgtgtggtgtgtgtgaggtctgtgtgtggtgtgtgaagtttgtgtgtgtgtgtggtatgtgtgaggtctgtgtgtggtgtgtgaggtttgtgtgtgtgtgtggtgtgagatctgtgtatgtgtgaggtctgtgtgtgctgtgtgaggtttgtgtgtgtgtggtgtgtgaggtctgtgtgtgtgtggtgtgtgcagtgtgagtgcgtgtatgtgtgtggtgacatctgtgtgtgtgtggtgtgtgaggtccgtgtgtgtgtggtgtgtgtgaggtctgtgtgtggtatgtgaggtttgtgtgtggtgtgagatctgtgtgtatgaggtctgtgtggtgtgtgaggtttgtgtgtgaggtctgcgtgtgtgctgtgtgcagtgtgagtgcgtgtatgtctgtgtggtggcgtctgtgtgtgtgtggtgtgtgaggtccgtgtgtgtgtggtgtgaggtctgtgtgtgtggcgtgtgtgagtgggtgtatgtgtgtgtctgtgtgggtgttgtatgtgtgtgtcgtgtgtgtttgggggctgaggtcccatgtagacagaagtcagtgccaaagccacaaactcctcccgaccccccgcctgccatttgaacacttgtcccgacatgccctgtcctggggcgccaggacccactcactcatttactccttgctggggctgccttggctccccgagaggtgggcgggaggcgagcatgaggagaga

SEQ ID NO: 3104 - DNA, 30226 bp, Homo sapiens
ccgccgcgccggccgctggagcgagcgccacccgggccacctggctgcggcgaagcggcgagactcggtggccaccgcgggactccgaggagctgcggccgctgagcgcatcggagggcgggcgcgccgaggcgccgggtgggagcggaggtgcggatagggactctttaccggaagtcggaggggtcagacggaagcagaaccatcttcacttctgcggggacctagtttgcccccacctgatgcaacccagaaaatggactgactgcgagtgccttggggcggagaatgtgtcttgctacgtgtaaagcacctagaaccctgccagattcaggggacacagcatcctgccgttttcctgccgtcccccgcccgccacacagtaggcgctccagtggctcggggcatctaccaggcaggccgcgctgtcctgccctgccggggctggagtggagcaaccctccggggccacccacatctgggtaccttttccccactttttccaccccagccgcgcacagtcaccagaaaactcttttagaaatacaaacacttggcctggcgcggtggctcacacctgtaatcccagcactctgggaggccgaggcggatggatcacctgaggtcaggagttcaagaccagcgtggccaacatggtgaaaccccatcgctactaaaaatacgaaaaaattagctgggcgtggtggtgggcatctgtgatctcagctacgcaggatgctgaggcaggagaatcgcttgaacccaggaggcggaggttacagtgaccaaagagggcaccactgcactccagcctgggcaacaagagcgaaactttatctaaaaaaaataaaaataaaaaaatacaatcacttttctctgattggaatcaaggtcccagaatacaatcttaagaacaagttttggccagtgtggtggctcacgcctgtaatcccagcactttgggaggcagtggccggtggatcacctgaggtcaggagttcgagaccagcctggccaatttttagtagagcccatctctactaaaaatacaaaaattagctgggtgtggtgatgcgcacctgtagtcccagctacttgggaggctgaggcaggagaatggtgtgaacctgggaggcggtgcttgcagtgagcggagatcacaccactgcactccagcctgggcgacagagcgagactccgtctcaaaaaaaaaatagtaagtttcaggtcgatggaagttgaataagaaggcctaggctggatacagtggcctacacctataatcccagcactttggaaggccaaggcaggcagatcctttgaaccaaggagtaggagaccagcctgggcaacatagtgagaccctcctctccataaaaaatttttcaaaattaaaaaaaaagaaggcctgaagctgacatagctgagaaagtttgttttaactcactaccattgaataaaaacttaatagttttatcaagatataatttacatactatgaaattcacctattttgtgtacaatttaatgattctcagtaaatttacacagtaaatttgcacaaccattgccactaatttcagaacatttccattaccccaaaaagatccttcacgatggtgggcagtttggttcccatccttagccccaggcaaccactcatctacattttctctctatggatttgtccagatttttcacataagtagaatcttacagcatgcagccttttgtgtctgccttctttcatttgtcataatgtttttgaggtttatctaaggttgtggcatgtagcagtatttcattccttattattgctatgtcatattccatgtatggacataccacattttgtgtctactttccaattgtggatgtttagattgtgtcaactttttgagtattatgaaaatgctgctggggctgagattggtggctcactcctgtaatcccaacactttaggataccgagatgggaggatcacttgaataccccggagtttgaaaccagcctgggcaacatagagagaccctgtctctatgaaaaactttaaaaataaaaaattagctggttggctgggcgtggtggctcatgcctataatcccagcactttgggaggccgaggtgggtggatcacctgagatcaggagttcgagaccagcctggcctacatggtgaaatcccgtctctactaaaaatacaaaaaattagccaggcgtggtggcgggcacctgtaatctcagctacttgggaggctgaggcaggagaattgcttgaacccaggaggcggaggttacagtgagccgagattgcaccattgcactgaagcctgggtgacacagcaatactctgtctccaaaaaaaaaaaaaaaaaaaaattagctggtcatggtgacacgcacctatagtcccagctactagggaggctgaagcagaaggaccgcttgagcccaggagatcgaggttgctgtgagctacgaatgcgccactgcactctagcctgggcaacagaccaagaccctgtctcgttcagttaatagagttgctaaaacacacacacacacacacaaagaagaagaaagaaaaataataatgctgctatgaacatttgtgaacatatatcttcatgtggatatatgttttcatttatcttgggttggttcctacaaacgaaattgttgggtgatgtggtaagtttatttagttatttttattttatttatttatttatggaaactaccttttctctggacttcagaaggcttaagctttatatgaaaatatcagagtaggctgggcacggtggctcatgcctgtaatcccagcactttgggagactgaggtgggctgatcacctgaggtcaagagatcgagaccatccttgccaacatggtgaaaccctgtctctattaaaaatacaaaaattagccaggcatggtggctcacacctgtaatcccagcactttgggaggccaaggcgggcagatcacgaggtcaggagatcaaggccatcctggctaacacagtgaaaccccgtctctactaaaaatacaaaaaaataggtgggtgtggtggcgggcgcctgtagtcccagctacttgggaggctgaggcaggagaatggcatgaactcgggaggcggagcttgcagtgaggtgagatggcgccactgcactccagcctgggcaacagagcgagactctgtctcaaaaaaaagaaaatacaaaaattagctgggcatggtggtgtgcgcctgtagtcctaactactcgggaggctgaggcaggagaatcgcttgaacctggcaggcagaggttgcagtgagtcaagatcatgccactgcactccagcctggtgacagagtgacactccatctcaaaaaaataatatatatatatatatatattagagtaatgcaccttaaaagaagtggtgtgtcaggcagcctctatggcggtcccaaatgattcttgcctcctggtgttcagacactgtgaaatcctccccacctgaattttaaaacaatacttttttttttttttttcgagacagggtcttactctgccaaccaggctggagtacagttccacagtctggctcactgcagcgtctgcctcccaggcggtcccgagcaatcctcccatctcagccttcagagtatcagggactacaggcgtgcaccaccacacccagctaatttttgttagttttgggggatttgtttgtttgtttttaggcagagtcttgctgtcttgcccaggctggaatgcagtggcacaatctcagttcactgtaacctccacctcctgggttcaagtgatcctccccgctcagccttccatgtagctgggattataggcactcaccaccatgtccagctaatttttgtatttttagtagagacgacattttttcgtgttggccagaactcctcacctcaagtgatctgcctgccttggcctcccaaagtgctgggattacaggtgtgagccaccacaccacccaaccaacaagtgaacattttgaatgctctcctttcccccaaatgattttcagacacccctttaaacaaaagcagagagtcagagagttgtctgcaaaggcagtgaacagtactctcctgaaagagttctgatattgagaagtgttgctaaaatttcaacttcaaaaatagctatggtcatttcagccactatttcagaaatgaaaaaatatctcaagtgagagagcttggagacagacctgcagacttgagaatctagtccagtagattctatacttgctttctgattttcattgacccttcagcaagccacagggcccttttattagcctgttaataattttcttttcttttcttttcttttttgttttttttgagacagattcttgctctgttgcccaggctagagtgcagtggtgtgatctcagctcactgaaacctccacctcctgaattcaagtgattcttctgcctcagcctcccgagtagctgggattacaggcgcctgccactgtgcatggctaatttttgtatttttagtagaggtggggtttcgccatgttggccagggtggtctcaaactcctgacctcatgatctgcccgccccggcctcccaaagtgctgggattacaggtgtgagccactgcgcccagcttttttttttttttttttttttttggagacagagtcttgctctgtcacccaggctagagtgcagtggcacaatctcagctcactgcaacttccgcctcctgggttcaagcgattcttctgcctcagcctcctaagtagctggcactacaggtgtgcgccaccacacctggccaatttttttatttcctttttttttttttttttttttttgagacagagtctcgctctgtcacccaggctggagtgcagtggcgcaatctcggctcactgccagctccgcctcctgggttcacgccattctcctgcctcagcctcccaagtagctaggactgcaggtgcctgccaccaggcctggctaattttttgtatttttagtagagacggggtttcaccgtgttagccaggatggtctcgatctcctgacctcgtgatccgcccgcctcggcctcccaaagtgctgggattacagacgtgagccaccgcgcctggcaatttttttatttctaatagagacacggttttgccatgttggccaggctggtctcgaactcctgacctcaggtgatccacgcacctcagcctcccaaaatgctgggattacaggcatgagccaccatgcccggctgagcctgttaattttcatcacttcaatgattaatcaagtctcgggatttggggatgacaaactgatggagctatgtggagcagaactgtgaagagtgatttgcttgcactcactacagaagcacatatcacgtgatccagtattcctggcaattcacatttctgcaatcatgccttttcatttctcttcccttgatcttgcttaatgtatgatggtatattattcactaaatactcttgatttcactttcaaaagcatgaaaattaattcaaatcagaactaacttgcatccccccaaattcatcctcttcaagtttttgtatagaccaatcctcatttaaaaaaaaaaaaaaaagctgatgtaatatcaaaaataggaccatggctaattaaaccaatgtttttttttctaaccacagttactcagaattcgtagaggctcatctatttgtagacactccaggaatcccaaaagagtaaatgcaataaaaaacattattttttaaaaaatgaaaagtgtttgggggagagggcttccaggaagggattatttatataccttgtatgcaaagtaacaactttcccatagctttgaaaaaagtggagggtggggagctgcaaaattgtagagaacacagcaacattatttaaagaacttttaaatgagccattccctccaaacgagcacactcctggttgttaagttgctcgttttgttttaccttgtgggatagaataatgatgcagtaacattattcacaaggcaaagctggttgccagctgaaatagacacagaagaaagaattctttatttttcattggaaatgcttgggctctgcagagccagaaatttaaagaaactcagccttttgtttttcctctttctcccttttttgtttttattcaccctctttttgggggtgagtttggtgggcagcctgttgtttcagggccacagatttatggaaagccaaagatctgaattatgcatgatttggagaatgcaggaagggatttaaaatggatgtgtgcagaccagtgacagctgaactggccattagcatgggatcttgttagtttgctacgggatatggtgagtcctacaatggaaccccagaagagtcagactataatgaatactgacattgctgaccttcgatctcagaatagggacttggatacttgttccccagtagaatcacatatgggcttaaccatacacaccgttttgcttaagccctcatattatcaaaatatttattttccacaaggtaaggcagggctagagaacaataatgaaaataataattgtagacctttacatggcatttactatgtgccaaccatgttctaagtgctacctgcacaataacttgctcattgaatccttgtaacaacctgctgcttctcaatgccaaggacagttttgccccagctccatcgccccctcaggagacatttggcaatgtctagacacatttctgtttgttacgattggaggggaatgcccctggcatcttgtgagtacagaccaggtatgctgtttgtgatattgttaaatataggtatttggtgtttgttctggttttctggcacgcaactcctaaaattctcaaaatctccaaagtgatggacagcctcagtatgagggctggacataggaaagacaataatgacagggttgggactcttcagccccatcccccagcctctggggagggaaaggaggctgaaggttaacttgatcaccagtggccaatgatttaatcaatcatgccaatagaatgaagcttccataaaaatcaagaagagctgggttatgagagcttttatttattattattatttttttttttgagatggaatcttgctctgtcacacagactgggttgcagtggcgtgatctcagccctgtgcaacccctgcctccctgggttcaagcgattttcatgcctcagcctgctgagtactgggattacaggcatgcgccaccacgcccggctaatttttgtatttttagtagagacgggatttcaccatgttggcgaggctgatctcgaacccctggcctcaggtgatcaaaccgcctcggcctcccaaaatgctggggttacgggcatgagccactgcacctggcctatttttttttttctttgagtcggagtctcgctgtgttgcccaggctggagtgcagtggcgcgatgtcagctcactgcaagttccgcctcccaggttcacgctattctcctgcctcagcttcccaactagctgggactacaggcgcccgccaccatgcctggctaattttttttttttttttttgtatttttagtagagacgggttttcaccgtgttagccaggatggtcttgatctcctgaccttgtgatccgcccgctgagctagagcaatccttctgtctaagctgtccaaagtgctgggaatacaggcatgagccaccatacccatccctgagagcttctagatagctgaagaggtggaggttcgtggagtgtgacttgccccttcccacataccttgccctgcacctctcttccatctggctgtatcttttgtaataacagaagtgtttccctcagttctgtgacccaccctagcaaagtaatcaaacctgaggaggggatcgtgggaaccccgatctcttgctggggccctgatttacagcctgtttttgtgactggcatctgaagtcgggggtgtgatccgatgctatctccaggtagatagtgccagaattgaattgaattagaggtgcccagatgcacactccagaattgcttgcttgatatgtggtagggaaaagcccccacacatctagtgtcaaacgcatttttttttttttttgaggcagagtctccctctgtcacccaagctggagtgcagtggcgcaatctcggctcactgcaacctccacctcctgggttcaagcagttctcctgcctcagcctcctgagtagctgggattacaggcacgcaccaccatgcccagctaatttttgtatttttttcgaagagacagagtttcaccatgttggccaggctggtcttgaactcctggcctcaggtgatccgtctgccttggcctcccaaagtgctgggattacaggcctgagccactgcgcctggctggtgtcagaagcctttttttttttttttttttttttttttgaggtggagtcttgctctgttgcgcagtctagggtacaatgatgtgatctcggctcactgcaaactccgcctcctgggttcaagcaattctccagcctcagcttcccgagtagctgggattacaggcacccgccatcatgcccaactaattattgtatttttagtagagacggggtttcaccatgttggccaggctggtcttgaactcctgacctcaggtgatctacccacctcagcctcccaaagtgctgggattacaggcgtgagccaccgccccagcccagaagcgttctatgttgtattgtgagagtataggagaatccaaatttgtttttttctatgtccttatactgttgaacaccctataatgcacaggacaatctcccagcacaaagaattaatccagcccaaaatgacgatggtgctgaggttaagaaaccctgtagtaaccctgagaagtagataggattattattccccttttacagatggggagactagggcatacagagagtgagtcactttgtctaagggcacatttattaaatggtaaaggtgcaattcgaacccagaaagtctgtttccaacatccgggttctaaactgctttcctatatggaatagtaaaggcctggccgggtgtggtggctcacgcctgtaatcctagcactttgggagtccgaggcgggaggattgcctgaactgaggagttcgagaccagcctgggcaacatggtgaaaccctatctctactaaaatacaaaaaaaaaaattaaatagctgggcatggcgttgtgcgcctatagtcccagctacttgggaggctaaggcaggagaactgcttgaacccaggaggtggaggttgcagtgagccaagatcgtgccactgtgctccagcctggcgacagagcaagactccatctcaaaaaaaaaaaaaaaaaaaaaaaaagtaaaggcctaaggtggctctcttgaaaaaaatcagcttctctcctttgtctcatcaaatacagggctctagtgaactggcaccactgatgactgcctgtttctttattcaaggaatagtgattattatagaagtcaccacctgcaagggacaaattggcaatgccttaaaaactgacagtgcacgcatgttggttcctataggaaaaaaattaattaaaaacaaaaacaaaaacaaaaaaaccaggcacagtggctcatgcctgcaatccaagcactttgggaagccgaggcgtgtggatcacctgaggtcaggagtttgaggccagcccggccgacatggtgaaaccccgtctctactaaaaatacaaaaaaaaaaattagctgggcgtggtggcgggtgcttgtaatcccagctacttgggaggctgaggcacgagaattgcttgaacccaggaagccaaggttgcagtgagctgagatcgtgccactacactgcagcctgggtgacaaagtgaggctctctcaaaaatataataaaaattaaaaaataggccaggcgcagaggcccacgcctgtaatcctagcactttgggaggccgaggcgggtggatcacctgaggtcaggagtttgagaccagcctgaccaacatgtagaaacgctatctctactgaaaatacaaaattagccaggctggtgcacatccctgtaattccagctactcgggaggctgagcaaagagaatcgcttgaacccaggaggtagaggtggaggtgagccaagatcatgcgattgtactccagcctgggcaacaagagtgaaactccatctaaaaaaatacataaaaataaagtaaatgaaaaagaattagctgggcgtggcggggcatgcctgtggtcccagctactcaggaggctgaggtgggaggatcacttgggcctgggaggtcaaggctgcatgcagtgaaccatgattgtgccactgcactccagcctgaacaacaaagcgagatcatgtctcaaaacaaaaaaagaggctgggcatcatggctcacgcctgtaatcccagcactttgggaggccgaggcgggcagatcatttgaggtcgggagtttgagactagcctggccaacatggtggtgaaaccgtgtctctattaaaaatacaaaaattagagccgggcatggtggctcacacctgtaatcccagcactttgggaggccaaggtgggcggatcacaaggtcaggagttcgacaccagcctggccaatatggtgaaaccccatctctactaaaaatataaaaaattagccgagtgtggtggtgtgcacctgtagtccaagctaattggaaggctgaggaaggagaatcacttgaacccaggaggcagagtttacagtgagccaagatcatgccactgcactccagcctggatgacagagtgagactctatcccaaaaaaacaaaaaacaggctgggcgcagtggctcacacctgtaatcccagcactttgggaggccgaggcgggcagatcacgaggtcaggagatcgagaccatcctggtaacacggtgaaacccccgtctctactaaaaatagaaaaaattagccgggcgtgttggcaggcacctgtagtcccagctactcgtagtcctagctactcaggaggctgaggcaagagaatggcgtgaacccaggaggcagagcttgcagtgagccgagattgcgccactgcactctagactgggcgacacagccagactctgtctcaaaaaacaaacaaacaaacaaacaaaaattagcagggcttgatggtaggtgcctataatcctagctactcaggaggctgaggcaagacaattgcttcaacccagggggtggagcttagtgagctgagatcgggccactgcactccagcctgggcgacagggagagacttcgtctcaaaaaataaaaagagctgggggcatgttggcccatgcctataatcccagcactttgggagagtgaggcaggcagatcacgaggctgggtgatcgagaccaccctggctaacacagtgaaacccggtctctactaaaaattcaaaaaaaattagccaggtatggtggcctgcacctgcagtcccagctactcgggaggctgagacaggagcgacaggagaattacttgaacccaggaggtggcggttgtagtgagccaagttcgcaccactgcacttcagcctgggtgacagagcaagactccatctcaaaaaaaaaaagaaaagaaaagaaaagaaaagaaaaaatatcttattgtctacaccactttacttttgtgttattcaaacagaaactaccattttcaaactctaggcaggaaatcctaagtcacacagaaatagaaaggaaaggccattttcaggaagatttttttgttttgttttgtttttatttgtttgttttgagacacagtctagctctgtcgcccaggctggagtgcaatggcatgaactcggctcactacaacctctgcctcccgggttcaagcgattctcctgcctcagcctcccgagtagctgggattacaagcgcacaccaccacgcccagctaatttttgcatttttagtagagatggggtttcactgtgttggccaggctggtcttgaactcctgacctcgtgatccgcccgcctcagcctcccaaagtgctgggattacaagtgtgagccaccacgcccagcaggaaatttaatcctgcatgcttttctgccacatttggatttttttctgctgaaatgtcatattggccaaatataggagcagcagaagcaggcagagccctctgctcctgttgtcacctacatggagtcaatctgagcatagtgggtacttaataatttgatctgagactaattctcaatttttgcaagtttgcttaattgggcctgcaatggcacatgcttcctatgcacctgctaatggctaccagccatgggccaggacgatggggccaacatccaacgctacccacaatgacccaagcaattccaggcagttaggggaccttctttacctaagtgttgccatcgtatgtgatttcagtggagaagtttccttttttttttttttttttttttgagacagggattagctctgtcatccaggcttgagtgcaatggtgtgatctcagctgactgtaaccctctcctcccagtgatccgcccacctcagcctcccaagcagatacatgcgcacagggacagggatcacagttgcacaccaccatgccttgctaatttttgtatttttttgtagagacgtggtctcaccctgttgtccaggctggtctcaaactcctgggtcaaagtgatctatctgcctcggcctcccaaagtgctgggattacaggtgtgagccactgtgcctggcccagaattttcattctcccactggatgaagccatttttttttttttttttttttgagacggagtctcgctctgttgcccagggtggagtgcagtggcgcgatctcggctcactgcaagctccgcctaccgggctcacgccattctcctgcctcagcctctggagtagctgggactacaggcgcccaccaccacgtccggagagttgttttttttttttgtatttttagtggagatggggtttcaccgtgttagccaggatggtctcgatctcctgaccttgtgatccacccgcctcggcctcccaaagtgctgggcttacaggcatgagccaccgctcccggccgaagccaatttttattgcagttagttaatagcttgtgatgtcgccttgcaggcattgggaaaagcatcattctaagttcatcagaagacactggaaccaagaaaccacaggagccttcaggggatctactcttggtcactagccttctgcaggcttgaaagaggttagaactgaggctctctgtgagttggtctcactcttctttgatcagggttcttgtttctttccatgtacatgtgactaatctctatcctcagagggtcaacacaggacaaatcttgatgcagcaataagcaatttatagtctcctggtgtcctgaaaatgactcaagaaatcccgttactatgatttctaatgatcttgacatgcgaatttatttttcagttatgtaaccctttttaaaaacttcctgaatatttgtgtattcgttagcttctgctgtgtaacaaaccactcacccccaacatagtggctgaaaacaacagatgttatttctttcttaagattctgagagttggctgggcacggtagctcacgcctgtaatcccagcactttgggaggccgaggcaggcagatcacctgaggtcaggagttcaagaccaacctgaccaacatggagaaaccccatctctactaaaaatacaaaaacattcattctgtcacccaggcttaagtgcagtgacaaatcccatctctactaaaaatacaaaaaagccaggcatggtggtgaacacctgtaatctcagctactcaggaggctgaggtgggagaatcgcttgaacctgggaggtggaggttgtggtgagccgagatcgcaccattgcactccagcttgggcaacaagagcaaatctccatctcaaaaaaataaaaattttctgagagttggctggacacttctcttctgagctagttcaactggggttggatggtctaggatgttctcactgacatgtctggcaactggctgttggtcacctgtggatgataggggcagcatagccacaggtctgtagtcatctagcaggctagcctggacatattcacatggccgtacatactaggttcccaagaacagcaagagaaggcaggccccactgcacaggcactttttttttttggagacggagtttcgctcttgtcacccagactggagtacaatgatgcgacctcggctcactgcaacctccgcctcccaggttcaagcaattcttctgcctcagcctcttcagtagctgggattacaggaatctgccaccatgcccagctaatttttgtatttttagtagggacagggtttcggcatgttagccaggctggtctcgaactcctgacctcaggtgatcctctcacctcagcctccgaaagtgctggtattataggtataagcgattgcacccagccttttttctgaaacaggatcttgctctggcacccaggctagagtacaatggcatgatcacagtcactgcagccttcacccccgggctcaagcaatcctcccacctcagcctccccagtagctgagaccacaggcacgcactaccaggcctggctaatttttgtatttgttgtagagccagggtctccctgtgttacccaggctggtcttgaactctgcacaggcacttttcaggtcttttcttgtgtcacattttctaatgtcacattagccaaagcaagacatgtggccaaacacaaaatttgaggggtagggaaatatacagccaaataactttgcaaaggatgggcatgtagggaggaaccaattggtggcttttttgtgtaatcatcacaattggaggcgagatatttgaatatcaatacaaaaacttttattctttctttatttactttttgagacggagtctcgctctgtcgcccaggctggagtgcagtgtcgtgatcttggctcactgcaagctccgcctcccgggttcatgccattctcctgcctcagcctcccaagtagctgagactacaggcgcccgccaccacgcccagctaatttttttgtatttttagtagagatggggtttcaccgtgttagccaggatggtctggatctcctgacctcatgatccgcccacctcgcctcccaaaggctgggattacaggcgtaagccaccacgcctggccgaaaacttgttcttttaacaagatgccttccggaatgcagaacaaagctgagaagccttcttttaacaacctgatgatttccaaactctagattcttggtcatctcaccctggactattagaaccatcctgatgaaaatagcaccaggtatagtttctgcacagctgcttgtccagaaatgtgtgaccttgggaaggtcatcctcattgttcttcatcgaaaacaaggggttatactagatcttctcaaattgcaaggaacctttcagaggtcatgtttcaggaaaatgaaagaacaggccatatgtggaatggcccaatcgctgcctgtagagataagacagccagagaggctgaaattttcagctttcatccagattttggcatgggctgtgagtctatgatttttcaacttttccttctcgtaggcttgtttaaaccctttgatctcattttattgtgcaatattattacaccactttacaaatagaccatttattccaggctgaccgtaaaagtcattcccggctgggtgcagtggctcaagcctgtaatcccaatactttgggagttcgaggcaggcagatcacctaaagtcaggagttcgacaccagactgaccaacatgtagaaaccccgcgtctactaaaaataggaaaattaggacctggcacagtggctcacaccagtaatcccagcactttcggaggccaagacgggcggatcacctgaggtcaggagttcatcaccagcctggccaacatggtgaaaccccgtctctactaaaaatacaaaaattagccaggagtggtggcacatgcctgtaatcacacctactcgggagcatgaggcaggagatctgctggaacccaggaggcggaggttgtagtgagccgagatcgtgccactgcactccagcctgggagacagagtgagactccgttaaaaaaaaaaaaaataggccgggcgtggtggctcacgcctgtaatcccagcactttgggaggccgaggcaggcagatcatgaggtcaggagattgagaccatctggctaacattagtgaaaccccatctctactaaaactacaaaaaaattagccggctgtggtggcgggcacctgtagtcccagctactcgggaggctgaggcaagagaatggcgggaaccctggaggcagagcttgcagtgagccgagatcatgccactgcactccagcctgggagtgcagacagagcgagactccatctcaaaaataataataataacaataataataaaagtacaaaaattagccagcgtggtggcaggcgcctgtaatctgagctactatggaggctaaggcaggagaattgcttgaactcaggaggccaagattgcagtgagtcaagacggcaccaccgcactccagcctgagcaacagagcgagactccatcacaaaaaaaaaaaaaaaagttatttctgtcccctatggcttgaagggcactcatactcatagttagcagaatcttcaataatactagagcttaaatgggagagagtcatacagtagatgcttgaaaatgttcaaataaatgaaggccaggaggctggatgcagtgactcacacctgtaatcctagcactttgggaggccaaagtgggaggatctcttgagcccaagagtttgagaccagccctggcaatatagtgagaccaagtctctataaaaaaaaaaaaaaaaattttttttttttttgagacagaggcttgctctgttgctcaggctggagtgcagtatcatgatctccgctcctgcaacctccgcctcccgggctcaagcgattatcttgcctcagcctcctgagtagctgggattacaggcacctgccaccacgcccagctaatttttgcatttttttagtagagtcagggtttcacaatgttggccaggctggtcttgaactcctgacctcacgtgatcctcctgcctcagcctccgaaagtgctgggattacagtcgtgagccaccgcacctggcctcaaaaatttttttaaattagccgggcatggtggcacgcatctgtagtcgcagctacttcagaggttgaagtgggaggattccttgagcctgggaggttgaggttgcagtgagccatgatcgcagcactgcactccagcctgagcaacagagcaacacccggactcaaagaaaaaaaaagacaagaaaagaaagaagaaaggcaactgaataaagagaatctacttacagtatttccctaagcatgcccaattggactttttttttttttttttgagatggagtcttactttgtcacccaggctagagtgcagtggtgcaatcttggctcactgcaacctctgcctctgggttcaggtgattctcctgcctcagcctcccaagtagctgggactataggctcacgccaccatgcccggctaatttttgtatttttagtagacacagggtttcaccatgttggtcaggctggtctcgaactcctgacttcgtgattcacctgcctcagcctcctaaagtgctgggattacaggcgtgaaccactgtgtctggcccaactggattgcatcctccacctcccgagttcaagcagttctctgcctcagcctcccgagtagctgggattacaggcgcccaccaccacacccagctatttttttttttatttttatttttagtagagacagggtttcaccatcatggccaggctgatcttgaactcccgatctcgtgatccacctgccttggcctcccaaagtgctgggattacaggcgtgagccaccacgcccagcctccatagactattttttaaacaattttactcaggtataagtcacaccctatacaattcacccatttaaagtatatagttcagtgagtcttttagtatattcacacagctttgcaaccatcaccatagtataattttagaacatttttgccggtcatggtagctcacacctgtaatctcagtgctttgagaggctaaggtaggaggattgcttgaggccaggagttcaagatcagcctgggcaatgtagcgagaccctgtctccacaaaaaataatcagaaaaattagccaggcattggggtgcatgcctgtagtcccagctgctaagaaagctgaggcaggaggatcacttgaggccagaagttggagggtagagtgagttaggatggtgccactgcacggcagcctgggtgacagaacaaaactcttttttttttttttttgagatggagtttcgcttttgttgcccaagctggagtgcaatggtgtgatcttggatcactgcaacctctgcctcctgtgttcaagcaattctcctgcctcagcctcccgagtagctgggattacaggcacgcaccaccatgtccagctaattttttgtatttttagtagaaactgggtttcaccatgttagcctagctggtctcgaacttctgacctcaggtgatcagccccacctggcctcccaaagtgctgtgattacaggcgtgagcaaccgcaccaagcctttttattttttttttttttgtgggtacctagaaggtgtatatatttacggggtacatgagatgttttgttttgctttgagatggagtcttgctgtgttgcccaggctggagtgcagtggcgcaatcttacctcactgcaacctccacctcctgggttcaagcaattctcctgcctcagcctcccgagtagctgggattacaggtgtgcaccaccacgtccggctaatttttgtatttttagtagaggcagggtttcaccatgttggccaggctagtctcaaactcctgacctcaaatgatccacccaccttggcctcccaaagtgctgggattacaggcgtgggccaccgagcctggacacgtgaaatgttttgatacagacatgtcatatgtaataataacatcatggaggcaaggagctgttttgttttattttgttttgtttgagacaggatctctctctgtcacccaggctggatttcagtggtgcgatcttggctcactgcagcctccacctcccagattcaagggatccttctacctcagccttccaagtatctgggactacagccaggtgccaccactcccagttaattaattaattaattaattaatttgagacacagtcttgcactgtcacccaggctgtagttcagtggcgtgatcttggctcactgcagactctgcctcccttgttcaagtgattttggtgcctcagcctcccgagtagctgggagtgcaatggcgtgatcttggatcactgcaacctctgcctcctgtgtgcaagcaattctcctgcctcacacaagcatgtgccaccacacccagcgaatttttttttttttttttttttttggtatttttagtagaggcggggttttgctatgttggccaggctggtctcaaactcctgagatcaagtgatccacccgcctgggcctcccaaagtgctgggattacaagcgtgagccaccatgcccagccttcccattgagattttttttttttaattttaaatttaaattttttttttagagatggggacctgccatgtttcccaggctggacttgaacttctggcctcaagcaatcctccatctcagcctcccaacgtgtcgggattacaggcttgaaccaccacacccagcccccactaagatttctaatggactccctgaatttaggacatagtcagagctccagtctcctcttcccagtttccccatctcaggacactctacctccagtcttccagttgctcaataaaacaacaacctagacctagacttgtccttggctcctctttttctcattccctctcttcaatgcatcagcaaatatgattcgcttggcattctgcaatttctcccacttctgtcactaacacccttgtccaaccaccatcatcctccccactgagggttgctggagccttctaacatgtttccctgtttccagtcttagccccatcaagtccattttccaaacagcagtcagagcaatccttttaaagtgccagtcataggacgtgcctccactgctaagaacctctgaatgcctcccatgtcagagtaaatgccacctgtcttttttttttttttttttttttttttttagatagagtcttactccgttgcccaggctagagtgcaatggcatgatcttggctctactaacccctcctggattcaagtgattctcttgcctcagcctcccgagtagctgggattacaggcgtgtgccaccacacctggctaatttttatatttttagtagagacggggatttaccatattggccaggctggtcttgaactcctgacctccggtgatgcgctcgcctcagctcccaaaatgctgggattatacctgtgagccaccacacccggccaatgccacctgtcttttttttttttttttttgagactgagtcttgctttgtggcccaggctggagtgcggtggtgcaatctcagctcactgcaacctccccatcccaggttcaagcgattctcctgcctcaacctcctgagtagctgagactacaggcgtgtgccaccacacctggctaatttgttgtatttttagtagagatggggtttcaccgtattagctcaggatggtcttgaactcctgagcccaagtgatctgcccgcctcagcctcccaaggtgctgggattacaggcgtaagccaccatgcccggccaatgccacctgtcttaacgtgacttagaaggtcctagatatccaatccttcactactttctcagctttcacctccttccactctgcaacttgtgcagagtaggccctttgcacttgccactccctctgcccagaatgccctttccccaggtattcacatggctcagtccttcattcaggtccttggccttattttattttattgttgagacagggtctccctctgtcgccaggctggagtgcagtggtgcgatctcgactcactgcaacctccacctcccgggttcaaacaactcttgtgcttcagcctcccgagtagcagggactacaggcgcatgccaccatgcccagctatttttttttttttcagacagagtctcactctgtcgcacaggctggagtgcagtggcacgatctcggctcactgcaagctccgtctcccaggttcacgccattctcctgcctcagcctcccagcctcctgggactacaggcgcccaccatcatgcccggctaatttttgtatttttagtagagatggggtttcactgtgttagccaggatggtttcgatctcctgacctcatgatctgcccaccttggcctcccagactgctgggattacaggcgtgagccactgcgcctggccacccagctaatttttgtatttttaacacatacgggttttcaccatgttcgccaggctagtcttgaactcctgacctcaagtgatccaccctgctttggcctcccaaagtgctgggattacaggcatgagtcaccttggccttattttattgtatttttttgagatggagtcttgctctgtcacccaggctggagtgcagtggcgtgatctcggctcactgcaacctccacctcttgggttcaagtgattctcgtgcctcagccttctcagtagctgtgactacagtcacccgccaccacgcccagctaattttttatatttttagtagagacagggtttcaccatgttggccaggattgtcttgaactcctgacttcaagtgatctgcccgcctcggcctcccaaagtgctgacattacaggtgtgatccaccgcgcccaggctcttttcttttcttttttttttttgagagagggtctcctgctgtcatccaggctgtactgcagtggcacaatcatggctttctgcagactcaacctccctgggctcaggtgatcctcccacctcagcctcccaagtatccaggactatacctgcacaccaccatgcccggctaatttttttgttttttgtagagatggggtttcaccatgtggcccaggctggtctcaaactcctgagctcaagcgatccagctgccttggcctcccaaaggggtgggattacaggagtatttttttgttttgagatggcgtctctgtcagccaggctggagtacagtggcagaatcttggctccctgcagcctctgtttcccagggtcaagtgatcctcccaccacacatcagaattctctctctgacatctatctaatcatactgccttatgagtctctcatttccctgtcccatatggaatgaagttcaaatttcgtagtgcagtcggcacagtcttaataacctattttcttttttttttttttttttgagacggagtctcgctctgtcacctaggctggagtgcagtggcacgatctcggctcactgcaaactccgccacccgggttcatgccattctcctgcctcagcctcccgagtagctgggactacaggcgcccgccaccatgcccggctaatttttgtatttttagtagagactgggtttcaccgtgttagccaggatcgtctcgatctcctgactttgtgatcctgcctcagcctcccaaagtgctgggattacagcacccggccttaataacctattttcttcccatacctaccctgctacctgtttagtctcctatgctgttataacaccttgccacaaacttagtggattaaaagcacacaaatgtattatcttacagtaattgaggccaaaagtccaaactgagtatgtgtggttgtttttttagagacggggtcttgctctgtcacccaggctggagtacagtggcatgattatagcttactgcagcctcaaactcctgcactcaagcgctcctaccctcctcagcctccagagtagctgggactataagtgcgtgccacctctagctaattgtttgaacatttttagtagagatgagatctcgctctgtcgcccaggctggagtgcagtggtgtgatcacggctcactgcagccttgatttcccaggctcacgtaatcttccctcttcagcctccccagtagctgggacaacaggtgcgggctactgcacccagctaatttttgtgttttttgtagagacagggtttcgctatgatgcctaggctggccttgaactcctggactcaagcaatttgccctcctcggcctctcagagtgctgggattacaggtatgagccactgcacccgggtaatttttaaaaaatttttagtagagacaaggtcttgctgtgtcatccaggctgatctcgaactcctgggctcaaaccatcttcccacctgggatttcacaggtgtcagtcaccctgcccggcccgaaatgagttttaggaagttaaattcaaggtgttggcctggctggtgtcttctcgggggtgcaggggagaagctgatccttgccttccccagcttctagaggctgcctgcaatccttggcccgcgatccacatcacgtcaccttttctccctctacttgcttagtcacaccaccttccactgaacctgttctcccgcctccctcttaggaggaggacatgtgattgcatttagggcccatgtggataatgcagggtaacctccccatcctaagatcattcgtttcatcacacctgcagagtctcttctgctatatgaggattattcacaggctccagggtgaggacatggatatctttggggggccattactctatccaactacatgacacccacactctagccagtgaggaattccttcgcactcttaggatccatcaggcagttccctctgtgcctttgcttctgctgagtgactctatgactctatcctatgcctttctacccgccagtctctttacttcaaagattggctccagggcacttaacttttgtagctttccttcaccctcacagccaggaagaattaagtgcacctggccgggcacagtggctcacgcctgtaatcccagcactttgggaggccgaggcaggcgaatcacctgagatcagaagttcaagaccagcctggccaacatggcaaaactctgtctctaataaaaatacaaaaattagccagtgtggtggcatgcacctgtaatcccagctactcaggaggctgaggcaggagaatcacttgaacctgggaggtggaggttgcagtgagctgagatcaagccactgcactccagcctgggcaacagagtgagactcagtctcaaaaaaaaaaaaaaagaatgaagtgcaccctttcttgtgttcccacagcatggcattttatgatagtgaatcatagtagccagtttgcatgtctgatcacttgttcaaatgtgaagtcattggaaggagagcactatcatcctatatccttgatcatccttttttgtttttttagttgttgttgttgtgttgttttgagacagagtctcactctgtcgcccaggctggagtacaatggtgccatcttggctcactgcaacctccaccttctgggttcaagcgattctcctgcctcagcctcccgagttgctttttttttttttttttttgagacaaagtctcgcttatgtctcccaggctggagtgcgatggtgcgatctcggctcacctctgcctcccgggtttgagggattctcctgcctcagcctcccgagtagctgggattacaggcgcctgccaccacgcccagctaatttttgtatttttagtagagatggggtttcaccatgttggccaggctggtcacgaactcctgacctcaggtgatccacctacctcggcctcccaaagtgccgggattacaggcatgagccaccgcacccggcggttttttttttttgttttttttttgttttttttttgttttttttttgagacagagtcttgctctgttgcccaggctagagtgagtgcagtggtgcgatctcagctcactgcaaccagtgcctcccaggttcaagcaattctcctgcctcagcctcctgagtagctgggagtacagttgcccaccatcatgcctggctaatttttttgtatttttggtagagatggggtttcaccatgttggccaggccggtctcaaactcctgacctcaaatgagccaccgcgtctggcctgatcatcctttttgttgttgttgttgattaaagacggggtctcactctgttgcccaggctggactgtagcagtgtgatcacagttcactgtggcctccaactcctggactcaagcgatcctcccacctcagcctcccaagtaactgggacttcattgtccttttggatgcattttgcaagtgtgaaagcactgtccagtccagctgatgtaataggtgctagcattgttgaggtgaaaatgcccaattgctgccttcaattatgcaacgtcttcttggttttactctgcctggcctttgtttcttcatccattccttcgtttattccagtagccctttgttaaggggcttctctgagtgaggccttgcataaatggaggaaagttgtccccactttcaaaatgcacaccatctagcagggggagaatcatgagctcaggggccatgagggaacaggatgggggccactaacactgcctgcaggagagcaggggtgggaaggctccaacacagagacaccagcagtgctcactgagctatgctaagcactacctcatttaatcctgtctaggcggggcagatactcttattattggcctcattttataggctgaaatcagaaatgtttagaaatgtcaagtaactctccctagatcacagaaccaggcagtagcagggctgggatttgaacccaagaaggccaactccaggaccatgcagataacctctgcaccacactgttctgccttgacagcacacctggtccctggaggtagtgacaccatgctgctcatctgtgacccccccaccccagggtaccttgtacttactaggccctagatgcatatttaagaaaatagtttatttcctggccaggcgcggtggctcacgcctgtaatcccagcgctttgggaggctgaggcggacagatcacctgagatcaggagttcaagatcagcccggccaacatggtgaaacctcttctctactaaaaaatacaaaaattagccggtgtggtggtgcatacctgtagtcccagctacttgggaggctgaggtgggagaatcgtgtaaacctgggaggtggaggttgcagtgagccaagatcgtgccactgcactccagcctgggtgacagagtgagactccgtctcacaaaaaaaaaaaaaaaaaaaattatccagtcgtggtggcacacacctgtaatcccagccactcaggaggctgagacatgagaatcacctcaaccttggaggcagaggttgcagtgagccaagattgcctcactgtactccagcctgggcaacagagcaagaccctgtctcaaaaaataaagcattatttccttagtattaattaatattgatttgagagctcctctcctgtttctgtgtgcctaacactcattgaaccctgtgctaagaatttcacaggcattaagtcatttgagcttcatatcagccctattgagtgagtattattaccccccgcttttttttttttttttttgagactgggtttcactctgtcacccaggcacaatcatagctcactgtaaccttgaactcctgggatcctcccagctcaatctcctgagtagctgaaactacaggtaagggccaccacccctggcttcttcttcttattatttttatagagatggggtctcactatgttgctggtctagaactcctgacctccagtgatcctcctgactcggactcccaaagtgttaggattacaggcgtgaaccaccacacctggccaacctacattttaccgagcgagaaactaaagtacaacaagagtaaggaattggttgcagttcacacaactagaaaagggagaaagaagctgggatttgaacctaagtagcacaagcacttaattacttgtttgtaatgactatgcaaaacagcttgtttagaggcttatttcatagtagagagatgcttttgtagagagggaatatggaaggacatagaaattaggaggtagggctgggtgcagtggctcatgcctataatcccagcactttgggaggccaaggcgggcagatcacttgacctcaggagttcaagaccagcctgaccaacatggtgaaaccttgtctctactaaaaatacaaaaattaaccaggtttggtggcacatgcctgtagtcccagctacttgagaggctgagggaggaaaatcactggaacctgggaggtggaggttgtagtgagccgagattgcaccactgcactccagcctaggtgacagagcaagaatccatctaaaaaaaaaaaaaagaaagaaagaaaaaagaaattaggagataggagatctggggtatgaccctagctctgtagtgtgaccaggtaaactcaacctttgctctgtcatttggtccacaaacactggggatacagtgaagaaagaggcaaaaccctggcttctgagattttatagtttagtgcaaggagggaggaaaaatacatgcatatagatgaacagaactgttgccgtgaaggaaacagtgttgtggcaaagcgtaatagcaaatggctgaaccaaggatgcttcagggaacactcactttatttagcacgagaagggagatttggggaaagcctctcttaagagaaaacatataagttgagacctgaagtaagagaaggcctcagtcattcaaagggttcaggaggtcattcctgcaagaacagtacatgcaaaggtcctgaggttggaaagagcttaaaaagtcaaagccagccgggcgcggtggctcatgcctgtaatcccagccctttgggaggccaaggtgggtggatcatgaggtcaagagattgagaccatcctggccaacatggtaaaaccccatctctactaaaaatacaaaaactagcttggtctgggattacaggtgcccaccaccacccccagctaattttgtatttttagtagggatgggttttctccatgttggccaggctggtctcaaactcccgacctcaggtgatatgcccaccttggcctcccaaagtgctgggattacaggcgtgagccactgtgcccggctggagatagggtttttaacagaagtaaccaagttaaaataaggtcattaggatgtatcctgacccaatatgactggtgtcttaaaagaaggaatagacacatgcacacaggggaacgccatgtgaacatcaaggcagagatctttgctgggtacttttcatgaatttggctgggataactgggcttgcttggctcgcatccatgtggtctctcatccaccagcagactaacctgggcttgttttcctagaggttgggcagggttttgagacagaatagaattttaaaaggcctcttgaggctcagaactatcacagtattgccgggtgcagtggctcacgcctgtaatcccagcacattgggaggccgaggcaggcagatcacttgaggccaggggttcgagaccagcctgggcaacatggtgaaaccctgtctctactaaaaatacaaaaattagctgggtatggtagcacatgcctgtattcccatgaggctgaggcaggagaatcgtttgaacctgggaggcagaggctgcagtaaactgagattgtgccactgcactccagcctgggcgacagagcaggactccatctcaaaaaaaaaaacaaaacaaaaaaaaaccgaaaacaaaaaactgtcacagtgtcacttttgctgaagcaaaagttgtggtctaaagcaagtcacaatactagcccagattcagtggggtggagatgctgcagagtcacattgtggggggaatagtgagccattttttgcacacagtctaccatcgtggccttccctgactatcctacctaacacagccctcccctccatcccaattacactgttttaccttttttcctggcatttaccattatctgaaattttatatattaataattttgtttcttttcaggatggcagtgcctggactcttggccttcattgccatatccccagaacctaggcagtgtctagcacttattaggccctgaaggaatttttgaaagaataaagaaatcatgtaaaaagaatatgcatgctgggcacagtggctcacacctgtaatcccagcactttgggaggccaatgagggcagatcatttgaggtcaggagttggagaccaacatgcccaacatagtgaaacccggtctctactaaaaatacaaaagttagctgtgtgtggtggcatgtgcctgtaatcccagctactcaggaggctgaggcaggagaatcacttgaacctgggagacagaggttgcaatgagctgagattgtgccactgcactccaacctgggtgacagagcgagactctatctcaaaaaaaaaaaaaagaatatgcatagaaaataccagatgattagctgggtgtggtggtgtgtgcctgtagtcccagctacttgggaggctaaggtgaaataattgcttgatcttggaaggttgaggctgcagtaagctgtgatcatgccactgcactccagcctgagtgacagagcaagaccctgtctcaaaacaaacaaacaaaaataccagaagaaacatactctaaagtgttaataacttcctctgttgagataaccatttaattttctttatgtttttctgtttaaaaaatataacattgtattttttaacaggggagatagaaatattctacacatcttgatttgggtagtgattacatgggtatatacaattctcaaaactctttgaactgagc

SEQ ID NO: 3105 - DNA, 5671 bp, Homo sapiens
ttatattatatgcaaatggcttaaatatgtcagctaaaatacaaagattatcagattagataacaagaacatcaaaaccataagaatacaattatatggtatctacaaaaggtacttccaaaatataaggtagagaaaggtctaaaatgaaaataagaaaaaagatgtattattcacactataattgaaagaagctggtatagctatttaataaactaatgctggggcccggcatggtggctctcgcctgtaatcccagcactttgggagctcaaggcgggtggatcacttgagttcaggagttggagaccagcctggctaacatgatgaaacccatctctattaaaaatacaaaaattagccaggtgtggtgatgcatgcttgtagttccagccacttgtctcagaaaaaaaaaacaacaacctaattttggtatattcatacaatggaataccatgcaccataaaaattgattaactgcagttgtacataacaacataaatgaatctcacatatataatgttagatgaaagaaacaggacacacacacacacacacattcagtgtgattctatttacatatttttaaaacaggcaaactaaattatatcacttagaaatgcataaacaaatggaaaattttaagcaagaaactgaattttgcaaaagtcataatggttatttctgattagggaaggaaaagattatgattagaagtgacacactgggggcctctgtagtggtcacagtattagcttcattaaattttgcatatatatgtgtatatatgtgtgtgtgtatatatacacacaattttgcatatatatgtatatatatacacacatatatgtgtacatacacacaattttacatatatgtgtgtgtgtatatatatacacacactcacaaatgccactagtgtggattatagctgaagaaatggataacacactacttattaatgtagaacaaaggccagtgcaccccaccaaactgatacccccaaactcacttatatgaataagtgtatgaaacctatgaggtttccctatgaaacctactccataaaattgctgaaggcaacttttccatcagatgtgtaaaattaatgtagggatacatcaaacattagaaagcaaggaaaacagtaattctccattaacagtccataattataagaaaatctgtgaaaggtggagaaaaatgtaaaataatagtcataaggaaactcagtgagatacaataaaatgcagacgtacaaactcaataaagtcaggaaagcaattcatggtttgaattgatttgaatgagaaattcaacaaagagacagatatcataaaaaaggtatcataaaaaagaaccaaacagaaatcctagagctaaataattcaatgaataaaacaaatgaaattgatagcttcaacaaaagactagatcaagtagaagtaacaatttctaaactgaaagataggtcttttcaaacaactcaggaagtagaagcagcagaagcaggaggaggagaaggaggaaaagaagaagaggaagaagaagaggaggaagaggaggaggaaggaaaagaagaggaagaagaaggaggaggaggagaacaagaagaagaaaaggaagaagaagaggaggaggaagaagaaataatgaagcaaggatatcagatttatagggcactattacaccaagaaatattcatattatgggtgttccagaggcagaagacatgggaaaaggtgagaaaaacacatttaataaaagaatagcagaaaacttcgcaagttttgagagaaaggtggacatccaggtctaggaagctcaaagaattccaaatagattcaacccaaacaggtcctctccaaggtacataacagtccaattgtcaacagtcaaagacaaagaattctaaaatcagcaagtgaaaagtgtcaagtcaaacttaagggaatccccattagactaagagcagatttctctacacaaacattacaggccaagagagaatggggcaagatattgaaagtactgggaaaaaacccctgtcaactaggaatattatactcagcaaagctatctccttcagaaataaaggagaaataaagtcccagacaagcaaaacataagggaattcactatcactaacctgattttataagaaatgctcaagggagccttgcatctgaaagtgaaaagataataatgtgaacccaaaatatctgagacaggtcgcagtcaatttagaaagtttattttgccaaggttaaggatgcacccatgacacagcctcaggtggtcctgaggcttggacatgtgcccaaggtggttggggaatagcttgcttttatgcatttcagggagacatgagacacttcaggacaacttgaagtgggggcttccaggtcagaagtagataagagacaaaaggttgcattcttttaagtcctcgatcagctttccactgaatacacaatttagtctggcttggtgcatctgcattgttacataaagaataagacagaggaaacaatcagatatccatttgtctcaggtcaacctcagagggatgactttgaattctgtcctttgcccacaaggaatttccttgagacaaggaaattccaagtctcaaaacactaaaacatcaaaattatgtcaaatatcttatgtgaccacagtggaataaactagacatcaattacaagaggaacatttaaaactatgcaaatacatgggagttagaaaacatgcttctgaatgaccaatgagtgaaggaataaattaggaagggaatttaaaaattccttgaaacaaatgaaaatagaaacacaacataccaaaacctatggggcacagcaaaagaagtgttaaatggcaaatttatagcaatcaatgcctacatgaagacactagaaatatttcaaataaacagcctgatgatgcacaaagatacaaatctaccaaaagaagaaaaaaccaaatccaaaattagtagaaaaagggaaataatgaagatctgagaagaaataaacaaaattgaagctaaaaaatacaaaagatcaatgaaacaaaaatttggatttttgaaaagataaacaaaatagacaattagctagactaactaaaaaagagagaaaaccaagtaaataaaatcagaaatgaaaaggggatgtcacaatggatatcacagaaatacaaaggataattaaaaactactaaaaataactatatttcaataaatttgaaaacctcaaggaaatgaacaagttcctggacacatacaaactcttgagatttaaccaagatgaaatagaaaacctgaacagagtgataagaagtaatgcaattgggctgggcacggtggctcacgcctgtactcccatcactttgggaggctgagctgagcagatcacaagatcaggagtttgagactagcctggccaacatggtgaaaccctgtctgtactgaaaaaatacaaaaattagccaggcatggtggtgtgcacctgtaatctcagctactcagaaggctgaggcaggagaattacttgaacccaggaggcagaggttgcagtgagccaagattgcactgctgcactccagcctaggtgacagagtaagtcacacacacatacacacacacaaaagaagtaatgagattgaattagtaataaaaagttccccaaaaaagaaaagttcgggactgaatggctttcctattgaattctattgctcctttaaataagaattaataccaatttttctcaagttattccagcaatgttgaagcagtgggaattcttcctaatttattctaggaggtcagcataaccctgataccaaaactaggcaagaacagaacagcaacaaaacaatctacaggccaatatccctgatgaacataggtggaaaagttctcagtgaaacactagcaaactgaatccaaaattacatcagaaagatgatacaccatgctcaggtgaaatttatgccagcaattcaaggatggttcaacatatacaaatcaataaacatcattattacatcaatagaataaaggactaaaaccgtgtcatcatctcaatagatgaagcaaaagcatttgattaaattcgacatcccttcattatcaaaattctcagtaaattaggtacagaaggaaagtacttcaatataataaaagctatgtgtgacataaccacagctaacattttattcaatgggaaaaagccaaaagcttttctcttaagaactggaacaatacaaggatgtccactctcattgcttttgttcaacgtagtactggaggtcttgtgcagtgcaattgccaagagaagaaaataaatggcatccaaattggaaaggaggaagtcgaatttttctttgcagatgacataatcttatatactgaaaaacttaaaggctctaccaagaattcttagaactgataaatgaattcagtagagttgcaagatacataattaatatacgaaaatcagtagcttttgtaggcacatacaatgaactagctgaaacagaaatcaacaaggcaatcccatttacaatagttacaaaacaaataaactgcccagtaataaatgtaaccaagaaggtgaaagcctgctgtaaggaaaactacaaaactttgatgaaaaaaattgaagaggatacaaacaaatagaaagacatccccatgcttataggttggaagaattaatattgtcaaatgacaatactacccaaagcaatctacaggttcaatgtaatccctatgaaaataccaatgacatttttcacagaaatagaaaaaaatcataaatgtatattatactacaagagacttcgaatatctaaagcaattccaaacaaaaagaacaaagttggaggtatcaaataagaagggtgagaatgccccctgggctgaccaaagcccacgggccactgcatcccttgccaagtgcctacatcccactgccattgctgccatcatgcccaagacaaagattgaaggggatgctaaaggagataaagccaaggtgaaagacgaaccactgagaagatccgcgaggttgtctactaaaccttccaaagccagagcccaagccaaaaaaggctctcgagaagaagggagagaaggtacccaatggaaaaagggaaaagctgttgctggcaaggaggggaataaccctgcagaaaatggagatgccaaaacagaccaggcacagaaagctgaaggtgctggagatgccaagtgaagtgtgcacatttttgataactatgtgcctctagaggtgactgtagagtgtgaaatactctttttatcaagttttataaaaatgcagcattttgtttcactttttttaaaagctatgttgttagcacacagaacaattcattgttgtttttgggaaaagaatgtccgtgaagctggattgatgtggagaagacacctttcccttctagttttgagagacttcctcttggctcccaggaggagggatttcctgactttgacacacatggccaccttgtcacaaaagccattaaaaacaaattcatttttatgtcctcttctccctttcaacctttcagcatagacttaactcccttaaacccagacacctgttgggatgtgaccccccagtaattggtcaccagtgtgtcaggc

SEQ ID NO: 3106 - DNA, 2951 bp, Homo sapiens
aatcaaatagtccttcagagtccctcccgtcctccctccctccttcttcctctctctcccccatctctcctcttttaaacagagatgaggtctctatgttgcccaggctggtctcaagctactgagctcaagcactccacccacctctgcctcccaaagtgctgggagtacaagcatgagccactgtactgggcccagacctttttctgaaacttccctttattttttgtgtccttcccatggatgctgggctccatacccacactccaacactgcgcccaacctgagatctctctacacagtaggaactgatgtttccgagaccagctctgagacaccacccgccctggccactggcaccccccgtttctgtcagctcctcccagcttaacacacagtcaccacctcatacatgcacttttccttatatatagaacactgtaaattacacatttaatatattcatatgtttaagtcagtgtgagaacaaataaagcatattttgacctctatgacagggggctggctctgtctcatagtaggcactcaaaaatttttaggaagaaataaggactcctgggcctgaagggatcttagggaatcctatcatcctacagtcctcgggaaacactccctgcaactgcataggctttggagacagacttggattcaaaccagcatcagctcacctagtcaggtgtggtggtgggagcctgtaatctcagctacgctagaggctgaggcaggagaattgattgaaccgaggaggcagaggatgcagtgagctgagactgcgccactgcattccagcctgagcgagactccatctgaatgaatgaatgaatgaatgaatgaatgaatgaactggaaccaaaactagaaccaggtcacccggctcctcatgccatgttcactccatggatcacattgcctcaaaggcaaagtcaaacagcccgttgtgttagcaggcctcccactgacagctctttagagataggcaatttgggccacctgaggaggttatgaggccaggacaggagatccgggcagtagcaggtatgttcattgttaacttgtgaaacacaactaagctgcaaagactacactttggactccacactgaccaatctcacacgagatctctgtttctggtggggactgggcaatgcggcagagtcatgaggcatgagtatgggaagtcagctctcactagctctgaggccttggccgactgctggcaccttctgaaatgtaagatggggccgagcctgtggctcacacttgtcatcctagcactttggggggcagaggtgggaggatcacttgaggccaggagttcaaggctacagcaagttatgatcatgccgctgcactccagcctggtcaacagagcacgaccctgtctcaaaaaaagtcataataagatggcccatagaggctctgctttaaacacaaacacttcaatcacttattacttgtattggcgatggtgatgggaacaacatccaggcagactgtaggataacacctaaggatgttagtgtctctaggagtcatcaattggaacattccttcattcaaactttgaacattagggtggggtagactgagactcagtccaaggaaaacaactgactgccattcagacctggctcagcctaagaaaaaagtacgctttagactgcagtaagaggaattgtggtgagaagggccatgtcactccctccctttttcctccttccccatgaaggtcaatgagaaactgtaaatagcaaggatgagggaaagtgaggaggccagggaggccattgcattcatctgtgttctaaaatatccaactcagccacatgcggtggctcacgcctgcaatctcagcactttgggaggccaaggcaggtggatcacttgaggtcaggagtttgagaccagcctggccaccacagtaaaacctccatctctactaaaaatacaaaaattagctgggcgtggtgacgcatgcctgtagtcccagctattatgcttgggaggctgaggcaggagaatcgcttgaacccaggggtggaggctgcagttgagccaagattgtgccaccgcactccagcctgggtgacagagcaagactctctgtcaaaaaaaaaaaaaaatccaactcaattccaggtcatgctttgggtctgtccaggagtatgaacactagaggaatacagagcctgacctggctctcaactgtcgaggcctggaggtccaggagggttgaccgccctttaacacatgtacccctcacatactaatacagaaatgctgttacattctatgatcttcatcccctaaacgaccttatttccaacttcctctagcacctacccatcagacccccaggatgagatgaagtaagaggctgaaaacaagcaagatgacgaacatgagcatagcagaaccagaacgcaagtcatggctggggggtggcaaaaggaactgaatacggaacagaaacccttaacttctcttgctgctgcccaatcctcttgtgattccagacagccatttcatttaaaatccctttcagaagcctgtcatcttgcattagagctgggaggggggttgtgttctgggttggctgatgatacatggacttctgagacatgcacctaggcggactcaacaaatattaaacatctgctcggtcagaccctctgctcaactctgcacacacaaaagacaatgagatgcagaatggtgggtgccaggggctggaaggtggagggttcagagagtcagtgtttaatgggtacagagcttcatttggggaggatgaagaagttctggagatggatagtggttacagttgcacaacaatgtgaatgcacttaatgccacagaagtgtacgctgaaaaatggttataatggtaagtcttacatatacttaatcacattaaaaaacaacaacaac

SEQ ID NO: 3107 - DNA, 1457 bp, Homo sapiens
catttgagtgatctctctcttttgagcacaccagtctatccattcccttccgcgaccccacgcgggcacccggcagtggccaccagcttctgtctcagcagagcgtccacctgcccactggctgattctgcgaggcagctccgttggctgtctttggacggccacctgcatggccgtcactgaacagtgttctcaagaccaatccttggagatggtgagactctacgactgctttagggacttttgggatctgagtttccattggaaaagtcggaatgaaccatggtgggtggggaggatgctgaggagtggccacacgcagggacagggttctccggggccccgcccgcctccgtccttcgtggctggtgccctcgctctggccaccggcccccggctgcccagcccgtcagaggtggttgatggggtgaaatgctccagactccgacgtggctccagtgaccttcaaccaagcgtccagagaaccctgggagggggtgtggagaggagtgtcttcggaaagggacagcatcattgcatatgcctggcggggaggggatgacacacacacaggacaggcaggtgagcgcgtgggcagggcgggccatcccagacaggcagcagatgggcagggcaggccatcctggacaggcaggtgagtgtgtgggcaggacaggccatccccggccagcagggccaagcctcgtccgttcccagcctcccgtggccctggcctggctcaaccttgccctgggccacagggggcagaaggaacaagagggactaagacccggattctccccgcagcctggaagaggaagacatgagcaggcgtgacggcgggagggacgagggccgccccctgctccgagtgatgccaggacattggggtgctggtgcagggcctcctgtgcacaccagctcccttggctgctttggggtgctccccctcgaagcctcctctccttcccaccccttccccctgtttcctccacctggtgatcagcagaaactacagacacgtgtctggtttgggacggccctgggaactgggggtcaacaagagccacccctgccaggggatgtctgttttggtgaccgtggggacaccaaagagctgcctctgggacagggatgtgcagcgtttctgggccaatgggattcttaggaagtacagatgtgtttccaggcgttagttcatgggacatccttctgcccccagcacagggcaggtggggatgggacctggggagcatcgtgtgtgggttaagggcagggaaggtggggaagcccagcactgtcctacccgagttaacactccagacagaattagtaaaaagacaaagacagacacgcagacggcttttgctgagacctggggcgggcctgttccctctgggagggctgtagagtgctgaatgagaccctgagtccctacagactggagagaaatgcgg

SEQ ID NO: 3108 - DNA, 1159 bp, Homo sapiens
caaaaattagctgggcatggtggtgggcacctgtaatcctagctacgtgggaggctgaggcaggagaatcgcttgaacccaggaggcggaggttgtagtgagctaggatcatgccattgcactccagcctggacagcaaacctagactccatctcaaaaaaaaaaaagaaaaagtaaaaaatttaaaaattagatgggcatggtgacatgtgcctgtaatcccaggtactaaggaagctgaggtaggaggatgacttgagcctgggagttcgaggctgcagtgagctctgatcgcaccactgcactccagcctgagtgacacagcaagaccctgcttcaaaaaaaaaaaaaaaaaaaattactggacacaattattgtgccagacccctaggttaacagtgaggattcagtgggagaactaaacagataaacagatccagtccccgccctcagagagttacagtttaatgggaaaaagagacattcaccaaagaaggacacagcccactagtgagttacactcgagagggatcatttacagaacaaagcagactataaaaatacagcgattggctgggcgcagtggctcacgcctgtaatcccagcactttgggaggcagaggcgggcggatgacttgaggtcaggagttctcaaccagcctggccaaaatggtgaaaccccatctctactaaaaacacaaaaattagccaggcgtggtggtgggcacctgtaatcctagctagttgggaggctgaggcaggagaatgaatcgcttgaacccaggaggtggaggttgcagtgagctgagaccgcaccattgcactctagcctgggcaacaagagcaaaactccgtctcaaaatacatacatacatacatgcatacatacatacagggattaaaatagtctagtactgacacctgaacagacagattgatccaagaaatgaaacagaaattccagaagttgacctgaatacacacatacacacacacacacacacacacacacacacacaggaaggcgtgaaagactccatgaccctcaaggtataagatgcattttttttttttttttgagacagggtctcactctgtcacccagactggatgcggtggtgcactatcccagctcagctctaccctccatccccccaac

SEQ ID NO: 3109 - DNA, 17352 bp, Homo sapiens
ggagacgcgggcagccagcgatggccgcggagggggcgaactgggttccggccctcggaggctgacggaaggcggtggctgaggagcggcgcctctggttgagcgctcgccgtgtgtcccgcacctgtctgtcctgccgccgcccggtaagagtctcactctgttgccaaggctggagtgcagtggcgggatctcggctaactgcaacctccccatcccgggttcaagcgattctcctgcctcagcctcccgagtagctgcgattacagacatttgccaccatgcccggcacagcacagcaccgcacatctccagtcggactggctacatttcaagggctcaaccatcacgcgttaccagtggctactgcatcagactgtgcagtgctagatggggagtcagaagagaaaccaagtgatttccatgtcaagtggtgaacaggctaagaagaaaaagtctcgctgcatcccccaggctggagtacagtggtatgatcttggctcactgcaacctctgcctcctaggttcaagtgattctcctgcctcagtctcccgagtagctgggattacaggcgcccaccaccatgcccggctaatttttgtatttttagtagagatggggtttcactatgttggccaggctggtctcaaactcctgacctcaggtgatctgcctgacttggcctcccaaagtgctgggattacaggcatgagccaccttgcctggcctcttcctaatgattttttaaagtacatcttgttttctctgtcttactttatcataaaaatatatgatacaaataaaatacagaatatgtgttaatggactgtgtatgttatgagtaagccttccagtcgacagtgggctattattggtggttaagttttgggggagtgtgtgttcaagggtcaaccgcacttcctgagggcactgtgagaactaagttaaataacccacttttacaatctttggaaccgggggcaggtggctggggctcacacctgtaattacagcactttgggaggctgaggcaggaagatcccttgaggccaagagtttgagaccagcctgggcaacaaagcaagactctgtctctacaaaaatttttaaaacttaaccaggcagctgggcgcggtggctcacgcctgtaatcccagcacttcgggaggccgaggcgggaggatcacaaggtcaggagatcgagaccatcctggctaacatggtgaaaccccgtctctactaaaaatacaaaaaattagccgggcatggcagcatgcgccggtagtcccagctgctggggaggctgaggcaggagaatggtgtgaacccgggaggcggagcttgcagtgagccgagatcgtgccactgtactccagcctgggcgacagagcgagactccatctcaaaaaaaaaaaaaacttaaccaggcgtgctggcatgtgcctgttgtccagctagtcaggtggctgaggtgggaggatcccttgagctcagaagtttgaggttgccatgagccgtgatcgtgccactgcactccagcctgggtgacagcaagaccctgtctctaaaaaaaattttctaaaaaaacaaaacccaggtctgcttggtctcaaagatctttatttgcctgctctgattgtgagataggaagttcttatctgattttgcccttttatttatttatttttttttgagatggagtctgtctctgtcatccaggctagagtgcagtggcacaatcttggctcactgcaacctccgctgatagcagattacacttttatttttagttttttatgagatggagttttgcttttgtcgcccaggctggagtgcaatggcaagatctcggcttactgcaacctccgcctcccgggttcaagcaattcttctgcctcaggctcccaagtagctgggattacaggtgcgcaccaccatgctcagctaatttttttgtatttttagtagagacagggttttgccatgttggccaggctagtctcgaactcctgacctcaagtgatccacccgccttggcctcccaaagtgctgggattacaggcatgagccaccacatctggctctgttttgctttttttttttttttaaatgagaagcatagtcttgatcctggggagtaggaatcggccacggtagttcggggtactcttgctgtccctctcagtccctgtctgttccttcagcacaagctattgtgagtccaggaggtcaggagacagagaagctgactgagcccaagtccctgttctagaggacatcactgccctgaggcaacgatggacacgtggacacataaatccacccaacgtgacaagggacgggcacagatcggcctcccatggagggcagtgttggggccacattaatccatgaggaagggtcggctaggcagagaagagaggtggggagttccagacagagggaccgacaggagtaacggcacaaatttgtcagggaggatcattcagggagcaggggtgccggttcggaggggagatcacagtgaggtggcactggccttgaggagccctggaaagtcgggcagagaagatctgatgtgatcccatagcccacgtagtcagcccacaacagcccgattcagcccatgcctgttttccggcggcccgtgagccaagaatgatttttccacagttggaaaaataacagtagcgttttgtgacatgtgaaaattacatgaaatgcaagtttcagcgtccataaagtttgacagtaacacagccacgcctctcctttgtgtgtggccaggggacgctcttgagctgtcatagaggcggaagtggtgcacaggacgcgcttcatggatgtgcacactgcctcacacggggccctgcccttccactgtccctgttctgaagttctttatgattgaagggccccaggtttttattttgcatcagaccatgcacattatgtcatgtagggtacacagcaacagagaccgtgtgccctagaaagccccgagtatttgctgtgaagcccttttcagaaaacactggtggatcccccgcagagacttccatgtcctgataccctggaacccatgaatatggtacctcacacggcaggcttaagggtctttttttttttctttaagagatagggtcttgctctgtcacccaggctggagtgcagtggcacgatcacagttcactacagcctcaaaacttttagtctcaagtgatccgcctggcttagcctcctgagtagctggggctacagacataatgcccagctaattaaaaaaaaaaaaaaatagagatggggtctcactatgttgcccaagctggttttattgaactcctggcctcaagtgatactcccaactcagcctcccagtgttgggattacaggcatgagccaccgtgcccaacctggttgaagattttgagatgggccaggcatggtggctcatgcctataatcccagcactttgggaggctgaggcgggcggatcatctgaggccaggagtttgagaccagcctggccaacatggtgaaaccctgtctctactaaaaatacaaaaattggccaggtgtggtggcacacgcctgtagtcccagctacttgggaggctgaggttgccgtgagccaaggtcgcaccactgcacttcagcctgggcaacagagtaagactccatctcaaaaaaaaaaaaaaaaaaaagagatgggagatcattctggatgatgtgggtgacccaatggcatcacagggtccttataagagggaggcaggatggtcagaatcagagattggaagaggctgcactgctggcttgaaggtggaggaaagggccacaagccaaggaattcaggcggcctctagacgttggaaaatgcagggaaatggattctcccttggagcctctagaaggaaccagccctgcgcacaccttgattttagaacctagtaagaactaatttcagacttctgaccccaggattgtaagataataaaaatgtgctgctttgggctggatgcggtggcttatatatgtaattccagcatttttgggaggctgaggtggacagattgcttgagctcaggagtttgagactagcctgggcaatggtgaaaccccatctgtacaaaaaataaaattagctgggcgtggtggcatgtgcctctagtcttagctacttgggagactaaggtgggaagatcaactgagcccagaaggctgaggctgcagtgagccatgatcgcaccacagcattccagcctgggcgacagagtgaggccctgtctaaaattaaaataaatagctgggcacggtggctgacgcctgtaatcctagcactttgggaggctgaggcgggcagatcacgaggtcaggagatcaagaccatcctggctaacacagtgaaaccccgtctctactaaaaatacaaaaaattagcggggcgtggtggtgggcgcctgtagtcccagctactcaggctgaggcaggagaatggcgtgaacccgggaggtggagcttgcagtgagccgagattgcgccactgcactgcagcctgggcaacagagcgagactcccatctcaaaaacaaaaaaaaaccaccaccaccaccaacaacaacaaaattaaaataaataaaataaaatagttgttttaagtcaccagggttgtggttatttgttacagtagccgcaaggaactaaaagggggtgggcattgaaaatttattggccgggcgcggtggatcacgcctgtaatcccagcactttgggaggctgaggtgggcagatcacttgaggtcaggagttcaagaccagcctggccaacatggtgaaaccccatctctactaaaaatacaaaaattagccgggcttggtggcgggcgcctgtaattccagctactctcaggaggctgaggcaggagaatcgcttgaacccgggaagtggaggttgcagtgagctgagaccatgccactgcattccaacctgggcaacaagagtgaaactccatctcaaacaatatatataaaaatacaaatacaagtacaaaaattagccgggcatggtggcacatgcctgtaatcccagctacttgggaggctgaggcaggagaaaggcaggagaatcgcttggacccaggagtcggaggttgctgtgaggtgagatcgtgccactgcactccagcttgggcgacagagtgagatctgtcttgaacaaacaaacaaacaaacaaagaatttatcttttaactgaaagagtttaaaactgagagacttacgtgagtctctctctctttttttttttttttgagacggagtttcgcacttgttgcctaggctggagtgcaatggcgtgatcttggctcaccgcaacctctgcctcttgggttcaagcaattttcctcctgcctcagcctcccgagtagctgggattacaggcatgtgccaccatgcggggctaattttgtatttttattagaggtggggtttctctatgttgatcaggctggtctcgaactcccaacctcaggtggtctacccacctcggcttcccaaagtgctgggattacaggcgtgagccatggtgcccggccgtctctgtctcttaatttctctctttctttcctttctttctgtctcccttccttccttcctttcttttcttttccctccttccctcctttctttctctttctctctccttccttccttccttccttttttccttctttccgcgggaacctggggcaagtagaagatacaacatgagaagggggaggcctccagggaggccatctagacaactgaaagagagacggcaaagtggactggtggccggaggagtgctggagggttctggagagaaggaggctgattccagatgtttaagatgtggggtcagcaggaccctgggtgaccagtgaaatgtggagaaggtggcagccaggtcaattagagacagatgtgggggaaagccattctctctcagaattctggagggttccatatatgggatggagttattctggggacatcataagaaatgggtgtgcctgtcaggcgagcagttcacttgtcagcccccacacagagctgaagcatcatagcccaccccagttcactgcccactctgaaaacagaagccgggcaagctccaaaaagccggaagaaccttctagaagccctgtgttcttctgaggcccaacttcaatctgatgccatctcaagcgccagtgagatcggtcatagaagattagaggctttattttttctcaggcagttgagtttattttcaggttagcagcagtttggagttcgcttcctggatgaggtcagagttggaggggcaggtggccacagtgtgctgtgtgcagagtccttgcagccacgacactttggccgttctaccttgtgcacagttctgtctcaaagagactggccccaaagcaggcacagaaataccaggcttacttacttacttactttatttatttgtttatttttgagatggagtctcactctgtcgccaggctggagtgatctcggctcactgtaacctccgcatcctgggttcaagcgattctcgtgcctcagcctcctgagtagctgggattacaggcacgtgccaccacacccagctaattttagtgtttttagtagagatgggggtttcaccctgttggccaggatggtcttgatctcctgacctcatgatccgcctgcctcggcctcccaaagtgctgggattataggcgtgagccaccgcgcctggcctatttatttatttaagacagggtcttgctctgtcacccaggctggagtgcagtggcatgatctctgcccacggcaacctctgcgtcccagattcaagcgattctcttgcttcagcctcctgagtggttgagattacaggtacccgccaccatgcccggctaatttttttgtatttttagtagagacggggtttcaccatgttgggcagtctggtcgcgaactcctgatctcaaatgatcggcccgcctcagcctcctaaagtgctggaattacaggtgtgagccaccgtgcctggccaccaggcttaactttaggaattacttcactttccccagccgcagttcgtttatttgtacaaggcaggcagtaccggtgccaccacctcgagagcctgtttaaagcaggcaccgagcagggcacttaacgcaccttcttggtggctgtccagtaaacaacgtgggggtcagcgacccagagggcagcacagacctctccaccgcttgtcacagaattgcagcctctctaacaccacgcacaagataacacgggtcactggcctcagccagctcgggacgttttccagagttcactttctggatcctacctataacccttccattcctctctctttctctctctctttctttctttctttctttctctctctctttttctctttttttttttttttttttttttttttttggagatagagtgtcgctctgtcgcccaggttagagtacagtggcgtgatcccggctcactgcaagcttcgcctcccgggttcacgccattctcctgcctcaccccccaagtagctgggactacaggcacccaccaccacgcccagctaattttttgtattttttagtagagacggggtttcgctgtgttagccaggatggtctcgatctcctgaccttgtgatccacctgcctcggcctcccaaagtgctgggattacaggcgtgagccaccgcgcctggcctcttttctttttctctctctctctttctttcctgctttctctttctttctcccttccttccttccttccatccctctttccctctctctctctttctttcttcgatggagtctcattctgtcacccaggctggagtgcagtggtgcaatctcggctcactgcaacctccgcctcctgggttcaagtgatcctcccgcctcagccttccgagtagctgggactacatgtgcgtgtcaccacgcccagctaacttttgtattttagtagagatgggatatctccgtgttggccatgctggtctcaaacccctgacctcaagtgatctacctgtctcggcctccgaaagtgctgagattacaggtgtgagccactatgcccggtctccagaatattttcatcgccccagaaagaaaccctgtacccattacctgtcactccccatccctggaacccactggtctacttcctgactccacggatttttttactccggatacttcatataaatggaatcttatccagtgcattattttgtgtctggcttctttcactgagcatgtttttaaggttcacgtgctattgtagaaggagttagtacttcattccttttcagggttgaatgtaatttcatcctatgccggaggctgagtcaggagtgttacttgaagccaggagttcccttaggcaacatagcaagactctaactttaaaacatctttgaaaaattaagtccgggctgggtggttcatgcctgtaatcccagcattttggggggccaatgcaggcagatcacctgaggtcaggagcttgagaccagcctggccaacatggtgaaagcccatctctactaaaaatgcaaaaattagccaggcgtgatggcgggagcctgtaatcccagctactgaggaggctgaggcaggagaattgcttgaacctgggaggcagaggttgcagtgagccaagattgcaccactgcactccagcctaggcgacagagcaaaattccatatcaaaaaataaaaataaaataaaaattagctgggggttggcagggtgcagtgtctcacccctgtaatcttagcatgttgggaggccaaggagggctgatcacctgagaattgcttgaactcaggaggcggaggttgcagcgagtgtaatggtgcgagcttggctcactgcaacctctgcctcgttggttcaagcgattctcctgcctcagcctccctgagtagctgggactacaggtgcccgccatcacacccagctaatttttttttgtatttttagtagagacaaggtttcaccatgttggccagactggtcttgaactcttgacctcaggtgatcctcccgccttggcttcctaaagtgctgagattacaggcatgagccaccatgcctggccttttttcttttctctatttttgagatggagtctcactctatcgccaggctggagtgatcttggctcactgcaatctccagggttcaattgcctccagggtttgagcaattctcctgcctcagcctcctgagtagctgggattacaggcatgcaccaccacaccagtctaatttttgtggtttttatttttatttatttattttttgagatagagtttctctcttgttgcccaggctggagtgcctcgatctcagctcactgcaacctccacctcctgggttcaagagattctcctccctcagcctcccgagtagctggaattataggcgtccaccaccatgcccagctaattttttgtgtttttcgtagagagggtttcaccatgttcgccaggctggtctcaaactcctgacctcaggtgatccacccgcctcagcttcccagagtgctggaattacaggcatgagccaccacgcctggcctaatttttgtatttttagtagagatggggtttcaccatgttggccaggctggtcttgaactcctgacctcaggtgatctgcctgacttggcctcccaaagtgctgggattataggcgtgagccaccatgactggacttcttcctatttttttttttgttttgttttttgagaccgagtctcgctgtgtcgcccaggttggagtgcagtggcgcgatctcggcttactgcaagctccacctcccgggttcatgccattctccgcctcagcctcccaagtagctgggaatacaggcacccgccactgcgcccgtctaatttgttgtatttttttagtagagatggggtttcaccgtgttaaccaggatggtctcaatctcctgacctcgtgatccgcctgccttggcctcccaaatgctgggattacaggcgcgagccaccgcgcccggccccttcttcctattctttcaaagccaccagttgccctcctatgataacccattatctattaacccatggatctgttaacccaggaatggattaatcagttcatgagggcagaattctcatgacccagtcaccccttaaaggccccacctctgtcaacacggccacatcaaggattaagtttcaacgtgagttttggaggaaacgaacattgaaactgtggcaccaggtgttatcagtctattaagagctcatgcaaattgataagcaccaaaggtgcaaagatcagaaacagacaattcccaggaggataagcggggggtctaggagcctaagagtggatgtattgggcatcaagggagggcctgttggccagggttggtcacagcaaggatcattccaatgctgccgggaccccaacacttgctttctggccaggcgcggtagctcacgcctgtaatcccagcactttgggaggccgaggtgggtgggtcacgaggttaggaaatcaagaccatcctggctaacatggtgaaaccctgtctctactaaatgtacaaaaaattagccgggcgtgatggcgggcgccagctacttgggaggctgaggcaggagaatggtgtaaacccgggagatggagattgcagtgagcagagatcatgcgactgcactccagcctgggtcacagagtgagactccgtctcaaaaaacaaacaaacaaacaaaaaacacttgctttccaaaggggtggctgccacttcaattggaaagaccctttggacaatgcacacccagcatataagagggttcataggccaggcgtggtggctcacacctgtaatcccagcactttgggaggctgaggcaggaggagaattgcttcagtctgggagttcaagaccagccggggcaacatagcaagatcctgtctctatggataaaaaaaaaaaaggtcgggcccagtggctcacacctgtaatcccagcactttgggaggctgagacaggcagatcacctgaggttgggagttcaagctcagtagctctctaaaaatacagatcacctgaggtcaggagttcgagctcagtagctctgtaaaaatacagtaattagccgggcatggtggtgcacgcctgtaatcctggctactggagaggctgaggcatgagaatcacttgaacctgggaggcggaggttgcagtgagccaattgcgccattgcgctccagcctggacaacagaacgagactccatctcaaaaaaaaaaaaaaaaaaaaaaaagagggttcgtagtctgagcttgtgattataccactgaaaattaccccaagccacttgtggaagggctgcctgcagaaggacgtgtcttaggctctttaataagttaccttctggttggaaactacctaaacgcccagcacgcaggctggcccggtaaatcacgcacccataggagttatggtcaggaggcctgtgactctgtagagtggtagtggctcccgggccctgggccaagcgctgtactgatgccctcaaatcctcatggtaacagcctgttcagttctgttcaccccattttacagcaaggggctgctctgggggcagggaggagcccagctgggtgggagatcgtgggttcatggtggcatctgtgggtactccatccaatcaagggtctgaggcttaagaagcttaaatttgggggagatagggacattctcaatggtgcagttaaagcagtggcttcagattctggtgggagaggaaggaactgaggctggggaaagggatgtattggtcttttctttggaaacagtcttgctctgtcgcctaggctgggctggagtgtaatggcacgatctcggctcactgcaacctccgcttcccaggttcaagcgattctcatgcctcagcctcctgagtagctgggattacaggcatgtgtcagcacgcccagctactttttgtatttttagtagagacagggttttgccatgttgcccgggctggtcttgaactcttgggcaacagtgatccgcccgcctcagcctcccaaagtgctgagattacaggcatgagccatcgcccagtctcactggtctttcatctttgttccatcctcattcccattcagcacctgatgtacttctctcttactggggtgcaccccaggggacgcatgactgtgctacagcccacggggtttcagcagggtgcgcagaggacctcaggtggcccttgttacccacactcattccttgccaggtcttccacaggtcaaggagccaggattctggggtttggacaccccattctctggcggatggggctggcctggagcctgggtgggagtaccgggtttcatacatcgggggctcaggcttggggaggggtcacatggaagtcacctggctggccagagcagttgcagccacagcaggtagaaggcaggagccaggactgggtgggcctgcgtgggagggacggccaaaccctgaaactagcctccaccctccagggtacaggggcttccctggacacacactggccttcctcgtcctcctctttataccattgcacccaggtttgtttgtctgtttttagtgacagaggcttgctgtgtcacccaggatggagtgcagtggcacattctcagctcactgcaacctctgcctcccagattcaagcaattctcctgcctcagtctcctgagtagctgggattataggcatgtgccaccgcatccggctaatttttgattttttttttttttttttttttttttttttttagtggagacggggattcattatgttggccaggctggtcttgaactcctgacctccagtgatccacctgcctcggcctcccaaagtgctgggattacagacatgagccactgcacccagcccctggggttttatttacccagatccccactgcctttccttcctgtggctgacatctccctacactgtcccccagaaacacagctgttttgccctcaaccacagctcctgcatccagtgcagggcctggctcttgactgagacatcagcaaatgtgagccctgctctcctgggtcaatgcaggctccttcaggaaggaggcggggatctgtcccccttggcatccccagtgcccagcatggggggcctggcacccatgaggcagccaaggctttcagaccaaatgaacaagcagtgagccctgccttcgagggcccgtcttgaggacaccaggtgggtttatgacatcccagtggacatgaggcccccagggaccagttcctctccggcattggcaccagggcccctgccccactggatcagacctcccaagcttggggtcccttttccagtaggcaagagaggcacccgactcctgcttcagcccaaggagaacctgccgactccaaggggtggccattgaggggatcagtgacgtaagtccttcagaggcagcagggacaaggagctgtagggaaaacagggcaggcctggggttggggggtgtggggtgctgacaaggtgcagacccaccaccccaaccaagcccctcctccgcagatccatcacctctgccccgtgccccatgaatgaaccagctcattccccggcccagtgaccagcacaggctccagacgtttccctcggacattgtctgcctgaccacctcttccagcacagtgaggggcctgggatctggaggccagagtgggccaggcctaggggtggggggaaaaacgtcactattcttagatccctcgtcctccagggcccaggccaggcggagcagtcacattccagaggtagaaaccatcagcccacacaaatgcttgtgttccctgaggaggccaagggtcaccaggaactaaaatcagcttttcccaagaaaggcgggagacagggtggggggcggggggcagggttagaaaggccaaaggtcacccaataaacccttccagctgcccctggtggaaagcccctctgagtccggagggatgaggacagagggattctcgccctctaagctactctgcgggctggctgattcttcctggtagggggcggtcctgtgcagtctagattatttagcagctctctggcagcccaccgcccccccagcctcccagtggtgacagccaaatctctctccaggcacgggccaggtgtcccctggggaaaaatcgaccccagatgagaactgtactttcccaaacagagcttccaggtggcgtctggggtagatatttaggatcctgctgttctatggactctgttctctcagcctggaatcctcttcccgcatagcacaatcccccaccagccctgcaatcttccagaactaaacccacacatcacctccctcaggaagtgtcctgtgggccccccatcttatgattttggcccccacggatgctgtggtaggtaaaataaagcccctttggccagatatggtggcttacacctgtaatcccaacattttgggacgccgaggagggaggatcacttgagcctaggagttagagaccagcctggacaacatagcaagacacagtctctacaaaaaaaaataaaaaaattagctggggctgggcgcggtggctcacgcctgtaatcccagcactttgggaggccaaggcgagcggatcacaaggtcaagagatcgagaccatcctggccaagatggtgaaaccctgtctctactaaaaatacaaaaattagctgggcgtgttggcacgtgcctgtaatctcagctactctggaggctgagcgaggagaattgcttgaacccgggaggtggaagttgcagtgaaccgagatcgcaccactgcactccagactggcgacagagaaagactccgtctcaaaaaaaaaaaaaaaaaaattagctggggccgggtgcagtggctcatgcctataatcccagcactttgggaggccgaggcggatggatcccttgatgccaggagtttgagaccagcctggcaaacaaggtgaaaccctgactctactaaaaatacaaaaattagccgggcgtggtgacacatgccagtagtcccagttctacttgagaggctgaggcaggagaattgcttcaactcagtgggggcagaggttgcagtgagctgagattgagccattgcactccagccttggctacagagcaagaccctgtctcaaaaaaaaaaaaaaaaaaaaaatgctggtcttggtggctcacgcctgtaatcccagcactttgggaggctgaggcgggcagatcacctgaggttgggagttcgagaccagcctgcccaacatgaagaaaccctgttgctactaaaaaatcaaaattagctgggcgtggtggagcatgcctgtaatcccagctactcaggaggctgaggcaggagaattgcttgaactcgaggggcagaggttgcagtgagatgagatggagccactgcactccacccttggctatagagtgagactctgtctcagaaaaaaaaaaatgaggaggcaggagggtcacagtcagaaagagactggaagaggctgcgctgctggccgtgaaggtggaggaaggggccccaagatgagagctgtaggtacctctagaagctgggaaaggctgaaaatggagcctccaggaggaaccagcctcatcaacaccttaattttaggacatctgacctccagtgctgtaaaatcataaatctgggttgctttaagctgctctgtttctggtcatttgtttcagcagccacgagagactcataccagcctcttctctgcagccccgagtcagccctggagagctgccgggcagtcggcctggcatttgcctttcctggcatgagctttgtaacccggcagagctgctggccgtggcaagcatctcctaggagatgggagaactcaatggaaaaaggtttcagagtcagggcttgggtggaccacattccttcaagctttataccatagagagctttgttagggaggtggagaagcagacaaagtgactcgtgttctctccaatttatttatttatttaatttatttattttcagacggactctctctctgttgtccaggctggagtacagtggcttgatcttggctcactgcaacctctgcctcgtgagttcaagtgattctcctgcctcggcctcccaagtagctggaattacagacatgcactaccacacccagctagttttttggtatttttagtggagacagagtctcaccatgttggccaggctggtctccaactcctgacctcaagtaatccgcctgccttggcctcccaaagtgctgggattacaggcgtgagccaccatgcccagcccaaataattgttttaaaaggccaggctggtggctcatatctggaatcccagcactttgggaggctgtggtaggaagatcacttgagcccaggagcccgggattcccaggctgtagtgagctatgatcgggccactgcactccagtctggacgacagagcctacccccatccctgccccccgaaaaagttattcctataaagacccaagggcccaatctttgtttcatggtacctttgttctttatttcttactacttattcatttttaaatattctgaatagtcaaagtcaagatgtagctgactttgaaatgcttccctgccaggtgcaatgactcacacctgtaatcccagcattttgggaggctgaggcaggagaattgctttagctcaggagttcaagaccagcctgggcaacatagcgagatccctgtctctacaaaaaaatgacaaagttagctgggcatgatggtgcacacctgtaatcccagctacttgggaggttgaagtgagagggatcactggaccccaggagtttgagactgcagtgagccatgatcacaccactgcactccaccctgggtaacagagtgagaccctgtctcaatcaatcaatgaatcaacattttaaatatgaaacattttccacattcttcaacatgtcctagggcagtccttgttccctttccctaggacagctcatttttgaattttagaagcaatgctaaagggaaaatgtgtctgtgtgttttttttttttgttgttgttgttgtttgtttttgttttttttgagacagaatctcactctgttgcccaggctggagtgcagcggcatgatcttggctcactgcaacctccacctcctgggttcaagccatcctcctgcctcagcctccctagtaggtgggactacaggcatgc

SEQ ID NO: 3110 - DNA, 3140 bp, Homo sapiens
cagcgggctcctccgcgcgctgagtgtcagttgcacgtcttacctgataggtgggtaggcactcgcctgtggaggagcctgaagcttctaggggtgccttgctctttcaggagaaagcggccagaaggagcgggtggggagccctggagaggtgggagtggaggctctcttttatacctgcgtctgtcgctgattccaaaaggcgtaggggagcccgggacgcgccctccaggccactgggcgggcagtgtatcctgcgggaacccgagcctgctcggggctctgtggggttgagggtcgtggaaggcttctaggcgcaggagcggcggcgactgtggctactgacattaagaagggtccccgggagttttgcgagaaattagagggtgacgacggccagcgggcgctggtcataaaattccgggctcagcccggcctccagaggtcagaaataggtggttatctgagagggagggacgaggcgaactctccgagagccacaaactggagaagccgctcccgctggctgggaccagggactctcctgcaagaggcctagggtcactaaggaaacataaccagcggtagtgcagggaacggaacctgcgtgatgtcacagcggctggagcagttaccaaagacgttggaagaggtggctatggacatcacctgggagaagtggaagcaaatggacactgttcagaagtccatatacagaaacatgttggaaaaatatagaaacctggttttgctagatgggaagcttgaacgtggggccaagacatcaagagtagagcagcaggacatttcaaaagaagattaatctcaaagattagagatggaagaacttgcaaagagaaagtctgtaccggaagaaatctggaaatctagaggccagtttaagaatcagcagctaaacaaggagaataatctagggcaagagatagctacctgcacaaaaattcctaccagaaaaagagacatagaatctaatgaatttgtgaaaaattttactgtaagatcaatacttgttgcagaacagatagatcctatggaagagaattgtcataaatatggtacatgttgaaagatgctcaaacaaaactcagatttaattatacaaagaaagtatgatggaaaaaaaaaaaccttgtaaatatagtgaatgtgggagaaccttcagaggccacatcactcttgttcagcatcaaataactcattgtggagagagaccctgtaaatgtactgagtgtagaaagggatttaatcagagttcccacttaagaaataatcagaaaactctttcaggagaaaagccctacaaatgcagtgagtgtgggaaggccttcagttattgcttagttcttaatcaacaccagagaattcacagtggagagaaaccttatgagggtactgaatgtggcaagacattcagtcgtagtacataccttactcagcatcaaagaattcacactggtgagaagccctatacatgtcttgaatgtggaaaggcttttagtcagaacacacatcttactctacatcagagaatccatactggagagaaaccttatgaatgcaatgaatgtggtaggtcctttagtcagagtgcacatcttactcaacatcaaagaatgtatacaggagaaaaactctatgaatgtaatgaatgtgagaaagccttccatgatcactcagctcttattcaacatcatattgtccatactgcagagaaaccctatgaatatcatgactgggaaaactttcagttactgttcagacctcattcaacatcagagaatgcacactggagagaaaccatacaaatgcaatgaatgtgggaatgcctttagtgattgttcatcccttattcagcatcaaagaactcacaccggagaagagccttatgaatgtaagcaatgtggaaaagcctttagcagaagcacataccttactcaacatcagagaagtcacgcaggagagaaacagtataaatgcaatgaatgtgagaaaactttcagcctgagttcattccttacacagcatatgagggttcagactggagaaaaaccctacaaatataatgaatatggaaaagcttttagtgactgctcaggacattttcagagaactcacactggagagaagccctgtgaatgtaatgactgtgggaaacctttcagtttctgttcagccctaattcaacataagagaattcataccagaaagaagccctgactgtaccttcataccagtaaatgcactgactgtggaaaagccttcagtgattggttagcacttgttcaacatcagataactcaacactggagaaaaaccgtataaatgtactgaatgtggaaaagccttcagttggagtacagacctcaaaaatcaccagaaaactcatactagtgaaaaatcctataaatgtaatgaatgtagaaaggcctttagttactgctctggtcttattcaatgtcaggtcattcatactatagaaaaaccttatgaatacggtaaatgtggcaaagcctttaggcagaggacagaccttaaaaaacatcagaaaatgcataccgaagagaaaccctatgaatgtaatgaatgtgggaaagcctttagccagagcacatatcttacaaaacaccaaaaaattcatagtgaagagaaatcaaatatacatactgagtgtggggaaaccattagacaaaactcttcttttttacaacaataaaaacctcacactggagagattctctgaatgccttaagaatttggttaatatggagacccttcccagggaaacagaaggaggatcgtgaaaactgttgactacttagaatgatcacatggtttagtggagagagcatgattctgggttttaaaagtcatggatctcaatctcagctcctattactaactagatcttttactttggggtaagtcacttcatatctttaggccttaatttcctcatctgaaaaactggaaggcctgacttgttgagctttaagatcctcaattattatatttactaggaattcaagtttctatagatgtggttcagaattgtgacttatttattgtacatcaggtgtgattcacaagtgagcttgtagtagttattaaggagtcaataa

SEQ ID NO: 3111 - DNA, 918 bp, Homo sapiens
cagtccacaccatcacacacacacacccacacacatccatacagtccataccatcacacacacccgcacacatccatacagtccacaccatcacacacacacccgcacacatccatacagtccacaccataacacacacacacatctatacagtccacaccgtcacacacacacacatctatacagtccacacctgttacatgcacacatctatacagtccacaccgtcacacatctatacagtccacaccgtcatacacacacacgtctatacagtccacactgtcacacatccgtacagtccacactgtcatacaaacacacacacatctatacggtccacaccgtcacacatccatacagtccacaccgtcatacaaacacacacacatctatacagtccacacctgttacatgcacacatctatacagtccacaccgtcacacatccatacagtccacaccgtcatacacacacacatctatacagtccacaccgtctcacatctatacagtccacactgtcatacacacacatctatacagtccacaccgtcacacatccatatagtccacaccatcatacacacacacatctctacagtccacaccatcacatgcacacacacatctatatggtctacaccgtcacacacacacacacatctatacagtccacaccgtcacatatctgtacagtccacaccgtcacacacacacgcccacacccgcatgccacacatccatacagtccacattcacgtatgcccatatgcatccattcacacgtgtgtacacatgctcacacacacacattcatagactccacacatgcacacgtgcacacacacgcacatgctcgcacacatgcacagatacactcacgtccacacacgctcaaacatgcgtgcacacccg

SEQ ID NO: 3112 - DNA, 7083 bp, Homo sapiens
gatgaggaggtcggcgcggctgtgctgcgggcaggcagcggagagggctcgcggcgagggctccagcttaccccgccgccgcgtcgcgtgcacggagcgcttcagaggtttggagggggccggaacctcaaaagcaactggatgagcacaacgcggacgccccggagaagcggcgcaagcgggcccaaaatggttgctgatcagacgagtggcatctctcgcccccctaccgcgggaattgggacctccagactgtgcctgggggatcggcaagtggttcccctctggttttttcggcgctgccttcccggtggtatcctcactctctctctttgaaatgacctctgctttcctatctctaactcttcccagatatttgaaagcaagtttttgtacaaagcaacatatgaatgtattcagccattcgatcgttcggcgaacatttctaggtgtctcgtgctgtgccagatattgttctgagtgcgctgaagatgcacctgttagcaagacaaagtcctggctcccacggagcttattcgaagcaataggggcccccaagcaggtgcctgagaagtagggaggggtggacagtgggaaaacaacctaacggtggagacacacgaggggtctttttttacttttagaaacgggggtgggtggtcaccctatgttgcctaggctggtctcgaactcctgggcccaagcgatcctcccgactcagcctcccaaagtgctggtattacaggacaccatgcccggcagaggggtcgtttttgttgtttttttagtgtcgtcaggagactccctccatcagaattactcaggctgattgttttgagtcctgggacccagttggtatccagaatcttggcttgtttgcctaggaacctgcattttcacatccccatctccacacccctggtgattcttatgcatataataatgtgaaaagcattgcattgaagaattgctaaagggtgtcagaaaacggattaacaaaatcaggaagctttaattttcaagattctattaacctcaaaattcaacatatccaaaaattgaatgtctttttctccagtgttttctaggagagtgccaacactagccacccaagtgctcaagccagaaacctggaaatgatccattactctttcctctgtctctggagtccccatgttaaattagatgtgtttgtttgtgagacagattctcactctattacctaggctggagggcagtggtgcaatcattgttcactgcagcctcgacctctctgggctcaaggatcctcccacctcagcctccccagtagctgggactacaggtccccaccaccacgcccggctaatttttgtatttttagtagagatgaggtttcatcttgttggcccgggctggtctcgaactcctaggctcaagtgatctgcctgccttaacctcccaaagtgctgggattacagccgtgagccactgcacccagccccaattagatttttaaaactgttgttccctgtcagttcttactctggttcaggctactgtcatctctcctagagacactgcggtagactcctcttggtctccctgccaccgaaattgccctctccaaatccactacagcttgaatggtctttcaagaaagaaaatcatgttttttccctgtttaagactcttaaaaagatctgattaacacgtaggataaagtctaaaattctttgaggtggctacagggccattggtgatctcatccctgttgccatctctgacctcatctgccacagatatttctcaggctacactcaaaactgggaagctctcaggtcatttaagcctggaaattgtgccacctcacaactgttgcaagggctgttccctttgcccataacttcatttctctctacaccatctatgcacttacttgaatcctcacctgaataattcttaccattctttcagatcccaacattaataccatcgcctccaggcagcattttttcatctcccaagattgggtgcattagaccctttgtcatcacacccagtactccccacgtttattgagcgctcacgatgcgtcaggccctagtggaagcctttatgcacattatcttctttctcatttaattatcaagtagagcccacaaggtaggtactaccttttttttaacttttgagacagggtctcactgtatctcccagactggaatacagtggcgcaaacacagctcactgcagtctcatcctgggctcaagcaatcctcccatctcagcctcctgagtagctgggaccacaggcagatgcctgttgcccaggctggtctccaactcctgggctcaagccgttctaccttagcctcctaaagtgcagggattacaggtgtgcaactgtgcccggcctgggtagttactaatattatcccattttacagatgaagaaacaaggacatataggggttacttgcccaaacccagacaataagctagatctgaaagtcatcagcctgacctcagagttgtacttttaaccattatcagggtctcaggccagtacccactgatgaaacacataagtaacttagtgggtcattaccaacatttcattaaagaaatagaaaatggcagagaacatcaaacttagtaaggctcttgtttcgtgaaacttgtcagattctctaatatgataaatactaaatcttacaaacattgaaaatacaaaattaaacaaaatattaccaaggttaacacaaaagtatgaatactgcagatctgatttattttactatcctcatctttaatgcagaaccttcttaggattaaatgacatttaccattctgagcaaactgaggttactgccccaaacggactgggcttacctttgcaggagaacaggggaggctgtgttttggctggagatttttggctaagagtcaagacacagagattcttctgctaccactgtgaacacatcaagtccctttcacatagatgctgtttccacaagggtctccccacacccttccctacagattagattcccgtgatgccttatttaattcttgttggatctgttgatttggttatgaagtaggtgaaattctggtaacctcacccaggttccttcccctcttgattagatccagccagtctgttcgctggatgattaaatttggcattcatttttctgtgctttccctatctgctactatcctaaagtcattctaatgaccaaaaaaggtgccttgagccagactgtagagggttctaatggcctccttagaaattgtgtttttttgttttttttttgagatgaggtttcgctcttgttgcccaggttggagtgcaatggtgcgatcttggctcactgcaacctccgcctcccgggttcaagcgattctcctgcctcagcctctcaaatagctgggactacaggcatgcgccaccacgcccggctaattttgtgtttttagtagagacggggtttcaccatgttgcccaggctggtctcgaacccctgacctcaggtgacccacccacctcggcctcccaaagtgctgggattacaggcctgagccaccatgcctgccaaggaactggttcttagtaggcaatagacagttgacaattttgagctaagcactaaggtcataggagtgtagattcaccagggagtgagttgggcttctggtctctagagggcgctcaaggcttctccctccccaccctcttccttcccccaaggtggaggtaggatggtgaagaaatttcatctccccaccaccaaacacacacaaaggaagaaaatcttactaaaattggagaatatggaataacattttcttgggatggagcccttaaaagataacacgttcaacagaaagtgctgcgtctttcccgttcttcaacatactctgagtggtaacaagggctgcccttgcctttctcagaggcagcccagccagcttgttctctttccctctcccacaaggtagccaggccctaaggctatggcccacagaaaaagtcttagcaaggccccgggcttggggcaaagaggctgtggatttgtctttctctctactttttctggttagtgtgcctctatcccactcggaagaaaagttccaagactcaaatttgggcattgatgtggggaggatagacagagatgaccagaatccagcctatctttcctgacttctgcattgtggttcatacccagctaataataaagtgttcctttccctggtgtgtcattgcacatgtactccccacactcctgatgagtagagatggctggccaagacaggattcagacattcccacatccccaaccaaacatcctctccataccatcttattaatcagtctttgaacaatttcctaaactccctaacaggttggagatggctggaagaaatgaaaagaagaacgccaacaaaggcgataaagaaaaattcaacactgcttgataactgatgagatagtgaaggagtaggagggcaaaagtcagaagtaattccaggtgttcaagaactaaatgctgaagagatgttagtgtcgttgacggtcttctaatgggaagtgaatttcaatagaaagaggatgtgtttggtttcagacagaccgagtgactggtgacaacaggaaagccacgtgtttggagcagattactcggtacagtcagcagctggaatggaagtgaagaaggcccagcagagcatcagacctgagtgcaaactatggtggtgttggtggaatagagggaagggagagatttgagagacattgggaagaaaggttttggtttttgagacagagtcttgccctgtcatccaggctggagtgcagtggcataatcttggcttacagcaaactccacctcccgggttcaagcaattatcatgcctcagccccctaagtagctggaattacaggcaagtgccaccacattcagctaatttttgtatttttagtagagacagggtttcaccatcttagccaggctggtctcaaactcctgacctcaggtgatccacctgcctcggcctcccaaagtgccgggattacaggtgtgagtcaccatgcccagccaccagaagtttaatcaaggctcagagactgattccagtttgagttttctaataactgtctaatacttagctaatagctttggacagttgctctttttaaaatgagatcattcaatcattgcattcatctttgggtatgactcactagtcaacagagtcccccttctgtagaaactgcctcattcacagagatgacctccaccagtcatgcctatatttgagaccctgtctctctttatcccccattgctgcgtgattcaagggtggtcacctgacccaggcagtgccaagtttattctctgtcttgggaatttagaatgtttgtttggctaagagacacagaaactggaagctggagctgatgatggagctgatcacgctaatgatggagctatagagataagatgcatgaacaccaccgaggtccccaagattgccatattcctgcagtgccttctggccacagatagttggtccagaagcaggttcctgactcaacctgggccaattagagcctttcacggagattttgaaatcaaagttgagatctctctttctctctatgccctttggtgtatgtgtacttgagctacaagttacccaactttggaagctgtagacagaggcaattttccactaaatgaagtgagaaacagaaagtccatcattagtgagagaggagcaaggcagatgcacacagagaagcagatagaggggaagcgggcgggagtggggcgggagttcctggagtccccacagtgctctagtttctgattctcttcctaagacccacaggattcctgcctttgggtttcttaagttcctgaatagctcctgattgcctttgtcttttttacgaaagtcctttgagcatggtttcaggtgagcagacagtcctaacctaaagagctgtaacaaatacacgtgggctgtgtgtgagattcggggagaggcaccagggatccagtgtgggtcaggcgtggtgccgccctcaaggaacttagtggggagaaaatgaagtctgtacttcaataactacagtgcaggctaggaagagaacacccttagagatgtgcaaatcaagctctttgggagtttagaggaggcctaggactgctaaggaaaggctgggactaggaagaggtaagcaagtcactgaggaggcaaaatttaagaagccacccactctcagggtgtgtgaatgcagcgttggcacttgcatgaccctgagaatgagcaaccccttaaatgtatcttaggcaccttgccagactcacttttagcttgctggactaattgtggggatcagtaggccttcagaggaaagttagtgtctgagctgaactgaaggatggggtggttttggacttggtggcaatgtcatctacctcaaggtaaagtaacaatatggaaaacgctcccgtgaaaattcacaaggtctgttctaggatcatcaggctcttcggtgtgacttaagagttcagagcatgaaggaggagggggcagtaagaaaaatggagagaacgtagcatcagattctgcaggcaaggagaaaattgctaagctgggaaataacataatcagagcggtacttaagatgaatctaacggaatagcatgaaataaaggaaaggctaaggagaggacaaacaggaggctattgtggcaatccaggcgtgaaagtctaaactaatcagcactgggaatagagatgccataggaaaaataatacatcattaatataacttggcaattgagtagatgttggagacaagagagaaatcagaaacactgctaaacactatgcagctataacaaagaatgagagagcattcagtaagatcacatccaagatatgtacatgaaaaacacaagggatagaactgtgtatatggcaagctatcacttgcattttttattttttaaatggtatttatttatttcttgttttttcctttttttaagactaaaaaatcaattataaaatcctcaa

SEQ ID NO: 3113 - DNA, 860 bp, Homo sapiens
gtacagctgcatcagctgttcgtaggacatgtccagcagctggtccaggtccacgccgcggagaccccagagagctcccttgcctcttccaccttctgaggacacaggaaccaggaagcaggctctcaacagacaccaaatctgccagctccttgaccttggacttaccagcctccagaactctgagaaataatttttgattttttataagccacccagtttgtattagtctttcctacactgctattaagaactacctaagactgggtaatttataaagaaagaaaggtttaattgactcacagttccacaggctgtacaggaggcatgactagggaggcctcaggaaacttacagtcgtggcagaaggcaaaagggaagcaagcgtgttttcaggtggtggcaggagagagagaaagagtaaagggggaagtgctgcacacttttaaataaccagatcttgtgagaactctgccacaagatagcactagggagatggtgctaaatcataagaaaccatcgatccaatcatctcccaccaggccccacctccaacgttcagatcacaattcaacaggagatttgggtggagacacagagccaaatcatatcacagtttatggtattgttactgcagcctgaacaggctaagatggtgccggcctgtctcccacctgtttctgaacatcctattcatcctgtttggctcaactcaaaagttacttccttcatgaagaagttcccagtcccccaaaatcaaataagcaccaagtctgccctcgagtgccacctatctcacaccactgcctcatattggatgtcttggtgaccttggtcagtcctcttattaacttccaagt

SEQ ID NO: 3114 - DNA, 2211 bp, Homo sapiens
gtttcactgtgttggtcaggctggtctcgaactcctcacctcaggtgatccaccctcagcctcccaaagtgctgggattacaggtgtgagccaccgcgcccggcacttaatagattttaacctagtaattggggcatggtttcctccgcggatcaagtgaaatcctacatggtacactggactttggggaattcggtagtggcggggaggttctccaaagttacaattcaaagaccaacaagtttactccttgatttttttttttctttgagatggagtctcttgtcacccaggcaggactgcaatggtgtggtaacggctcaactctacttccatctccgaggttcaagccattctgcctcagcttcccacgtagctgggattacaggtgcccgccaccatgcccggctaattttgtttttttgtttttgagacagagtctcactctgtcacccaggctggagtgctgtggcgcaatctcagctcactgcaagctccacctcccgggttcacgccattctctgcctcagcctcctgagtagctgggactacaggcgcctgccaccacagcccggtaattttttttgtgtatttagtagagacaagggtttcaccgtgtcagccaggctggtctcaatctcctgacctcgtgatccgcccgcctcggcctcccaaagtgctgggatgacaggcatgagtcactgtgcctggccagtcctgcacaatcttgaaatgctgaggctctcagcaagctgagtgttggagataacttcatagacagtaatacatggtggcatagctgtttttaagagaatcctgccttgtgggtactatcaaaatcacagttccagttgggctcagtggtttacctctgtaatcccagcactttgggatggtgaggcaggtgaatcacctgaggtcgggagttcaggaccagcctgaccaacatggagaagccctgtctctactaaaaataaatgttagccaggcatgatggtgcatacctctaatcccagctactcgagaggctgaggcaggagagttgcttgaacccaggaggcagaggttgctgtgaggtgagattgtgccactgcactccagcctgagtgacagagccagactttgtctcaaaaaaacaaacaggggtggtggggggccagactcggtgactacaggccagcctgtaatcccaacattttgggaggccgagatgggcggatcacatgaggtcaagagttccagaccagcctggccaacatggtgaaaccccgtctctactaaaaacacaaagctagccgggcgtggtggcatgtgcctgtagtctcagctattcgagaggctgaggcaggagaatcgcttgagcccaggaggcagaggttgctgtgagctgagatggtgccactgcactccagcctgggtgacagaccgagactcggtctgaaaaaagaaaaaaggccaggtgtggtggctcacgcctgtaatcccagcactttgggaggcagaggcgggcagatcacaaggtcaggagttcgagaccggctaatataaaaattagccaggggtggtggcaggtgcctgtaatcccagctacttgggaggctgaggcaggagaattgcttgagcccgggaggcagcggttgcagtgagctgagattgcatcactgcactccaacctgggagacagatcctgactccatctccaaaaaaaaaaaaccggggaaacagtctctctagtagtgttggaggaatggggctgaatccagagaccgggaccagtgagtgggttaaaaaaaaaaaaatcactttatcatgaaataaacacacaaagttctgttcttcttcctggcagcttcggacgaaattacacaggcatctcccatgcccaccacccgttaggaatgtccattcctgggctgcgtgcgcaggtccagcagccagtctgtgcaggcgcctggcccggccagggagattgaggcagacccccacaagccctgaaccccagtctcaagttttctgcacgacctgtacttcagtcaccagacactcctccaggccggctttgcccgcctcccagaccacctgcagagacgagaggaggcagggtgagtcggccaccccccagataacagagcccacgtcctgatctgcgggggcctgtcccatctcagatctgctctgtgggccaggcatggtgtctcacgcctgtcatcc

SEQ ID NO: 3115 - DNA, 396 bp, Homo sapiens
agttcaaaacaaaaaactctttggaattttgattgtgattttgcttaaaattagagattactttggggagaatagtggtctttgcaattttgaatcttcctacccaagaacatgaaaaacaggatgaagttgtctattacgatccatgtgaaagtccagaggaacttagtcattgactgtggtggggctgcaggacgataagaattcggaagtgaaagaactcagaaggcagtgccagcagctggagtctgttaaacggggcagtctgtgtcaaaagagcttctctccagagtagaaaggtaggtacgctcagagcggctttcttttcttttctcttccagagatttattcttgtatgaaggataaagaggtattgaaataaggtttttaccaaca

SEQ ID NO: 3116 - DNA, 2706 bp, Homo sapiens
agtcccggctcagcgtctgccccggagaggctgcaaggcaagaggagcagcggcgttaatctgctgagggctgagagaaacgtgagcgttaccctgggctggccccttggctgctctcccttactacggagctggaaggtggcccctgacttctttgcaaaggccgtaggcaagcacccaaagcatatcatcaggtgcccacaaggcacaggacaccgggccgacacctggagctggggtgaggcctccttcatgccaggcctggaccatgaagaggaaaccactttctgtccccaaggagctcaagtctgatggggaaggagccactggagtggacggagtcagggcctgggatgccaaccacaggacccagctctgtcagcgaagcagaaaggttgtgcctggtctccctgcgtcccaggccaatccctcctcctgggtgtgtgatctttgcctgctgaatcctgtcttccagttagcccgcgagctcagggagtcttctctgcatgtacagttatctactctgtggggcaggactgtgtggaagggaaacggaggctgcgtgggagcctggaagaggagggtggcacctaggctattccctctgccagggaattccttcgccctcgttcagaaaacatctacccattcggggtggctcatggacagggactcccagcactgagcacccagcaggggcagagaggtgtctgctggctgagtgaatgaccctgaccaaatgggaagagagacgccttcctggcctgggggcactgagatgctgaagcctggccgcgtgggggtcgtcatcagctgagtctgcggtcccctgtggtcacacaggaccaggtcctcctagactccacagcccccggcccagggatgaggaaggtgctgctcggcccaccatgggccacagccttcctgctcagctcagcctcggtgatgaataacgctgcccctgctgtgccacttccgggctctctgggctcccacactctgctgtggaggcccaggctggctccctctcggggtgggtgctgcctctggagggtggaggtgaggggaagggactgagggtggccctgcggggccttgatggagcagcagtggggaccatgcacctctgagggtctgggtgagtgggggctgcagccaggcctggctggcctgggggatcaggagggtctgcaaaccaagctctggggctccctgaggttccaggaagaaccccgcctgtcccggcaaaggtggatccaggagaggagtgggcttggccacctcggctgccaccagaagctgccccctcagctcctatctgttcccctctgcccctggaacttctgaaaccacttccctcctccctggacttctgcaggccgaggtatgactgttctgtctcccgttagcaaggtctgcaacattgctctgagcagcatcctccaatgtggtgcacctgttcgacaggggtgcaaaggtaggtgctggggtgggggcagtcatggacttgctccccactccgaaaagctctcactcctcaggaaagctctcaaaagcagagcctgcatctgactagtctctgcaccccagtgcctggcatagcttctggcctcaggtaggtttcaggtaaggtctgaatgagtgattgagggaaacaggtgctggcttggagaagatgctgtgggatagacggcactgagctgggtcttgaatggacagggtttgagccaccagccatgcaggaagggctatccacaagcagagactcaaggtagggaagcacagagtgaccagggatgctacagttgggccagctgggtgcgggacgatggagggaagacgtcaaacagggaggaggagaaaaaaataacgcagagaggggcaggaccgtggcaacaactgaactgaagtgctttaggcatttccagaaatccagtgttcttcttccctcggcagcgcctaccagggaaagcaaaagcctgcaagcctcagtgcctggcccgctcctggcctggaaagaggaacagagggaggacggcggggctgggtggtctcccgatcacaagcatacatttcccaggcatctgggcagtgatggaactgtcaacctggaagtcacctcgaaggagaaatgaccgtgtgcctcagatagaacagaccccgggccccagggtggagcacgcactatccatgaactcagggtcctaggggtggagtccagggccctgggtggcagggccaggaggagcagccgggtctacacaggatggcaccgtgcagtggtggtgacgctgagcagggcctggtgagcacttgctgggtgatcaccacgtgctggcgctggcactggcacttcacagtcctcattgcttttgagttttgggagaggtgcagtgaggtgacctgcccagaggagggaggctgatctgatctgacatctgccataggcctgtcctgtctcacattggttcctggcctgtgtactgggctcacctggaggctttaaaaacatactgaggctcaggcttcaccccacaagtttctgattcaagagtatgtttttgcctttttgttctcactcccaaagtgtccggatctgtgctcagagcgcaaagaaatttactgaaaaaaataaaattaaggaacgacagctcaaagagccagcaatttatgcaaatgaatgcaaataaatacacacttccatac

SEQ ID NO: 3117 - DNA, 5813 bp, Homo sapiens
cccccaaaagcacgcaaacaggaaagacttcagccaatggcaggccgcctatgcggggcggggccctggcgctagccaatggtaggcagtgtagggtgaggggcggggcggtgcctcagctgtgggccgcgggaggaggggcaggctggggcgggggacctgtcgggatgccccgacttcaccaccttccccggcccccattggtctgctgtgggtcccgagagacttcaggagagttatcttcagcctctcacttcccgttttcccttcctaggcaaatgttcttttcagcttcgctaatccccgtggccagtttgtaactccctagagtccagctggagccttcactcggtcctttggcccgccccgccttgtgggggcaggtctggaggtctgaagagagtttgggctaatccaggccccttcccggctcccacccaacccccactggccccaggagacctggctggagaagcccatgggttctgaaacctcctttctcacagtctgtgcccaaagatgctgcccactcttagtccgagtaagtgtttgccgttttgactctcctggggtcccaagtcgtgtccggcccgccccaccagtcaggaagattccatactgagtaggaaggcagagcaagggtctggtccccccaccacaatgtgtttggatccctagttcttcactggcaaaatctgccctgtctctcacaataatgtgagtctgagcagaaaatattaataataaacctaacactcattgcacgtaccatgtgccaagtactgttctaagcactttcccacatgttaattaaaatagatgtcaaaaagtttttgaaagtaggaagtatagctaaatgattatcactgctgatagtcacaggcattgtagggccccaatcaaaccacagtctctcttgcaccccaggagctcactgtcacaaggcagacagatgcacagttgtcagtgagaggctataattcctaccagaagagggaaagggtgggtcagagattggttaggaccacagggatgattagcattggaaggcctcctggaggaggtggactgctgtaaacaatgtctctcaattctccacccatgacctttgtcccttgggctcctgtcatcactgactcacccatactgctgcctccccctcaccaacttcctggcaggaggcaaaagtactggccagtgggagtctgggaaccagcacagggaccagcccagctctaatcaccctccagagatcccatccggttcttccttccagggatactgggagggtggggcacagactcctgggctgctgcctgctcagaggcctctgcctcctcctttccctgctctggggtctgggtgttctgcactggaagagggctaagccactggtacacgtgggcacaagggaggaagctgctctggaaaggagaccaccagaggggaggcagaggagcaggccatgtcttcagggtccacgtcctgcctggctctccccatcggcgtcctagaggagggagcttgtgggggcactgcatggagctggagggccctttctgctgtattgtttgggctgggcctagtctaatccccccatctgccttgcggactaagtggggcccacattcagggagacagtgtccctgcggagttagtgatggaagcagggaggccctgtctaccagggctgggaagggcctaggtgctgagtccagtcaggtgctgagcatgctaggtagggatggcgtctaggctctgggggattgactacccctccccagagggtcttggcaagggttcctgggctgtttccagaggtgtgtggcacccacctcctgagtccaccaagccctgagggagtagggagccatgggtggggcagacccctcctcattcccagtccctcccacccctgaaagctgatagccgtggggccctgccaccgcccagggagcgtgaaatggggtgtgccgctgggcagccacagtagctcctaccaccgcctgggcctattgccttttctccttgggcagcctctggcatcctgagctgctctgtagatgttggctgggctgtccctgccagcttccccagctttgcctggcacaggccccaacccaggctggaagatgtctccctcaggcttcagctacccccacacccaagaaaaagattcagagtggtcagctcaagtgcaggcaccctaggcctggctttctgccttggagttgagggaactctctgcaggcagcattgctgctctctcttagatggcagtagggtggagcccctaggaaagagttggcacccagggattttggaaccatccctgtccaactggcatgccctgactcagcacctgaatccctaaggtgcgctgaggactaggctggaccttgaccttcctgtcctcaggtcttttccttctttgctgtccaaccccatccaccttctgtaccttcttgcctagaaccccttcacctactcaggcagcatcctggcctcattccctaaactgctgtcttggagcctgttcaggcttcagactggatggccaggccagagttctgggttgggtgctgagttctctctccctgggggaatgtcctgagacccttgtgtcagccccgacacccagaggctggtgatgagactagtaggagtgacctttgcacctcagcctggtaacaatacccaagacccttgcttcagggccaagcccagagtcctgggggtccaggagagaaaagaactgaaacaggaacccggcaccttcccaggggctgaggcccaccgctgactgcactcaagggaaggattaggtctggcttagctcagacaatgtggtagaatgggggcctcagcactgcacctgcattcccttcccccacctcaccatgaggtttgtggggagagccaggtagagctgggaagctggaggcaggtggagagaggggagcagctgcctgggacccagtgggctgtggggtggatccagctcttcttccctctcgccagtaccccccttcctcaggcccttgggccctgccacccaccctgagctgaaagtcagtcccactcaggagattctgggcagccagaatacccctggccccggcccccaacatactcacacaccgtgggccccattcctcaccctgtgggccagaattctttcaggcagtccttcctagtccctcactgccttcccagacactccctcttcccctggtccaggttctctggcctaatgtgcttccatcgcagcagcttgagtggaaaggatggggtctctgggtttttctaccactgcatcttctgtcctgctcctaccaccctccacaccttcttctctagtcacctcctctttcaccttggccatccaggctctggagcagttccgggaagacttgaaaaggggccttctggccattactcaccttggccaccaggtgtcagactttgcccagctgggtgggaggaaggttctagttaaccatttccaccccatcagtctggcctcagagagagatctgggcaagttggggaggagcctagaggtgaccactgaactggcaaggctgagggaccctgaaggttgagactgggaaaaggactggaactctgactctacagctttcccccagatccccctcactgccactgcccccacaccaccccactgacaagggctttgtcccctgctgggaagttcaggaacgaggctgagtcagggagcttgagaattgaaggaacaaaggcagggacagttgtagctccacagcagaaggggaagctgagagggagctgcccatcggagtgcccagccaggactgagtcactagcccttgccctctaggttaaggggaacagagggcctccctttgcccttccccatttagggtggctgtggcaagtgagagtgtgtgtgtgcatgtgtgtgtaaactcagtgcttgaatgagcctctcatatcatgaggcggcctgtaagtcttggacggtaggtcagtctttgcaaaagtggaaaactggcaagatctgagtattgtgccatctcccatcagagcctcctctagccccacttcccccagaggttgcccctgcctcaagtgatagttctccattttatgctcattctttcaaacataggtgtgtttctaagcactcaagatgatgacaagatttctaatccttacattctatctggagatgatggagaggagggtcttctcttgcccactctcccgatccttgtggggacatgaggaatactagagataacacaccctccaccctttgacattgcaatgccttagagtctcatgttagcctctgggcctctgactctgaagccattcttaggaggtagaacctcgataaccaacaaaactcattggatctcctgaagcagctctggatggaaaaccaatgactcactcacagaaaacgccagtgccctgtgatctaccaggtgctccctgtgctgtggtgctggcattttcacaagatgcctgtgggacacagtgccaaaacacaaacgagcagctcacatcccctgtcaccatcattaggggctatttgagagagttcaagaactcacactctgaagtgccctctctgatggtgctctcatccccctctccctccaccacgccaccgccactgtgggagcgttctgcgtcctcagcatgcaggaaccccagcgctccccattcaggattcttctcccagcctattcccctcctctgtttccctccactgaccactcttcccttactgcctggctctggctcccagccaatttccagtagtttccagcagcctagaatcccccttgattctctgccattcttgccttgccaatcctcagccttggaaaatgccctcttctccagtctgtccctccctctgaaatgctaaggaatgtcactgcccatggtgacaggtccacggcaaaggtgcctgctgatatcaccgggttctatttggctgcccagacaccctttggctctcctgtggttgtctccttattccattctctaaacctccccatttttctccacccgccccctactcactcagcaataacatgtttagatcacttctatttaacaacaacaacaacaaaacaaacaaaagccttctgtgatcttgctaacctttctagatggtgtttttttgtttgtgtgttttttgagacagtctcgctcttgtcgcccaggctggagtgcagtggtgggatcttggctcactgcagcctccacctcccaggttcaagcgattctcctgccttagcctcctgagtagctgggattataggcatgcaccaccaggcctggctaatttttatagttttagtagagatggccatgttggccaggctggtctcaaactcctgaccttaagtgatccgccctccttggcctcccaaagtgctgggattacaggtgcaagctgctgcgcctggtctcttaaccagcaaactctgagggacttgatttaccccttctacttctgcccaccatggccttcattaatctcacaactcggtggctgcctctcacctgctgtttcacaaaggttgcctgagacttcctgattgccaaagccactggattttgctcagcattcttcttgagctcctctggggcatctgagactgttgatcagctccttccttcacctaggctggagtgcagtggtgtgatcacagtttactgcagcctcgacctcccaggctcaagcgatcctcctgcctcagccttccttgtagctgggaccacaggtgcgccaccacacctggctaatt

SEQ ID NO: 3118 - DNA, 3165 bp, Homo sapiens
aggctttcaagggctgcccacctaccgggcacgatcttcatcggggacggtggcaggagcccacggggcagacggagcgggccaggggtgtgggaggtcacaggcccctcggaggaggcacaagccactggcggcagcgtcgggtgggaggagggcacggccgtgctgctgtcagcagcagcttgtgggggaggggagcagtgggcaggggcccaggggatataaatatccgaggagggcgcgcaaggaccgtcaccacccagacttggaacatgacgcacggcgccagggcacccaggccccgctgcagtcaggtctggctggacggtgccacccgacacctcggtcccccagctcccacagggggttctaatataatagagcagggcgcgggaggtgcgggctcacgtccctgcaggaggcggtgcagtccccacccacctgccctgccaagccagggggtgctcttggaaaggccacaggggccaagagaagaggccgcccattctcccagagggccctgcgcaggtcactcaacacagcacctggccccaccggtggccgggacagccaccccaaagtcacgcgcaggccagagacccaggcagcccgaaaccagggctcaggcctgcgcctgccccacagcacagcctctcctggggtcccagggatctgggatggagacgcctctcctgggccacggcaggagactggcctggctccacccaggagtcccgaagccctgctctgtggaaggcctgggtcagagagccgggccacaggcaggcccacagcatatcctatgcagatcagatcccaatgcagccggggaaacaggacgtgggacacgcacagtcctgctcctcttcctgggacccctgtctgctgggcgcacccctcaggcccaggagaatgcacgttgacggtataccccattccacagcgtcgctcctggcaccacatggaaccctcagcaaaccccatgaagtcctataccatgaaggcctcatacagaccaggagcctgaggcgccgcctgctgtcccgcacgctgccatctgagcccaggtggcctccagtgtagttacctcagcccacagcaaggcacagtgaaccagcctggccccgggccactgggcaggccacccaggtccatgctgggaagcccgcggacaacaagagggccgggcccaccccagcctcctgctctccagccccacacctcaaaaacgtgcggccgagggaaatgcctgcagtggcccactctgggcggccaggggtcgggcgggcccaggcagccctgagggtcagggatacccaggcatgccagaaagggcccaactcccagctgagcccaggacagcatctggccagcagtgggcaggggccgacaggccggacgtttcagcccactccctgccacgtgctggggaagcctcagaggagcctgactcaatggcctgggtgagaaccagctcctggcgggaggagtgccccaggctggcagcgggcagttcttctaccactccacggaggtccggacaggcctgtgcttccgggacacacatcacacacacccctggggcagctccgagagggggctgtgcctatccctgcatcccaggtctgacggcacagaacggtggacaacgggaagagacaggtctgccagaggcggccccggccctctcctctgcctcccacagcccccagctctgcctgccctaccttggcccagctgaatcagctcctccatgctgtacctgtccatggctgccacacaggccaggctgctccgagagccggcagggaggaaggcgaggcaggaaggagggaaggggtgggaggcagagggagggcccactcatgccctggtagcagcggctcctcctcgcagccaccccttagtcagtaagcagagatgaagcccagccgactgacgggtcagaccagcccagcagacctgcctgggggtgcaggggactggcctgcctgcaatcccagagagccctccggccccagcccacgggtcttccctactgttcctgccccgcccagcagaccccccgcccagcagaccccaccctgtagcctccccttcccgctgcaggccccaccagcccagccctgccctcccaccctcccacccacattccaggcatccatgtgcccagcggtatttcaggagccaggcgggagcagagccccaaactgcccaccacaccccactccttgagactcacattcctcagccccaaaggtggtctcttcctccacctgagtcctccccaaccagcacagccccaggcatctgtccaggggcaatggtgacacctgcctcccctctccatacctctccacccaggtgcttgctgaccagtgaagtgcaaatcaaatcccatcgtaactaccccttagaagcctgccggcgatctacagaaatcccgcaaacgggtgactcggccaagccagtgatccctgtggaaagctggccgggccatagtccctccacctagagcaccctgtggctgggaagaagggcaaggcagccaggccacctccaggcttcctccttgacgcagggccacagagggtcaaggggggaggtcaaggcacaggcgtgtcctccgtgtagaggggaagtcatggtggctacccaacccctgccctttgctgtgggaagcagctctaggtgctgtgcgtgtacagcgctcaccgtggtggcggctacctggcccctgcccgttgctggtgcatggacagcgctcagctggcgtctcctccacacaatcctcggttccttcagaattttgagccaggcaaagcatcgccatttgcaatgtaaattagggctgggcggtagctataatcccagcactttgggaggctgaggcaggcggatcacctgaggtcaggacttcaagaccagcctggccaacatggcgaaaccccgtctctactaaaaaaaaaaaacaaaaattagccaggcatggtggctcatgcctgtaatcccagctactcaggaggctgagacaggagaatcgcttcaacccgggaggcggaggttgcagtgagccaagactgtgctattgcactccagcctgggcaacagagcgggactccatctcaaaacaataagtaaaataaaaatgaaacgtaaatgaaa

SEQ ID NO: 3119 - DNA, 4236 bp, Homo sapiens
ctgccatagtggaagtttctcaagaggcttggcctctgcaggaggcttctgcctggaaacagtgggcggtggtgtgggtgcaggatcttcttgatgctgatctcctgatagtgagacctcatgtgatctggttgtctaacagggtgtggtacctctttcctctctctgtcttgctcctacccctgccatatgaaacatctcattgccacttggccttctggtatgattaggaagggcctggtcagtgtgggcctggtcagtgaactagtcagttgggacttggtcagtgaggcctatttactgggggaatggtcagccagggtctgcttagagagggtctcattagagggatcgagtagtgcaggtcttggtgagtggggacctagtggcagacaaatgtttggtgtctggtcagtgcaaacctgggctgcagggcttggtgagtggagacctggtcagctgtggcttagtggtagccttgtcagaatgggctgggtcactggtgacccggtcaaggggtgctattcagtggaggcctggtcacatggcacctagtcagcagggcatgtcctcatcagtgagacccttgtcagtgggaccctggtcatggcagcctggtcaggtcagtggaacctaatcagtgggggcctggtcagagaggacttgatcagtggtggcttttgtagcactggtctatggggtgacctggtcaacgggggtctgagcggtacatgcctgttcagtggtgcctagtcactaggttcctggtcggggcatctggtcacctcaggcctggttagtagggacctggtcactggcagcctgttccctggagacctggtcagtggggcttcatctgtggggccaggcaatggggtcatgattggtggaatgtggtcagggaggtcttgtcagtgaggccctggtcagtgaggccttgtcagtgaggtccttgtcagtggggtcctggacactgtgggcctggcagcgggaatctagttagtggggcctggtgatgggggcctaatcagtgagagtgtggtcagggaggacctgatgtgcgggatctggtcagcagggacctggtcagtggggctgctgagcactgctgggaggtgtcaggggaaatgcatgttatcaggggccctatggacagctgggatggcccagtggtgtccaatggcccagtcaaaagtggacaaagcaggtgtttggatggacctgggagatcttgctcagagattctgaaagaacaaaggtaaaggaagggccagagtggctagagagatggtaacagtctatgggctgcacaggatggaggaagccagggaacaggcagggtgggcagtaggggtgcagggagaggcaggtgcatgctgggaggtcggaccctgtgagggctgtgggggcgtcaggtggggtgggctccaggtgcactctcagtgtgcactgggcaggtctcggtccaggctctctggaccctggtcgggtgatgtggtcactccctgggggactgctgtcaggcctagccacccacccttggcagcactgtcccatctcaggactggactttctcagatcctgcagagggcacagcctccagcccaggaggggcagccccttggtgcagcccaagctctccatgggcctggagcatccctgccagccctgcgctccctctactcccaggtcccgcttttcaagtgtcagccagcagagaggctccgtcctcccttccctatgtgtctcctgggctaaaacttggggcgcattgggacagggatggtgctttcctcaggcccatttagggaggggactggctcccagcctggcacaggtcctcagctctgccttggttgccttagagtgacatggatcagtcagtgccctgaaggtaaatggaagagactgtccctgctgtgtgggaggctggtctagggatggaggacttggcaggtcctcccagtctgtcaggcctggacagcactgtcctgtctcaggactcagaaaatccggtcttgggatgggacggtgctgcccagggtgggtggccagggcttgacagcagtcccccagggagtgaccacatcagccaaccagggtccagggagcctggcctgagacccacccagtgcattgagggtgcacctggagcccaccccacctgatgcccccacagccctcgcagggtctgacctcccagcatgcacctgcctctccctgcaccccagatgtccaccctgccttttccctgatttcctccatcctgtccagcaggatgggctggtcagtgggatagcctctgtgcacattttgtggcaagtaggagtgacacatcattcctgggaggccccgtggttcctgccaaacccaaccccagaattctccctgaggtggttttaccaaacccataacccagaactgctattgtggtttgggggtcagcacccaccagtgccagggcactactgggaggctgggacctgaccaaagcccatggtgtctgtggcctgaggacagggtgtcttggggccatgaggacaggccaccaatggccgttgggtcatagggcctgagccccagtgtttgtccttccctggctccttctggttcagtcccatcagggctctggatcccaagacgcagcatccaaggttccctccaggaatcctggtggctcggcttactttgtcatgtttcatctgatagcaaaaatatcagatcggctgcacagaaaaatggctcaaagtgcttaatgaccagaagaaatctgggagtagcaagaaggtaatgtggagaggggaggacctccatgactggtgtctgcagagccaggggtacagggacccagtgcagtgacctggcaccacctgcctctcagagggtgggtagcacactgtccttacctgggggacagcaggcctggtcaccggcttttctccctgtccctgcaagcatcacattgctggaagagaatctcatgccagagcttggaccatccctagcttgggggttaggggttgtctcttggtgacctaaatgaaaaaataggtccagatcagagttcgtgatgcatagcactcacccactctttgaatcatgggaggggaggcctagtcctaggtaaacctaaactctttgaggaaccacagagcccaaggctggaaacctccagaatcctccagcccctgatcccccccccccccggggacctctgtggcctgtctcaccagagcactcttctgtctgtagaggtctcaggtgctctacaagggagtcccatttcaggtgtggggctgggtatggtcactcctgctggatgtctagaaggtgaaaaccaaggacctaggaaaataccagatacagcctttccaccgtcatccagagcaggacaaacacgccaggtggtgtcaggagcccaggtctccagctggagggaatgtcaaccctgcagtgggagcccatcatgcatcctaggcacagatgctaacgtaggcaccgcaggaatcccagtgaatatattgccaccatcttggagctcagtgccctcatagtgtaacagcaccagcagatctgcctgtgcacagacttcctgtactacctcactcctgaggggagatgcttctgcagggcctgcgacctggtgcacaactttagacaccatcatcctggagcggcactgcaccctcactagccagggtgttgatgacttcctcaatgccaaggccacgttcaagattttcgacttcagtgatgcgtttgtgctgagcaagccaagagacccaagcctgccttgctgccacttaggatatgacagcacagccagtggcctctactggatcctggtacccctcagaagacacccagacactgggagtgctgccacctcgtggtgcaagagttctgagggacggcaattctgaagacattgaatgccgttttgcacaccctggtcagaatgaaacattccttgggaactcgggccgtgagaagcatccttcctgatcacctgactgtagaaacatccttatcgcaccctcccgggcaaaggcccaacagcctgactgcaggaacatccttgccatatcctgccgggcagcaagctctaccgcccacacccctccttcccagtcccatgatcaccccagcctgtgagaggcagttggtgctggcagtaagctggtttcctcctctgcagggttttgctagtaataaaggtgttgctgttgaagccgt

SEQ ID NO: 3120 - DNA, 2908 bp, Homo sapiens
tggcgccggatcgcgggtcacctctgctcaggccccacagacccagccgtgctcagaagccgcagcaatcactcaccacgtgccctgacctgccctctcctttgccgcggctccaattcagggcccctgacctcaacacggcgaccttcgaccttctaatctcccagggccttgctctgtctccctcagaggtgacctccaccctagaaatcccagcccccaggcctgcaccccagtccggatgcccctattgattctgcacctttccccacggccctcagcccctcctgacccagctgccattgccatccacctgcaccctgtccacatggctgtccccactgtctgctccacagggccaggctgtgtgttacccagggcaatatccatggccacccggcacacaggaggggccatgactattgactggctgaatgaaagaatgaatcagcaaatgagtgagagcagactgggctgaaccctgtgaggagacaggccgctgtggagcccctgacactgctccacatcaggcctcactcctgagccaattaaggaatcatgacctctactcaaggaggggccgacagcagctggacgcaacacttaggaaaacgaaaatatttctacccatccatccacccacccatccactaacccacttacccaccatccatccacccacccatccactcacccacctgtccatccacccatccactcacccacttacccaccatccatccacccattcatccactcatctacctatccaccatccatctgcccaccatccatccacccatccactcacccacttgtccaccatccatctgcccatctatccactcacccacctgtccagcaaccacccatccacctccccatctacctacccatccactcacccacctgtccaccatccactcacccacttacccactatccacccacccattcatacactcacccacctgtccaccatccatccatctccccagctacctacctatccactcacccacctttccatccacccacccacccgtccactcacccgcctgaccaccatccatccactcacccacctgtccaccatctactcatccatccacctccccatctacctacgtatccactcacccacctctccatccacccatccatccatccacctccccattgattcacccacccagtcacccaccactcttagagatatccattcttgtgtctggcactttgggtgagggaaggcaaagacacaagatgtggattttggccccaaggattttgaccttgaggagggcaatgagcggcagacacaactgggaaagttgagggatgagaggggctccctcgtgaggccagcagctgagacggaggtactggggggccagcgctgagacagaggtagtggggtgtcctgcaccagtttctgcagcaggggctgatggtgagccacatgttcagctccaggactccaaaggaccacgtgttgttcctcaaacaggggacagcacataccccctcatgtcctgaccacccaccagtctcaacagaaaaaaggctccttaccgtccctcgtgggagtggtgtccgggcctccagctggaagaaagcagcagggtcacccaggacctgcggctgggcctgagccagggtgccctcccagcccacaggagggtgccctccctgcccagcacctgcccctccaagcctgtgccagggtacgctccctgcccagcacccggccctcccagtccacagcagggtgccctccctgcccagcacccggccctgccagcccacaggagggtgccctccctgcccagcacccggccctcccagtccacagcaggttgccctccctgcccagcacccacctctccctccccaacacccggccctcccagcccacaggagggtgccctccctgcccagcacccagccctcccagtccacggcaggttgccctccctgcccagcacccagccctcccagcacgcgtttgctaggatgccatcccctgcctcctcctgtcaggaccaaagcccctgaaagttaggatggggctgcatccgggtgcctacaagcacacctggcacacagtgggcaccagctcagcatctgctatgagactggcagcctctccctggccagatgaagggactggagtgggattcactgtctggggtgctgcaggggctggccaggcctaggagggggccggtggcgagagggagggagtgctagagggaaggtgggagggctctagaaggaaggtgggtgtgttggaaggtgggagggctccaggagtcagggctgtgtcagtgtgcagtgttctgccatggaggctcccacggatgtcacaggccgtttcggcggcatggggcttctacccgtcctcacctttgccacacgaaggtaaaccttcccggggccctgcaagcatggccgcacccacctggatcagagcggccactcctgccacccagaccattttgggaaagcaggaaaggggctggcctgtcctggaaggggcaatcccaggtgtgtctgaggagccaggctggtgagcaaggcccgtgctaagcagagaggatgcatttcatcccaccttggtgtttataacgcggggtgcagagccacgggacagcctgccccccagccggggccgtgctgtggacgtcacgtggccctggagggcctgagcccccctgccgcctcgtcccgtcaggcgccttgtcttattatcgggtgtgtgaggtgacatttatctttgtaaacgttcactgtgacatgacccaccaggagcccctcacacgccatgtgttcatccactttcagaagcttgagctcacttttctttaaacccaaaactgctcacaaaagtattttactaaacttt

SEQ ID NO: 3121 - DNA, 3222 bp, Homo sapiens
cctgcagatgcttgctctgggcatgcaggggcccctggggaaggatccgcgcctggctccctctctccatctgtccctcgttttggacgggaagtcgactatcattcctgacgttccagtgtaacgtgttatgtttctctgatggctttggggattttatcttccgttgccagtttcttgactatgatatgcctactttttaccaaatttggataatttttgccaatatttgggggggttgccccatgttctttctcctctcctgtggctccacggacatggacatcaggcctctccctgccttccacgagctcctgggccctgtgcttctgtgtggtgttttctaaaagcctctcatctctagaatgagtcactgtggctgctatgtcttcgtgttcactgccttttctttcgttcttcactctgctgctgagctcagccaggggcatttgtgctctggagattttagttcttgctctggagtgggcctggccttcctccgaggctctgtgtctctgctcagctctccagcccgcctgcctggcaagcacgttttcctgtgctttccggtcctgatgctttcctgcgtccgtgtggagccagcgcttggggtgtggtgtgtagagaggggaatgtggacatgcagtgcgtgctgtgggggctgacgggctggggccggtgtggatgtcgtgtcgggggccgagccaacgggccagggccagtgtggatgtcatgttgggggacgacggactagggccagtgtgaatgtcttgttgggggcccagctgacgggccagggctggtgtggatgtcctgttgggagccgacaggctggggccattgtggatgtcgtgttgggggctaagccgacgggccagggccggtgcagatgttgtgctgggggccgacaggctggggccagtgtggatgtcctgtccagcaaggccctggaggtggtgtccgggcagtcttgaccgaggccggaaggatggtgccgggggcaggagcctgactgcctcggaggaagggggtcccggggcggagctgtggggtggggagcccattgtggatgctggctgcttcaccctcacccccacgttctgtctgtgggtctccgtgaggctcctcccagggcggccctgccacatgatgtagctgaaacccagtcctctctgcacaccagtgtttctaggaaaacacttcctgtctttctccccaagacctccaggacgtgggcctgaggtcatcactgcctccttcagttgctgctgcccgaggcccccaagagtgacccacatgagactgcggtccagacgccctccctgcctctgagggcgcacactgtccagagcgggtctgtgggtggaatgcccccagcggcctccgggccccttgtctgtggggcctgtgccctggtgctgccggcactgctgtcctcacgcgagcgctggagatatgagctttcccaggggggctcagcagtgatgaaggtggggcaggagctgtgtgtgtccaccataggtcctgacagagatgaagcagaggccacagggctgccctgccccctgccgcgggcatgtggggtgattcccgcccacttctcaggtgtgccaacccccacgttccttccctgtgagtgtgtgagctcacatagcccctggacacaccaccctccacgtggggtggatcgtgcctgttggccacactgagcacacctggaaacgccgactgccgagtgtcaggggagggtctggaaaagccgcgagtgaaaacagactgtcccccgagactgtgtggtgaggggaacacctgattctgcagcctgggagtccacgccgacatgccgactgcccacacaggtgtcacagcagggatgtggatgctactgtcacgtgactttagctctgccttcaagatgagtttgcagcatggcagcccctgggtggcgtctccatccccgacgctgagcagtactcatgctctcagagctcgctgcgcagagaaatagccgtaacagacccggagctcaatattcaggggatcccagagctggctgtgcagagcaatggccataacagacccggagctcaacactcagaggatctgcgaggggacacccgggaggtggctagttgccaggagaggggtgttcctgacataccttcatttgctgccagggagccaacgaggcatcccaaggccgcaggcctcagtggcagagcctgcacttgtccctctgaagctttttcaaacatggtcacaaaagatgttttccccgtggccagagacatggagaagtggggtctggggctctgcatgtgggcggatcacagacaaggccacctggtgtcccggggccatgtgggtgtggcctaccagtgcccagccccgccactggcgcgcagcgagagccgaactccccagcccccatcatccagccccaggggcgtctgtagcccacagcccctgttccgtgatagtgcaaagtaagatttgcagtgctatttcataacttttcagcttaaaatataacctgtaaaaatgaaggaaacttttaaaagctcccagctctctctggggccgccattagaagcccctggggtggcagagggcggcccggcgcagagctgagtgacaggcagtcaagatggaagcgctttgctccctcgtccccgattttaacagcgaacttaatggatttcctgtttctaacgtggatggtggctgtcatttttgaaggatccatctgtgctatatttaatgactctccctaagtaactaaaatagtttccacagagttaatgaggcctcagctggcgttctctcctacagtggccattgcaatgacttgcacctccaaagcgttgtgttaaatcacgtttcttccttggtcagaggcggctcagcccacaacccactggcccctcatccctccctttgccggaggctaccccgtgtccctccctgtgtcctgagggctgcccccaccctgcacaccttctgcaccctccgagcctctgcccctcactggtggccaggcagcgcctgggtgtcacctgccccagctgctgagtctcacctgccccaggcccccaagtctcacctgctccggcccccgcgtcccacgtgctccggcccctgcatctcacctgctccggcccccggtgatggtgctcatctcacccgcctgaggcaccgcagtcgccccaccctgcgtgtctc

SEQ ID NO: 3122 - DNA, 6377 bp, Homo sapiens
acaccctgacaaacccggcccccacgcgcagcccaagccggctccgcgcagccgggagctcgccggccgccgggcctcggcccccggccgccaaggagagcggagcggagcccgcgccgccggccggtcgccccgctccgggggacactttaagggaaaaaccccagcacccaatccccacgcttgcaccccgagagtccccggggagcgggaggtagccccggagccagcgggcgcctggctctggccccaaacttaccgggcgctgcgagcgccgctgccgccgctggaggacgcgccgccgccaccgccgggtagggcaggctcgggccgggaggagcgcagcgagggcgccgagatccgctcggctccggctcctgctccgcgccggctggggctggggtcaccgcgctgcgccggcgttgctcgctcgctcggccgcccgatcgctgctcgcccgcctgccgcccggccgcccgctctccccggcgcccgccgccgccgctcgcttttttaatgtccacagacagtgaaaaggaactcggcgttagggggctgccaccgtgtcggaggcgaggcgaggaagggagctggaataacaaagggaggtaatggggtagattggatacctctggggtcttggaagaagctatgacttatttactgtctactatgtggtggatggtgtttgaagtgaattgaattaggggacacccagctggcatctgctgcagaactgatgactcgcttgctggtgggcagaaatctccataatctttctttagcagatgaggtcactgaggctcagagaggctgaagccacttgctcagagccgcacagcaagcccaccaccctgaacctccagattaccaactcagcattgtgtcctgacagtgtcatcatagatggtcaacaccgtcacctgggcagcactgaagcccagagcgggagagactggctcaagaccatgggtaagtcagcagcaaagctggggaaaggaaaccaccaacctgagagcccctggctggttcccaaatccaggcccttacttctcttccccaccatccagggtggggggcagacacccagtgaaatggcctgccccaaaggaggggagccttgccgagccaccccaggccacctcagacccacacccccagctcagcggttggaggggctgaggaggggctgagccgccaccccctccccaccccagtgccagggccccagccttgcagcgcttgtccccagcccagatgagcagggcgcccttatcagatctccgtttctgtttctctcctctggctgcttctgcctggccctgcccccaaccccggtggccttttcctctctgaagtgatgttccttttcctgtcaccaacacacacagcacacagagaagtttgtttctgttgctttaaaaaagtttccttctggggaggagggcaaggggttgtttactgggcctgcaaagcctcaccgtgggtgtgggcatgggtgtggcatgggtgtgggtggcaactgggtccctgctggatttggggttggtggaggctgcacccacgaccctgggcctctggatcctgtgcaaaagccaggaacgtggaaggaaaacctcctgtgcaccctgctcagggctgggctggttcacccaccgtccagccacactcctgcagaaacctgggaggtcaggggttttgttttccattttccacaggagacagctgaggctcggccaaggttgccagggtccaagcctatggatttgtggtctgggctctgccagtggcatggcactgtcttcaaagctcccaccctaccatttttcttacccacacagggcaggctcgacccagctaaggaacacagcttcctgaagcatctgtcctgggccgttggcccttctgtggacagggcttgagctctgtaggctggatttgaatttcaagtcctcctgctgtgtgaccttgaacaagttacttagcctctctgagcatcaaatggcttaactatcaaataagaagcacagagaagtccccaagagccagtagactctggaggctgtgagaccggggactggggctcctgcatccttaatgaaggtttcagtcttgagtcgcgtctgggagacctgctgaagcaatggggagctactgtaggtgggtaaacaagggagagtgtgatggaggccatgttctaaaaggattctataggcagcagaagggaggagggctcaggggagaggtggaggagctgcaggggagaggtggaggctgggaggccaacaaaggaggctttgacttccttttcagaaaaataaggccacccacctcccaccaggagcaagagtcatggagggagactgtctcagctggcctggcctggctcctgcccaggacagagatcccggcccctggactcctccagcagcccagtgtaggggaggagtgccttcctccccatgcccagggtagccccttgtctgagagtggtggttgtggcaggccctgctgagaactgcagtttcatttcccactgacctccacccactggactctcccaggctcttgtttcaagctgcctagtgctaaccccagcccttgagccagctcgctccagcctttacctcagaccagggcactggggctgtgtgtaggactcacacctcccaggtctgtctcttaccttgggacccttagggcaggaacacgggaggggggctctgatgtatgatgtcagggaactccgagggccacctcctcctctgacaaaagcaccttctttgtcaagtgagtaattcctctgacacatgtcgctctgacatggcacaggtcttcttaaagatgaacgtcctccatgacctgtgtgggtttcctgggaataacccacagtagtggtcaaggaggccaggaaagaagaacttctactgtttcccccttttccaaatttgttggatggagatatagagggtggggccaccttattcttcaaaaggatttttaacagcagggaaaaggaagggttgagtctcacagtccacactgcagccaccataaccatttcccagacaagtaaactaaggcccagggcgagatcccaggcttccttactcaacttccagccagggcagagtctctcgaacgaaagaagggacgctgctgcatggctcacgtgctcagccctggtaatagaaatacgtctccagtgagatctaattgtaactctcattgggacctgcgtcacctacaaggctggcagccagacaccctgagaatgcaccagctttactcttttttttttttttttttttgagatgaagtcttgctctgctgtacagtctagagtgcagtggcatgatctcggctcgccacaccctctgccttccagattcaggcaatctcctgcctcagcctccctattatatgggattacaggcatgcatcaccacagcctggctgatttgtgtgtgtgcgtgtgtggtatttttagtagagatgggggtttcacgatgttaaccagtctggtctcaaactcctgagctcaagtgatctgcccacctcgacctcccaaagtgctgggatcacaggggtcagccactgcacctggcctacgagctttactctttccctgggtgatagggtgatggcagtctctggggcagggggaggagtgctgtgccacatgccctgggcacctgctttgctgcatgtccttctccaaggctctgatcctctctgggcctctttatttcttgcagtgcctgcctcatgggattgcagggaccaaaggatttgggtgccggcaattggagggccgttctgtgggccagcattgggcaggcgcctcccacatggttctctttttgtcctcccagtagccctgtgcatcagacgcagagctgtgctgcatgcacccacttgccccactcgcctcagaggagcgttccttgcaggaggaatttgatagattttaataccagggtcccctgctgaccaggctttgcatttccttacctaccctcggctctaactttggcctggcgaagcagggcaccacaggacatcagggtcacacatctcagaccacaagagcctcagcagtctccaagacaaagtagagattgaaggccctgcttctccttccagagtactgaggagcctcctgccttcctgagtgaggctgggggatcaaagctcaacaatagtgggttgtcagaattacgtttctagaaaggaaaatcaagactgatttttatggggagtatagcattatgctccagtaatagtactattagctccattgcacagaggaggaaattgaggcttagagaatttctgattgtctaaagacatctttcctggaactggtggatcagggacaagaaccctgatttgttgatgtcaaagcgtgtgtagtttttccttttttatatcttctggatcagcaagaccaccgcatttggggaacagaaggcacaatggggggagtggcacagctgcaacgtgaagggctccatgtggggccttggagacaccaagctgccctcctcctggtccgagctgcccacttcccatccctcatccctcctccttcagcttagggccagctgcacctggctccaggccctccactcagtgtggagaagtcctggccctcctcaccaccttcccacagcccctgctcagctgcagagcctgccgtgggccttctaaagctgtgtactgctcccaaaggtggcagcaggcagagccaggccttgctgggggctccttcaccccttggagtctgggcctcagagtgacgtcccaggctgaggctcattgggaggggtcagcattggcatcaggagactggggtcaagtctgagttctgacagtgactgtgtgaccttggacagtcacttgccctcgctgggccttggttttcctgttgtgaagtcatatggtcctgggatgtgggcaagggtagagaaatgagacacttcagctccccactcacaagccgtgccccctcaggcccaccacttaggttttcttagcccctccattttccccggcataaaatggggataatgaagcccattccttctgatcgttaaggaaaccagcatttactgaaggctcggccccgtgcaagatgctctctgaagcattttctctcatggactcccatccatccaacaatgaaatgaaatgtcttgcttttggtctttcatacaatgtctctttgcagcctctcctggtctgacagtctcagatgcagtcatggatggctttctggaggaggtggtacctggtctgtgggaagtaggggtcagcatcctggtctctgggagcatctgctccagatggtttccctggggcccccagaagcaggtgtttgcgctaacagctctgcaagcagagagcttcagtgcatggcccttcttgcccttgttcccaggcacatgctgttcccctggggctgaataccccacttacttgtaaatcccagtgctctcctgttcattctgcagtgccagcacaagtctcctccttggggaaggctttctggacttcccagcccactggccattgttccgtcttgcaggtgccccctcagggtgcctgctgtaaccgtcactcacatatctcccccacccaacagagggccttgcttttggtcctggacctgcacctttgactgtattcttagtgatttgtccaagcccaccctgggagataggggcggtgccaggctagcacccagttctcctgggttctctgagaaagttcctaccttcttccctggctcacaagtagtacttaagcagttttggttgttaaagaaaatactgaatttattcttccaaccactcatatatatatataaatcagtgttattgagaaacaatttacaaaatgcacccattttcactgtacagttcagtgaattttaacaggtgtgtacagtggtgtaaacactgccacacccaagatatcacacatttccatcacccctcaaaatctcctcataccccttcctgatcaatccctcttcctgcctcaggcaacatttgatttgattttatcaatatcgattagttttgcatgttctagaatgtcctataaattgtgattaggcagtatgtactttctgtgtagtgccatgcatgttgtatcttgcatgagtagttcggccctttgcattgctgggtagtattctggagaatggacattccacaatttgtttatctgttcaccaattgatagaatttgggttatttccagtttggggattttatgaataaagctgctatgaacattcatgtgaacatgttttcatttaccttgggctaatgcctggaactggtattgttgtattgtcagggtaagta

SEQ ID NO: 3123 - DNA, 2572 bp, Homo sapiens
atttcctggctgagaaggtcccgagataccaggctgactggaagctcccacacagcccatttctgggacctgagggcgcaaggctccacagaggaataccggcggggaatgcagtggagacccccaggaaggtgtctccaagcagaagggagagagaggccgtgtctcaaaactccagaggcttctgaagtccttctggagagttaagaaaatcggagctcatgtgaaagcattcttgtcatacaactgccttccaatggcatgaccacggaaggagaacagctcctcaccaaagcagccatgatggattctgacattttcgacattggtgtgcccagtggaagtttcctacaaggggtgacagctctggacagggcatcaggtgcctgtgtgctcactgcaagtctgcccctggtcggctatatgatcttggtcaagctgctctgtctctctgggtccagctagacaagatgctcactgagtcccctcctgactcatttgtgattttataagggttgcctggtacatgctttctgaaggggagagcaaggggaggaggaaccaatgcagagactcaccacggacctgagtcttggcagggaggagagagcagagggagcctggggctgaggaagactgggggcaggggtgctagagatgcctctcttctttcacaaacctcctgtgctggcctgctcccggagtgctgtccagaaagcctcttcaagaaacccattacaagtgaccacaaagaatgcccgttccaagacatgcattctgagggaggtgtgcaccaaagctttagtgggcaggaagctaccccaccacccagctccagcactgctgggagctgattccagcccagccactcctcatggcttttatatggccctgctgggccctggcgatctggtttgaaaatcatggttctatctcaatccaatcaatggaaaactgaatttcaagtgttatctcccctcaaacaaaaaacaaaacaaaaaaacaacaaaaaaaacagggtgaaaaagagcacacagtggctctcaacacagctttcaccttcctccctggattctgccattcctggatgtgcttacacagagctggctgctcggatttcccctagtgaatgcaaccagttaccggactgcgacaggtgcatggaccccagcaccttctctcaaacacccacgcttggaggaaaacgtggcagctctctccccagctggggcttggcctggggtgcccaccctctttctcattaagcagcccttcatctgagaggtaagaaactcaagttcatccagcgtgtgaacctgcaatgtggggtgtgctaagatccaggcgggctaatgatcactaacaatgctccctatccaacccagcaaggcacacaaggacaaaaccccacctacggatccagctgcatgcctgagttttgagtacacagccaaagaaaaaagcatgctcaggttgtccagaaaaaaaaggaaacctgaaaaaaaaaaaaaaaccacaatagcgagaaagggggtctaagtttcctcggaggtcctcaactgtctgtagaagtgccccacccagaacccaaaataaaatgaagtaaccccgcccctggtcagggtcctgtcttttttattatccagacacacgtatcagagcctgctaacatccagttgtgggaagagcagcaagcagtacaccaggagccacaggaagagaataaaatacatcatatccggctgctggacaagctgtgtcagggagtcactctgcgggctgtggctccccagtgacatggcttctcctgagctgttggccttcctacagaagaaacacagaggaaacgcagttaccaagcaggttcccaggaaagtggaccccacccagtgctacccgtctctccccggcccccactccccgcctgaagacccgaaggctccccagcaccatgtccaggtaggccccacactgtgtgtactggcccaaggcagtgcgtcgggccatccaggcagcccctcgagcttttgcacgtactccgttcatctccataacatcaggtgagaggaggtggcagccccattctgcagatggacacactgaggctttcggggtggagtgacttgcccaaggccatgcaattaacttggcgacagagagggcgcctaggccaggtctcctgggacacctttcttgatgccacagtgctctcagagagtgacacggagttagatactgatcgcttgctgctgtttgttagtaacgcaggggaccccataggtcatctaagggatgaagtgtccctaatagcagatcattttaaatcatctatcagaaagaaacaaagacctctcccattccccacagttttgttttggctttggaatattacctttaaaataattactagatttgatttcagtcagatttaccttcctgcttttattttataggtggtagtgttaaaatgtcatttcagttttgcctggcggatcatagggaagcccagaaggttttgcctggggctggggcctctgcttggagctgcatgtagagaagcctgcagtgtaag

SEQ ID NO: 3124 - DNA, 1936 bp, Homo sapiens
ggcttaacatcacacatttattttctctgttctggaggctgaaagtccaagactgaggctccagtcaattccatctcttgtgagggctctcttctcagcttgtggacggcagcctccttgctgtgtcctcacacagactttcctcagtgcatgcgtgtgggaagaaagtgagagggagaactctggtgtctgtcctcataagaacactaatcctgttgaatcagtgcccatcctcacgaacccatttcatcttagttacttccttagaggccccatctccaaatacagccacattagagtgaggtcttgaacatacaaatttgggggagacacccacattcagttcataacactaccatttctgaaattgcaatcccaatctccccaacactccttcacccccttaccttgctctcttccccccacagttcacctttctcgtactctccaatgaattcatattatgaattctattgtttattatctgtcaccctctcccccatctagaataaaactcaatgattaagggtaggagtctttgtctacttgttctttatgtgtcccaggcatctaggttagtgccttgtacacagttggtactcaagattagctgttgaatgaatgaaggagaaaaaacatctccttcctggccccttttcccttttcattctctttgcacatcaccagggaaggaaaagaaacacacctcaataatcaattagtttgaggagagctgtttcttcatctgaaaattgaaaacaacaagacatgcaaggtacagcatgaggtaatgtgctcagggtgctttcaacagctagacttgtatactagttccagctgcgcagctctctagctaggtgactttgaacaagcagtccaaccttctgagctcccattttctttcctgtaatagttggataaaatcacctcgtagtggcaagaatcaagagacttctcaaaagttaaacatagaggccaggcgcagtggctcacagctgtaattctaagcactttgggaggccgaggcaggtggatcacttgaggtctggagtttgaaacctgcctggccaacatggtgaaactctgtctcttccatctctactaaaaatacaaaaaaaaaaaaaaaaaatagccaggtgtggtggtggacacctgtagtcctagctactcgggaggctgaggcaggagaatcacatgaacctgggaggtagaggttacagtgtgctgagatcgcaccactgcactccagcctgggcaacagagcaagactccatctcaaaaaaaaaaaaaagataaacacaaaaattaccatatggtcgaacaatcctgctcctaggtatatatccaaaatcattgaaaacagatacacaaacacttatacatgaatgttcacagcggcaatgctcacaacagccaaaaggtggaaacagcccaaatgtctatcaacagatcagtaaacaaaattgcagtggatacatataatggaatattatgccacaaaaagaaagaaagtactgatacatgatgcaatggggaagaacatggaaaacataaagctaggtagaagcagccagatacaaaaggtcacatactgattccatttatacaaaatacccagaacaggccaggtgcaatggctcacgcctgtaataccagcactttgggaagacaaggcaggaggactgcttgagtccaggagtttgagaccagcccgggcaacatagcaagacctgtctctacaaaaaactttaaaaaatatctgggtgtggcagcacgtgcctgtagtctcagctcctcgagaggccaaggtgggaagattgcttgagcccaggaaatcgaggctgcagtgagccatgttcatgccactgtacttcagcctgggtaagagcaagactgtctcaaaaaaatagtaatacccagaattaattcacagaaa

SEQ ID NO: 3125 - DNA, 4266 bp, Homo sapiens
gagaactgccaagtcagttccggtccggcagagatcgcggagagacgcagaacgcagcccgctcctccagggccctccaggccctccggccccgggccggcgggtgaactggggggccccgggacaggccgagccctctgccctgcagataacggaggcctctgctgtggctgcccactggctgtgcccgcccactggctgtgcccagaccttgaagccgcagcgaacctctctttcccaccccacctcggtgactaatggcggccgtggcgtctcccagcccggaccccgccggcacccgggtctcccgacccaagcctcgacgaaacccccgcagagccgccgggacgcagcgcctttgggcggcgctgggcgtggtgggccgggaagtatggcggcagctcgaacgccgcgcggcggaggccattaaggcgtggacggcccgggaaggcggcctagggacgcaagcaggctcggccgcctctttaggccacggagccgcgcagatccggttcccgggtgaccactctgtcgccattgggcgagacctacctagtcctgacgacaacggacaaaggccttaaggggcctggaaggtgagcgaagtcccgaacgacgacgggtggaacggttagcggccatcgggcggttggtcttcattctaccagactttgctgtcggaagagagaaatggtagaatgacaggccacgtttggcccgttggaaatgcccaccaccctctgggaagatttactggccgtttatggaaggcctgtgtatataatatgaaaaagctgctctcaactccaccccaaccttttaatagaaaacatttgtcacatctagcccttctagatggaaagaggttgccgacgtatgataaaatagagttagaaagttacacatcttgtaaattctcatttgtttaaaagaaatcatagaaaatacatgtcttctggagatgacttttggaaatggagttgttaagacggcctctggaagcgatacgtccacgtttgttaagtgggttagatgacatggagctggaagacctgagaaggaagagaagaaggttctatgctagactggtcatatttagaagacattttcatattctatccattgttttgtgtgcattttattcctcactactgtgtatatagttgacaatgctaagcttttttgaaatgtctcttctttttagatgttctgaagtgcctgatatgttaaaattagaggtagcaaaatcacattttgtaaatacctttttgttacaattcataggaaatatttttgggggggaatggccaaatcacctgttgagtaatactcattgtgtttgtgcagtggttcaggggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaaaccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctgtattaagccctcgttgcttgtagaatagagttagtatacgctacagaagcacaggttcatgctccttcatgcttgggctctgaggtatctggaatttctcatctttgactcctc

SEQ ID NO: 3126 - DNA, 541 bp, Homo sapiens
acacacatcacacaacacacacacacaccacacacacacctcacacatcacacaaaacacaccccacacataccacatgcacacacacacacctcacacatcacacaaaacacaccccacacataccacatgcacacacacacacatcacacaacacatacacaccacacacacacctcacacatcacacaaaacacaccccacacataccacatgcacacgcacgcacaccacacacacacctcacacatcacacaaaacacactccacacataccacatgcacacacacacatcacacagcacatacacgcacacaccacacacacctcacacatcacacaaaacacaccccacacataccacatgcacacacacacatcacacagcacacaacacatacacacacaccacacacacacctcacacatcacacaaaacacaccccacacataccacatgcacacacacacatcacacagcacatacacacacaccacacacacacctcacacatcacataaaacacacacacaccacac

SEQ ID NO: 3127 - DNA, 3472 bp, Homo sapiens
cctaggagacctgaaggctgcttccgctaacccgggctggcgctgctaacctcacccaacgatccctgctgtcggaaaatgtccagaggcaccatccctgctatgaagagggaatgccagtacaacagccacaaggggtcttcctgtggccctcaaacaaaaaatcactgcattacatcagcagactgcattggagagaaaggcgccgggacagaaaagcctgagataaaccacctgtcattcttggagaaaaggatgctgcggctttcccgatttggttgatgagatggaaaatcaacccttacaggaaggacatcaccaattccggaaaggatgctgcgccagtcatgtttccgcactctgtgagacgttgaaatctccagaagttgcccaaggttttcaagctgaacacaggagaaatgactctggatctctgaggactgttttcctcaataaggagctgcaatcttggctccaccaccctccctccaaaacatctcgtgtgtctggtatctggttatattgtggcctgacagagaagtttctttcggggccagtgaattaaaaaaaaaaaaaaaaagaaaagcgggtcctaccaactcattaatactttaatactttaaatttccctctttatagtaggttgaaatgtcagtatctcttaagaacaatggctgaaccaaatgtttcctcaaaactcacattttttcccaccatttcagaagctgcctcaggactaagctttgatttttttttttttttttaatctggcccaaattcctatctaaggggcctggggagtcatgcccaacaaaccataaattctcatcagatgagttttatttaaccctatatatggtgacttgctttccagtctgactctggcatgacatgtgacaaagaagaaagtcaaaatattttaccccaaaacatgtttctttgccatattttgaaatggtcctgcaaagctgtgctttgtgggggaaaatatgcatctgtaaagaatctctattaacacagctagatctttttcttccaggccctcccaatcctgaagagactgagagtctagcattgttttaaaggtctgaataggaaacatttgtcatctatcatctctaagggtagccattataagacttcaaaagaaccttttgaagtattataatcttttatcttaacctgaacatgtgcttcctattgatcccaggtcttcagacaattgtgaactcaaccatttgtcaattagaaaatgtttaaattggctgggcacagtgtctcatgcctctaatcccagcactttggaagaccaaggcgggcagattgcctgacctcaggagttcgagaccagcctgggcaacatggtgaaaccccgtctctactaaaatacaaaaatttagccgggcgtagtggcatgcacctgtagtcccagctacttgggaagctgaggaaggagaattgcttgaacccggcgggcagaggttgcagtaagcagagatcgtgccactgcactccagcttgggcaacaaagtgagactccatcacagaaaaaaaaaagaaaatgtttacctttacctatagcctggaaatccctgctttgagttgctccatctttctgaaccaaaccaatgttatttcttaaacgtatttcattgatgtctcatgcctccctaaaatgtataaaaccaagctgtgccccgaacaccttgggcacatgttctcaggacctcctgagggccgtgtcacgggtcataatcactcatatttggctcagaataaatctcttcaaacattttacagagttgactcttagtcaacatgtccatacctgatgagatgcttcatcaaaattctagtggactggctagttcagaaaatggaccagccaggtttgcttaaatgcacccctgcacaactatctcactcctgcttggagccggctagatcaggagacctgtccctaaactaatgtactccatgtcttaagtctttttgttttgttttgtttttgtttttgacagagtctcagtctgtcacccaggctggagtgcagtggcgtgatcttggctcgctgcaacctccgcctcccaggttcaagagattctcctgtctcagcctcccaagtagctgggacaacaggtgtgcaccaccatgccctgctaatttttgtgttttaagtagagatggggtctcaccctgttggccaggctggtctcaaattcctgacctcaggtgatccacccacctcggcctcccaaagtgctgtaattacaggcatgagccaccgcacccagcccatgtgtcttggtcttttttactaatattgattataaaatggatgaaactttggataaaatttctgcgttagaatttctttttatatctgtcctaaagcttgtaactacttgctcatgattttttgtgtatgtttagcaatgtgcatgtcattgatggcctttgtaaagtatgttcaattgagttgtggagacagaggtgcaattggagtaggttgtaagaataaaaaggagtaggcaaaaaggcacgggtataccagtggacttcaaagggtactcagactttgttcttaagggatcaattcccagatcttcagtttcatataaactctttcctaaaattgacttgcctaaaagcatgttagtgttgtgggcacagcttctcttttcttatttctgcttttacagtcatcctttttccaaaaggaaggtatacatatcctccttgtctaacaatggcacattgccccagggtgtaaaagaggccaggggtgacaagcagagacacaattcaaagcatttgtattaagagagcagtaactccaatgcattattttgcaagtcacatttttttgtttttgtttgttttgagacaggatctcactctgttgcccagcctggagtgcagtggtacgatctctgctcattgcagccttgacctccctgtttcaagggatccttctgcctcagccccctaagtagctgaaactacaggcatacaacaccacgcctggctaatttttgtattttttgtagagatgggattttgccatgttgcctaggctggtcttgaactcctgagttaagctatctgcccacctcggcctcccaaggtgctgggattacaggcatgagccaccacacctggttttaatctataatttcaaagttaaaatttttttaagtcaaaactatgtaaaaagttatgcttagaaaagtctagcttcctcagctctatcccttccacctattccttcctctgtcccccagagataacctagttcattatttttggtacatctctgtttctttttcttttttttttttttagatgcagtctcactctgtcgcctgggctggagtgcagtggagcaatctcagcttactgcaacctccgcctcccaggttcaagcaattctcctgcctcaacttcctgagtagctgggattacagtcacc

SEQ ID NO: 3128 - DNA, 558 bp, Homo sapiens
actgaatgtgggtgtctcccccaaatttgtatgttcaagacctcactctaatgtggctgtatttggagatggggcctctaaggaagtaactaagatgaaatgggttcgtgaggatgggcactgattcaacaggattagtgttcttatgaggacagacaccagagttctccctctcactttcttcccacacgcatgcactgaggaaagtctgtgtgaggacacagcaaggaggctgccgtccacaagctgagaagagagccctcacaagagatggaattgactggagcctcagtcttggactttcagcctccagaacagagaaaataaatgtgtgatgttaagccacccactctgtggtgttttgttatggcagcccacactaatacaggcagtgatggaatatctcgtgaggaagtgacgtttgaacacatctgaaagaaagtgtagaaggcagccaagggcatctgaggtaaggacattttaagacagaggaaccagtcattgcaaagagcctgaggcagtagtgtaccaggtggggtgaggaacacagggaggctg

SEQ ID NO: 3129 - DNA, 1657 bp, Homo sapiens
aggagaaggggctgtgctgccagcaggcagtgctttgagctctaatggatgaacattgctaaccagcgaaggtggagagagggcacccgtctgagaagatgaagaggcagcaaagcacagctggcctcggggaaccggaagccacagggacatcaggctgtgtgctgctgtctgtcggccaccagctgggggactatcctggacctggaagggcatccctgacactccccaccagatgccaggggcacccccagccccagtatagatctggactccatcctttgcaatgtgtggggttctaggaagaggccagccagccgtggaagtgtcctgggctctgtcccggagacgacgaacttggctccccacgagggcggcctattccccacagtgtcccccgggggccacacctgcacccaccttgctgaagataattcgctttctcatccgtgaaagaataaagtcggattaactcatctccacactcacttccaactctaacaacctgtgttaggaaatcaaaggtaaggactctgaccacaaacccaagaagcaaaacccgagactcacggaacgacgccaccattgcagttcccagcttgactagttgtttttcttttctggtctgttctgctcttttggtttaaataattaaagatccttgttgacaagtaaaaaaaattctttatgaagctaaaaaaagtggttctaattaaacatttaaacattcttccatatacttttaaaaacagttgtaattatagctctacttaatgttaagtactttaaccaaatgaaaggttaattatacagactggcaattataaaaaataaggtaacatattcatggcattatgaataattaataagaactcttcgatttcatttagaccagggattctgtgctaatatgctctcagctgtcttgaaataatggtgaaattttaaaattagttttgtacttaaacatgtccccaaagtgaagcacagcggccaacgtccgtcacggtgccgagcagtgccagccgctctaccatggccgacggcctgattcccaagggctgcgtcccggggccgtgctagtgcagtgaatgttcaggaaacagaccaggtggcaggagggagtcttgtcctcaaggaacctcataagtcttgctagggggacaaacaacgagagaatgaaactggcagccatagaatccgggccttgatgcccaggcctcgccatgcatacctgctggccggcatctccctgagacccgtctggcacaggcaacggcagggcccggcccttggagcacagggatggcagagcagggtcatcgaagcaggtggcgtgcagacagtggcttctccgcaagagctcctggctctcagggagctgagggctcctcaatggggaattctggctgagctccaggggaaagcgggttggaggcctggctcctccgcccccatctcctctgccccaaccctggaagggggtcagatatcaatgctaacatttgtgctgactcaattaattcaaacgattcacaaaaacaaacttgcttaaagtattaatttcctaaaaagaactaaaatgagttcaaataattcacataattaaattattttaattgttaatttaattaaaacatctcagttttcaaagcac

SEQ ID NO: 3130 - DNA, 6031 bp, Homo sapiens
ccctcacaaaggcggcggaaggtgatcgaattccggtgatgcgagttgttctccgtctataaatacgcctcgcccgagctgtgcggtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaaacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctaacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaatagcctgcagctggtgttttgagaagccctactgctgaaaacttaacaattttgtgtaataaaaatggagaagctctaaattgttgtggttcttttgtgaataaaaaaatcttgattggggaaaaaagatgggtgttctgtgggcttgttctgttaaatctgtggtctataaacacagcacccataattacagcataatcttcaagtagggtacggactttgggggattggtgcgagggtagtgggtgagtggcctactaaaaagcccagtaacccccacaggaaaataggg

SEQ ID NO: 3131 - DNA, 2027 bp, Homo sapiens
aaaaaaacttcatgacactctcacaccaagacttgcttcagagcacacacaaaagatataaaaggattgaaaacatacagaacaactttgcaatgtgcagatatacagcagtactcacctcaaattacagaaagtcatacaacaagatccctgctggttccatgatacacacattccatacacagacacagacacattccatacacacacacacattccatacacgtgcacacacacattccatacacacagacacacattccatacacacagacacatattcgatacattccacacacacacacattccatacacacacattccatacacacacattccatacacacacattccatacacacacattccatacatacacacacattccacacacacacattccatacacatacacacacattccatacacgcacacacacattccatacacacaaacattccatacacacacacattccatacacatacacagacacacattccatgcacacacacacattccatacacacacacattccatacacacaccttccatagcaacagacacacgctccatacacacacattgcatacacatacacacacattccatacacacacattccatacacatgcacagttacccattccatacacacacacattccatacacagacacacaccatacacacacacagacacacattccatacacacacacattctgtatgcacacacacacattccatacccacacacacacattcgatacgcacatatattccatatacacacacacattccatacacagacacattccatacacacacagacacattccatacacatacacagacacattctgtacacacagacacacattccatacacagacacattccatacacacacagacacattccatacacatacacagacacattctgtacacacagacacacattccatacacacacacattcagacacattccatactcacacacacactttccatacacatacacagacatgcattccatacacacacacacagtccatgcacacacacaaacacattccatacacatacacacattccacacacatacacacacagacattccatacacacacagaggcatattccatacatacacacacacacattccatacacacacacattccatacacacacagacacattccatacacacacagactcattccatacacacacagagacacattccattacacacactcagacacattccacacacacacattcatacacacacacattccatacacacacacagaatcattccatacacacacagacacattccatacacacagacacacatttgatacacacacacattccatatacacacacattccatacacacacattgcataccaacacacacacattccatacacatacacagacacacattccatacacacacaaacacattccgtacacatactcagacacacattccatacacacacacacattccgtacacacacacagtcacacattccatacacacacacattccatacgcacaaacacattccatacacacacacatattccataaacacaaacacattccatacacacacacagactaattccatacacagagacacattccatacacttacgcagacacattccacacacacacacattccatgcacacacatagactcattccgtacacacacatagacacattccatacacacacagacacattccatatgcatacgcaggtatgtccccaaagaaatagattgtctccatcatatgcacattaacccaacgaaatacttttggagctctgtaacacccaaacttgactcacaacacacatgaacactgaaccacacaaatgaaacctacactacccagacatacccattgtttgaagacttgctgcaaaatacccagccttacgccatgatatacagacttggcccattgacctatacctaccttg

SEQ ID NO: 3132 - DNA, 3905 bp, Homo sapiens
aactctgggtgacctgaccacaccgggtctgtgttcccaagtgccgccggaagctgactgcagctgccccctgtagccagggcatgtgtggggactgctctgacaactgtcccccactcccgcagtgcccagtgcccgacaccctggggagtcactgccaccccggaggggccaccaattcaacatgtgacaacccgaagtggagggaagcagaggaggaagagacggagggggacacacagatggaaactgagcccaagaaccaagagtgagcctgaggaccacagcgagggacagcgggagagggaggcagcaggcagacggaggcgaggagcgattccttgggcatcttaagtcactctctggcccctgagcagctgtctcgtttagggaaaagagcctggggaggacatgaaaagggtgaggcctggacacgctccttggtcatttcccaacactgacgtcaccattcctagcctgcctaggtcctggggtggccctctgtgggcgggtgagcacacaccttggcaggaggtgacgcagctggaccacgcgtgggaactcccggcacagcgggcgggcctggctcagccccacctcccctgccactgggttcctggcaacctctggtggcttcttcctcctccttctgccgccaggatgcaggggtccccacaggcgagaggctgaactcagagctggccaggtgagaagcgaagcaccgaaccactgaaatctccaggagaccacactgggtggcagatgtgacagcaaccctctgacctcacggggcgctgccgtcccagcacaaccagaacaaggtgtgccgatgccgggagcagtgcaaacggccctggacggggatgcagagggctccggatcagcctggggctcgctgtggggccctgctgtcatcccttggaaatgggtacacccccggcatattgagggggaggcacgcagaggaacaaacgtgataaatgcatccatgggctgcaaatcgggggccgctcggacagctgtcccccactcctgcagtgctcgctgcctggcactgtgaggagtcactgccacccccgaggggccaccaattcaacatgtgacaggccgaagtggagggaagcagaggagagaggaagacatagagggaaactgaacccaagacccaaaagtgagccggaggaccacagcgggagagggaggcagcaggcagacggaagcgaggagacagggcgcagaggggctgcggggggtgctgggcacacctggctgaggaagggaccaaaggcccagagggtcccatagtctcagcctagtacctgtccccaagcccaggggccctgatcacaaggcagcaacgtctatcccacagctgtgataggtggggcacatcacaccccgaggggccccggcatccatgatctcccctcctggagggtggtcagccgccatcctggccccggactccttggaaatgctccacaaagtgccagctggaaatgtcacagcacagggggccttgggatgagccagccccaaggggccattctttcctgtgggtttggggaactcttttaagatctggagtgcagattcgggttccagtgcctgctctgtgtcttcctagccttagtttcacctcctggggcctcaatttctccatcagtaaaatggggacagtaaccgtcatagcaccagctctcaggcttctcaggggagcagacagtgaagcagtgcacagaagtccttggtaatccaagaagcaccctctggacggagctgccaggacagcccgcagccaccctggactgacccgtggggctgggggcagctggggaggccaagcgtgtgcacacgggcaccagcagcagagcagacccccagtctcctctctcatacccgagatgggagatgaagactcccctgtgagttccaaactcctccaaccagttctggcagggaagaaagggagtcctgggaaagcaactcccatgcctggggctcggcggtgacccacccagcccctccccggcagaggcactggttgccctggaaactcacctcggtggtggccggtgctggcagaggtgccagccaaggtgtcgggctttggagagcggcacgacgggcgacggcccttctcctggcggtcaccacagagacacaggcaaagaacacagagcccttcctccccctgggcacggcaggcctggcacaaacctggcctgcttcccgggccatggtggggcgagagccaggtggggagtgggccctgcgggaggccctctgccagtgtgctcgtcgcctgcgtgccctagtggagtggagcacccgagtgcctgggcctggtgtcacccgcgtggctgtcatacctgctgctgtgacaggcaggaccaggaattcccgcttgtaccaggccatgggccagccgaggacgagtggagaggctgccccaagctagcctagctttctcccttaattctccaagtccccactcccattccccctgtgtcgggggcctggaaaccaccacacagagccagaaaggtgacagatacaagtaaccaaatcaaaacagggttcggtcagcagagccaccaggcggatgtgagtctagccagaggcactgggaggcaggcaggagaccccactcacttgttctggaaggcttccctgccccctagacctgagctcttccatccctggcacccaggcacgagatttcctttcttctttttttttttttttttttccctgagatggaatctcgctctgtcgcccaggctggagtgcagtggtgcgacctcggctcactataacctctacctcccggttcaagtgattctcctgcctcagcctcccaggtatctgggattacaggcacatgccaccatgctcggctaatttttttttgagacatcgtctcactctgtcacccaggctggagtgcagtggcatggtctcggctcactgcacctctgcctcccgggttcaagcgattctcctgcctcagcctcctgggtagctgggactacaggcgcatgccaccacacccagctaatttttgtatttttagtagagatggggcttcactacattggccaggctggtctcaaactcctgacctcgtgatatgcctgcctcagcctcccaaagtgctgggattacaggcatgagccaccacactcagccacttggctaatttttttgtatttttattagagatggggttttgccatgttggccaggctggttcgaactcctgacctcaggtgatccacctgccttggcctcccaaagtggtaagattacaggtgtgagccaccgcacccggccacaagatttcattttaactgggcgcaggggtgggggatgccaatggtttgtttcattaagtagggtggtaaaaaataataatattaccaccactactcccaccattcagaaaaaacaccaccaaaggtaacaagaaagggctgccatcagaaagaagggcaggcttgaaatgagtacatttggcttttagaataatttactagagtgactactggagttgtaaacaaccaccaccaccaccacaacaatacaacaacttactaccttgtccctgtttttctcattttgctgcaaaccagacattggaagccatcagacgcatccaacacacccgtctgacaagtggaaagactgagccccagagagagcagggacttgcccaagatctcacaggaaaagtgtctgtccagctgctctgcaaagcttgcagacgctccttccatcctgacctgggggccagaacactcagagccccaaccccaaagcccagagatgccagggcgaagtcagaggccaagagtctcagctacttccttaccttcctgggaacctggccgggtggatgccca

SEQ ID NO: 3133 - DNA, 2694 bp, Homo sapiens
gtgagcaggagacagggagggctgaaggctgtgcagcaccctggtatggggtgagtgagggtgcctagagggcgcccacagaaggggctcctgactcggactgaggggcagggaggtctccttggatgaaggggtgcctgggctagggctgcaggctggctggcccttgccaagagaggacaagagggagccattccgtgtagagggcatagtggctgcaaaggcctcagggagctgagggcatgtggcgtgctctgggtagcacatgactgagtgtgcgcctggactgggcatccgggatggggtcaccaagagcctcgtggacgatggagaagttgcaaggggatttgctgatgggcagccctgcccagcagcgactccactgggcttgttccttgtccgttccttgaacaacttgaagtcacagcagccagaggaaattctgccaccattttcccaggtctgcagcccctccagctgggaacctgctcctggagccatccctctgcaaacagagagcccagagtgcctcggggaaaattggctgaataaaaggtataaagactttctctatttttcctgaatagtttttgacagatatgagcatgttgaacatcttgggagctgctgataatgaaagccaggagtttctggggtttcccagccactggagggaggaagagtttgggggctgtggagggaaggcttggcgccgtttagcacctctgtgtcgtgttctctcttgtcccccatggatgagcccaaaatgtgctgggaaaggcaggactgggagccggaggggctgaaagggaaatggataaatggggtaaggatggaggacgattgtttttaggcaattctggctggcctgagaagcaatgtcactgccttcctgatcctttccctcccccaaccccaaggtcccccaccccaggtgctccgcgcatggccacccattcctcaggcagccccagcttgctggtccagggtggtccaactcatctccatggcctggtctcctcggggaaggggcttcggataccagctcagttcccagtgttgaccctcgctgggggactggctactactgcctgagcccattggtccattgctctgtacctccaacccccattacccacctgtggctgaccccctccacagattcacttgcagagtttactttggggagattattatacaagtatgatgcttctggaccttcaatggggttgtgtcctgataaacccatcataaggtgaaaatattgtaagtcaaaaataaatttaatggaccgggcttggtggctcatgcttgtaatctcaacattttgggaggccaaggtgggcagatcacctgaggtcaggagttcaagaccagcctggccaacatggcgaaaccctatctctactaaaaaatacaaaaattagccgggcatggtggcgggtgcctgtagtcccagctactggtaggccgaggcaggagaatcacttgaacccgggaggcggaggttgcatgagctgagatcacaccactgcactccagcctggtcaacagagcaagactccatctcaaaaaaaaaaaaaaaaaaaaaaaaaaaaagcacttaatgcccccaataaacccaacaaacataaagttgaaaaattcaaagtcaatcgtaagtcaaaccttcgtaagttggagatcatctgtaatgtatatttagtgtgaacaaaattagaaaatgcagccatcggccctcaggtggcctctcttcgctaggtcctgggttttgggtggtgtgtgcacaaggccagcgctgcgtttttcaaaaatcaggaccggaaactagatccgtcagcgtatgaagtcttcttcagccaaaactagaaaagttgggcactcttttttgtaccgcgtttgccctaagcccgcccttggctcagaagtgggcactgaccagatggcctggagctagacctgacattagaactagacctgggctagacctgagccgggtgcttccgtcctagaagcaggtcacctcggagccactcagggctgcgggcagaggcagctcgggctctgctgccggctctccggctttctagcaggaagaggacaaagagacagagcccagggggtccccttcacatggcctcaggcttcccacagtgggccgtgtgtaacagggtcccccgtaccgagtggctgcctgtgtgtgtcagggttagatgcagttttccgtgggagtagacaggaaggccgccgggtgttggcctcacaggcgcccgcaagtgttcaccacgaggagggcagcagccgtcacagccgcctcctgagatgccaccgctgtaaactgaatctattttacagggaagcatcggaaggagcccccaggtgagtcacttgtagaataaagaattcatttgccgggccgggcgcggtggctcacgcctgtaatcccagcactttgggaggccaaggcgggcgtatcacctgaggtcaggagttcaagaccagcctggccaatgtagtgaaaccccgtctctactaaaaatacaaaaattagccgggcatggtgacaggcacctataatcccagctacatgggaggctgaggcacgagaatcacttgaacccgggaggcagaggttgcagtgagccgagattgcaccacttactccagcctgggcaacagagcaaaactccgtct

SEQ ID NO: 3134 - DNA, 997 bp, Homo sapiens
acctcatcacctcagggtggcccttggcagcagccatgtgcaggattgtcctagactcaggctgggctggtcacccacaaggtgtcccccagccatccccggggcagccttgctgggaaaacttagagtgaaggagtgaagggcgtgagccttggccagactgcctgggttggaatcccggctctgccatggatctgccgtgagtctcagccagccactttcctttccgggcctcagtttccttatctgtcaaatgggaatggtatggtgcgcaactgtatgaggggtcatgcgtgacacgtggattgtgctgtcaggagctcgggggagtacgtgcccctggaaagcactagagccatgccagcgttcagtgagctctgtgaggtgacaggaagctcccaaggccaggcctagggcttctggtgcgtgggcaggggagcggagacagcttcctcttttgaaaggttggcaggagcgaagtggaggctgatggatgtaggagaagatctcacacaggctggggggcaagtgtgggtgccctgaggtgcccagggaggggagcgtaaggcagggcagacccgggagggccacgagtgccaggcgaggagcatggtggcttccatcctgagggtgatacggccatgaggggtttaataggtggggcagggtcagctcagggggcccagatatggggggagaccagcctgggagcatctggggacactttctggaagacgtgagtactacagcactaagagtttgctagaagggcaggaatgaagggccctcccagtacaaaggggcgaagacggtggtgaactgcggggaaggggtgaagacggtggtgaactgcagggaaggggtgaagacggtgaactgcggggaaggggcgaagacggtggtgaactgcagggaaggggtgaagacggtggtgaactgcgtggggaaggggtgaagacggtggtgaactgcgaactgcgcggggtaggggtgaaga

SEQ ID NO: 3135 - DNA, 325 bp, Homo sapiens
gctctttctcgcgttcccgctcgcgctcgcgctccttttcttcgcgcgcgcgctgctcggcctcgcgccgcaccttctccaccaggtcggcccgcttcttggccagcttggagccctccagtggcacgaagtacaggtcgctgcgcgcgcacgagttgaagccgcgatccaggtgtttgttgaacctgccgggcgtggaagcagcgggcgctcaggcggtgcgagctgcccgatggagcccgcagcgccgcggccccggcgagtgcttgtagcccccgcctcaaaaccacccctgcaggctgtgagctgctgcgggcctcactgg

SEQ ID NO: 3136 - DNA, 1747 bp, Homo sapiens
ctctgaagcgggattccacgctcctgcaccctaagatcagctagactctctgccttgtttcatcttctttcttttcctaaagaatcacggggagaactgacctctctgggactcaaccgtggctggaaggggacaggagaagccctttctggaggacagctgagccctgcagctgccatcctgcctggcaggctagggctgggctgcgggaaggccccccaggagggaggtccggccactgcaccccgaggaaagggctgctttcggcactctgcgtggaggtcctggcttctgccgtccctggaggctccgttcccgtttcgccagctattttgctgcctcggccatctgttccctccctgtcatctcctctctgctttaaccttaaccactacttcactgcagatggtaccaggcagttctgctctcgacatccttcacgacgcctggccctccttctcatctccagcaagtgaaccgctctgtcctttttaaagcctcatcccaaagacacggccagagcttggagttggattcgccccacacaactccccctctttgatgccatctgctttcaactccaccactggccaggggcaaacacctaccccttcccctgccttttcctcctgagacttcttctcaaactcggccaagaagctctcctggcatggacagcgtgtctgctccgggtctctacctggtctccatcaacagagccatgtaaccgcccagagggctccaggtccgcaagctgaggcggaggccagaaactctgaagttcactcctactgtggaggaacgagggctcgtgctgggagtttgggtcatgaacagtttccctgtagaaaatggacctgaacactctgcagtaaggaattgtttcccatgctggcatggtgggaaccgaaccaaaacacattttctatgttgtctgagctcacagggaacatccctctgctgtccttgctgttattctggcatgctggtgagaaaatgcatgcatgggctttacttagcaactcgctctgcctctcctctctgtcagggcgctcccctaaaatctctcctcttgacgtcttttttctggcataaggacccggagctttgaggagcgcagcagcccagaagctcctaaggagagaagctgttttggtgagattggttccaccaggctacatgccttgactgggacagaaatgggctgggaaggccgaaatttgacttctgcacctggatttgggctaaaaagtctcacagctcagcctccttgataagggttcttctatctcccctctatacttcctctgcagcagaaaagagtatcttggccgtgcagggaacgctcttctctcactctcgccactggggttaagggcagctacattactatagctccaagtcttggttgcccccagagagaggcagagatgtagcctgcccacatctggacacttgaagactctccaaacacctagaggagctgtggattcaagtgaagcaaccatctgatgccaccacggtccctccttccctttgccttcccttcttcccacaaaagagaagcccaaatccgccaccagaccagcccatctgcccgtggaaaccaagggaaccaaatgcatcgtactgggttgcaggccttaatctagctctcgctgaattattcagggatggcattaacttataaatgagtgtgtttgactgattttgtggttgatgtacagataaagtctaatgaaagaca

SEQ ID NO: 3137 - DNA, 14694 bp, Homo sapiens
gcctgaccacgccggagccaatcagcggcccccaagcttgtctgattctgtctgctccaatcaggaggcgcggtccttccagcctcttgctcctgtgaatcacaggtcggcgggagccttttttcctttttttttttttcccggggagtcggcctcggggctctgctctcctacctcagtctgccctaccctggaatggggaaaatgcggacatgccactcagtccggccgcgaacagtgctccagaactcagagagttttccagacgggtggagatcgcgttccctgcccgccgaggtcccatcgcttccctgctgggaagacaaatgaggcgctttagccgtctccacggccagcccctccctcataacccgagattctttgtgggctcttagtccatagctgcctttgaggtggtgtagaccttgctaaccaggacggcccagtaggcagagctcatttttattcctgtctgcaatcgtgcaaaaacgcctcttatggaaaagccagagcgccaggagtcagcaaaacacactaaagattgggcagtcactggggagaacgtgagtaaaagcacaggaacagcaaagcgttcaggaacgttcgaggctgacgcaaccggcgcaggaaggtggtgtgtggtgggagagtgggaggagacagtggaaagtttagacttgcttctgtaagtgataagaagtcatcagatattttcaagcaggagaggaaaataatctctctgtttcgcaaagttaactctcatggcaacagagcagagtagcggggggatgggggctgggagatgttgggaagctattgttaccactctggtgaagagtcatgggacctcaaaagctgggatagtcacggtgggaatggaaaggaagggcacaagctgagaggcatttgggaggagaatcaatagcactttattgactggatgtgtgagatgagtgaggacagcaatcagaagaggactttgaggtttctagcctgagtggctggaaggacaccacttcccctacctgaaataggtagcaaaaaggagagagaaagagagaagcagagggattttgcaaagggaataggagttcagtttttgacatgtggcatttgaattgcaagaagtacatccctgtggatgtaatacccagtagacagttgggaattaggatctggtgtcgagaagaaaagtagagatgagatccaaagggtttatagtggatcgggagagaaattgatgacctaaagagaaattatagaataagaagatttgggcagggcacggtggctcatgcctgtaatcccagcattttgggagaccaaggtaggaggattgcttgagcccaggagtttgagaccagcctgggcaacatggtgagaccccgactctacaaaaactgcaaaaattagccgggtgtggtgacacatacctgtaattccagctacttgggaggctgaggtggggggatcacctgagcctggggaggtctaggctgcagtgagctgagatagtgccactgcactccaacctgggcaacatagcaagagcaagaccctgtctcaaaagtaaaaaaaaaaaaagaagattcaagtacagaatcttgggaaggtagaaagaggacacagaggccaggtgtggtggctcatgcctgtgatcccagcactttggacgctgaggtgggtggatcatctgaggtcaggagttcaagaccagcctagccaacatggtgaaaccctgtttctattaaaaattatccaggcatggtggcgggcgcctgttaattccagcttctcgagaggctgaggtaggagaatggcttgaacataggaggcagaggttgcagtgagctgagattgtgccactacactccagcctgggcaacagagtgagactctgtctcaaaaaaaaaaaaaaaaaaaaagaggacacagagctagcaaaacagacaaagaagtatcagaaagatatgaaaaattaaaaaaaagcaaactacgatactgtaatagaaataagaaaataattccaggaagaggaagcaggacattgtttatgtatgtacaaaacagtaagacattggttaaataaattataaagcattcatttgatagaatacagccattaaaattatgttgcaaaactatataattgccataaagagatgttcaatgcatcttttttcccccagtgcatcttagaaacactcaggttaaaaaatagtatatatgctgggcacggtggctcacgtctgtaatcctagcactttgggaggctgaggcaggtggatcacgaggtcaggagtttgagaccaccctggccaatgtagtgaaaccctgtctctaccaaaaatacaaaattagcccggcatggaggcaggtgcctgtaatcccagctacttgggaggctgaggcaggagaatcacttgaacctgggaggcagatgttgcagtgagcagagattgtgccactgcactccagcccaagtgacaatgcgagactccatctcaaaataaaaaaaagtatatatatatgtgtgtatatatatgtatatatatgtgtatatatgtatatatgtgtgtatatatgtatatatgtgtgtatatatgtatatatgtgtatatatgtatatatatgtgtatatatgtgtatatatgtgtatatatgtatatatatgtgtatatatgtgtgtatatatgtgtgtatatatgtgtatatatgtgtgtatatatgtatatatgtgtatatatgtgtgtatatatgcgtatatatgtgtgtatatatgtatatatatgtgtgtgtatatgtatatataattgtaccatttttaaaaattacatatgtgactgcaaaaaggcatgagaaggctgggtggctcatgcctgtaatcccagcactttgggaggccaaggcaggctgatcacctgaggtcaggagtttgagaccagcctagccaataattgttatacaaaatagaacaatttttgtattttgtaaaaatacaaaaattagccaggtgtggtagcacatgtctgtagtcccacttactcaggaggctgaggcaggagaatcccttgaacccaagaggcggaggttgcagtgagctgagattgcaccactgtactacagcctgggtgacagagtgagacaccgtctcaaaaaaaaaaaaggcatgaggaaacttttaggatgagggaactgttctatatgtttgttgaggtaatgtatacacagctctgtacaattatccaaaatcctcataagggaggagaccacccctcatattgtcttatgcccaatttctgcctccaaagaaagaagaagtaaaaacttaaagacagaaatgaaatccacaggcagacagcccggcgccacaccctgggcctggtagttaaagatcgacccctgacctaatcagttatgttatctctaaattacagtcattgtgtggaaaagcactgtgaaaatccctgtcctgttctgttctgttctaattaccagtgcatgcagcccccagtcacataccccttgcttgctcaatcgatcaagaccctttcacgcggacccccttagagttgtcagcccttaagagggacaggaattgcttactcagggagctcggtttttgagacgtgagtcttgccgatgctcccggccaaataaagcccttccttctttaactcggtgtctaaggggttttgtctgcggctcgtcctgctacactcaaactagaattccttaaatttttattttttattttatttatttttttttagagactgagtctcactctgtcatccaggctggagtgcaatggcatgctctcggctcactgcaacctccacctcccaggttcaagtgattctcctgcctcagcccctggagtagctgggattacaggtgtgcagcaccacgcccagctaatttttgtatttttagtagagacggggtttcaccatgttggccaggctggtctcgaactcctgacctcaggtgatctgcccacctcggcctcccaaagtgccaggaccacagcacggaggaggcgagactgggagcaaggcccggagtatgggtaaaggccacacctgggcctctaaaacaaaaccaccaacaaataaaagaccctagaatgggtccagacaaaaaggaaagttgagaaactgaaaactttaagactgaaaaagggctctgggcatggtgactcatgcctataatcccaacactttgagaggccaacataggagaattgcttgagcccaggagttcaagaccagcctggacaacatacggagaccctgtctctacaaaaaataaaaaataattagtgggatgtggtggtacacgtctgtggtcccagctacttgggaggctgaggtgggaggattgcttgagcctgagaggttgcggctttggtgagccacaatcacaccactgtagtcccgcctgggtaacagagcgagactgtctcaaaaaaaaaaaaaggggggggaaggtttatgagggaccttggtagctgacttagaatatgacacaaatgaggaaataaacctattccttattgtccagagggttgaataaaggaataaaactatgtgggaatgagagcaagcatggctatggacaggaaggcagctcaaataacttgagctgttctacagtgtcttgggaggaataagctgcttctctcaccatatttgttcaactcgtccaagattctgtaaacatgttcctgaatgggatgagataatggattagatacctcttaggttccacctagttttaagactatgatataaagcacatcaaagctcttcaaccaaacataaggtaataggagttatgttattttcagtctatggaatggatgtcaatctcatctcttttgattgtcaagctagttcccatttcttcatggttttgatcaaatctgtttaagctgtctttatgatctggactaggtgagcttaaagtgatcatacctggctgataaatactaattgcatttctaagtaggccgctggtagaaatttaattatttggttttaatgtgagctgttttgttttgttttgttttgttttttgagacagagtctcgctctgtcgccaggctggagtgcagtggcgtgatcttggctaactgcaacctccgcctcccgggttcaagcaattctcctgcctcagccttccgagtagctgggactacatgtgtgcccaccacacctggctaattttttatttttagtagagatagggtttcaccatattggccaggatggtcttgatctcctgacctcgtgatctgcccaccttggcctcctgaagtgctgggattataggggtaagccaccatgcccggcccttaatgttagttcttattatacttcatatctatatcattcattttgcatactatggtacaatagagaaaccattaggctaggagtcagtgtgacccagtttcaagtactggttctactacttaatagatgtatggctttggggaaaggcatttatgcagaggttttcgatgtgtagtccatggacccctgagcgtaccccaaataattttcagggtatccataagaccaaaatgatgttcatggtgatattaagccttatttgccttttttcaccatcacattgacatttcttctgatggtgggaaattctttgcaccttgataggaatcacggtagtagcaccaaactgtaccagtgggcattacattcctcactgccctgcacttggaggggaattcagtcccccaggctggaatgcaatgatctcggctcactgcaacctctgcctcctgggttcaagcgattctcctgcctcaacttcccaagtaactaggattacaggtgcctgccaccacgcctggctaatttttgtatttttagtagtttcaccatgttggccaggctggtctcgaactcctggcctcaggtgatccacctaccttggccttccaaagtgctgggattacaggtgtgagccaccatgcccagccaagatgttcttgataaaataaaaattattaatttattaaattttgatccttaagagcaccttttaaaaattctgtggcatgaaatgggaagtaggaagtacttataaagtacttctgctatatgtcaaagaacagtggttgtcttgagggaaaacattagtgtgatcattatagttgtgagctgaattaacccctttattcatgtaatatcctttttgtttgaaagaatgactgacaaactggttgttcagactttggtattttgcagcttcaagaacattaataaagtaaaattgttacttcaaagtaacaacttgcaatatttgttccaatgataaaatttgagcttttggcagtggctcatgcctataatcccagcacttagggaggctgaggcgggaggagcacttgagctcaggagtttgagaccagcctgggcagtctctccaaaaagaaaaaaaaaattagccaggcatggtggcatgcaccagctgaggtggaaggagcacttgagcctgggaggccaaggctgcagtgagccatgattgtaccactgcactccagcccaggcaacagagcaagatcttgtcaaaaaaaaaaaaaaaagaaaaaagaaaagaaaaaatagctttcaagcaaaactcagaattgtagtgatcttgcatgtggtactaagcttgacagcttcctaataattaaaaactcttctgatgctatcagtggtgatgttcaaaaatgtcaatttttaaatattatagaataaaatgtgccaacattttagaagatttgcataactcagtgaaccaatacttttcaaatgaccaaaacataatgttacaaaatcatgcatggataaaaggtgcattgaaaatgcaaatgaggccaggtgtggtggctcatgcctctaatcccagcattttgggaggcagaggctggaggatcacttgaggccaggcatttgagaccagcctggccaacatagcaagatcctatctctaaaaataataagagtaagagaattagccaggcatggtggcatgcgcgtgaagtcttagctacttgggaggctacggtgggaggatggcttgagcttaggagtttgaggttacaggaagctatgattgtgccactgccctccagcctgggtgatggagtaagaccatgtttcaaaaacaaaacaaaaaaaaaagaaatgcaagttagaccaatgaagtataatgtaatgaaatacaaaaaattcattgctatggtttcaaattcccagtgcaattaacctttaagatactacgtgtcaggcctctgagcccaaactaagccatcatatcccctgtgacctgcatgtatacatacagatggcctgaagcaactgaagatccacaaaagaagtgaaaatagccttaactgatgacattccaccattgagatttgttcctgccccaccctaactgatacgatatattctcccccgcccttaagaaggtactttgtgatattctccctgcccttgagaatgtactttgtacgcctatcccaaacctataagaactaatgataatcccaccaccctttgttgactcctttttagactcagcccgcctgcacccaggtgaaatatacagccttgttgctcacacaaagcctgtttggtggtttcttcacacggatgcatgtgacatttggtgctgaagacccaggacaggaggactcctttgggagaccagtgccctgttgtcgccctcactccgtgaggagatccacctatgatctcaggtcctcagaccaaccagcccaaggaacatcttgccaatttcaaatcgggtaagtggtcttttcactcttctccagcctttcttgctacccttcaatcttcctctctcactacccttcaatctccctgtccttccaattcccgttctttttcctctctagtagagataaggagacacattttatctgtggacccaaaactccagcgtcagtcacggactcgggaagacagtcttcccttggtgtttaatcactgtggggacgcctgcctgattattcacccacactccattggtgtctgatcaccacggggatgcctgccttggtcattcacccacattcccttggtgacaagtcaattgcggggacacctgctttggctgctcacccacattgcagcccagggctgctcaatgccccccgctgccccacccgccttctccgtgcctctaccctctcttttctcgggtttacctccttcactatgggcaaccttccaccctccattcctccttcttctcccttagcctgtgttctcaaaaacttaaaacctcttcaactcacacctgacctaaaacctaagtgtcttattttcttctgcaacaccgcttggccccaatacaaactcgacaatgattccaaatagccagaaaacggcactttcgagttctccatcctacaagttctagataattcttgtcataaaatgggcaaatggtctgaggtgcctgacgtccaggcattcttttacacattggtccctccctagtctctgctcccaatgtgactcatcccaaatctttcttctttctctcctttctgttccttcggtctccaccccaagttccgagtcctctgaatccttcttttctatggactcatctgacctccccccttctccccaggctgctcctcgccaggctgagccaggtcccaattctcacttagcctctgctcccccaccctataatccttttatcacctcccctcctcacacctggtccagcttacagtttcgttcctcgactagctctccccgatctgcccaacaatttcctgttaaagagatggctgactatcctgacttcatcagagcaggctggtgcctggccttcctggaatgagtgggtgttctgacaggcccccagtttgtcccatctgcaccgccaagaggtctccgggtggccagaggagcaaagttgccttccaagtgcctgttggtgcctgggagaacacagcaggagtgtcgtgcggcccacagcgcagtgcatggtgattccaggcgctgaacaactccccttgacccttgggcctgcatctgactcccggctgcagaatcagaagctgagtccaggcaaccgctcggccactcccggtcactcctctctggacacccagttactaaagtcagcaaagaagatgcggtaatcaccgcctgatctccacatggtgaacacaacactctcactaacacctccttgaccagtcagtcttcagcactgggggtggacaggcaggttttctgtgtttaccagaatcgcacaggctaagcacaaacatggaaccagagttccaggtgaggaaacctcactcgcagaagcccaggctgcaccccaccaggtgatgcagtgcgcctaggctgtgggtgctaggagccaagtgctagggactcgtcatgagtgggaatccccacgttcctgtcactgctgtcaaacagaaggtaaacagtcttacgaatgtaattccttaggaagacttgtacaaacttttattaggatatctatttatttaatactgaactttggcctactttgtgataagactataaacaaattgaggaaatcactatttctcacttctgtatttctcaaaaaataattttgttacagagttcaatatactgtgtactactgatcttctattgtgaaagcaaagcatttcatcaaaacaaagtattttaaattatgagtgaaaattgtgtatgttaattttgcagctgtaatattaatcaaactttgtgtaattctaatcacaaaatgatgtgccttaaatgcccctccagctgtgggttggcagtgtccagacagggaccctgaaatcctgaatgactgctagaccaattctattaaaaacatttcaaggcaaaaaaaaaaaaaaaagaggtggctggagctgaaggcgtagtcaaggttaatgctcctttttcttcatctgacctctcccaatcagttagcgtttaggctgtttttcatcaaatataaaaacccagcccagttcatggcccatttggcaacaacccttagatgctttaccgccctagacccagaggggccagaaggccgtcttattctcaatatgcattttattacccaacccgctccggacattagaaaaagctccaaaaattagattccagccctcaaaccccacaacaggacttaattaacctcaccttcaaggtgtacagtaatagagtagaggcaacatatttctgagttgcaattacttgcctccactgtgagagaaaccccagccacatctccagcacacaagaacttcaaaacacctgaatcgcagcggccaggtgttcctccaggaccgcctcccccaggatctttcttcaagtgctggaaatctggtcactgggccaaggaatgcctgcagcctgggattcctcctgagccatgtcccatctgtgccagaccctactggaaatcagactgtccaacttacccaggagccactcccagagctgctggaactctggcccaagactctctgactccttcccagatgttctcggcttagcggctgaaaactgatgctgcccaatcgcctcagaagcctcttggaccatcacagatgctttgggtaactcttacagtgaaggggaagtctgtccccttcttaatacagaggctacccactccacaataccttcttttcaagggcctgtttcccttgcctccataactgttgtgggtattgatggccaggctgctaaacctgtcaaaactccccaactctggtgccaacttggacaacattcttttatacactcttttttagttatccctacctgcccagctcccttattaggtcaagacattttaaccaaattatctgcttccctgactgttcctggactacagccacacctcattgccgcccttttccccagttcaaagcctccttcgcatcctccccttgtatctccccaccttaatccacaagtatgggacacctctattccctccttggcaaccgatcatgcaccccttaccatcccattaaaacctaatcacccttaccccactcaatgccaatatcccatcccacagcacactttaaaaggatcccacagcacactttaaaaggattaaagcctgttatcactcgcctgctatagcatggccttctaaagcctataaactctccttacaattcccccattttacctgtccaaaaaccagacaagtcttacaggttagttcaggatctgtgccttatcaacaaaattgtcttgcctatgcaccccatagtgccaaacccatataccctcctatcctcaatacctccctcccacaacccattattctgttctaaataaacctagctgaccccataaatcctaaatcctttccccactcccctttccattccttaaaaaacagccctaaaagctgctcccacactagctctccctaactcatcccaactttttcattacacacagccaaagtgcagggctgtgtggtcggaattcttacacaagagccagaagcatgccctgtagcctttctgtccaaacaacttgaccttactgttttagcctagccctcatgtctgtgtgtggtggctgctgctgctttgatacttttagaggccctcaaaatcacattatgctcaactcactctctacagttctcataacttccaaaatctattttcttcctcatacctgacgcatatactttccactccctggctccttcagctatactcaactcttttttgagacagagtctcactccgtctcccaggctggcatgcagtggcacaatcttggctcactgcaacctccgcttcccaggttccagcgattctcctgcctcagcctctggagtagctgggattacaggtgtgtgccccacacccggctaattttttgtatttttagtagagatggggtttcaccatgttaaccaagctggtcttgaactcctgacctaaagtgatctgcccatctcggcctcccaaagtgctgggattacaggcatgagccaccacacccagcctatactcactctttgctgagtctcccacaattaccattgttcctggcctggacttcaatccggcctcccacattattcctgataccacacctgacctccatgactatctctctgatccacctggcattcactccatttccccatatttccttctttcctgttcctcaccctgatcacacttggtttattgatggcagttccaccaggcctaatcgccattcaccggcaaaggcaggctatgctatactatcttccacatctatccttgaggctaccgctctgccccgctccactacctctcagcaagccaaactcattgccttaactcgggccctcactcttgcaaagggactacgtgtcaatatttatactgactctaaatatgcctttcatatcctccaccaccatgctgttatatgggttgaaagaggtttcctcactatgcaagggtccttcatcattagtgcctctttaataaaaactcttctcaaggctgctttacttccaaaggaagctggagtcattcactgcaagggccatcaaaaggcatcagatcccatcactcagggcaacgcttatgctgataaggtagctaaagaagcagctagcattccaacttctgtccctcagggccagtttttctccttcttatcggtcactcccacctactccctcattgaaacttccacgtatcaatcttttcccacacaaggcaaatggttcttggatcaaggaaaatatctccttccagcctcacaggcccattctattctgtcgtcatttcataacctcttccgtgtaggttacaagccgctagcccatctcttataacctctcatttcatttccatcgtgaaaatctgtcctgaagaaaatcacttctcagtgttcatctactattctactatccctcagggattgttcaggccccttcccttccctacacatcaagctggggaatttgcccctgcccaggactggcaaattgactttactgacatgtgccgagtcaggaaactaaaatacctcttggtatgggtagacactttcactggatgggtacaggcctttcccacagggtgtgagaaggccaccacggtcatttcttcccttctgtcagacataattcctccatttagccttgccacctctatacagtgtgaaaacagaccggcctttattagtcaaatcacccaagcagcttctcagcctcttggtatttagtggctcctggttttacctcaaaacaccacccttaaggctctcttgaagtggatagatcttcagtggcaaggtaccctccgatactttcaccctgatgaagtcctattctttacttttatactcattcttattctggttcccgatcttatgccaccctctacctctccccagctatctccaccacactatcaatctcactctctcctagccccgtttataatccttcttttttttttgagatggagtcttgctctgtcccccaggctggagtgcagtggtgtgatcttggctcactgcaagctccgcctcctgggttcacaccattctcctgcctcagcctcccaagtagctgggactagaggtgcctgccaccatgcctggctaattttttgtatttttagtagagatggggtttcaccatgttagccaggatggtctccatctcctgacctcacgatccgcccacctcagcctcccaaagtgctgggattacaggcgtgagccactatgcccggccctctaatccttctttaacaaacaactgctggctttgcatttctctttcctccaaaatcgccaaggcctcgacttactcactgctaaaaaaagaggaccctgtatatttttaaacgaagagtgttgtttttacctaaatcaatctggcctggtgtatgacaacataaaaaaactcaaggatagaccccaaaaattcgccaaccaagcaaataattatgctgaacccccttgggcactccctaattggatgtcctgggtccttccaattcttagtcctttaatacctatttttctctttctcttattcggaccttgtgtcttccttctgtttagtttctcaattcatacaaaactgcatccaggccatcaacaatcattctatacgacaaatactccttctaacaagcccacaatatcaccccttatacccaaatctttcttcagtttaatctctcctactctaggttcccatgccaccccaatcccactcaaagcagccccgagaaacatcgcccattatctctccataccacccccaaaaattttcgctgcctcaacacttcaccactattttgttttgtttttcatactaatataagaagataggagtgtcaggcctctgagtccaagctaagccatcaaatcccctgtgacctgcacgtgtacatccagatgacctgaagcaactgaagatccacaaaagaagtgaaagtagccttaactgatgacattccaccattgtgatttgttcctgccccacgctaactgataccatatattcttcccccgcccttgagaatgtactttgtacacctatcccaaacctataagaactaatgataatcctaccaccctttgctgactctctttttggactcag

SEQ ID NO: 3138 - DNA, 9409 bp, Homo sapiens
ccttctacgcggctcctgaaacagtttagatgtttacttgcttacactggtttttggtttcagtttcctaccgctgaataactgcaggagtaaagttagtggtaaaataggaggctgtctagggacgtgatttcggggaagaagtcaggcctcgacgagccaccttaagaaaagtgactaggcggagcactcccagctaagagcggaaagatgagagatagaggtgtgactgaaggcagggatccccaggcgcacgtgagacctccgtagaggggcggggcttagggctttgcagaccggaggcttgttccgcggagggtggggcggtctctgcttgcgcatgcgcaatgccagccagtgcctgcgcggcttgctccagcaaggtaaaatttcccactgcgaggcaggcagtgatgctgcggccgcttcgcactgtggctcctgccgaccgccaggcgctgttacagtggatgcgaactaaccatgcagcagcagccggaacccacagttcaccttggtgcattcctttatgatgaagacttattgattcattatatgagaaaggaaaaatgagcagaaactactgtatgatgtgcagctcacaccagacagcaactttagggttatctttccagttcagcagtgcaactctatggagtagaattgaaaggagacttttcgccaattgcaggaaatggtcataaaaaaatacctgctcactgacagaataaagatggagtgtcactctgtcaccctgactagagtgcagtggcacgatctcggctcactgaaacctccaccttccaggttcaagcgattcttctgcctcagcctgctgagcagctgggactacaggcaagcaccgccacgcccagatcttttttgtgtttttagtatagacagggtttcaccatattggccaggctgatctcgaactcctgacctcgtgatccgcccaccttggcctcccaaagttctgggattacaggcgtgagccactgcccccagccttacttacatttttaaagatgttttttaccccttttcaaaggaaaatatgcagacacacccatccacatactttcctggcttgtagcttctgtggccatcagcaacccgataaaaactttttggccaggtgcaatgcctcatgcctataattccagcaccttagcaggccaaggtgggaggattgcttgaggccaggagttcaataccagcctgagaaactatctctcccccacaaaaaaaaaaaaaaaaaaaaaaattagccaagtatggtggcacacaccagtaagtcccggctacctgggaggctgaggcaggactcctttagcccagcagtttgaggcttcattgagctacagtcatgccactgcagcccagcctggataacagctagactttgtcttttaaaaaaataaaaactctgaggctggcctggtggcttacacctgtaattccagcactttgggagaccaaggcgggcagatcacctgatgtcaggagtttgagaccagcctggccaatgtggcaaaaccccgtctctactaaaaatacaaaaattagtcaggtgtggtggcgcctgccctgtaatcccagctacttgggagacagaagcaggagaattgcttgaacccgaggagcggaggttgcagtgagctgagatcatgccactgcactccagcctgagcaacacagcaagactctgtctcaaataaataaatagataaaactttttttataccttttttttttttttttgagacagggtccctccctgggctcagacgatcctcccaccttagcctcccaagtagctgggactacgggtgtgctccaccaacctggctaatttttgtgttttttttggtagaaacagggtttcaccacattgcccaggatggtcttgaaatcctgagctcaagcgatctgcccaccttagcctcccaaagtgctaggattacaggcctcagtcactgcacctggttttttggtttttttgttttgtttttttttttttgagacggagtctcactctgtcgcccaggctggagtgcagtggtgtgatctcagctcactgcaagctctgcctcctgggttcacaccattcttctgcctcagcctcccgagcaggtgggactacaagtacccaccaccatgcctggctaattttttgtatttttagtagagacgggtttcaccatattagccaggatggtctcaatctcctgacctcgtaatccgcccgcctcggcctcccaaagtgctgggattacaggtgtgagccaccgcgcccagccacacctggtatttttataccaccttatgacttttagaaaccttaacagtttccttccttaaagctataaacaaatggatttgaggtatcttaaaattaacagaaagggattctaggattgttttttattgtatctgttgaaatccaactagcctccaaggttcaatttttcctttttcatttgtttttgttgttgtttctttctttcttttttttttttttttttttttttgagacagagtcttgctctgtcacccaggctggagtgcggtggcatgatctcagcttactccaacctcctcttcccaggttcaagcaattctcctgcctcagcctcccaagtagctggtattacaggcacatgccaccaagcctggctaagttttgtatttttcgtagtgactgggtttcaccatgttggccaggctggcctcaaactcctgacctcaaatgatccacccaccttggcctcccaaagtgttgggattacgggcgtgagccactgcgcccggcctgtttcatcttttgtacagggcttttctctgaatccttggttttctgctcatgcttaagaatgagtaacaaaaaagctgattgaagttctgagtggggattgttaactgtggacttcactattgagtgatcttgctgggtagttcattagttgggaaatatctagtgaaatatcttaagatctttccttttgggctgatctgattgcctagaaaaaaccttttcaatcttctagctgaataacaagctgcatactgggaacagagtggtagagcaaaagggttgaagaggcagggttctcagcattctgcatgcatgtttccttaattcctcagttttcagtacgttaccctttctttcagcgaggcctggaatcccctggttgtctggttcaaccatttccagagaataaacctctattcatttgctggagtaggagaaagggaaatagggatctgactgcgtcttaatctgactttcagccacattcccttatttttagcatttccccctacttcacctggtaccaccaattattagccttttggagattctgtagcataagtcagatttgagtcttagctctcaatacttctatctttgaaatcaattttctctggtctcctaaattccttatcacttctccttttgttctaacaacaaatttttatatctgttatttcctttcccattctacccatccttgaaggtttacaccttcttttaaaaacccctattctgtcattataatggggtttcagtaatgtacatacatgtctcttatccactgtctttacaggcaaggcctatggattgaaattctttttcccttttcttcaggctagaggtaaactttccctcattcatatccctggtgttggcttattcctttgatggcagctgttgtatgaacttactaacatagcttttctaatccccttactagataacatatttgagagtaaatattgtgtctcattcatcatagtgtatatctctgcatggtatcttgtgcataggaggtgcctattaaatatcggttaaattgatttgagctaccttgtggcctctgcattgttagcattccagagttcgcccagagctattcctttatggttttcctgggaccttaagagcacctctgtgggctgccataattaattgatccacctgattctcttttaccctatctgtatagttgtgggatgtgggggaaaagagtgaacagaaatggaaaagaaaaggggggaattgtttgagagctgtgatagatcaggaggttaatttacatatttcatgtatttcatacatgtttcaaaagtttgaaatgattgactttttctttatattgagtaatatgtttacaggctccaggccaactttaaatttattattttagtattcttttttttttttttttttgagacggagtctcgctctgttgcccaggctggagtgcagtggtgtgatctcagctcactacaacctccacctcccgggttcaagcaattctcctgcctcagcctcctgagtagcttggactacaggtgcgtgccattacgcccggctaattttttttatttttagtagaggcagggtttcaccaagttagccacactggtctcgatctcctgacctcaggcaatccgcccgccttggcctcccaaagtgctggaattacaggcgtgagccactgcaccaggcccatattttagtattcctaacactgagaaaaaagaaggaaaatatttaaaaatcggaccacaggccaggcatggtagctcatgcctgtaatcccagcactttgggaggctgagatgggctgatcacctgaggttaggagttcgagaccagcttggccaacatggtgaaaccctgtctctactaaaaagctccaaaaattagccaggcgtggtggtgtgtgcctgtagttccagctactcgagaggctgaggcaggagaatcgcttgatcccaggaggcgaaggttgcagtgagcctagattgcgccgttgcactccagcctgagtgacagagcaagactctttctcaaaaaaaaaaaaacagaccccaaaacattttgaatattatatatttgtaagaccgtgtgcttatttgaaaagaaatcatatgatacaaagtaaacttttatttttaaaataaaagtttgttttgctcttgagcaaatacgttttttcttactatctttcctgttgtctgtaagatttatagattgtagtctaaattaatttgtttaggtatatagtattgggaggggtatttaacttctaagttcagggatatgtgtgtaagtttgttatatagataaagttgtgacatgggggtttgctgtacagattattttgtcacccaggtggtaagtgtggtaccctttagttattttttctgatcgtctccctcctcgcaacctctattctccaataggcctcagtatctgttgttcctctttatgtgtccatgtgttcttatcatttagctcccacttgtaagtgagaacatgtggtatttggttttctgttcctgtgttagtttgttaaggataatggcctccaggtccgtctgtgttcctgcaaaggacatgatcttgttcttttctatggctgcatagtattccttggtatatatgtaccgcattttctttatccactctaccattgatggacatttaggttgattccatgtctttgctattgtgaatagtgttgcattgaacatacatgtgcatgtgtctttttaggctgtaaatgctgtttcccccatggtccaacagcgaccctgcccagtttaactcccaattcagggacttaggcccgtgaaacctcctaaccacccacaatcctaggtaaggccaactctgtgaccctggtcagcaaagaacagttaaaaaaataaaacctggctgggcgcaatggttcacgcctgtaatcccaacactttgggaggctgaggcaggcagatcacatgaggtcagaagttcaagaccatcctagctaacacaggcgcggtggctcatgcttgtaatcccagcactttgggaggccgaggcaggcggatcacctgaggtcgggagttcgagaccagcctgaccaacatggagaaaccccatctctgctaaaaatacaaaaattagccgggcatggtggcacatgcctgtaatcccagctactcgggaggctgaggcaggagaatcacttgaacctaggaggcggaggttgcagtgagctgaggtcgtgccactgtactccagcctgggcaacagagcaagactccatctcaaaaaaaaaaaaaaaaagacacatagccctcctgcacaaataagtcaagttatcctgtgcccaacttatcaccagacacttgtaagttagctcaccacaaccttggcattatcagtactgcacaaagccctcttcagcatgcagcagaaacaccattctataaaaactcacagcaagcccttgtctctttgcagtcagcatttttcttgctgacctgcctgtttcacccttgcagtgtattttcatactctagtaaatctgcctttttttttttttttttcccccgagatggagttttgctcttgctttccaggctggagtgcaatggcatgatctcggctcactgcaaccttcacctcctgggttcaagcgattctcctgcctcagcctcccaagtagctggaattacagatgcccgccaccatgcctggctaatttttttgtatttttagtagagatgggctttcaccatgttagtcaggctgatctggaactcctgaccttgagtgatccacctgcctcggtctcccaaagtgctgggatcactggcgtgagccaccaggcctggccataaatctgcctcttttttttttgagacagagtttcactcttgttgcccacgctgaagtgcaatggcgcgatctcggctcactgcaacctctgcctcccaggttcaagcaattctcctaccttggcctcctaagtagctgtgtcacaggcatgcaccaccgcacccagctaattttgtggttttagcagagatggggtttcatcacgttgaccaggctggtcttgaactcctgaccttgggtgatcacctgccttagcctcccagagtgctgggattacaggcgtgagcccccatgcccggctaaatctgcctttctttgcctacaactgtctaaattcttaccaccggggccaccagcccagatagacactgatcatctgcaacacccgtctgatggacaagattgccctgcagagttcaagtctgagagttcccctagagctaaactctcctatcaaagtaagtcgagtctagaggcatggcagtccctggctgtgctccattacagaatgctcctgcagcaaaccctctggtctccacatcaggtggcttgctgcccttaccactcctctgagcatctctctgccaactcaagtgtccagagtctctctctgttgcccaggctggagtgcagtggcacgatcacagctcatggcaacctccacctcccgggttcaagtaattcttctgcctcagcctcccaagtagctgggattacaggtgaacgctaccacgcccagctaatttttgtatttttagtagagacggggttttaccatgttggccaggctggtctcaaactcctgacctcaagtgatctgcccacctcagactcccaaagtggtaggattacaggcatgagccaccacgcctggcctctcctgtattttttaaataaattgttttgtttacttttttggataggtgatacatttaagtgattttttgtttgtttgttttttgtttttgagatggagtttcggtcttgttgccaggctagagtgcaatggcactatcttggctcattgcaaccccgcctccgggttcaagcgattcccctgcgtcagcctcccgagtagctgggactacaggcatgtgccaccatgcccagctaattttgtatttttagtagagatggggtttctccatgttggttaggctggtctcaaactcccgacctcaggtgatccacccgcctcggcctcccaaagtgctgggattaaaggtgtgagccactgcgcctgacctaagtgatttttagatgaaaagccaaacaagaccagttaccatatattaacattttataattttttataacccatttaaaaaatgtttttatggtcctatttgattctgtgaattagaacatattctttcattttatttatgaagaaactgattacctaacagtataaacctagttggtgatggagccagaatttgaacttaggtcctttgactcttacaactagtgttataattatagtgggaaaaactgaactggaagtcaaagagcataattatgactaagtgaataattgcttctaaaagaaatattgacaggttcatgggttttactagataataagcatcttatataatactactcccataagtggtagtattatactgctttttctccaatttttagaagtgttaacctgtcatgttgtttcacaacatcagtgaaccaatagatacttcttatgtgcttgtatgctattgtatccttgttcttgtctgtgaattcattcttctttaggtgcttcatgcagacatctgtacaccagatttacttctgcaaaatgctgatgctatgaataatgcttttgaatattaataaggcaaaacagaccaggtatgttattttatcaagcaagaaatttgtcattaaaatatatccagcaagatatgaaaagagattagtaggtgagaaatgttttcatgttaaactttttaaaaactactcctcaaacaactataaggagtataatctccttatagagtataaggaaaagtgctgtttataaaatgaaaacaaaccttgtctgattttggaaaacatagtatctaattttttttttttttttttggagacagggtctcgctctctcacacaggctggagtgcagtggtgcgatcttagctcactgcaaccgccacatcccaggttcaagcaattctcccacctcagccttccaactagctgggattacaggtgtgtgccaccatggctggctaattttttgtatttttagtagagacagtgttccaccatgttggccaggctggtctggaactcctgacctcaagtgatctgcccacctcagcctcccaaagtgctgggattacaggcatgagctgtgacacccagcgtgtctaatttttgacagataaaatgatttcatgatccaacatttccttagcagtgagggatacaataaaataccaattctcagtgggcctttatacttcttttttttttttttttgagaggagtcttgctctgtcgcccaggcaggagtgcaacagtgcaatcttggctcactgcagcctccgcctgccaggttccagcgattctcctgcctcagcctcctgggtatgggtaactgggattacaggcacgtgccaccatgttcgactaatttttgtatttttagtagagatgggatttcaccatgttggctagcctggtctcaaactcctaacctcaggtgatccgtctgcc

SEQ ID NO: 3139 - DNA, 460 bp, Homo sapiens
atcagtgcacggtgccaccatccttccaggccctccagccagaaccccaggagctgaaagccttgactcctctttctctcacccctaaatccagttcaagaaggcaggatttcgtcatgttgcctaggctggcctcaaactcctggactcaagtgatctgcccatcttggcctcgtaaagtgctgggattacaggtgtgagccaccattcctggccttattttgtgtccagcttctcactcagcgccacgtttccaaggctcacctacgttatagcctggatccgggcttcattccgttttatggctgcgtagtattccactgcatgggtggaccatgttttctttatccagtcatcggtaatggacatgtgggctgttgcacagaagggtcctttttattttctccctagctttactgaggcatcactgacaaatagaaattacatatatttaaggtta

SEQ ID NO: 3140 - DNA, 1764 bp, Homo sapiens
cccggaccccctgggccccaccctcagcgctccccaccgctcggcgcccctgcgtctgcgctcccctctctcccctctctatccactgggtctgggccgcacttcccgcccacccgcctgccagcggccgggaagcctgtggaagttatggggatgcagggagagggggagaggggagcttgtgtgctagggtctgcaaagctcgtctgcatcagacaggaattttccccagacgcgggtgcacgtgaattaattcatcagaaggcggttcacggcctgagtgagggggacgagggcggcgaattcctccgcctcattcctaccctgacgattcgaggtgggtgagaggaaggcgtggggcggctgggtgcgtggggtgggggaaggtcacctcttcggcctctctgggccctccagcctcttcctgagaggagctcgcctcggccccttggttggggggatgggagcgtctccggaaggccctcggccgagcagctgggcctgcacccctggtcccttccagttcgtttctgctgcggcggcaagaggctggggagccgatgactcaccctgccggctaattgcagcgttaaataactttgcgccggattcggtggctgcagcagggaacgcgctccgggcgccgggggaggtggagggacgccctgagaacgcacctccgtccctgtcaccagccttagcaagttctggcctgtggagccgtcatccagagcgcacagcttcatgcccttgaagggcgcagtgtgtcccgtggtgcccggtgggcccggacagagaccccagaggctctgtctgaaggaagctgcacccacagactccatccaggcagcgcgggcgcggtcctgtcgcctacctttctcggaagccatctgcccatgtgaatctatgtgaaggcccttcatgcgctcctggacatctgcgtgggatttacttcaactgctatcgctgcgaggaggacgagcatgtttcactgtatttttagcagagagtgcagattttagaacctcgcgaacggtcctgtatctcctgcacgatgactctccagaacaggaatagtgacccttcctttgcatttatggtgcataggttttcaaaggacagtgtgtaaatcagcttgtgtaataattgtggcacccacgcgcgcaagcagacttaccatgagctgacttccactgattatttcagtttccagggaaacgaggtttgcagccccctccagtgagggcggagcggcctctccattcccaatgcagcaaggctgctgcagccacgatgattaggctttggaggaggaagtgaacggatggggcctcatcctcctgcctccctaaagggtgagggtggaaggatggggctgtgccctcttagggcagggaaaaacagcttggaggggtttctgccatcagagatcccataggaggcaggtcagtcctgcagaatttctccccagtctggcctccagcctccctggcccctttctagaggcctccatcccactggcggcttgctcctgccaccgggcctctgcacagtcacctcctgcagcctggggtgtgtcgcctctccacgtcctcaccggcgtctgcctttgcatttcccagatgctcgcttcaccccactgagatgtaactcagttttgtgggatcccactgccctccaggtgccgctccgagtgctctacacagattttcattcagtccttgcggcacacgaaggtaggcggccccactgccctcacagagg

SEQ ID NO: 3141 - DNA, 9795 bp, Homo sapiens
cttcctgctcgtgccaccaggccccggggccgcgacgcgtctctccagcccgggatccggggagctgggctgtccccagaccgacgggacagcggcatctcctccacctgaaaaggaaagaggaccaggtgggggccaggcagggcgcatgaaggcggcgccagcaccgcgcgatccgaatcacgtcggtgcgggggaggggtcggagcctggcctcggcctagggcgcagatgcggtgcgcaccgcaggggggcggcgtggggtgcggggccagtcccgccgggcacggggtcctggtcctcatccccttcaccgccgccgcccgcctgggctggcgtttccccagcgagagcgcgtagtttgcgcagcgcccctcgcccacgccgccgctgggtcgcggggcgcgcctacccagagccgaggtcccggactccccggccatcgcgacccttccggggactcctcgccccttcgcggtgggaccaaggcccgggtggggccgggacagggtggtggggggaagggggaccgtacaaaagcaaacagaaaccacggggggctcgccgcgacgcccagtccgagggcctctcgcctggaagagggaagaaacccacgtcctggacgcgggtgtggggtctgtcccgggtcaggacctgttgtctctgcgacgttgccagtccggagagctcggagggccaatgcagccccggattcaacaagatgcgaaaggacttctaaagccaggaaccggcacccagccacggccaccgcccgccggcccggcgccctgcccccactcactgcgcccccaagttccggcgccgcgggctgcaggggtgacttggctcggcgtgcctcggggcacgaggctcggccccgcacggctctcgggtcccggggggctggggtgggaagggacatggccggcgcgcggcgctggggagccgggtgcgccaggctggggaccttgcgtggggcagggcttggctcagccgaggggccgcggctcagcccccctcaccggccttaaaggttcccagagacgcaaagtcggacgcgggtcctgagcgcggagctacaggggggagcatggggcagcccccaaggcgcgctccctgcatttcccaccctttccacgctgccctgcgcgcacggtcgggcgcccttggggtgggcagggaggcgcgggcaggggcagcgccgaagacctcccgccgccatggagaaggggctccccacccaccctcctgccccaaccattatagatcccagccagtgcgccccgcgcccttccgggacaagctgcccccaggaccaccgtgccccagtatcaagcggacagcaaatctctcggtggctcctttttttgcaggactccgaactgggcccgcgagatctccacctgcgcaaaacgaaagggcggattctccttggactcacgaggcaaccgctccccggggtgagaacgggggactcattcctccggcactgggagaagacgattctttaggaggaggacagggaagcgaatgctacccagaacagtgctagagaagccgtgagccagctggcaggtgagaacgcccaggtgcaggtggatggctgcaggtcaggcctacttttcctacacctgttgctggggggcaatcccatacccactctcagtccagagtgcctgtcaccacagggcaagtaggtgaagggcttctcagatcctcaaagactcagagggataaaaggaggcagatgggtcctagaggcagcccatggcaagggagaggtctgcttttttctttttttttgagacggagtttcacttttgttgcccaggctggagtgcaatggcctgaccctggctcactgcaacctccacctcccaggttcaagtgattctcctgcctcagcctcctgagtagctgggattacaggtgcccaccactatgcccaactaatttttgtggagacggggtttcaccatgttggccagtcaggtcaaattcctgacttgaggtcaaactcctgacctcaggtaatccacccatctcggtctcccaaagtgctgggattacaggtgtgaaccaccacacctggccgaggtctgcttttctgatcagacaaaagtgggttccaaccttgactcactacatggcctgggcaatgtgccagcatcttcccaacctctccctgcacccccaaataatctcattcaatcttcaaaaagccctttgagataagtcctaggactgctgcatttacaggtgaggaaattaggacctgaaaggtaagactgggttggccacaaccaacgcagggaggagagcggggtggacccacgacccaaggtggcgcctgtcggttctccaagccctcactcctcatgtacctgccatcctgcctcaacttcgcaaattgcttacgcatgctgagcgtgtgtcctcgtgtacaccgacagcatcaggctcctagtatggatgcaataagtactgtggaatgaatgaatgaatgaatgaatgaaatgaatgcacacctccctacccccagggtgatgataaggactgtgcaagacagagtggctgcacacagtaggccctctcatgcatgcagtcgctcttctaaaacatctctatgaagcacctgttttgttccaggcattgagggaacattggtgctcattggttctctgttccttgcagacagacctgggagcattctccttggaggtccccacccttgtgggctctttttttcttgctttcctttcagagccaccaaaatgcctggacctgggcagctaacagtgggatgaatctgctttagagacaccagactgccagctagagaattgaaataacctgattcttatctatttttccatccagagagggcacaccaaggctaggcctcattttttttttctttaaacatttttgtgttgacaaataatgttttataaaggcctcactatctgccaaactgtgtctcacttctccccagccctgccaggtgtggggacaccgaacccacccatatctcctctagaatccaccgagcactgagatagccacatctctaacctacacctttaacttacaagccacagtcaagagggctttggagaaagggaaccacagaggtagcacggacaagcctccactatctgcccctggcgcaggacgcccacaaccccagacacggtgcacaacggtccctcaggaagcctttccttgagtcctacatttaaccacagaggcccagaggcccaggcgtggtggtgactgcctgctcggcatgccccaacctttttttttttttgagacagagtctgtcgcccaggctggagtgcagtggcatgatctcggctcactgcatcctctgcctctgggatttaagcgattctcctgcctcagcctcctgagtagctgggactacaggcgcccgccaccatgcccggctaatttctgtatttctactagagatggggtttcaccatgttggtcaggctggtctcgaattcctgaccacaagtgatccacccacctcggcctcccgaagcactggaattacaggcgtgagccaccatgccctgctggcctcccgctctgagattaccttttcacctcagatgagaaaaatgaactcagtaaagtgcttgggaaagaaacatctcaatccaagccaatgggaaagcctggcaaggaacccaaggaatgtggatctccagggagcccatggctccatcttgttcaaaaccagacatggtggtgcacacttgtagtcccagctactcaggaggctgaggcaggaggatcacttgaggcaggagtctgaggctgcaatgagccaagatcacaccagtgcacttcagcctggacaacagagggagaccctgtctctaaaaattaaccaattaatttaaaattttaaaaataaatgaattaaaggatgagaatgttctggaatgagatagtggtgatggttgtaaaacttagtgaatatactaaaacctacagagttgtatactttaagatggtgaaatttatggtatgtaggttcatctcagttaaaagaaaaaaaaagccaccattcgcattcttccttactggctgaaatatatggcataaacccagctagttaccggaaagcctcagcactcttgataaacagcaactctgctaacttagatgatctcatttcagtagggagtacacaagatcagccatcctagggctgcagcgggtctctgcagggggctgtagtggccacggcggcacatcatcaagaggcctgggcaacctgtctcttacaccccctgcagacagaactgcagggacacagggccccagactgcaccctgcagaaggaaggggtctcagaggaaggggctttcttcactgcaccctgagatcagagaactgcttggtggggtgatggacaggcctccgtgtatgggtgggtgtgtgtgggggggggcggggcagggggtgatgccgcatggctgggggtgctccaaagagcccacctagtacttacaaggccccatctctcaataaggaagcccaatttgttgtgttggtgaagaaattgccaccagattaaaaatggcaaataaatgcaagaattcaaaatactgtacaaagggggaaattacttttaggtatttacttactgctttgctgactggacattttaaccgaatgtagctttcagcttctgtttattttccagaagtttattttcctaaaaccattccttggctcatgcctcaaagcaacctttttcccaattaaattgaggacagagagaggtcagtttattcttaggagattgacaatcaatagatggaatgatatttaatacataaagatgtattatttagctgtcatatcgagtctgtattgtatatgttatgtacggttacgtgttttacagactttctcttttgatcccccccacagctctgtaaaatccctagtattatgcccatttagcagataaactgagactcagagaagcttcattctcacgaccctgtctaaggtcctacagtgtgtaagcaacagacgtgagatttggacctctgctggacccccaaaggcggggcagcgaacactcccctccactccgcgcctccgcagaacacacagggcaccatttcacaaacacagcaggcacagagagaaactcctgcattttcatcataatgcacggaaaccccctgacctcaagcccagagaagtgagatgcatccaggtctgtttgctgcctgcatgtttcacaaatacatctaacaggtcaaagtttcattcttgatttggatcaaaggggaaggagaaaaaggcacaaactgaaccatcaactctgtcaccgaaaagtggtcccctggatcttagtgctttgccaccttcttgccacccctatagtaaaatgcttttttattctttctttaaaaatttctgttattattattttatttaaatggggtcttgctatgttgtccaggctggtctccaacttctggcctcaagcaatcttcccactccagcctcccaaagtgctgggattacagacgtaagccaccatgtccagccatgatttttaaaggcaggcatactttatactttttgtacacacttacagctctgattctttttttaaacatatttatttatttttgttgagatgaggtctcgctatgttgcccaggctggtcttgaactcctgggcccaagtgatcctcctgcttcggcctcccaagtagttgagattacaggtgagagccgccatgcctggttcaggctctgattcttatgtcagtgaatgcccagtaaattattgttggcttgaactgaattatcaagaaggtgctatcaagaattctttgagccaggcacggttgctgacgcctgtaatcccagcactttgggaggctgaggcaggcagatcacttgaggccaggagtttgagactagcctggccaacatggtgaaacctggtctctactaaaaaataaaaaaattagccaggcatagagatgcacacctgcagtcccagttactcaggtggctgaggcaagagaattgattgaacccaggaggcggaggttgcagtgagccaagatcacaccactgcactcctgggtgacagattgagaccctgtttcaaaaaaaaaaaaaaaaaaaaaagaagtaaaggaaaggaaaaaagaaagagaaaaaaaaagaaaaataattctttggctaggtatgatggcactttgggaggccgaggcagacggatcgcttgagcccaggagttcaagaccagactgagcagtatggcaaaaccccgtctctacaaaaagtacagaaacatagcctggggcggtggtgggcgcctgtagtcccagctactctgaaggctgagatgagaggattgcttgagcccaggaggttgaggctacaatgagctgagatcacaccactgcactctagcctgggtgacagagcaagaccctgtctcaaaaaaaaaaaattattatttgggagatataattttacatcatcagagggtcaaaaaaaaccctctattttgcctattggccccatttgagatgaccctggtgaaatttctcagctaactttctccacctctgtcaagttgaccgagacaccacctaaatctccatgaaggacctggcagctttccggctctgcagcattttcccgacaagtttgctgcgcacacgcggatgctgacagcacagtctcatgcttgcctaagccagagcaccaccctctagtgtgacaccgtgtgatctctattttaccatgcagaagagaggtcatctcctggtacaagaaaatgggctgtcttctggataaccgcagcaattcatctctgagtagctgaaggtcattagtatgcattatacaagtggaaccatttgagagaaaagagggaactcactggacacaaaagtgcactgagactgtgaacagcaagtcccgaacaaggacacagagatagatcccaaagggaaaggctggagggggaaggatgcgacccagccgcagtggctgatccatgagggctcctgtctgggttcgtgctgccaatcagtagcattccccaggcaagacgtgggcgccaggcctgacttgaaacccaaggttggcttcaagatcttgcagctggatcagaatgctgagttcatcgttgctggtgggccgccgtcacctctccttagcccccctgttgaaggatggccggcccctcctgggaaaattgctacatttcctcagataacagatgcacacatgactaatcaggcctaccctaagaaatgagagccagcagcagaagccacagcgcacactctgtattgtgaaaatggaatgtgggatgacctaggagatgacacaaatgccgaacggcgaactttctgtttctatgagtctaataatgaaaaacttttctgcctgaacccgtgggatcgaataaaatgaaaaaccccattctgcaaaccactgcgccccatgggaagcagctcggtttccttcccgtgtcgtcgggagccctctgatggaggaagcctaaattacagcgctcataacctaacaggcagccgccgggctcaagtgccccctgattttccagaatcgaaaagaagaggaaccataaaagaagccgaatgttttctccccctggcactttgcccagtgacagttgtcaatcagaggtgctgcagaccgactcgaaggcagcgttcagtgcccaggcacactgcctgctgccgttggttcctcccatggttctcagggcgccaggtctctgtcaactcccagcccccagtttccttaccttgtcctactgcatctgagtcaggatgcctgatgggttgagcgctgatgatctcatccgtgtcccacatgtcccagggaatcccaggtctgccctgagcttcctgtgtccttgggaaagtcggttaatctctgggcctcactgtcctcatcgctgagcttggggacttgtaacagatgatttctaagtatcttccagctttgaatagagcatttgtcttgggtggccaggcttaaagtttaaaggcataaaaggaaaatgggatctgatctttaatcagaactgctgagaatgagaagcgcagagcaaactaccgactgcattgggtgaaaagtgaaaatggtcggtggggaggtgccacggtcaggatctgaggcgctaggatcttgccagtgccttggcgcctttctctgcagtccccggcctgcctcccttctgctccctctcttccggagtctggtgctgccaatttgccaggtgagccccgccagcgtcccattgccggttctcgtggccctcaccttttccttataccttcatccctgcaggagtcgcaggacctcagctggccagttggctctgcctggaaggtgcaggtcttgtccttgtcagggagactggcagccgcaatgctgtgcctgtcccaggctgagcaagaggctcctggtgtcgattctggagcagccacaggcctcagcaggcccccaaaagtgatgacatcagcacagtactgcaccagctctgagggccccactgcccctgccatctcctcctcctctccctctccagtctccctctcctcccagcacagtgcagcctccaagggcagcctccacggtggagatgctcaagctaaagcatggggacaggaaaaagcaaccaccagggtggagggtctcccaggggaagcacaaggtctgggacaatgagaggcatcagtcaccgaaccatctcacaactcgaacaaccccagaagagcgggctggagagtgcaatgtgacatcacttcccatcttgctgggagacagggcttttgccaagaacgggcccctggggattcatcgggcgacattttcatgccactggcataaataaagacttgtaccaaaggctgccattctgggcagaaggtgctgtctagacccccttagggctgccctctctggccccaggcccctggctcctaccacctaagcccatcacatcacccaggagggtcggcagctgctggcccccacccacattcgctggcttggttttactctgcaggggaagctggacttcctccacatccaagttcaactacatgacatcaggaacacagcctttctcccgacaccttcgagcctctatttgtctccagtagctgtcccagaaatcatgggtgggagcattcaaaaatgtggttccagaggtccccttgccctagcccaaaaggctgcctgagctggggatcccttccttaccccccaatccgaaaggcagcctggccttccaaactggagtccgtggttcagagtaggagatccacagtcagggcccgggacacggcttcccctggctggtctcaaagtcttcctaaccctccaggggtccgtcctggtcttccacggagtttcccaaaagcgcgcgccacacttggtgggcgctcagccccgaagcgcctgtgaacaccgcccatcccaggacgcacgaagccagttggtacgagcacctagaagcagcactccccatttgtcatccttcccacggggaaggctgcctgctgctccgagccctcaactccaatgaagtacagtcgtcaagaaacggtggtctaaataaagccggagactcactcactgcaccaatcagcaccgtgcgtccgtctggatctcggcgccggctgcgcgcagccgccaggaggtggccgtcgggacgcgagcgccgcccggagcagtggtgcagggtctccg

SEQ ID NO: 3142 - DNA, 3189 bp, Homo sapiens
aggtggggaaatggtcaaagagcgatgggcccagaaaagggtcagacccagatggagatgccactggctgctagcagacccccacgctgggtctagcccacccaatcccatggggatgctcctgtgctctgcagacatctgggtgctgccacaggggcccgacagagttggcatctgggtggatctgagccaagtggtgcttctgggcctcagcaagtagctggtgctgattctgggcagccaactgtggcagcatcttcaggtgcgagtgctgctgggtgaagctgcgtgggcagtccagaaagtgacgtgacagtccacagggaccgacgtagggtttccagcccctatctgtgcagatgctgtcctccaaaccatcacggtccctctctggctggggacgtgcgcctgccactgctggcttgccagcatgatcattggttgtgacctgttgagcccatcttgccagcctcacaaaggacagtactagctgcttatgacaggaaagtggaagaacttggcctggatatttctggagaattaccgtgtgtgctagtcagtctttcgtgtcaaccaggccaggctgtggggcccagtgatctcatcgagaggggccgaggtgttgctgtgatcgtgtgctgctggaatgtggtgaacacctacagtcgatttcacctaaagatcatccttgagaatgtgggtgggcctcatcctatcagctgaaagctttaagagcaaaacccgaggtgtcccagagagggaattctgccttgagacggcggcttcccactcccactggatgtccagcccgcggccccacggctgggtgagcccgtcctctcctcgtttctgtctccggacccaccgtgtggccccagaccctccagtgaggacctcccgtatttcttcagagcagcccttgcgtgctggaggcctgggcttcagtgtgtccctgggtgccctggggcatgttctgtgacctcccagctcctcgcctcatggggccgctgtatcaagtgacacagtttgtgtgctgcgtaccatgcctggcacccatttgaggtgttgcaaggaggccatgtttgctcgatgagagcagcctaagatctacaaactgttgttcgagtggatgggaacttgatgctattttcaggctgaatgacaagactccgcgatgcttctcggcctgggctgcacaacggaatctaccagggaggttttaaaaacactggtacttgctggaggtggtggcgcctgtctgtaattgcagctgctccagaggctgaggcggaggattgcttgagcccaagagtttcggtttatttgctttttcagagtcttgctcttgcccaggctggagtgcagttccatgatctcggctcactgcctcagcctcccaagtagctgggattacaggtgcatacaaccaggcctggctgatcttcgtatttttagtagagatggggtttcaccatgatggtcaggctggtcaagatctcctgacctcaagtgatctgcccgcctcggcctcccaaagtgctgggattacagacatgaaccacaacacctgccgagcccaggtgttttgaatccagcacgggcaatggcaagaccctgtcccaacaaacaaaaaaacactggtgcctgaggcccaccccgagagattctgattgagttgatttggatttgaattatctttaaaattttggatgtgaattttttttttttttcttggaatggagtttcactcttgttccccaggctggagtgcaacgggacgatcttggctcaccgcaacctccgcctactgggttcaagccattctcctgcctcagcttcccaagtagctgggattacaggcatgtgctaccatgcccagctaattttgtatttttagtagagacagggtttctccatgttgctcaggctggtcttgaactcctgacctcaggtgatccgcccgcctcggactcccaaagtgctgggattacaggcatgagccaccatgcctggccggatgtgaattatcttaaaaattttcaggtaattctaatgggccaaggttgagaacccctgctctgggcccatccgagcaccaggctgtcacaaacgcatgcatgcactcacgcccgtgggcttggggggcttcggaaatgtgcttctgcttttttgagatggggtctttctgttgcccatcccggagcacagtggcacgatcacagctcactgcagcctcgacctcctgggctcaggtgatcctcccgcctcagcctcctgagtgtctgcttctggttttcatgatgacctggggcccaggcatactacacttgtgctgttcaggggccagtcctgcaccaggagcccatcagccacagctccgccgagaagcactgatatgcagagctaagcagctttgtttccacgtggatcctgcgtaggttttcttggtccatccgtagacaccgcactcctgcagaggatcttctcgggatgccccactgtctctgttttccctcttcactgaacactcagtcggggctcgccatgatgcctctgtgtctgctggcttctcccccattggaacagccttcttggcacgccacactgctagctgctgggcactgtgctttctgcctttaccgttctgccgtgatgttgccaaaatagcagcaacaacaacaacaacaaaggctgggcacctggctcatgcctgtattcccagcagttcgagatcagcctgggcaacatgccccaactggaccctaggcaaaagtgagtggcactcctctgccaggactccaggcaagccccggcatcttcttgctgccgtcccagacaacagaagttaccagatgaacagacttggatgggccacgggggtggagagctggaaagcttggctgtgcctctcgatgatgattaagatttcaatatttacagcaaaaccacaaagcaaatgatagaataaagcaaaacaatggaaaatctgagttcactcgtgagagaggtacgtatgtgagctctgaggaaattacagagggaacgcatgcagcgggacagctctcccaatcgcagcgtgcaaagtagacatccatagtgtcttttgaaaaatgaaaaacacattactttgaacagccaagaaaaaaattgcaatttattaagattcaataaagcgttgtactttcgaaa

SEQ ID NO: 3143 - DNA, 3188 bp, Homo sapiens
aggtggggaaatggtcaaagagcgatgggcccagaaaagggtcagacccagatggagatgccactggctgctagcagacccccacgctgggtctagcccacccaatcccatggggatgctcctgtgctctgcagacatctgggtgctgccacaggggcccgacagagttggcatctgggtggatctgagccaagtggtgcttctgggcctcagcaagtagctggtgctgattctgggcagccaactgtggcagcatcttcaggtgcgagtgctgctgggtgaagctgcgtgggcagtccagaaagtgacgtgacagtccacagggaccgacgtagggtttccagcccctatctgtgcagatgctgtcctccaaaccatcacggtccctctctggctggggacgtgcgcctgccactgctggcttgccagcatgatcattggttgtgacctgttgagcccatcttgccagcctcacaaaggacagtactagctgcttatgacaggaaagtggaagaacttggcctggatatttctggagaattaccgtgtgtgctagtcagtctttcgtgtcaaccaggccaggctgtggggcccagtgatctcatcgagaggggccgaggtgttgctgtgatcgtgtgctgctggaatgtggtgaacacctacagtcgatttcacctaaagatcatccttgagaatgtgggtgggcctcatcctatcagctgaaagctttaagagcaaaacccgaggtgtcccagagagggaattctgccttgagacggcggcttcccactcccactggatgtccagcccgcggccccacggctgggtgagcccgtcctctcctcgtttctgtctccggacccaccgtgtggccccagaccctccagtgaggacctcccgtatttcttcagagcagcccttgcgtgctggaggcctgggcttcagtgtgtccctgggtgccctggggcatgttctgtgacctcccagctcctcgcctcatggggccgctgtatcaagtgacacagtttgtgtgctgcgtaccatgcctggcacccatttgaggtgttgcaaggaggccatgtttgctcgatgagagcagcctaagatctacaaactgttgttcgagtggatgggaacttgatgctattttcaggctgaatgacaagactccgcgatgcttctcggcctgggctgcacaacggaatctaccagggaggttttaaaaacactggtacttgctggaggtggtggcgcctgtctgtaattgcagctgctccagaggctgaggcggaggattgcttgagcccaagagtttcggtttatttgctttttcagagtcttgctcttgcccaggctggagtgcagttccatgatctcggctcactgcctcagcctcccaagtagctgggattacaggtgcatacaaccaggcctggctgatcttcgtatttttagtagagatggggtttcaccatgatggtcaggctggtcaagatctcctgacctcaagtgatctgcccgcctcggcctcccaaagtgctgggattacagacatgaaccacaacacctgccgagcccaggtgttttgaatccagcacgggcaatggcaagaccctgtcccaacaaacaaaaaaacactggtgcctgaggcccaccccgagagattctgattgagttgatttggatttgaattatctttaaaattttggatgtgaattttttttttttttcttggaatggagtttcactcttgttccccaggctggagtgcaacgggacgatcttggctcaccgcaacctccgcctactgggttcaagccattctcctgcctcagcttcccaagtagctgggattacaggcatgtgctaccatgcccagctaattttgtatttttagtagagacagggtttctccatgttgctcaggctggtcttgaactcctgacctcaggtgatccgcccgcctcggactcccaaagtgctgggattacaggcatgagccaccatgcctggccggatgtgaattatcttaaaaattttcaggtaattctaatgggccaaggttgagaacccctgctctgggcccatccgagcaccaggctgtcacaaacgcatgcatgcactcacgcccgtgggcttggggggcttcggaaatgtgcttctgcttttttgagatggggtctttctgttgcccatcccggagcacagtggcacgatcacagctcactgcagcctcgacctcctgggctcaggtgatcctcccgcctcagcctcctgagtgtctgcttctggttttcatgatgacctggggcccaggcatactacacttgtgctgttcaggggccagtcctgcaccaggagcccatcagccacagctccgccgagaagcactgatatgcagagctaagcagctttgtttccacgtggatcctgcgtaggttttcttggtccatccgtagacaccgcactcctgcagaggatcttctcgggatgccccactgtctctgttttccctcttcactgaacactcagtcggggctcgccatgatgcctctgtgtctgctggcttctcccccattggaacagccttcttggcacgccacactgctagctgctgggcactgtgctttctgcctttaccgttctgccgtgatgttgccaaaatagcagcaacaacaacaacaacaaaggctgggcacctggctcatgcctgtattcccagcagttcgagatcagcctgggcaacatgccccaactggaccctaggcaaaagtgagtggcactcctctgccaggactccaggcaagccccggcatcttcttgctgccgtcccagacaacagaagttaccagatgaacagacttggatgggccacgggggtggagagctggaaagcttggctgtgcctctcgatgatgattaagatttcaatatttacagcaaaaccacaaagcaaatgatagaataaagcaaaacaatggaaaatctgagttcactcgtgagagaggtacgtatgtgagctctgaggaaattacagagggaacgcatgcagcgggacagctctcccaatcgcagcgtgcaaagtagacatccatagtgtcttttgaaaaatgaaaaacacattactttgaacagccaagaaaaaaattgcaatttattaagattcaataaagcgttgtactttcgaa

SEQ ID NO: 3144 - DNA, 5054 bp, Homo sapiens
agcgcgcatgcccgggcccggggcgcctggacctcgggagggagcggagggcgcctacctgcaggccgttggggtatgcgtcgccctcggagagcgagtccaccaggtcctcctcgtccagcgtggcccgcttgtacgtcgacatctgcaaggccaaatgcagcacggactccctcagcgcctccatggctctcgcgcccgaatggggaagcggccccgaccctggcgccgccgccgccgcgccccgccccggcctggacacccgagaccgagaccggcccacggagcggcccgcgcggggaggggtcccgcccgcctcccgcccccgccctccaggccgcgcccgcctcacccccagcgccgacagcagggcggacaccgggggcggccacacgccccgcatgctgtgccccagacgcctggtcccgctgcccgggtggccgggatgggatgggccgggccaggcgttgcaccaccttcgcgggcggggcctgatcggttcgccggcgcccggttcccaacctccggcctcccggggagaccccaagacccgagaggcccgggggagatggggacccctcccttccccggaggtcgggagtgggggcccccaaactgaagcccctagcaggcaggaaaggccctcacagtgacccctccttcgagaaaatcttaagtcccccttcaacaaccgggtccccagtggcagataacaaaagtatcaggaaggtgccctcgatgtggcccagagcaatcaagacaggttccccccggcatcagcccttaggtgtgtctagggggttaatgctagaaagaccagacaaaaaaggtggggtaaaaaggtaggtgtcccctttcagttcccctttctagctcagaggcctttaagccagagttcgtgaatgagtttcagaaaatttcagagaactccctgacacgggatgaaaggagctgtgtgtgtgcatttggatggctgcagggtggtccggtggtcacccccgtgctcaaaggtgtcgccctccctgcaacacaagagaaccattgctccagggggagtcagaagccaggaaggggacccttctttcccatcttccccctcaagactcggagcctcagccaggtgcccccctccccagcccctgagccctctcctataaccctaggcagggaaagggggctctctcggatatgaggtgttcagttagggactcaggcccagcactgtcccaaccaagaaccccagagaggtctaacccagcagatttccaaaggactctccgcttctagcaaggcgggaatccctgcatttatgcgtacttttcagctttgcaaagtgcatttctgctcattccaaatttgattctcacagtcacacatatgtgtgaataaacaggtttagaggggtgaggggcctgacgtcacagggacagtgagggcaatggctccagatggtctcctggcttccactcctgccctctgacagccccctcagcagccaggatgagcctttaaaatgaaatctggctgaggccaggcaccatggctcgctcgcgcctgtaatcccaacactttgggaggccaagttgggtagatcacttgaggtcaggagttcaagaccagcctggccaacatgatgaaaccccatctctactaaaaatacaaaaaatcagctgggcctggtggcatgcatctgtaatcctagctactcaggaggctgaggcagaagaatcgcttgaacccaggaggtcgaggttgcagtgagctgagattgtgccactgtactctagcctgggtgacagagtgagactccatctcaaacaaacaaaccacagaaatctggctgggttcagtggttcacacctgtaatcccagcactttgggaggctgaggcaggagatcacttgagtctaattctaggccagcctgggcaacacggaccccatctctacaaaaagaaaatatatatatatatatttatatattatatatttttaattagcaggacgtggtggtatgcgcctgtagtcccagctacttgggaggcttaggtgggagaatcgcttgaagccaggaggtggcggctacagtgagctgtgattgcaccactgcactccagcgtggacgacacaacaagatcttgtctgaaatccacagctttactggggctgggaccttgtctggcctgtccaacagagactctccatcacccggcacagatgcctcgtccctgagatgagaatcatcacctccgctttacaaatgagatgaccaagggtcagagaggagaaaggacctccccccagccctgagtcacctgcctggagactgagggagccataatgcgaatcttccccttgccaaacccactgactccattacgctgcctccagagaacccgagccccgcggcgagaaagtggtagagctgggcctcgaacctgggtcctggactcttggtcctgtgctccttgtggaagatggaactgcttcttcagagacaaggtctcattgtattgcccgggctgttctaactcctgggctcaagcgatcctccggcctcagcctcctaaagtgatgggattacagtcatgagtcaccatgcttggcctgggcaggactttctcaagtggaactgcctcacacacagactccctggagctggcaggatgaagcccatgaaccttggcctggcttgctaaaccctccctcccgactccctcaggagttcgagtctgccttctttctccggctggctcctcagcttaacgcgctttcctccaggcagctctctcgggcttcgcagtgacccttcctcggtgctccgcggcagcatgcttctggcatctcatcccaacacagtgaagagcagccaagtgcggctgtgtggccctgaccaagtcatttcacttcaattttatgctttggctttcacatctttccacggacgtgaatggagatgatcatggtgccgaccccaaaggatccttacacgtcttaaaaaagtgagccacggaaaggcctcagcccagtgcctagcagagaagcagcacatgggagggaaggaacgaccagagaagacccgtggtgtgccaggcactagacctggggctcggtggcacatgtcagctccttgcaagtgtgaaacaactggagtgcagcgagcatcagtaactcaccctaagtcacacatctggtaaacagcaaagcctggatttgaacccaggttttcccatgacatcagataagacggcaatcaccacctccttctaacccaccctgcctcacctgctccatccttacgacttcaggtgtcacctcccagctgggtttaaggggctgagttgtccactctgatcttctccaagcacaaactgcaaagcagaccagaaagcagctggtcctgactccagggctacccacagatgcccctgcacctcctcatgctcctgtgctcctgtgtgatgtcctggactgtgtgatgaccaggctggggaagtcccaatctgaagagaccaagcgctctctgacaatgtgctgatctaatcacgtacaacttaagacaaagttaacccgtctcattgaatgatatggtataatggtgatgactgagctgcccagtaattgtgctcaaccaggaagcagctcatggagtcagttgtaattagtatttgtgttacacaggtgagtgggtgggtgagggctgggcagagggaggaggaagtgggtggggcaggaagctctggggactccttggatccatgaaccccatgccagccaactcatgtggttgatcctgtctaaccttcatgatgacctcatgatgtactgttatctctcttctaaggtgagaaaacaggctcagagaagtccattcacttgtccaagatcagacagctagaaaatgacagagccagggttccctcttcagcccaggcgatgtcttggacagcagaaggaacaggaatagggctgggaggctggagatccacatctcggtcccagttctaacactgccttaccctgggcctcagcaagtagcatccctcttcaggatacaaagagatagtatgtctgtcaggttgcagacggctgagggtgtggacttgggagctaggctccttggattctaatccttgggcaagctacttcaccatctgagcctcagtgtcctcatctgtaaaatggagatgacaacagtgtctccctcataggcttgtgaagataaaacgagtaacaagacttagaacaatgcctgaatattattgtcatttatggggaaaaaatgagctttgctgtccatttttcatctgtaaaatggggaagtagttgctggatctgaacagtggtttgcaaacagattttttttcattccatagagtcctttatttaaaaaactaaacacagcaacccaaaatacaaaagagatgtaagtggagctgccacttaggcactcaatgagctcatatcctgaccctgaacccagctccctcaggggttctaaggaatggagtttgaaaaatcactcaactgtctctgagaactggtggctctaagctgagatcagggtcgggtggaagcaggaaaccatggcatgggccaggatgctgctcacccactggaggcagcacatgggggctgtgggacacgcagggttccctgctgctggcctgctggctgccaccattccagctggacaacagtatccccaggaggcggctgagaagcagggagaagaacaccaggcttggagtcaggtgggtggctctgggcaggtcgtgtccctctctggggcccattttcctcacctctaagagagggatggtaacactgcactcatcaggggtcctaaggacaaaattgcatcacacatgtgaaaaggctttgcaacggaaagactgccctgaatgacttttttttttttgagacagagtcttgctctgttgccctagctggagtgtagtagtgcaaactcagctcactccaacctccgcctcctgggctcaagcaattctcctacctcagcctcccaagtagctgggaccacagacatgttcc

SEQ ID NO: 3145 - DNA, 7092 bp, Homo sapiens
atcagcctcctgagagctgggactacaggcgcctgccaccacatccggttaatttttgtatttttagtagagatggggttttgccatgttggccaggctggtcttgaactcctgagctcaggtgatctgcccacctcggcctcccaaagttctgggattacaggcgtgagccatggtgcccagcctggctcctgttttttgagacagggtttcaccctgtttcccaggttggagtatagtggtgccgtcatgacttactgcagccttgaactctttggctcaagcagtcctccccactcagcctctctagtagctggggctccaggcatgaatcaccgtgccagactaagtttttttaaaattttttgtagagagaatctctctctgttgcacaggctattcttgaactcctaggctcaagtgatcctcctgcttcagcctccgaaagtgctgggattacagttgtgagtcactgtgcctggctcttttaatcttgaaaactctgggaagagctcacttctgtttaggaggctgccttgggaactgcatctcctgggctggtgctctgtgctgcttggagtctgcagaccctatctgggtcgcttggcctcccgtgcacaagctgccagaatggaggccccattctcaatgtgggggctgcccaaagagcagggagcttcccacaggacagaggctgggcacctgcttggcctggttcttccttttcccagggctccaacacccaccccctcaggtcctcccaaaccctgcaggtccctggcctggtccgtccacacctacactcaggaatctctacacatctctgagttgctgcatctgtcttcaggcacagcccaccagcccccctgggtacccaaagacaccgcaaatatcagccattccagacaacgtcctcctcccgtgtccctatctcatggagtaatgcctctaattcagccacaccaagaccccacgctccacatcccctagaactctcatctcctgtggcccaacatggcccttcctttcagcagtgggatgtgggaaggatcaaggtcacccttgtccaaatcccatgcagacaacggtgttggagtcttgggcccaaagaccagctcctagaacctgcagggaagcaacggcacgttccatctctccccatgccactgaggaatcattggtggcaggattctcagcaggcatggccgtgggtgcacagaacagagaaaggatggcctggaccacacacatcactgtgtgcagatgctttcctagacactgcagccaaggacacagaggctcagagagaataacctccatctcctgggtcccagcgattctcctgcctcagcctcttcctatttcacaagtagggaaactgaagcccaggtaggcaagcctgacttgctggagtcacacaggaagttggcagctctgctccatccctgggatctggagcccctgctctggggaaggagaggtggggcgctgccttcccagagtcccctcaagctggcagggacggctgtacccccagggtcagaggagaactaaaaggagcggaagctggcctgggtccagggagagacctcgtgtttgcccaaaagggagctggagaggggcagctgggcccatatgcagggaggagctgcagggagctggtggcggggcagcaaagagaagtggatttggtgggtagaggggcccctccttggttctagtcctccccgcagccccttgcaaacaggcggggctctcctgtccttcttgtctcctgcagcaagccctacatgaagaggcctctttggtgagtggcagctcaacctctgctaaatgcctccagtgatggggagttcactaccttccaaagtttttaaaagatgttaaccactgctattcaagaacaattctagaatttttttttttttgaaagacaaggtctcattctgtctcgcaggccagagtgcagtggtgtgatcatagctcactgcagctttgacttcctgggctcaagcaatcctccctcctcagcctcctgagtacctgagactacagatgtgcaccaccacactggctcattgttttcattttttgtagagacaggatctcactatgttgcccaggctggtctcctggcttcaagcaatcctcctgccttggcctcccaaagtgctgggattacaggcgtgagccactgcatctggccttttttttttggagatagagtctcgctctgtcgcccagggtggagtgcagtggcgtgatctcggctcattgcaacctccgccttccgggttcacaccattctcctgcctcagcctcccgagtagctgggattacaggcatctgccaaccatgcctggctaatttttgtattttttggtggagacagggtctcaccatgttggctaggctggtttcgaactcccgacctcaggtgatctacccgcctcagcctcccaaagtcctgggattacaggctgagccaccgcgaccggccctgctgttgcttctgaggtttgaaaaccgctgcctcaatgctcctgattcagctcttcttacccaaaggttcccccacctcatctactctgttcctgcacagtcgcccttttctctgatgccccgggcaggtttctctctgccagctccacgcttctggagtcccccatccgtcttggggcccagctgcccactgtctgggttcagaccttctcaacactccctggcttctctgccctagttttgccttctccaatccactcttggtgggtggaagtacggttaccatggtaacttgaagacaacgcaaatctgattgtatcattacaatgactgggaaaacctccagtgccacaaaataaagctcaagtcactagctttgcagtccaggccctttaccattccggcagcatttctgggggctattctccttccccccactgcacaaccccgcctggccaccccaggctcaggctgcagaacagcgtagaccagggagtggctttggggtcatgctaactacctggtttttgtctctttcaggctgtttgctcagttgcaaaatgggaaggacaacagcacccgcctcacaggctaagaggctgtgtgtgaaaagcccgcagcacaggatctggcacgcgtggacgtgcgggatgggaggaggggatttcccagctcctcatctctgcagggactggccttggcctagggaacactagctgtccagggagggggagctttccctgagccccccgatgtgtggcaggcagaggagagcaagctacttctgggaggggagttgtggggaagggcaagttagtctttactgagggtggcagtgagctggcactttggtctcacctcggctgcagaaacccaccctgctcccgtcttatttcctggggatttcagctgtgtgcaggcacagatgcatctcccaagtgcctcatgcttgccttgatctcctctccttcctctggccagtcctgaacctcttggtgatccacggcggcacctctgtgtcctacatccttctctggccatctccttccctccttccagccctccctctaggaccctgaccccaaccatccttcatccccatggggacattcagtccactgactcatcaccctcccctgtccctctgtgagagaaggagcaggcagagaggatcttgcaagagccttcagcaactctcttccacccatcctgttgcttgctgctttttttttttttttttccaaaaaaatagagatggggtcttgctatgtggctggtctcaaactcctgggctcaagtgatcctcctgcctcggcctcccaaagtgctggattacaggcgtgagccaccacacccggctccgttccctttctaagcagggtgctccttttcttgccatttcccccatcctccttcctctcccacagctcacttccctctctactgaatctgctgaagatcatgcagctgctgttcctgcctctaaaaccctctcttggctgggtgtggtgggtgacatatgtaatcccagcactttgggaggctgaggcaggagaatcacttgaacccgggaggcggaggttgcagtgagccgagattgcgccactgcactccagcctaggtgatagagcaagactctgtcccctccctccaccaaaaaaataaagccctctctgcatccattccactctccactcttgctcattctctcctgccctctaaaaggtgatctgtctttggcagattcaatcacttgcctttctcattctctcctgagcccactattccactctggtccccaccacttcccccaaaactgctttgaaccatcgcactgcaacctgttgcttagcccctccatctagtctcaggcgttaggactgactgcccagcagaggctggtgcaaccaatcacctcctttagtaagtttctccctgggcttcacctcttcacctgtgggctttccacctgtctctctcttttttttttaagacagtctcctctgttgccaggctggaatgccgtggcgcaatctcagctcactgcaacctctacctcctgggttcaagcgattctcctgcctcaggctcccaagtagctgggattacaggtgcccgccaccacaccgggctaatttttgtatttttagtagagtcggggtttcaccatgttgcccaggctggtctcgaactcctgaccttacgtgatccacccgcctcagcctcccaaagtgctgggattacaggcgtgagccaccgcacctggcagtctccctaatttaattcagtgccactgcgggcaggtggggtgtggcctggttgggcagtatagagctaccagctaccaatggtgttcagccctcagggtcgagcgtgggttgtctcagccccttgcaggcagggctggagttccttctggtgcgagttgggggacccagctcccccatccctctgcaaccccaggccccccaccaggtcccctctggttcagcctggtgccttccagcacccctggcccccagaaatccctggtccacagctcccttgacctgaggcctgaaattgacccactgccccctgaggcttggtccaagtccaagtatgccttcctctccagccagatgcctgcctgccactcagcatgtcagagcaggcagggcctctagattttaatggggaaactgaggcactgagggcagatgtgatgtccccagttgggaaaacattaaagacattctgggcttctctctcttttttttagagacaagatctcactctgtcatgcacgctggaatcatggctcattgcagcctccaactcctaggctcaagggatccttccacctcagcctcccgagtagctgggagtacaggtgttcgtccccaccatgtctggctaatttaaaaaaatgtctttgcaggatgggatcttgctatgtttcccaggctggtctcaaactcctgggctcaagtgattttcccatcttggcctcccaaaatactgggattatacgtataagccaccacgtctggcctgagtcatctcttttgacccagaacaaaaccagtccaggagtggctgtactccccaggagtgtacactggggaggcccacagctccggggtgcagtggggctcttgcaatttaatgactgattcatcttcaaaaaagcacaatctcagccaggcgtggtggctcatgcctgtaatcccagcactttgggaggttgaggcgggctgatcacctgaggtcagaagtttgagatcagcctggccaacagggtgaaaccctgtctctactaaaaatacaaaaattagccaggtgtcgtggtgcacacccgtaattccagctacttgggaggctgaggcagacgaatcacttgaactcgggaggtggagatcgcagtgagccaagatcgtgccattgcactccagcctgggcaacaagaagcgaaactccatcttaaaacaaacaaaacaaaacaaaaacaaaaaagcataatctctttcagaatttttaccttcttggtgtggttctgttaggaaaggcttccatgggaaccttcaataagtgacctaaaaaaaaatctcagagcaattcctttttttttttttttttttttcagacagcatcatgctctgtcacccaggctggagtgcagttgcacaatctcagctcactgcaacctccacctcctgggctcaagccttcctcctgctttggcctcctgagtagctgagactacaggtgcatgccaccgtgcccggctaatttttaaattttttgtagaaacggggtcttgttatgttgcccaggctgacctcaaactcttggcctcaagcgatcctcctaccttgtcctcccaaagtgctgggattacaggggtgaaccactgttcctggtttagagccattctttttttttttttttttttttttgctttgtggttttgagacggagtttcactcttgttgcccaggctggagtgcaacggcatgatctcggctcactgcaacctccgacttccagtttcaagcgattctcctgcctcagcctcccgagtagctgggattacaggcatccgccatcatgcccagctaatttttttgtatttttagtagagacggggtttcaccatgttgggcaggccggtctcgaactcctgatctcgtgatctgcccgcctcggcctcccaaagtgctgggattataggcatgagctaccacgtccggccctagagccattcttaacagggtttgtctccctggaaacttcccgaagcctcaccctcccaggaattccctgctaagtgccacagtcatctcttcaccactcggtttccactctcccatccttgcaccgagatcccactgttaggcctttttcaagcacggaccttctcatgctcagtctctctgtggtgtggaagtgtctactgggtgggcctcacagaaggttccaggccctggtacaagcccaagggaaatgatgatccaaaatggactccgataaagtttctgccactctgcattgggggcttttggtaggagtccagttcaattttataaaaataaaaatacatgtctcgca

SEQ ID NO: 3146 - DNA, 4763 bp, Homo sapiens
gtttagtatttttgagaacccagccacctggccatgctgtaccagccttgtgctgagtgctggggataaaggaacaaataaaacccagtccaggcttctgtgtgcccagccctgtgccgggtcccagtgggtaacagcatgtccaatcccctcagtgtcccactagaggcttcctttggggctgctggggacatcttgtttctagttgagaattcagatttatgtccaaagacaagaactccctgaggggcagattacaacatggactgggccattacaatcaacaaggacacaaagctaacacagccatcgttatacaccagacatgtgctaaggacttgatttccccattgtttaatcatcaccaactccattatcacccccatttcacagatgtggaaactgaggctgagaagagtaagggacttgtccaagggcacagagcaagtcagggctacggtgatgtttcaggcccagacctgtttgcctctggagcccagggtttaacacaccccagtgctgctgtgaaagggctctggacagctcaggctggccggccaattcggggataaccgaacagaggtatggaacagaaaggggcgttgaggatgttgctgtgtgtgtgcggtggggggagtgacaaggcttcagcaatggtactcattctctccaaccagctcccagtgctgctgtcctctgatccaccctccgctctgcctgccatggactaattgttctgaaatcccatggatcaagtcactcctcagctgaggacctgtccatggctccctggtacccagaggatagaaacccagcattcaaaacctctctaaccagctccccacctcaaccctcacactcctgctcactagcccccaggcgcagtgggctcttccagcggccaagcctgtgcctacggtgccttcttgcctggaatgcccaactcccccttctcagccttctttgactctcaagtaaggaaaagcactctttgtctccctgagccccttggcacttatcacagagcactctgggcgttaacttccactgtctccgtcttggattagagtggatctcagagggcccggtggtgtctgcttcacctccctctccactgcagcagcttagcaaggactggccgggtaaactaaaaaatgcaaagagctgagagaatcctgggaaagtgcacatttcccaggactgcccaatgacaagccccgtaccaaggcacagcatcaggataccctgatgtggaagaaccaaaaattgcaccctcatggcttatcaggatggtccttgtgtctgtccctttcaagggttctgataatgaaatctgggcaagtcaccctcctgctttaaaacttccaatggttcccagaggtctagcataaaatccaaactcaagggcccacataacctaggtgctgcctggcccccaggccctcctcttgccacgcccccctccctggccagcctccctcacttctttcagttcctcaaggactccccctcactaaagccttacccaggtcgcctctctgcctagggggctcctccattccctgctcactcagccacctccctctccctcttcaggtctcactttttaggggaggcttccctgatctgtccagataagacctcaccactcccacccaatcccaaacgctcccataacctgatcgtttccttcacagcaagaattaatcttcagtgtaaataatgatctactgaagacctatgaggaatgggaaagtcttgttttttgctgattcttcaacacccagctcagagcctaaatatctctcaaatgaatgaatatatgaatgaatgaatgaatgaatgaatgaatgaatgaacctatatacataaatcaagacaagaaggtgggcagaatcctagggaacactgaggcaggaaaagcagggccctgggccaggcgtcatggctcacacctgtaatcccagcactttgggaggccaaggcaggcagatcacttgaggtcaggactttgagaccagcctggccaacatggtaaaaccctgtctctactaaaaacacaaacattagccgggtatggtggcacatgcctgtagtcccagctactcaagaggctgaggcaggagaatcacttgtacctgggaggaggaggttgcagtgagctgagatcgtgccactgcactccagcctgggcaccacagcaagactccgtctaaaaaaaaaaaaaaagaaaaagaaagaaagaaagaaaaagaaaaccagggccctaactaaaaaagacaggaggaaaaacagggccctaactaaaaagagaggaggggccctaactgaaaaaaccagggccctaactaaaaaagtcaggaggaaaaacagggccctaactaaaaagagaagaggaaataaaccagacagtgcagcctcccagaagcaaaaggagggagtttctggaactgcactagagactggcacatggagtcctgaggaaagagcactggattggacatcgaggaggtcactggggcctccctgattgaaccaaggttccgtggaggtgggcacagggctggtacattgcagggggcagaggagtaaagagggatgaataagcaaagctctcaggcgacggttgctcagctgggtctatgccagcctggccctgcagggtctgcggaagacagggcccctgtgtcatagtcaccaaaagcatcaacagagcataacattctttttgttgacagattacattgaggcaacttggcttttggagttatcagggctcagtctcaaaggcagatgcatcagagccaagacccggccctcaagtcctcctattagggcagcactagggctacctctttgtcagcagaacctttggatagccgctgatggggtgagtcagctttctgggcccggcagaccttttgggaatccctggcttttggggcacaacatcctggggaccaccaaaaagccctttcacctgagctttgggaaagaggaacagctccggctgtgggtggctcatgtcaccatctggaagccagctgggccacagcagacgcgtaagtcctgtattcattcatccccttctccttttggcagaaaagggatggcgtgggttggaggggtgttttcctgggttcttgcacaattgctcattagaaattcacttctgtttgggtgttggaagctgggcgattccccctagtagtgatccttcctgtctcactggtcacaaagccctttggcatctacaagctcgttgggtccacacagcagctttgttaggtgggtagggggagaccaaggcacccatcctacaggtggagaaaccgaggctgaagctgggaggtgagccagtctcctggcttccagcccaggactctgcactcctccccccacctccccacctacttcagcaggtcacctgtgaatctgatagtcaggtgggccccaccctgccagctggccccagcgggcatgactcatccgcttccccatgactcacacacctcaggtgctcctcctctggtcaacaagtccagagacttggcaaatggacccccatttttctcacctctccaaagcctctgggaagaattcctgcacctcctctttatggggactctgctcttctacagaatagcaaccaaggccttgagagggaaagcaactctcctaaagtcacatagcaagcaaccagcacagccagggtgggagccaggcatccgggcaccgagcccagtcccggcctcctccctacaagatcactctcgcctgacctccctctcaaggacaggaaaggagcagagacgcactctgagccttattaggaagacctcagggactcccactgaatccactgtggctacagcggctgcttccaccactgaagtcccctccaggcttccctgggcagccagggcggggtttaagaggacgacaggtgtctgtattgctctacctacctaacaaggctgtgcagggtgaagagtgctgctccgtgggaaggcgctgggaccaaggccgaagcactggacaaagagagctatgagcactacctgtaaacaaagggcacagaatgtcagcctcagggggagttcaaggtcatctggtcaaatccccatttgatgtttcaacccctttcctcccctccaccaggggtcacacaatcagtacttgcacacatccagcaacaccgcactcactacctgccaaggctgcaagacctgctgctggagggtttggctgcgtaaaagaattgtcctaaggatgcactaaaatctctctcttcttatgccttgtacctgctggtattagctctgcctccttttgggtcagccagaacaggtctgtccccctctttcctgatggctctttggagatttgaagacagtgatcctgggcccctcaagtcttctacaaattgtgcaccccctttcctccagctcttcctgagaccagggtttccggttcgctcaccctgttccctgatctgctccagatgaaacctgtccctactgacagcacaagacccagaattagacaatcagtcaagctctatccaggacagggcaagcaggactctcacctccttcattagagatatcatgcttctattaattgagcctaaaatcccatttgcatttaaggcagccctattgcatggctgaattcagtttacagtcaacttcagagctgtacgttagtactctgaagttatataaactgggccctcacttaactgtgtaacttgagcaagc

SEQ ID NO: 3147 - DNA, 2470 bp, Homo sapiens
aaaaccccacagctcctaagaattctctcacctgccttctgcccttaagctccggtagattgcaaataacctgctttctttctgttcccgagctgcgttcggacccgtcggatcgtaaatcccatgtaaggtacctgccgtcggaagatttgatctttctacttggacacctaatacccacagtcctccaggtgggtcctaaggatcttaggatcaacgatgggggccctaagccagggggggaagagggtctggctctcagtccccgcctcaaggggggtgcctcccccctctgcgatgggtgtcctaagagccagtgggggaacaggggcaggctctcagtccctacctcgcggggggtgcctcccccaccctgcgatgggggtattaacagccaggggcggaagaggggatagctctcagtccccaccctcgtggggggtgccacaccctcctgcgatggggttcctaagagccagagggggaagagggactggctctcagtccccgcctcgtggggggtccctcccccctctgcgatgggggtcctaagagccagtgggggaacagaggctggctctcagtccctgcctcgcgggggggtgcctcccccaccctgcgatgggggtactaacagccaggggcggaagaggggatagctctcagtccccactctcgtagggggtgcctccccacctgcgatgggggtactaacagccaggggcggaagaggggatagctctcagtccccactgtcgtggggggtgcctccccctcctgtgatggggttcctcagagccgggggggaagagggactggctctcagtaatcccacgtaaggtacctgccgtcggaagatttgaactttctacttggacacctaccacccgcagtcctccaggtgggtcctaaggatcttaggatcaacgatgtgggtcctaagctggggggggaagagggtctggctctcagtccccgcctcgcggggggtgcgtcccccctctgcgatgggggtcctaagagccagtgggggaaccaggggttggctctcagtccctgcctcgcggagggtgcctccccccccctacgatgggggtaccaacagccaggtgcggaagagaggatagctctcagtccccaccctcgcggggttgcctccccctcctgcgatgggggtcctcagagccagggggggaagagggactggctctcagtccctgcctcgcggggggtgcctccgcccccagcgatggggatcctaagagcaaaggggggaagaggggctcgctctcagtccccgcatcacgaggggtgcctccccccctgcgatgggggtgcaaagagccaggggaggaaagggggaggttcgcagtccccgcctcgcggggattgcctccccccctgcgatggtggtcccaagagccaggggggggaagaggggttggctctgagtccccgcctcatgggggatgcctccctccacccgcaatgggagtcccaagagtcaggggggaagaggggatggatctcagccatcacaaaatggggggcctttatgttcaggttttgcccaagaatcagcttatttgcttcttgtactagcagggcagttgctgccaaggccctcaaataggggggccattctttagcaaccctgtctagttgtttagagacgtaggctaccggcctcagccagggccccacagtttgggttaaaagtccagctgccatcttttctctctctgacgcatacaatggaaaaggctttgtcagatcgggtagccccagggctggggctgccagaagattttcttataactaatgaaagacttgctgttgtcgggatccccatttcaaaggttccgggtccccgccccctttgtgacctcatacaaaggcttggctaatactgcaacgtttgggatccacagcctacaaaaccccacagctcctaagaattctctcacctgccttctgcccttaagctccggtagattgcaaataacctgctttctttctgttcctgagctgcgttcggacccctgtcgtattgtaaatcccacgcaaggtacctgccgtcggaagatttgagctttcttcttgaacacctcatacccacagtcctccagacagaaggacaacaggtacaaagtcctaaggattataaaggtatgctgcttgccatcatcttagtgaccaaggcagcgaagctgtttctgtaccttggaacagtcttccctgacaagccagagaacagcgataaagccaccagccttgggatcaggactgaaaaggcaagagtgatggagatttctcctgcgctaagccaagagaaggtttcagcacctcagacagctcccaccgaagtagcggcgctcccagctgcttgcagatgtggaaaaggaaagcctcggtttgtcttgaggttgtcagcagttgcaagacacgtaataaaatgcaatgtgttcct

SEQ ID NO: 3148 - DNA, 6236 bp, Homo sapiens
aaaatcatctctgacggtgttgaggaaaggtgagcaggggactggccaccctatattaggtttgtaaaattttaatattattccttttaatttgtgaagtcaatattttcttttctctgtgctgggaaaggctgcgccgtgggggccgactcagggtcctctcctcgctgggaggccatggcctcttatgtcttattcactggcctcctggcagactcataatgagcccacggacctgctgtggaatgaagccaaagctgtgagtgtgtctgggtgacttattctcctctcccagtgccagggaactttggtctctcagtcactcatggattcagcagatacttcggagcagctgttatggaccaggtgctcatagctctcacatcactaggtactgaggtgagagctgtgagtagaatggcaaagtccccaccctggggggctcacattccagccaggagatgcacaggaaataagggagcagacagccccacggggtgtgctgtgagatgccagctatgatgaagccgctcagggctggagcgggtggctggagattaggtgggtcaaggtcttcgggaaaactgcaaggccacctgagcccaggggacaggtgccttcagatgaattaggggtcagggagtgggagcagtggaggaggacctgggatgtgggaaacagtgggaggagcacagcctgtggggctcaggaagggttttgggttgcatctgagtgacaggagaaatgggtttggagatagagtaatgacatggtcagagccgtgtttttataaggagcttctgatggtgagcagagatggggtctggggtcaaggacagaagcagagggatgaggcactcagtatcaaagccagtcaaatcattagaatgaccctacttgaattcagtgtctgtgatcctcaatggctgcccagactgagctgtgcgaggcagagtgtccctgttccttatctgtccccatgagtggtcatggtattggtgacagcgggaagcagccaacacttagggggtactcttgatgggctagaccaatgcttctcaacaagggggattcttctccacagcgtacattcagcaatgtctgggggcattgtcattggcacatttgggggttgtgctcctggcatctagtgggtgcaagccagggatggcgctcagcatcctgcagggcacaagatgaccccacctcagagtagtgtctgacacagaaagtcccaagtgctgaggctgagaaatcttgggccagaacaggataaaggctacgtgtgctttgcttcatttcatcctaggagaaccctgtcaggaattatgattctcattgtgtagttggggaagctgagacatggaaggctgagctgtctgacgtgacgcagctggggagtggccgagctggaaatggagcccaggtctgtctgactctggagtctgtgcctttgactgatgcagaaattcagaacatccgtgctgaggcgtagcaggggtccagcatacacgggggctcaagtgcataaaaaaccctctctttgttttgagatgcaagttcgtcaggacctccaaaacattgcctcccatcttcccctcctccaaactgttcggcgatccccttggtttgttcagcctccccagagtcatcaaaacattgacaccgcttccctattattcatcaaaaatgcaccctgtcacaccagcaagccaggggttaaggcatctcaaggtgagggtggaggagactgagttcagcagagggtgagtggccctgtgggagccgtgcccggacatgacagaggtgggattccaaatatgaaaaacaccttcctcctgccccaggcccctttcttatgagaatccaacaggcagccagtggtctccagcatggggattcctggaccacgtcatgtggtaggtgacccctgaaggctcactgcacctgctgtatctattggacatgtgtgtgtgtgtttgagttgaagactatgtataggaattcaattcagcagacatgtggatgcttaccacatgcactgcctccacttgcttttgcctgtgtgcacctgctcatgcaacatcttcatggcaaacccaggggcacatgcactggggtagtgcaggatccaacggtgccatctgcacccagcagactttccaggagagaagattgactgagcactcagccatcaatgtcagcctgtagtggaaggctctagggcaaaattcttttatgggcatcgcagaacaagtcttcattgaacactgtgaaccagacaagtgggaaggtggatgaagagctaattcactgaaacaaggtgagaccccacggaccaaccaaaatgtggaatcaaggctgctactgtaaggactttcagctgcttaatcatgtatattccttctcctgttatagatgagatgcccgagaatgttccctccccaactcagaatcctttgcaaaaccaccaggatcttggacaaagaggtcctgcagccagaaatacgattcatcctcaactcattcttctctgacacctcacactgaatccatcacaatgccactcagctcaaccttcaatatatgttgagaattcaacctgcctgatgtctagcctgcatgtggccttctgccctggcctggaaactggatttcctgttcctgctcctgccctgccaccacctcattgcctaaagtagccagagtgaatctgttaaaaggtagacggggctaggggtggtggctcatgcctgtaatcctggcactgtgggaggccaaggcgggcggatcacttgaggccaggaatttgaggccggcctgactaacatggtgaaaccccgtctctactaaaaatataaaaattagctgggcatggtggcacacacctgtaaccccagctacttaggaggttgaggcaggagaattgcttgaacccaggaggcggaggttgcagtaagccaagattgcaccactgcactccagcctgagtgacagagtgagattccatctcaaaaaaagagtagacgggatcacctcactctgcttctaacccttcagtggctcttttctcactcagctggacacatgaaaatataagtgaaggaccttgtaagccatgccaaagggcaggctcttgaggctggagaactacagggcaaggggagataaaagacaatgagaataataatgaaaggaacaggtcatgcggccagtaagcaggtgctgaaggttccagcctcgtccctctgatatcagagcatgtgctttattcagttcactctattgccagccagggaaaacttcttagggcagggtcaccgtgcagtggggctttggaggtcacaaaggtgggttggttgtaggggagagagagtagcacggcagatgaagaaaatctcattgagtatattctagcctaggaaaagccaacacatcaaaaatacagagagtggctggaataggcaaaggctaggaatgacctctggtctttgctattttgtgccaggacctctgccctccgcccgtgaatggggtgaaggtgagggactgagactgtcaatgcaaagctactgttgctcttaaagagcttactgtttggaaaacttgccaaaaacctccaagaaggttctgaactggtaggtgtcaaccttgcaacacacagtttggttcaaggcaagtcttgtacaagaggactcattgataccagaggccaaggcaggagaatggcaggagttcaagactagcctgggcaacaaagtgagacccagtctctacaaaaataacaaataaaatattagctgggcatgatggcatgcttctgtagttccagcttctggagaggctgaggcaggaggagcgcttgagctgggaggccagggctacagtggatgagctatgatcacatcattgcactccagcctaaatgacagggcaagaccctgtctcaaaaagataaaataatttggagacaatatctggctttcttcatacttagcccaaggcaactcaagtgttacatctaaggccgtctcggagttcacttgcatcttttctatctccctacttctggattcctttgaatctagcattaagccaggagtctagattattgattattggttatttcactcattcccacatcttaatcgtagcctcttatgtgcaaggcagctagccgttgggcgttgggagccagacaatctcctgatttttactgaattcccccacactgagagtcccaatgccaagtctctggaataacccttctgatgcagtcatccaaaatctgtcttcacaagggtttctgcaaggcttccctctgcagcttcctcacatctcggctgtatgttgtctacgtgaggggcacaggagatcggtgagaggcatcgaaagtaccagagatgctcactcagagccttagaaatgcctagaccgttcctggtgcatagacagcatcgatattttcgctgctccatttttactgcaacaaatatgaacaacaattaaatccattttcgtgggataattgcctgcaacctgatgtccttgtaagacacattctgcaacttcagtcatgtggattacacagcactatttaaaaccttcccattaccagataaggtggagggaaggaggaaagagccaatccatggccaagtccattcctagattgtccagccttttgtgtctgttattaagcccttcaaaagtacactgcttccctggagagaaaatatatttacatagttcccaatcactccaccagagcagcagtggcctcaagataaacctcccagcaccagggaagaggggattacacacaccacaacgaagtccaattatattgaaaactaacagctaaatttctctgcccctgcagttcctagagtgtgaagagagaaggaacaaacggaagaaaaaaattgttgtagcgccttaatgatgagtgtgtgagaagcagccagttccctgttcctgccgttcattttctgtgtatcggtccctaacgaggattggcaagatctggagattgtcctggtccctcctcgtgccctctttcccttattcaaagcactgtgagcctctcttgcttggttccagttgccttggaatgtgttttggaagaaatgtcctggatagtctccaggcttctttatattctttctttttagtaattaactttgtattgagttctcccaccaaaatgaacagccaggccttccttccagatagaaattgtggcaagaaacaaatgggagttgaaataaataacatcgtgttgcttgataaatgtatttgcagtagcaacagagactgccacccaaggagttctaattacgaatctgaccctgtagagccaatgccacagttgctacagaaaataaataggctaagcagggcctggggttggttatttccatagacttgtcctggaaatgttaatcaaagcaaaccagagggagcagggagccagggttattctgatagtgctaaaaaaattaagttcccggccgagcgtggtggctcacacctgtaatcccagcactttgggaggccgaggtgggcagatcacgaggtcaagagattgagaccatcttggccaacatggtgaaaccccgtctctactaaaaatacaaagactagctggcatggtggtgagcgcctgtagtcccagctacttgagaggctgaggcaggagaattgcttgaacccagaaagctgaggttgcagtgaacagagactgcaccactgcactccagcctggcgacacagtgagactccgtctcaaaaatcaagtttctgttagccctttgcaatctggtcatagttctttctctcttcctccctcactctttctttatggaaactatgcctacctgtgtattttctttgtgaaatatgatttcacactttagcttataaaagaggttttgccaggtgtgatcgctcacgcctgtaattccagcactttgggaggctgaggagggtagataacttgaggccaggagttggagatcagcctgggcagcatggcaaaaccctgtctttactaaaaatacaaaaattagccgggcatggtggcgggcacctgtagtcccagatactcaggaggctaaagcaggagaatcacatgaacctgcgaggcggaggttgcagtgagctgagatcacaccattgcactccagcctgggcgacagagtgagactctcttctcaaaataaataaaaggggtt

SEQ ID NO: 3149 - DNA, 560 bp, Homo sapiens
actcctggagcggggggagactaacccctctcctgtgtccacaactgtagtaacacaatcctcggttctgctctccaaacttcaaataaggggtcagagccaagggtcaagactttaggaaaagccccggaaataccctgcactcaaaaagcagtttcagagtttcacattttcctgagaattaaacaaattatcctccaaattctgctgcttgttttgaattatggttatactggcaatgttatccaacccttgagttgtttttcttttctttttttttttttcctcgagagagtgtcttgctctgtcacccaggctggaatgcagtggcatgatctcggctcactgcaacctccgcctcctgggttcaagtggttttcatgcctcagtttcccaagtagctgggattacaggtgtgagccactgtgcccggccctgttacctttgagtttttatctccacatacttatattaaaccgtgtagttcttcttcccatctgacatctacaatctcttcactgggtctgtactccatagctattttaccactttctgaaata

SEQ ID NO: 3150 - DNA, 3674 bp, Homo sapiens
tttttgggctgcaaggaggcagttagcacagggaactacgtagtgagggacatggagactaaacagcagctggcccatctctctggcttctcatggccaagcctgggacacacagctgccctcgtgcaggtccagaactatggcacttgttccctcaggacccatcctcaaagccagtgacttggtcttttcctatgacaaaggagctcccagaatgtggcagtcccccttcctagagggagaatctgactgggtcagggaggcacccccggtttgcagagcccccattggtcaggttcagtgtccaaaacacctgaggggcaagtggcttctcgaagtccagcccatatggttacttttgacttggacactcaaggcacagggacacatgacacaggcacagggtgtgacaactgcatgcagaaagagccactctcattcctcagaagaggctgtggagatgagtggctgagccatgtgccccaaaattcatgttgaagtcctaacccccagtatcttaaaatgtgaccatatttagaaatagaacctttaaagagctaactgggttaaaatgaattcattagggtaggccctacttcagtatgaccggtgtctttagcagaagaagaaatcggtacagacacgcagaggggagggcatgtgaggacatgggaaggaaatgccacttgcaagccaaggagagaggcctcagaagaaaccagccctcctgacaccttgatcctagacttccagcctccagaactgtaagaaaatacatttctgttgtttaagccacctggtcttagagttctatcttgaatttctctctgcttcagacttttctgttttgttttttagcctaaatgctattgaaaagagcagagaagatagagtgcaggcccctagagacaggatggaacgaaacacgcagtgtgcatctgtgtcctgctcagcatacgctcttggtccccactgggccatctcgctgctgactggcatcccgaagaacaggcagattgcacaggggcagctctttcctccaaagctgcaatgtggtgcatgaagtcctcagatttgggaactcatacaggcacttgagctcaaacatacagttctgatctaagacatcacaggtaagaatatccaaaaaggtgagctttccccctggaaaccatgacttcctcagaaacaaggagaaatgtttcagctgcccaggttgcagttccgagtatggaggcttccatgtttcatgtcagggtcatggtggagctgtttcagctgcaggtggtattccaccatttggtcctccctgatgtctcctggcacctttccttcttcagtctcagcactctgaagaagcgtgcttgtgagcgccgcgggacgatccaggatgtccaggattgtggacgatcctgttcttcccatctgtgaggtaaggcagattaggaatgtccacgtctagcttgaatttcacatccagccattggctgccaccatggccaggggcttctgcagatggatcaccgtttccctcccaggagcaggcaggtgtccagtatcagccccagaacatcccggtcacccatctccatagggcttggatgacatgatgatgctctctgtgcctctgaggacggcgccttgggtctttgtacactaaatcccaccttgtcctctcctctatttgaaacagccatttcccaaatcccaatctgatgaaatcctgttcttccttccctcatgtttctctaggcctcctgtggactcccagaatgtaaagtcagcattcccttgagccttttggggacttataagcacatggcccaaggtccacctaactctaggtgtatcctgtagaaccagtattctaatcctaactttaaagatcttacaggaccatagggtgtgcgtaaaaagcctgctgcaaatcagagtgcttcaactgcgtattaatgagatggaggaaagaggctgtgagtgcagacaatgagtccctgagtaaatagactccagagccaaaggtgttctccacaccgaaagaatgactgtacccagggaaggagctcagactcacctggacaaaccctgaggggacagccatgttccagtgtggctaggagggtctggagctgggcacgtcccccatgtctgcttgattcccctctggccgagttctactcaggtgagttgtgctcattcttgcttccccagggcctggatcacagttcctcaagctttgggatacaaacgaatcacctgggatttggataaaatgcagattcgtgttcagcagccctggcattctgcatttctcatgagctccagggagacgctggtgctgctggggcaggaccacactttgggtggcaagggcttggcaggcaattccaggtgtcaccctagagatggcctgctattgcactgtcagtaggtagctgccacagtgacggccgctccagatcaaggggaggaccttttgaaaagggtccttgaatcatttgggaaataaatcaagccatatgagtaaaaagtaatcaaaaaatatgttgaatattggaaccagaggaaatcttagcatcattttgtaatgactccctccacgaattttccagataaggaaactgacaaagccaggtggcctgtggctgaggagcgagacggtcagcgaggtctccctgctgcactctcgtgcacttccacagtgaaaccctgctgagagacacaggaaatgttgaacatagtgtctttaaaattaagactatgactgccctaaacatttacaaagcacaaaccatgagaaaaaagcctgtaccagaaatcagaagatggcttttgtccatgtgcaaccttggacaagttaattacttatcgctgctctctgagcccgtttccccactggttaccgaaaaaatagaaaaggatatgcctgcccttcctaattcacagggcatcgcagggaggtaggtagttaatatgctgaaccacttcaaaacggtggagctgaactcacagcaggaaccctgtcacacctttccatgacaaggatatcagtggggtgagggaggtggggagaggcatgaggatgggagacaaaggagtggggtggggggcgggggaaggaggaagccagaaggacaggcccaggctaggctctgaagtcagcaggtgagcgaggtagagaactagcagcaccactgtccatggatatttgcggtgatggaaatgtactgtatccatgttctccaatatggcagccactagccacatgtggctatcaagcgctagaaatgtagctagtgtgatcgaggaactgatctttaatttttctttaattgttattaatttccatttaaatagccacatgtggccagtggcttatgtagcaaagatctagatcatttgtttgaagcagtaaaaagagaaatgtgaatcccctcttcttacctcctataacatgctaattaacatcactgcaattaaccaccattcacagctcttcagctgctctgtggaacctcagcccactctgaaatgaacagccgcagtggcaggggttacagaatgggctgggagtggcaatgtagatttatctcttcacacactctatgccctctatcaaaaatgcctcaggctgtgtaaaattccacaaataataaagagattttaaaaatgtg

SEQ ID NO: 3151 - DNA, 4611 bp, Homo sapiens
cactgagtcccacggtgggaggctgtaagatctcctctctccatttcctagtctctgtaaaccttttacccttcagggtgtggggaggaacctttaagtataaaagggtccctgtggccccgccctccccagaggctgtggctgcctccaggggtgggggtttctggcactttaggggccttaactgcctcccactgctctgtctttactctgcatctcccgacacccaggccttcatcttgggtgtgaggcgggtggcacacagcggggtgcggtacccatggggcagccaggagctgactcagcatcttcaccttcccgctcacgtgacgcctcctcctgccaccgctggagactctttacaaaccttgcgcccttcctccatcaccgcaattgtctatctatggtcagcacccccacatcacaggtaaagaggcggaggtgcggagagatcctgcagctgcccagagccacacaaactaagctcacagtgagtgaaacacagcaatggctccagtgtcctgcgatgatgtaaaagcagcatttttccatcaggctaggaaccagcaatgcagaacgcccaggattcctttgctgaactccactgctgccccgacccaacctcactccttgggtgctcccccacccagtgcccggactcctggctcctttctcaagaagattctcagcccttggcttacatattcaggaactcttgggaggaagtccatttatttatgctgtttcatgctaaaatgtgaatggctaacataccagaactatttgcttttatttttttttatttttatttttttgagacggagtctcgctcttgtcgccaggctggagtgcaatggcacgatctcagctcactgcaatctccgctcccagggttcaagccatcttcctgccttggcctcccgagtagctgggataataggtgcccaccaccacgcccggctaatttttgtatttttagtagagacaggtttttgccatgttggccaggctggtcttcaactcctgaccttaggtgatccacctaccttgacctcccgaagtgctgggattacaggtgtgagctacctcacccgtcctatttgcattttaagaaaggacattgttaacttacaccatgttttcttttttttttgagacggagtcttgcaccgtcgccctggctgtgcagtggcgcgatctcggctcactgcaacttccgccttctgggttcaagcgattcttctgcctcagtctcccgagtagctgggattacaggcacccaccaccatgcccagctaatttattgtatttttagtagagatggggtttcattatgttggccaggctggtctcgaactcctgaccttgtgattcgcccacctcagcctcccaaagtgctgggattacaggtgtgagccaccgtgactggccttacaccatgttttcttaatgtcagcatgactggcattggggctggatgacgctgtgctctgtgggggctgccctgtgccctgcagggtgcttggtgcccccccacccccctggcctccacccactggatgccataccatctgcccctctgctgtgacgaccaaaactgtctccagactctctagatgctcccttgggaacaaaacccctgggtgagagcaattgacctaaatggatttcatctctgtaggtgggatgccaggaagtgtgattaagcaaaaggctggtctccaggatggggccagctcgtccgagccgcagggatggacacatcatgctctcttcaattcaaccagtgggaggatctgtgagaaaccagggaagaggggcgtgtccgagccaggaactggactcacctgggcaacttcccgcacgagaccagggaagaggggcgtgtccgagccgggaactggactcacctgggcgacttcccgtgcgagaccagggaagaggggcgtgtccgagccgggaactggactcacctgggcgacttcccgtgcgagaccagggaagaggggcgtgtccgagccgggaactggactcacctgggcaccttcccgagagagaccagggaagaggggcgtgtccgagccgggaactggactcacctgggcaccttcctgtgtgagaccagggaagaggggcgtgtccaagccgggaaattgactcacctgggcaccttcctgccctcctcctgacgccctctcagaataaggctctcgctgtctcgctcccatccccaccctcccgtggggtgggggctgactctctccacttgtctgggtagcatgaggttctgtctcacttgggcaactacaacagagtaactttgacttggtgccttaaacaacagaaatttatttctcacagttctggaagccagaggtcaagatcaaggagcgggcagactcggttctgtgagggccggcttcctggcttgcagacgatgccttcccatgtccccacatggcacgaagcagagaagggaacccagcgcccgtgtctcttcccctgagggtgctggtcctcttccgagggctccaccctcctgacccagtcacccccaaaggccccctctcctaacaccatcacactggagtgagggtttcagcatgtggattctggggacacatccagtccacgcaggcctgagtggccgcctggtctgctgaaagccactcagctcgggcaggcccatggcggctgcctgcgggccatactctctgcagcccacaccagcgccgccctctgcaggggctgaggcagatgctgctgggtgccgagggtggcgccttcgtgtttgccggagggtgtggggcagcgggccgccctgggagccttgggactcgccggacttcagctctgtgcagcctctggtgtgcagcttggagaacccagcctttctgaaccatccacctggtgtggcgctagatgaccttgtcctggatgtggggtggggagggctgtgacagtccatgggccttgccaaggctggatggccccgcccaaagcctactggacatctggccaagcaaggccctggtgagcgtgggcaggacgttggtgggtgggcagccagggcacagatgcagcctgcatgggcaggacgtctggccgctccgctagtcctgagctccagctgcccatgtcctcttggggtctccccggcagccctgagccacacaagccccaggcctgtgactgaggccacatctggctgggggctccagcgacgtccagccccaggtcaaagtggccatctgtcatctgacaggttgacatgcaccttccttgggctaggtggggctgtgagtgtctgtgcccacccctccccccacaccttgtgcgctctgtgcagtggggcagcagcgccaggcaaaacagtttcccatcgggatgaggaccagctccagagaaggtggggaggggaccccgcgccagggcctccctgagaagaagcagtgtctgccatcctggtgagcagaggagacagcaaatgcaagagctccttgcctgctcagggatgtcggggtggccgtgtgcccaggaagggaggacgggggcagaggggtcggtggtcttggagcgtgtggcagggccaggtctcaggagcgaggaggccttgatgaggaaagcatttgggtagcgtcgaggtgccagggagtctggatgtgtagatccacggtggggcctggtctctcccacgagtgagcgtggcgcctgcgttcctcacgatatatctgccacagaacggggacgattgccacagcttctccatttgcctgaaggcataggagggggcgtgtgggaggccacctgtgacacctgtggaccagagatgacaacatatggggtttggggatgccacggcacagcatcaagcagagagttccctcgaggtcccagagctacaggtggatttctgccctttccggatgcctccggagccaccgtagctccccagccgtcacagctgaccacgggctcctcaattgacggtattattggtggctgggaagtacaagtcaactccctcatgcaattagccggcttgccaggggctagggaagcttattgagagccttggtcctttagaaaaaactgtaaattaaatttttattgactttagtgtaagatgttaaaaaaaatcaatgctttcatatcttaaatcttttcctcactcccctgctcccccgcaagcggataaatacagcctttcctcctcctaataatgtaaaattcctttgggggggctgggcctccctgtctggggaggcacttcctgtcgcccaaattacagggttaaacccgcagcagctctggcccaggtgagatgactgagaacctgtctctcctcatctcatttccccaaattaaatgttgttcctcctccaggcctctgtggggtcgtctgtttttctgaaggtgcagtgacggggaagcagctccctccgtttccaccgggaggcacgggcccaggtgagatgactgagaacctgtctctcctcatctcctcatttccccagattaaatcttgttcctccaggcctctgtggggtcgtctgtttttctgaaggcgcagtgacggggaagcagctccctccatttccactgggaggc

SEQ ID NO: 3152 - DNA, 337 bp, Homo sapiens
tttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagtctttcagctcacagcaggatgctaatccatgaaggtgacctcgcagtactggttaattaagctttattgctcactgaaaaagaaaaaaaa

SEQ ID NO: 3153 - DNA, 3554 bp, Homo sapiens
agatgagatactgccataacctgtagttataccctgtggtctcaccaaaacaaggatgccaggattcattagttcattagtataagccacactgcacattgggatcatctcggaaaatgtgcaacttggtctcaaaaaccctgtgaaatacaaattgtgacagtccaagctccctggtcatttcttttttgtttgcttgttttggagatagcatctcactctgtcgcccaggctggaatgcagtgacgtgatctcggctcaccacaacgtctgcctcctgggttcaaatgatttccgtgcctcagtttctcaggaggctgaggcaggagaattgcttgaaccgggacccgggaggtagaggcagcagtgagccaagatcgtgccactgcactccagcctgggctgcagagcgagactctgtctcaaaaagaattgctcaggtgataaaggacatgaatatttttaaaaatttattctttaaattaatatatcataaagctcattcttttggagtacagttccacgagtttttaagaaatgcacagatctgtaaccatcaccataggagagttccatcacctccccatattcccttgagcagcctcttggccccttgtagttaaaccctaccctcaacctatccctgtttcccttttgtttaacctctggtgacctctgagctgttctctgcccctatatttttgcctcttccagaatgtcacctaaatggactcatgcagtatgtagccttttggatctaacttctttctacttggcgtcatgcatttcagagaacttcattatgttgcaagtgtcaacagcgtgttcctttttaaggctgagtagcattccatcgtgtggatacaccacaatttgtttactttcaccagttgaaggacatttgtgttgtttcctgatttttcagcaattatgaatgaaacgtctatcaatattggcatacaggcttttgtgtaaacatatgtttacatttctcctggctaaatacccgggagtgagatggctgggtcatgtgataggaaacctccaaaccgttttctaaagcggataagccgttcttcagtcccagcagagttctagttgctctgcaccctcactagcccttggcctcatcacttttttgttttgttttgtttttaaaacttgagccattctaatgagtgtagtagtggtctctggtgactttcatttgtatttccctaatgactaatgatgtcgagcatcttttcatgtgctcatttgccatctgtacatcttctttggtgtcaaaatcttttgcttgttttttaatccatttgtttaattatggtagagttttgagaggctttttattttgagatggagtgtggctctgttgcccaggctggagtgcagtggcgcaatctcggctcacagcaacctccgcgtcccaggttcaagcaattctcctgcctcagccacccgagtagctgggactacaggcacacgccaccctgcctggctaatttttgtatttctagtagagacggggtttcaccatattggtcaggctggtcttgaactcctgacctcaggtgatccacttgcctcagcctcccaaagtgctggaactacaagtgtgagccactgtgcccggccccgagagttctttttctgtattctgcatagaggacctttgtcagatatgtgatttgcatttctttttctcccagtccctggcttgcctttccctcttcttaacagtgcctttggagatcgaaagtttttaatcttgatgaactgccaatttatcagtttttctttttttttgttttatgaattgtgcttttggtgttacgtctaagaattttttgcataacttaagtttgcaaaggttttctcctattttttttttctaaaagttttacgttttacatttaagtctactatctatttgaagtttcaaaaaaatatggtgtcaggtagagttcaaggttgagtttttttttttcatatggatgttaaattgtcccagcagcatttattgaaaagactgtattttctccattgaattaacctttcgcttttgtaaaaagttcgtgagccatatttgtttggttctgtttttggacccttcattctgattcattggtttttgtgcgtatcctttctcctttcacattttagaatcagcttgccaatatctacaaaaaatcctaatggcaccaggcgtggtggctcacgcctgtaatcccagcactttgggaggctgagtcgggtggatcgtttgaggtcaggagtttgagaccagcctggccaacatggtgaaaccccatctttactaaaaatacaaaacttagctgggtttggtggtgcgcgcctgtaatcccagctacttaggaggctgaggctagataatcgcttgaacccgggaggcggaggttgcagtgagcagagattgcacccctgcactctggcttgggcgacaaagcaagactccatctcagaaaaacaaatcccaatgggattttgactggggttgcactgaatccataaaccaatttggaggaaattgacatcttaataaatatagagttttccattttatgaacatggtatattctccaaagtctttgatttcctttatcagtgttttgtggtcttcatcatacatactctaccgttggttagatttatacctctaagtgttttatggtactattttaaattatactgtattttaaatttctaattgctcattgctagtatatagaaatataattgactttgtatgtgctagccctgtatcctccaacctcactaaactcatttattggttctaagaattttttggtagattccttggaattttctgtcatgtctatgaatagtgacagttttatatcttcctttcaatctgtatgctattaatttcattttcttacctgattgtactggctaagacttgcagtataatgttgaagggaggagtaagagcagacagtcttgccttatttctgatgttaggggaaaatcattgagtgtttcacattgagtgtgatgttacctgtaggttttcggtagatgaacggtatgcatatttgaaaagccaccactgtcctgaaagatgtcacaatatagaaatggtatagatttggagttcagagaataagttctggagtcagacttactgggtttgaattctgactcgactccttagcggctgctagatgttggagttttgggaagataggctaagcgaatacatgtaaaatgcttagaatggtgcctagtatattgtatgctctcaatgaatgttagttgttattctgtttggacaacagtaaaaatagccaaagagctcatggagcctggatgtaggaattttttggcccagaccgtggggattttgatgcccatattggaaactttggagaatgttttggttcaggtgtggattcttattgagtcattgagcacatttgggtccgaacactctctgaatcagggatatggaggaatccataccaaaagaacaggttgtttcatagaaacagggaggggaacatcacacaccg

SEQ ID NO: 3154 - DNA, 2279 bp, Homo sapiens
ggacatcgggggaaggctttagacttcctcagaacatggcttctaatccccagaaccctctagagctgagagtcaaggccaactgagcatgctgagctcccacctttctcttcccagtaggaagcccagggaccttggctctgaaagtatcaaccgaggccagaggcgaagcaaggcaggtcccagccatggccgccacaccacagcttgtccccctcattgctgtgcattccttcagcacttggagcgcagttttagtttgcactccgttaatttgtaagtgttcttttgtcttttttccttggctgtcctgactccctcacccaacaggggctccccaagggtgggggctgccttccttgtcagcctcctcagcggaagccctgcactagtgcccctgcacccaaaggctatagggtgcgtggcacggaccctgcaaagagcaaaagagctgctggatggtgcaaaatgcaaagccccaacaaacaaggtgatgaaggggcagtgtcctcattttccaggtgggaaactgaggctgagggaggctccacagccacatcagactggcagaaagaggtggagcaggaacctagattttgttttcctaccagagcctcagctcactctgctacactgccctgcctccctaccacacagtcctgcacttccagagtacatgtgagattagcaagccttcaaggcacaaactgggtcttattcatcttcatcttcctgggggaacccgggctgaacttttcttctccccagggaccctccaaagaacttcagggaaggaccagtgaaacatgaggctgccaggagcaccaaactctgacctctcatcaccttatcagaggggctcctttggagcctgagatgtgagagtatgtggcacccagacactaggcaggtcccaggctggacgggttcagtcccagaataatcaacccacttgccatggatacggaaggggggaagggaagggcacggtctctggctagggctccacccccaggcctgtgcccacggacctaagtgaggacaggcatttttgttttcctgcccaaatgttgcatttcccaagaccaccctggcctgccacaccccctgatcctgtacctaaaaatccctgagaccctagcaggcaaacacacaggcagctggacatccagaggagcacatcagtggaggaacacacaagcggctggacagcaagaggacgttgaggggagcacgctggcggaagggcacattgacagacgccggcaggccacccacgggcagaatgatgcggagtttggctggggcagtcggaggagagcctgggccaccaagcagcccgactccagaggaaaaccaatctcccttctggctcccctatctgctgagagctacttccactcaatgaaaccttgcactcattctccaagcccacgtgtgatccgattcttccagtacaccaaggcaagaaccccgggatacagaaagccctctgtcctcgcgataaggcaggggtctaactgagctgactaatacaagccacctatggatggctaaactaaaaaagtaccctgtaacatacacccactggggcatcagctataaacattcacccctagacactgccgtggggtcggagccccacagcctgcccatctgtatgctcccctagaggtttgagcggcagagcccggaagaagcaagccacatccccatcgcactccctttgagggggacaaggaaacttttcctgtttcaccatgactcccaaagccaagtttaagcccccaagttaatgggacactaaccatcattccactttctgcaaacatctctgccaactgggaaggcatcacagagcatgtttttccccagcaaattcttgcaggacaggtccctggatgagcatggctgacccagcttcacaccccgccccccgccttcttgtagttctcaggatagctgtaggatgtgttgggaatgcaacatcttgagataaggagggcctgtctgagacagcctgggctcatgttcctacctcttctggaacaggatgtcctgcaacactttagcacagtaagctgatgtcccccagggtggaaaccccagggtggagcgctcccaggctccctcagttgcagtgtgatgtggtacgtgggtggacgagactccatcctccctgggcagctttctcgagccatggggcaccagcttgccttgagtggtaggcgtccattgtccccgaggcctatctgtgagtaataaagttgcttcgcttg

SEQ ID NO: 3155 - DNA, 8882 bp, Homo sapiens
aggccgctgccagtacccgagcgggcgggagggcagctgcggagtcagaagcccaccctgatgcccagttcgctccgagtgcgtcgtccgctttctcccggaggccgcggcgaccccgccgggatgtgcgacatgtggtgccccgacccccgacccttgacccttgacctccgggcagctccgaccctttcaacactctccggggtcgtgcgtcgggagaccccggcccctgcccgcgtgcacccggggggccccgcgcgaagcctgcggcggcttccacgtgggcgcggctcagtcccgctgccgatccgtgactccgcgccgccctccgcgcccggcctagagatggggttccatccatccattccagaagcatttggcaagcacatcctgggtgccaggcccaagcaggctggtctcaaactcctgacctcaagtgatccgcccacctcggcctcccaaagtgccgggatgacagctgtgagccaccgcgccccgcccagaagcagaggtgttttaacgggaagacttcaggcttcatcggacggccgggaaggaatcagagcaggggtgaggttggctttgtgcggggtggggtggggtgccaggctctgtgtcgggtgggggcagcagcacatcttttgtaattaatcattgccgaggctctgcctgtacgaagtgtggtccggggagggctgatgaggctgcaggatgagggggcttgacagacccctttccccagaagagggcccccaaaaggcattgcccctgaagagggctccccaagacctcatccctgaaaagggactcccagggtcacccccctgaaaagggctcctcaaaaggccccccgaacggggtccccccaagactgccctctgaaggaggcccccgaagacttcccccgtgaaggtgccccccaagacctgccccctggaagagggctccccaagacctctccccctagaagagccccctaagacttttaccctggaaaagggctctctgcaaagcttccctggacgtgcgccttcgagctgggcaggtagggaggagctgtgtactcgacatcatccttaggatctgttgtcctcccgcttcccctgccccggcccccagatgaatccagaggctgttttagagccagacggacactcctggtatgcaccagacactcatagtgcagtgctcgctgagtagaggaggagttagtgggtgaacccggcccgccaggctgccctgcacagaattccagccttgtcaccccactggtttttaaatcatcacaatcctcgggatgttctgtgcatgccacacacagactcttaagagtccagaggtcctgtttttgcacagttactccaatgaataaaaagacgggctgggcgtggtggctcacgcctgtcatccgagcactttgggaggccgaggcggggtggattgcctgaagtcaagagctgaagaccagcctggccaacatggtgaaacctcgtctctactgaaaatacaaaaaaattagctgggcgtggtggtgggcgcctgtaattttagctattgcggaggctaaggcaggagaatcgcttgaacccgggaggcggaggttgcagtgagccgagatcacaccactgcactccagcctgggcgacagtgagactgtctcaaaaaaaaaaaaaaaaaaaaatttctagcagacactgaagggagagggagaggaacaagccccagggaccctttatccgacttccttccacctgggggactccctccacgggcccttgctttaagggcaaatggcgagggcaccagaacacagggaggccatgccggaggtccctgctgcaaccatgcggccccccagctcactcccagcagccaagacgaaggggggcctgggctccccctagggcaggcgcctctgattctctccaccgagaggcacctcccatgccggcctcttcctggggtgactcccagaaccttcttggacccatgaacatttcaatctggggtggggccttccctgggcatccaagtggtgggaatctgtccctagcccctagaactcctggagggctgggcccacctctgtctgcatcccgtccccattccccgccccgggtggcaggggctggagaggaaggagcttcaggcttcaaaaccatcaaagcaggtttcttccgagatggccagtggtcacctgagatggagcagagagcacctgtggcgggcatcttctctagaagccgcctgtgagccctacggaggccctgggcttcgtgccgtaagacagacggtgtcctgcaggtacgtgggggaaccctgtaggcagggactttgcctgctttctcagaacaggacagaggagtttggctggggcagcccgaggtgaccgggatgctgtcgccccagctctgggccaggtcctgcctggccccacgctgaggccagtgtgatggaggggcctggaagcctcatccttcttgattgccacgcggtgagggccacaggcatgcgccaccgcactggactccccctttcatcatcaaagccaaattttcttcttgtttcatctaggcctcccatggagacaccatgtgtgattgtaaaaaaaaaaaaaaaatgagtcaggccgggcacggtggctcacgcctgcaatgccagcactttaggaggccgaggtgggcagatcacctgaggtcaggagttcgagaccagcctggccaacatggtgaaaccccgtctctactaaaaatagaaaaattagccgcgtgtggtggcgcatgcccgtaatccctgcactgtgggaggccgaggtgggcggatcacctgaggttaggagttctagaccaccctggccaacatggtgaaaccccgtctctactaaaaatacaaaaattagctgggtttggtggtgcgtgcctgtaatcccagcactttgggaggccaaggtgggcggattacctgaggtcgggagttccagaccaacctggccaacatggtgaaaccccatctctactaaaaacacaaaaattaggcgggcatggtggtgggtgcctgtaatcccagctactcaggaggctgagacaggataactacttgatcccgggaggtggaggttgtagtgagccaagatcgtgccattgcactccagcctgggcaacagagtgagattctgtctcaaaaaagaaaaaaacagaccaaaaaaaaaacggagtctgtccagaattatacacagtcacctgtgccaggtaacaacccttcagtcaacaacggccttcctagacagcggaggtcccaggagatggtaatacagtagttttcgtgtgcctttatttgtagacacacaaatccctaccattgtattacagcagcctgcagcactgggcacactcacctgctgtccaggtttgtagcccgggagcctggggccctgccgcacagcccaggtgagtagcaggctgtatgtgccacggcggtatgtgtgagtgcaccccgtgatgggcacacaaagagaattgcctaaggatgcatttcccgaaacaggtccctgtcattcagtgacacacgtgactgtgtgtgtgtgtgtgtgtgtgtgcgcacagatgggtgtgtatgtgtatgtatacacacctgaacactcacacctctacacacgtgcctgtacacggatagaacacataatttacagaatttatggaacacataatttatattacataaaatatatagagatcagttttgttttcttttatttatttatttagacggagtctcactctgtcgcccaggctggagtgcagtggcacaatctcggctcactgcaacctccacctactgggttcaagccatcctcctgtctcagcctcccccctgtagctgggattataggctcctgccactatgcccggctagtgtttgtattttgtgtagagacaggatttcactctgttggccaggctggtctcgaattcctgaccacaggtgatccgcccacctcagcctcccaaagtgctgggatgacaggcgtgagccactgcacccagcctatttcagctgttttcttaaagcacaaagcaacctacacattcttttgtgataccaggccactgtaagggtggagcagcatgtgactttggtgttattgagatcatccgtgaccattgcagaaaaccactcccatctgtgcagtgagcaccttgaaataggccgcccaggaggcagagggtgcaccttgaaattgggctaggaggcggggcttgccccttgaaataggccgcccgggaggcggggcttgcaccttgaaataggcctagaaggtggggcttccaccttgaaataggccgcccaggaggcggagtttgcaccttgaaatagactgcccaggaggcggaggttgcagtgagccgagattgcattattgtactccagtctgggtaagaagagctaaactccagagtctgtctcagaaaaaggaaaacagctgaaatataggagactgacgcccagcccaggaacaggtaagctgggtgcacgcgccgtgaaaacagcacctaggcctgctccggttctcgctttgcagatgcctcctgaacctcagtgcctcctaaggtcaaggctgtgagttaaagggctccaccccagcccagccccaggttggcccagccattccctggtggaggggccagggaggaaagggggctgtgtgggcaccagagggtgaactgaggtctgagggtcgggacacaggccgggaacagcagctgggagcggagcacgggggaaacgtggatgcgctgagctccctacaaccgcagtgagcatgtgcccaggagggcctcacggggtgggtgtgagtctggcctgcctgggctcggggtggggggtgtttacagacgcatttcagccccgcagcaggggctggggaggtcccgctcgtgacagtctctgcaccaaggcaggagagatggaagccgcccagagaactgccactccatagcctgtgggcatccaggggtgagcggcagcgatggcgccccatggaggaaacacactggaaatcgtgcagaagatgggaagatgcaggctggagtgcggagaaggactgagaccctgcctggtagacggcaccgtcacagcagccgtctgcctgctaggaggagcgtctccaccagcagcaggccggcccctgagggagacagcagagagctggagtcctggccagccaggcggggatccttcagcaggacacaggggacacagcaggcaacaggagctcagaacgctctcggcgaccctgctgagtaacttgtggactttgtcgtctggccagtcatgcaggatccggcacaggacgtacagctcagcgctggggagggggtccctgaaaaagtcacctggtttaaagacaaaacgagatacgtccgtcaggtatggaagaagcagtcctccccggacagatcctgggacggccacccgcatcctaaatcagggacagagaagagaggggtgtgggcgggaatgggtcttcctgaagtacatccccgtggggacttgaacagagctccatgaggagctggttagtgatgtcacgcccgtgcggtttgactcgggctgagaaaacgctggggacagtggctcacacctgtaatctcagcattttgggagcctgaggtgggcagattgtctgagctcaggagttcgagaccagcctgggcaacacggcgaaaccccatctctactaaaaatgcaaattagctggacaggggtggcgggcgcctgtcatcccagctacgcgggaggctgaggcaggagaatcgcttgaacctgggaggtggaggttgcagtgagccgagatcgcgccatcgcactccagcctgggcgacaagaaggcaagggaggaaaaaagcagggaattcaggggcagcacctgggcgaggcaggcagagtcggcgcacatgggcgtgtgccagggagagtcggggccgcactgccggtgagtgggcaatggcagggccttctctggtgatcccctgattcaggcgccccaggagggttgcctgttgcggggggcgcatgtagctgcacgcccctctgtaattgctgaaataaaaagatggtctgctgtagtgcagtgaatggtgtccccttaaaagatatattcaggtgctgaccctcagtcgctgggaatgggaccttatctggaaatagggtctctatggatgtcattgagtaaagaatttcaaaatgagatcatcctggagtagggtgtcccctaaatccaatgacaggtgtccttctaagagacagaagaggagacagacacagaggagaaggccacgtggagacggaggcagagactggagtgatgcggccacaagcccagggacgcctggagcccccaggagctggaagaggcgggaaggatcctcccctagagcctctcagaaagaatcaaacacaactgcaatgggttgggtggtgacgtccaaaagatctgtccaagtcctaagccccagaacctgggaatgggacctcatttggataaagtttctttgcagatgtaattaaggatctggagatgggatcatcctggagtagggtgggccctaaatgcaatggcaggtgtccttctaagagacagaagaggagacacacagaggagaaggccacgtggagatggaggcagagactggagtgatgcggctacaagcccagggacacccggagcccccaggagctgggagaggcaggaaggatcctcccctagagcctccagagggagcacagccctgagatgccttgatctcagacctccggtctgcaggacagggagaggataaatagcaagctgtgagttgcatgaggggaaagaaggggcgggagagtgtgcggtgggaagtctccagagctgttttcccccagctgcgaggagaaggtgctctttcagggctcatgattttaaactttagcatttccggccgggcggggtgtaatcccagcactttgggaggccaagacgggtggatgacctgaggtgaggagttcgagaccagcctggccaacatggtgaaaccccatctgtactaaaaatacaaaagttagccaggcgtggtggcgggcacttgtcaccccagctactcgggaggctgaggtgggaggatcccttgaacccaggaagtggaggttgcagtgagctaagatcacgccactgcactccagcctgggtgacagagcgagacaccattcaaacataaataaatttcagcatttctgtctctgcagatctggcaaatcagaagcacagctatcatgatgtcctgcaggaggagctgtagggtggttgcgttttgtttttttaaaaacgagaaaagcatccaggaacctctgggggagggttgtggaggtccccagcacctgtgcccacaggcctggccgctgtcggatggtgctgagttacagcacgtcagctgtctctttttttatttttttattttttttgagatggagttttgctgtgttgcccaggctggagtgcagtggcgcgatctcggctcacggcaagctccgcctcccgggttcaagcgattctcctgcctcagcctcctgaataggtgggattataggcacccgccaccatgcctggctaatttctgtaattttagtagagatggggtttcaccatgttgctctggctggtctcaaactcctgacctcaggtgatccacccgcctcagcctcccagagggctgggattccaggcgtctcctgtcaatccgtcctggcctcagcagctgccacctggaagttctccttcaagtctaacctaaggccacactgtgacggctctcgggtcagttccttccgtgacctcggcaccgtggatgcccatgaatgctgatctcggctgttccccatctccactcccctcacgtctcggctacttgcactgatgataacttcacacagtcgtccacctgtttatttttatttatcattattattatcattgtctttttttttttgagatggagtttcgctcttgttgcccaggctggagtgcagtggtgagatctcagctcactgcaacctccgcctcccaggttcaagcgattttcctgcctcagcctcctgagtagctgggattacaggcgcccgccaccacgcccggctaatttttgtatttttagtagagatggggtttcgccatgttggccaggctggtctcgaactcctgaccacaggggatccgcccgcctcagcctcccagagtgctgggattacaggcgtgagctactgtgcccagccttgtccacctgtttggagatgccctcgtgtctgtgtggacccgcagagagacacgcacaggcagacccacggacgcacagacacagacacaggcacacacacatatacccatccagatgcacagaaatgcagacacaaaggcacacatgcaagcacacgccacaagacatgcacacacggacacatgcaggacacagatacactgacaggtacacacatggacacacagatacagcaagacaggcacacacacacacacggacacagatacagtgacaggcacacgcgcacagagacagacatgcacagatgggcacactcacgcacggacacacagtgatacaccaacaggcacacacagacgcagacatgcacagatgggcacacacacatggacatacagatatagcgacaggcacacacagacgcagacatgcacagcaacaggcacacacagacgcagacatgcacagatgggcacagacagacacgcacggacacacagatacaccaacagacaggcacgcacacagacgcagacatgcacagctggacacacacacacacggacatacaga

SEQ ID NO: 3156 - DNA, 3070 bp, Homo sapiens
ctctcccccgtgacctcttcgacccaaacctcaagcgaaaattccctagctcgctagaccggcgcaggactgtgactgcgcgcctccttttacctgagagggaccgccgggcccccgggcgcagccgccaaaggcggggagccgccgccgccccggcgcaactcattgccggaactaaaaaaagcaaccacttcgttgaacggaactggccaatagtgcccttggctcggactgatgacgcacagcagacgtaaggaaggctcagctcgcccgcgcaccggtgggaacgccccctagctctgcgctaggggttagattggttagatacgacaaataaaaagattttattgggtggggtcactgtcaatcactcggaagaccaaggccaaggcgccttgggttgccagggagatgaaaatgctaaattgctgtttagaaagatcaggacaaggttatgatttctcacccaagttcctggggaaaaggatcatgagggaattacttattaacaaggaaaaagcaaagaggaactttacaaactattacagttttccatcatcacttgactgctgacaagaagcctctttgaattccagtatacacgatcacattttaaaaccttcaagacgccgtttaatcaggagttgtaaggcacatttgttagagagagctgcactttaaaagttatacagacatcacctgaagttattaaagttatcaaaacatattaaaaaccttcaagtaagaggtatgcatattagcagcatttaactaaaattaatatattaattagcatatttcagtatcacttttataataggaaaaaaaacgcagtacgttttcgttgtgttcatcacacacacacacacacacacacacaaatagaaaacttgaatatcatcaagtctggtcacagtgaaaatgttatataaatataaaggcactgggcagaaatgtttacaattacaactttttttttcttttcacctatctttttttttgagatagggtctccctctgtcacctaggctggagtacagtggcacggtctcgcacactgcagccttcacctcccaggttcaagtgattctcatgcctcagcctcccaagtagctgggattacaggcacacgccaccatgcctggctaatttttgtacttttagtagagacggggtcttgccacattgaccaggctggtctcaaacttctgacttcaggtgatctgccctccttggactcccaaagttctgggattgcaggcatgagccactgtgcccagcagaatttatttttttaagtgagactggaatgaatctttggttactcaaaattccatgacaccagttattagatttagacgagatcaggcattttcagggtggtatgactgtagttattagatttagaaacccataaaccttaccaagtcaggaaaagaccgaaaagctcattggtatcccagttacaaaaatattccactttaaataatatctttgtggaaaagcaagaaaatggctgtaagaaagggacgagaagatacctttgctcctctgagcaaggattcaggcatttttgagtagtggagtggagatggccgggagaattattgttaacagcaacagctttctaaaacctgcacccaactttaaattccaggctactccccaggaaacgtgtggagccagtgaacggaagaaaaacaatggaaggaaggcttgaaaagtccattacaaaactacagtcctttgaaaaagatttcaaagatattaaaatgaaaactgattacattaaacaataacttaaacttctgttcttctgttaaaaggttgacatctatcaattttgggtaagcttacaatgaggtatttattgcatatggtttttaccataacggaaatcttaagagatattctacattttttttttagggagagttttgctctttttgcccaggctggagtgcaatggtgtgatctcagctcactgcaaactccacctcctgggttcaagcaattctcctgcctcagcctcctgagtagctgatattacaggcatgtgccaccacacccagctaattttgtattttagtggagacggagtttctccacgttggtcaggctggtcttgaactccccaacttaggtgctccgcctgcctcggcctcccaaagtgttgggataacaggcgtgagccgctgcgcccagccacatgttttgtgaaataaaggcacatgcattaaaaattgtaagcacaggaaaacaaccctaaaaaatgtggacgtgtgtgtttaagaaaccagcctccaattctgtttgttatacactcatgggctggtctgattaacaggctgagcttcagtccacaacccaaaacacttgtgcacataaactcgtggctcaaatactaaactaccgtctccgctctttcattcttgtaaaagcttgaatggcttgttggtttttggtagagttgtcacagagtggccggtctgcaggcaaagccttgggtttcccctgcttttctaagtcactgaagccctaattaagggctgggttaggtaaacacagctgcacatatggaaaagcctaaactcaagaaaaatatatttttaaatgtccactcaaaacccaggtagactctgtaggctcagcagaatcactaggtcagcttagaagcaacaggcagcaccatcttcacgctcagtctagttagttcctcatgtccctttgggcttctgttagtttctggattaggtagcacttgtcacgactttcctaaaaaataataagttcacatgtacatttaatatatttggaaacaaataccatcattacctaccagactgagggctgaggattctaaccactggactattgtaatggcctctcatctggtctgtcattgtgtctgctccacagccccttgtccacaaagcagccgatcctttttttaaaaaatgcacagtacagctggacacggtggctcatgcctgtaatcccagcactttgggaggccgaggcaggtggatcacctgaggtcagaagtttgagaccagcctgaccaatatag

SEQ ID NO: 3157 - DNA, 1382 bp, Homo sapiens
gcaatgtgcagatatacagcagtactcacctcaaattacagaaagtcatacaacaagatccctgctggttccatgatacacacattccatacacagacacagacacattccatacacacacacacattccatacacgtgcacacacacattccatacacacagacacacattccatacacacagacacatattcgatacattccacacacacacacattccatacacacacattccatacacacacattccatacacacacattccatacacacacattccatacacacacacattccatacacagacacattccatacacacacacattccatacacacacattccacacacacattccatacacacacacacttccatacacagagacacattccatacacgcacagacacacattctgtacacacacacacaaacacatattccgtgtacacacacttccatacacacagagacacgttccatgcccacacattccatacacacacagacacatccagtacacacacacacagacacattccatatacacacacacattccctacatacacacacagacacattccatacacacacccatactcattccatacacacagagacacattccatacacacacgcacacattccacacgcacacacattccatatacacacacagacacattccatacacacacattccatacacacacacacacattccatatacacatacacattccgtatacacacacagactcattccatacacacacagagacacattccattacacacactcagacacattccacacacacacattcatacacacacacattccatacacacacacagaatcattccatacacacacagacacattccatacacacagacacacatttgatacacacacacattccatatacacacacattccatacacacacattgcataccaacacacacacattccatacacatacacagacacacattccatacacacacaaacacattccgtacacatactcagacacacattccatacacacacacacattccgtacacacacacagtcacacattccatacacacacacattccatacgcacaaacacattccatacacacacacatattccataaacacaaacacattccatacacacacacagactaattccatacacagagacacattccatacacttacgcagacacattccacacacacacacattccatgcacacacatagactcattccgtacacacacatagacacattccatacacacacagacacattccatatgcatacgcaggtatgtccccaaagaaatagattgtctccatcatatgcacattaa

SEQ ID NO: 3158 - DNA, 14994 bp, Homo sapiens
acttgacgctgcagggcgggcggggtaaagaagggagcgagcccttctcaagcttggaaagtttccagactgctgggccagcctcctccccagagggaaactgaggtccgattgaggtttctccaagaccgcccactcctgctcctgtccccaaacccctttctgcctagggttcctggaagccaaggaaacagaacgaactgttccctgggtgggcgagccactgcagagtacaaagctttcaggccgcctgcctcattagcactaatggctgctcccttccgccctgtgtcgtcaggactgtctatgcctggtctcatcagcacaaggctgggctgaagaagtcccaggagtcctcccatgtcctctcagcaacccaggctggagcctactccttggtgttggcaaaggaaaccgtctttgaaggtgagacctttttttttttttttttttgagacggagtctccctctgttgcccaggctggagtgcagtggcgcaatctcagctcgctgcaacctccccctcctgaattcaagcaatcctcctgcctcagcctcctgagtagctgggattacagatgtgcatcaccacgcccggctaattttttttgtatttttagtagagatggggtttcaccatgttggtcaggctggcctcgagcccctgacctcatgatcaggacttcctaaccgcgcccggcccaaaggtgaggcctcttacagctgtaataaagagaagagaaggctgggtgcagtggctcacgcctgtaatcccagcacttcaggaagccaagataggcagatggcttgaggtcaggagtttgagaccagcctggccaacatggtgaaaccctgtctctactaaaagtacaaaataattagccagtgtggtggcacatgcctatggtcccagcttttcaggaggctgaggcaggagaattgcttgagtccaggaggcagaggttgcagtgagccaatattacaccactgcattccagcctgggcgacagagcaagacaccatctcaaaaaaaaaaaaaaagagagagaagagaggagggtctgaagacttcctgctggctgagtgttatctgcctcaggctaccctgactttttcactgtttttcactttttttttttttttgagatagtctcactgtgtagcccaggctgatgtgcataacacagcagccttgaactccctggttcaagtaatctccctacctcagcctcctgagtagctgagactacaggcatgcactacctctcccagctcgctacttttcagaaagggtagacaaactacagtagctgcctggacaccatacttggaggagaaggggagggggaggctgcaccggattctgtcttctgaactatgttatcttccagtttcaacatcataaatagcacagcaatcttatatgatgggcctcctgatgtgatgcaaaaatcaccaaagtagtattcttgacaaaagtatttaccatgaatccaatcttgaagaagcaatcaggtaaatccagaatatactagaaaagtggcctggcctaaactcctaaaaagaaaatcaatgacatgaaaaacaaacaggctgagtgtggggcagaggatactcttctatattaaaagacactagagagacataaccaaatccaattcatgaaccttgcttcactcctggactaaaataagaatgctaaaatgggctgggcgtggtggctcacgcctgtaatcccagcactttgggaggctgaggtgggcgggtcacctgaggtcgggagtttgagaccagccttaccaacaaaccccatctctaccaaaaatacaaaattagctgggtatggtggcatatgcctgtaaacccagctactcgggaggctgaggcaggaaaattgcttgaatccgggaggcagaggttgcagtgagccgagatcgcaccattgcactccagcctgggaaacaagagcaaaattccgtctcaaaaaaaagaaaaaaacatggtaaaatggcattcttggaacaagtcagggtgatactgctgaattactgttggtgtggtgatggtgttttcattgtgtagagcaaggtttctcaacctctactgttaacattttggtgcagataattttccttttcttttttttttgaggcaggatcttgctctgttgtccaggctggagtgcagtggtgcaatcatggctcactgcaacctccccttcccaggctcaagtgatcctcccagctcagcttcccgagtagctgggaccacgggcccacgttgccacgcccggctaattttttgtattttttgtaaagatggcgtctcactttgttgcccaggccggtctcaaactcctggactcaagtgattctcccacctctgcctcccaaagtgttgggattaccagcaaccccaggcccacataattctttctggtgggaagtttaacagcagttctgttctctgcccactaggtgtcagtagcaccacacctctttagttgcaacaactaaaaaacgtcaaatgttctccaaataggtagtggtgatggttgaataacatcgtgaatatacaaaaaccattggactgtaccctttaaaatggttaaaatagtgaattttatatcatgtaaattttcccaataaaaaatgttattaggccgggtgcggtggctcacatctgtaatcccagcactttgggaggccaaagctggcagatcactcgaggtcaggagtttgagaccagcctggccaacatggtaaagccccgtctctactaaaaatacaaaaattagccgggcgtggtggcatgtgcttggaatcccagctacttgagaggctaaggcaggaaactcgcttgaacccaggaggcagatcttgcagtgagctgagatcacaccattgcactccagcctgggtgacaagaaagaaactacgtcaaaaaagaaaaagaaatgagtttcctcctccatacttgcagagccccagtgagtccctgctctgcaatgctcatacccattgtgctgttactgcaagtcaatgagaacgttggtggacttctctccacttcacagaagaatgaatggaggcccagaacaatggcatgaacctgtcgtttcttggccttttggctaagatcaagtgcaatggcatgaacctgaccatagtcgtagacaaacaagaggcagagacattgtcttagtttgagttcccacttcagaaaaccttgagacaaacattgtagcacaggaagtttattaagaggatacaagccaggcatggtggctcacgcctgtaatcccaacactttgggaggccagggtggacagattgcctgagcccaggagttcaaaaccagcctgggcaacatggggaaatcctgtctataaaaaatacaaaacttaggctgggcgcagtggctcacgcccgtaatcccagcactctgggaggctgacatggctggatcacttgaggtcaggagtttgagatcagcctggccaacacggtgaatgaaaccccatttctactaaaaatacaaaaattatccaggtgttgtggtgtgcacctgtaatcctagctacttgggaggctgaggcaggaggctcacttgaacctgggaggcagaggttgcagtgagctgagatcgtgccactgccactccagcctgggtgacagcgagactctgtctcaaaaaaaaaatagcctggcattgtggcatatacctgcagtcccagctattagggaggcttaggtgggaggattgcttaagcctaggaggtcaagactgcagtaagccagccgggggcggtgggtcaagcctataatcccagcactttgggaggccgaggcaggcggatcatgaggtcaggagatcaagaccatcctggctaacatggtgaaaccctgtctctgctaaaaatacaaaaaaattagccgggtgtggtggcgggcgcctgtagtcccagctactcaggaggctgaggcaggagaatggcttgaacccgggaggcagagcttacagtgagctgagattgcaccactgcactccagcctgggcgacagagcaagactccatctcaaaaaaaaaagactgcagtaagccgtgagcatgccactacactcagtctgggcgacagagcaagaccctgtctcaaaaataaataaggaaataaaagaggatacaaagaacaagcgtacaaaaatacagggagggaagacagccactataaagtgggtcataagcagggttccaccagggatgcctggtccccccggggtgtgggtggggaactctgggctgcagtgcagaatgcatgtctcagagaagttccacccaaggcaggaggaaggtgagtagatatacagcaaccctgtctcagtcccttggagggttgttgggggagagttaactcctagcacttctgaccaacttgtagagtgagctcagaaagccccagacacatcagaggcagataccagcagtggacaccaagagtctgttccacgtgtgtctaagcatacttatcccccaaaatgtggcgcccacaccaacagcatcagcctaaggtaggaacctgggaggatgttaagtctggctctgccccaacataatgaatcacaaactcctggggtagggctcagctgctagagtttgtttgtttatttgtttgtttgtttgtttgttttgaaatggagtctcactgtgtcgcccaggctggagtgcagtggctccatctcggctcactgcaacctccgcttcccaggttccagcgattctcctgcctcagcctcccgagtagctgggactacaggcacgagccaccatgcccggctaatttttgtgttttttagtagagacaagctttcactatattagccaggctggtctcgaacccctgacctcgtgatccgcccacctcggcctccccaagtgcagggattacagatgtgagccaccgcgcccggccaactgctagagttttaacagacctttcaggtggctctgatgtgactgagctttgagaatctctgccctaacccaccatttctaactccaaagcccaaggtctttctggtactagatgatggctgaggcctgcagccaattagtgggaagggctgctggggatgttagaggcagaggaataagcggcctgacactcagctccggggacaccaaataggtgctggcccttgtaacccagtgaggaggcagcgctcattcctttatcttaaaatatgtcctgagcacttactgcatgccagagcctggtgcaaatgcttagggcttactaggaacctgggggtggagggagcagggttgatgtgaaggctgggtattgaacacaaagaatttgggtcttttggggctcctgtggtctggtccactccttggagatacccaccaggagatgactcagccttcctagtccaggaaggcccccgcctctttttctgtgagcccagccatcaccttattgccttcagcatgtcctgaatggattttgtcactgttactggggcctgcaaagcacacagccctcgtggtccagctaagaccacctggccacaggccggcccacagccgtacttgcagggtgaaccaaagtcaaggaagggtccagagaagctgggtctgaatgccacccaccacttccccatgtcaggagatgacacttatgtggacaccccagggattcctatgattcctccaacccatcaccttttctagagcacccctcactcctctctccagagtctcccacctttccagcactggcttcccaagttccactctctgcagcctccatctgtggcctggaccccaggatccaaccccctaaactccttctaggcaaccatcttgggcaacttcacccaatgacaacctatgctcctcctgttattgacagccctgaaaaaatggagttcaaggtcataggccccattggacctgatatcttcaccaggctcctgagaacccaactgagcagccctgtcctcagattccagctcggacataacattgggggtcagaaaactgactcccaaggtacaaactggaacagccagggtgagtgccagcacacaggatggcttcctcatcataggccagagtctggccctgggttagcaagttcagggcagcctacaagaggaatgagctggaaagagctgtggccaacccagggaggccccaaatacaccaagtcccaggtcctcctgctcttgtcacctttctacagtggtaagacaagacacattgtctgaacagtcccagttcagaacttctgtcgtggagcctgtagtgctgcaaaggttgaagacagtggcttatacccagctcagttctttattttctctctttctctccttccttccttccttccttctctttctttctttctctttctttctttctttctctctttctctttctttctctttttttgagacagtctcgctctgtcacccgggctggagtgcagtggtgtgaactcagctcactgcaagctctgcctcccgggttcacgccatcctcctgcctcagcctcccgagtagctgggactacaggcgcacactaccacgccccgctaactttttgtatttttagtagagatggggtttcaccgtgttagccaggatggtctcaatctcctgaccttatgatctgcctgcctcggcctcccaaagtgctgggattacaggtgtgagccactgcacctggccttttttttttttttgacatggagtttcgctcttgttgcccaaactggagtacaataacacgatttcggctcactgcaaactctgcctcctggattcaagtgattctcctgcctcagcctcctgagtagctgggattacaggagcacaccaccatgtccagctaattttgtatttttagtagagatggggtttcaccatgttggtcaggctggtctcaaactcctgacctcaggtgatccacctgcttcggcctcccaaagtgctgggattacatttttttttttttttgtcatgtgtctgttgccaagggaataaggttggggggaggatcaggcaagggcgtgatttatatacatatatatgtgtatatatatatattttttaattttttaatttaaggacaggatcttgctatgttgcccaggctcttgaactcctgggctcaagcaatcctcttgcttcagcctttcaaagtgctgggattacaggcatgagccactgcacctggccaagctcagttctttctgggggtgggcttgggaagccttcctcagcagtgatccaaaggcctaggacagaggagagggggtgcagacaagaaggaacaaggcctcagcctcccattcttggcaaatctaaacctggcaaccaagatgatgatattctcatttcacagaaaagtctacttttctcagctggggagcaagtgtcaggagcactggggccagactccctccccaacctggccctgctcattttcccccgttgcctgaggaccctggggatggaggaagagcatcagaccaggggcagggtctattctgggccagcacgtggagcggaggcagagctggcctcaggcccttgcctgatcctccctccccttattcccttggcagcagacacatgacatagaaatcactggttccaccaaatactgcacagcccagatgctgctggcctgatcagggccaagctgagtcaccactttaggatacgattcttgctttttggactatgaatgcaccctcatcaccccatgctcaacccccaactgaagactgaggttacagcagatccgtggatatcacagggtgatgaggcactaggccacctgctgcctattccctggcacttcattcttctgataatggagtatgagagagaatgggacatgaggtggaccccgatcaggcatgtcatagacaggagggacacatactaccactgggcatggtgccctagataatgacccagagggaggttgtaggtctcgaccctggggtccaagctgatgaggaaaggcaagaaaaaaagaaggggccaggcatggtggctcatgcctgtaatcacagcactttgggaggccaaggtgggcagatcacttgaggtcaggagttggagaccagcctggccaacgtggtgaaaccctgtctcttataaaaatatatatatatattaaaaaattagccggggccagccacagtggctcactcctgtaatcacagcactttgggaggccaaggcgagtggatcacctgtggtcaggagttcaagaccagcctggccaacatggtgaaaccccgtctctactaaaaatatcaaaattagctgggcatggtggtggcacatgctggtaatcccagctactcaggaggctgaggcaggagaatcgcttaaacctgggaggcggaggttgcagtgagctgagatcatgccattgccctccagcctgggagacaagagtgaaactccatctcaaaaaaaaaaaaatagctgggtgtggtggtgcacacctgtagtcccagctacccgggaggctgaggcaggagaatcgcttgaacccaggaggcagaggttgcagtgagccaagatcacgccactgcactccagcctgggtgacagagcaagactccatctaaaaaaagaaaaaaaaagaaaaaaaaaaaggaaagaaagaagggaaagcaggtaggatgtcttgaacaaataggtggatataggctccagaactggtggttgttgggaaaagtgggaaaaccttctgcatggggttgcctgggtgagctgatttcctattaggtcctcattcctgctgccaccaagataaagtgatgggtggcatggagatttcagctgtgtccttggatgtcatgtgctctgcagtcctcatgatgataacaagagtccatccagtccatgcttcgatgctggcatgactaaaggaacagggatgttatcgaatgggagggccacgtggtgccctcgtgggcttccccaagcagctgaccagacctggaagcacctttgtctaaggccctacgagcagcctagttaatccttttccattcccccatcccactcacttgtatcccactctgcctttgccatactgaatcccatccttggaaagtcaggaaagccctaagatctctaggctccagcataaggcaggtccccagtataatgactgactcttgtcccttttcttcttcttcttcttctttttttttttttgagatggagtttcactcttgacgcccaggctggagtgcaatggcatgatctcggctcaccacaacctctgcctgtcgggttcaagtgattctcctgccttagcctcctgagtagctgggattacaggcgcccgccaccacgcccatttttgtatttttaatagagacggggtttcaccatgtgggtcaggctggaatgcaactcctgacctcaggtgatccgcctacctcggcctcccaaagtgtgggattacaggtgtaagccaccacgtccagcctactttcttcttttcacatgataggtatgaactggtaatggaataaaataggccgggcgcagtggctcacatctgtaatcccagcactttgggaggctgaggtgggtgaatcacctgaggtcagaagttcaagaccagcctagccaacatagcaaaaccaagtctctactaaaaatacaaaaattagccaaacatggtggcacgtgcctgtaatcccaggtattcagagactgaggcacaaaaatcgcttgaacccaggaggcagaggctgcagtgagccaagattgcaccactgcactccagcctgggggacagagtaagactctgtctcaaaaataaagcaaaataaaataaaataaaataaatcgtcattgtatgatgatacatttggtactccaaactatcaagttgtggccaggtgcagtgactcatgcctgtaatcccagcattttgggagaccagggtgggtggatcacctgaggtcaggagtttgaaaccagcctggccaacatggtgaaaccccttctctactaaaaatacaaaaattaggtgggcgtgatggtgtgcacctgtaatcccagctactcaggaggttgagacaggagaatggcttgaacctgggaggtgaaggttgcagtgagccgagatcacaccactgcactccagcctggcgacagagcaagactccatctcaaacaacaacaacaacaacaacaaaactatcaagttgtaacttcaaaactgaaatttatttatgtatttatttattttgagacggagtttcgctcttgtcacccaggctggagtgcaatggtgcgatctcagctcactgcaacctctgcctcccgggttcaagcgattctcctgcctcagcctcccaagtagctggaattacaggcccccgccaccatgcccaactaatttttgtgtttttagtagagatggggtttcaccatgctggccaggctggtctcaaactcctgacctcaggtgatccatctgcttcggcctcccaaagtgctgggattacaggcatgagccacgacacccggcccaaaactgcaatttatagtgcactgagcagcaaagaaaagtgacgagagcaccacttacgatctctgttccaacaactcgactctgctgttggaacccaaaagcagacacaggcaccatgtaacagatgaaccaggctacatttcaataaaactccatgtctgcacactgaaattagaattttagataactttaatgtgtcacaaaatagcctccattcgattttttttcattgtggttcacgcctgtaatcctggccctttgggaggccaaggcaagaagatgacttaaacccaggagttggagacgcagcctgggcaacatcaggagaccctatctctacaaaaaaaattttaaattagctgagtgtggtggtgcgcacctgtagtccctaccctttgggaggctgaggcaggaggatcatttgaggccaggagctcactgcactccagcctggacaacagagggagaccatatcttggaaaaagagagagagagagagaaaaagagagatggagggagaaggagagaaatgtaaaaactttagaaaaacttcagtgcttcttagttggtttaaaaaaaaaaatgccaggcatggtggctcatgactgtaatcccagtactttgggaggccgagcaggcggatcgcaagatcaagagattgagaccatcctggctaacacagtgaaaccctgtctctactaaaaatacaaaaaattagccgggcatggtagcgggcgcctatagtcccagctgctcaggaggctgaggcaggagaatggcttgaaccctggagccggagcttgcagtgagcccagattgcgccactgcactccagcctgggcgagagtgcaagactccgactcaaaaaaaaaaaaaaatccttgggaggctgaggctggaggatcccttgagcccaggaggttgaggctgcagtgagctgtgatcccactactgcactcagcctgcatgacagaatgaaaccctgtctcaatcaatcaatcaataaggccgggcacagtggctcacgcctgtaatcccagcactttgggagaccgaggcggatggatcatttgaggtcaggagttcaagaccagcttgacctacatagtgaaaccctgtctctactaaaatacaaaaattagccaggtgtggtggcagatgcctgtaatcccagctacttgggagactgaggcaggagaatcgcttgaacccaggaggcggaggttgcagtgagccaagatcacaccactgcactccagcctgggcgacagaacaagacaccctctgaaagaaagaaaagaaagaaagagaaggaaggaaggaaggaaggaagaaaggaaggaaggaaggaaggaaggaaccattcttgacttgtgggttatacaaaaacaggcagggttccactcctggcactaggtttgttcttgtgtttgttctctgttcagggttatgccacgcagagggtaggaggggaattagtccatggttatgtgtcctcacagatgaccactgagaaggccaccatgcctagtcgtcacgactctaggcccagcaacttgctgaagactctgcagtgctggggacccaggcatttttgtgaggctgtccacaccctatctgcctgtgaggactgggcagtccatctgggggtctggctgcctctcctgcgtgctgctgggaggctaggcctgactgtcattgctctacggccacatccccagccacgctcttctttttcttctttcagccagagggagccctgaattcatgcagaggagtttttctaccttccatctgcttctgcatatcatcttgtctacttaatgcccctccttccggatttatagaacagtatgcataatatgaccccaactgcattccaaaaaatagatgtagatgtaagcttagagatgcaaagaaactttttgagagaattcactatgcttctcgcgggtggtgacacagttcaaggaggttccatggggtgtaatgtttatctttctcttttgtccttctgatcattgaaatgatgctttgtgtgtgtgaacatgtattacttttataattaaaatagaaaaattaatttgaatgggacaaatgctcgaagtcaaagtcacctgttataactgctgtcactaacagggcaactgtttgaaaatgctgcagaaacatgagaaatgttcatgaagtgaccctgtggaggcttccggtcacaggatcatgtgagcgccacgatcaccccaggggtggagcagatgctaagtgttcaccacacccaattctcttcctggacacacaggaagatgacatttccagtgacatgccccacctctaggccctagtcttttttttatttaaaggtctgagtcttgttctgtcacccaggctggagtgcagtgctgtgatcatgactcactgcagcctcaacctcctgtgctcaaacaatcctcccacctcagcctccctaatagctgatgtcatataggcatgagccagtgtgcctggctcaggccctacccttaaaagcatcccacctgattcaccagcccccttctctctctcagtaaacttggaaaccacgcattccagatggtataatttacagcatgatggaaaaagccagctctccatgggaagctggccagtcttcattggagtacatttttattgcatgaagccaatgagacttgatattgtttaactctgtggtttccaaagtgcggtccttttgaagtatccataaagtctacactaggttcacggtaatattaagatgttatttgtcagctgggcacggtggctcacgcctataatctcagcactttgggaggccaaggcaaatggataatgaggtcaggagtttcagaccagcctggccaacatggtgaaacccagtctctactaaaaatacaaaaattacctgggtgtggtgatgcatgcctgtaatcccagctactcaggaggaggctgaggcaggagaattgcttgaatccgggaggcagagattgcagtgagctgaaatctcaccactgcactccagcctgggtgatggagcaagacactgtctcaaaaaaaaaaaaaaagatattatttgtctttcatgagtgtacagtgggattttccagaggctacatgacatgtgtttttttattttgttttttatactgacagaggggtcttgctatgttgcccagactggtcttccaactcctggcctcaagtgatcctcccgccttcacctcccaaagtgctgggattataggtgtgagccactgcgcctggctgtttgtgacatgtgatgttgaaacaggttgagtatagaagcagatatgggaattaaaccagaatattaaaccagacattgaagagatttgcaaaaaatacaaaacaataccactgttttcactttctttttggtttggaaaaatgtagttatttttcattaaaagtatgttgtgttggctgggcacagtggctcatgcctgtaatctcaacgctgggagactgaggtgggaggatcacttgagatcaggagttcgagaccagcctgaccaacataatgaaaccccatctctactaacaatataaaaattagctgggctggctgagcgcggtggctcacgcctgtaatcccagcactttgggaggccaaggcgggcggatcatgaggtcaggagatcgagaccatcctggctaacatggtgaaaccccatctctactaaaaatacaaaaaattagctgggcgaggtggcgggcgcctgtagtcccagctgctcaggaggctgaggcaggagaatggcgtgaacccagcgggcagagcctgcagtgagcagagatcgcgccactgcactccagcctgggcgacagcaagactccgtctcaaaaaaaaaaaaaaaaaataactgggcttggtggcatgcgcctataatcccagctacttgagaggctgaagcagaagaattgcttgcacctgggaggggcaggttgcagtgagccaagatcgcaccactgcactccagcctgggcaacagagcaagacaccttcaccttctcaaaaaaaaaaaaagttgtgttaacatgtaatggtttcatgatatcattttaaataaattaataaacatgtaaacattttctctgttttaatttctcacatggtaaatattaatggtgtgaaccaaaaagtgactgaggcatctcaatcaatttagaggtttatcttgccaaggttgaggacacgcccggggaaaaagagacacaagtcacagtacgatctgtgtcctgtgctttttccaaagaggaaagaggcagcaggaggggagggaggaaaggggaaaaaagcgggcaggagggtaggcagggcggcaagtggtgacattgttgtgaggctgtgattagcagctcagtgactctac

SEQ ID NO: 3159 - DNA, 2455 bp, Homo sapiens
cggcccccaggcctgcgttcagtgaggcctcccgtggcgtcagcatgttcgtgtggaggaatgtggaaggtcactcttcggccgtgttctcctggtactccatccccttcctgacccctccctgcagccacacgaggcccagcaacctgccagtcactcagagtctctggcctccaaccagagaaaacaacctgccaagttggcagccgttgctcatgagcgtccaccaagtgggacagggagtgttgaccctgggcggccccctggagccacctgccctgaaagcccagggcccgcaaccccacacactttgggggtggtggaacctggtaaaagctcacctcccaccatggaggaggagccctgggcccctcaggggagtccctgctggacagtgagacagagaatgaccatgatgatgctttcctctccatcatgtctcctgacacccagttgcctctaccactcagatgatgtcaggcccagtccctcagtgccctgcgcaaggaaaaggactcatcttctgagaaggatggacgcagccccaacaaatcagacaaggaccacatccggtggcccatgagtggcgctcatgatcttcagcaggcggcaccaggccctggcggggcgcaccagggtcaccccaaccaggataaccggaccgtcagccagatgctgagcgagcggtggtacaccctggggcccaatgagatgcagaaatacaacctggccttccaggtgaaggtggcccacttgcaacaaggaccgaaagaagtccagctcagaggccaagcccacaagccaggggctagcaggagtgtaacaagggctcgtgggagcggagcatatcagagacgggcactgccactgcccctggggtgtcctctgaactcctgtcagttgcagcccaaacactccagagctcggataccaaggagcagcttctatggggcagaacggctgcacacagtcagggaacctggctcagcctggcccaagccttctcccacagcggggtacacagcctggacggcagggaaatagaccgtcaggcactacgggaactgacacaggtggtgtctggcactgcatcatactctggcccaaagccttctactcagcatggagctccaggccactttgcagcccctggtgagggaggtgacccgtgggcagccctgctgccgcccacgtgagctgctcattcccagcacatggccagcgaggtcatagcgagtgacgaggagcacacggtcatccatgaggaggagggggtgatgatgtcattgctgatgatggctttagcaccaccgacaccgatctcaagttcaaggagtgggtgaccgactgagagtggggacaactctggggaggagccagagggcaacaagggctttggtgggaaggtatttgcacctgtcattccttcctcctttactcctgccgccccttgctggatcctgagcccccagggtcccccgatccacctgcagcttttggcagtctatggtcacaccctgtcctcctcctacacatactcggatgcttcctcctcaaccttggcacccacctccttcttactgggcccaggagccttcaaagcccaggagtctggtcaacgcagcagagcgggccccctacggccccaacccctggggatgggggcccagggacgccttccaaggtggcctgtttcctcccaatggatcctgccaccttctggtgcaagagacctgaaagtgtgggtgacctggagctaccaggctcctcagtcatcagggtccctcccaacactaaggctttcctaggcaggagctgggctgagccacccggggggcagagcctgaagagaaactgactgggctttcggggtcggggcagagggaaccccacggacatggatcccacactggaggaccccaccgcgcccaaatgcaagatgagaagatgctccagctgcagtccaaagcccaacacccccaagtgtgccatgtgtgatggggacagcttcccctttgcctgtacaggtggagaagccgaggacaggctcagggaaccggagaccgagaaggcgctgtcctcttcactgcacgtaccctggaccagtgccggccctgatcatgcagctcttccaggcccactgcttcttcctgtccactaggccacagccgccctccaggcccactatgcacacatcttcccctccaaggtttgttctgcccctgccctgactcccagccctgtgggggtcctgaccgcacctcacctgactgctgctgcccctgccctgactcccagccctgcctgaccccacctcaacctgctcaggctctggcacaaccctggctgccctgccactgcctctgccccagagttggggccttgacagcctggttggaaggggacaccccagccctgcctcaacacctgggggtctccataactaccacaggca

SEQ ID NO: 3160 - DNA, 3053 bp, Homo sapiens
atgaatggggaataaggtagaaagtggaatggacaagtcctctctgtcaggcccagtacagagcagcagcccgggacagcagttaaaagttggagtggtcagagccccgagagtaactcacctgctgagaaggattagttatcagctcctaggcagcagccacagccaacagagaattaaacatgcacaacattagccaagacatttggggacccagaaatagcatgacagacacagggatccctcagcatctacactgtccacttcatcccagtgagacccatggttgtagacaggcacccataagtggcactagacaggagctgcttctagcagacatgcactcacggagaagccaaacgaagcggagatcaggcagctcctcccatctgcctagtgcgaccaccactccccagttagggcagaccaaacccctgagttctcccaccccaggctttgctgcctgttcttccttttcctctgctgaaaacctgcagagagggtggaggacattcctccatcctgggatgagttcacctttctaaatagaggaggagtcacaaatgaactcgatctggaagctccagaaagttgtgtttactgaggcagagaaaagcaagtgcccttgaatttgctcactgcccctcatctgtcctttgatgtgcaaggggaactgaagaggcacagcacgcacctctgttctccctgacgccgatggagtggaagctactgactcaaaactcgcatggggcacagagaagaccatgactcccaggacctcccctgccccacaaccaactgagagaagaggcaacaaggttaatacggcctccgggatctctccagtcctgctgctgggatttcagtcccagagactagacggcccactgagtgaggggaggcaggtgattggactgtgtgggctcagagaggtgagggggacaggacagggggtctttcagtcttaactcttctcaactcaccaagctgggaggccccagacccagtttgtacaaaatccataaccttctttcctgactggccccatcccagcctcacctcagggccctggagcctgagtaggctgggccagagtcctgtcctgcagaaagactctcaaatgaggaggtggcctgcgatcaccaagcctggtatgcttgccacacactcctctgtcctcaaccccactcgtggagaattggctcccaggagccagtgctcaaagagttcctttcagctccagcagccttagctgccagcctgacatgggcatggggttaaaaatgcctcctggaattaggagtagagaatccgatgctgtgggcacccacatttaaattaaataagcaatcatctggccagagccctaggagcggctgcatgtgtcctcagtcatccacagatcagggctgggcagaaagtgagctagggcaacctctccagctcagtggggagccaggccacaacagccagccattgccaggacccactcattggcacccagggaaaccctcaagactgagatcccaggctaagtaaagaaaacaaggaagatggtagcccagccccaagagggagaagtccctctggggcgggccagagataaagcaattccctgaggcttctaagctggtcattccccaaatggacttagagggaaggcccctagctgctagttaccaggcggattcctgggccccaactcatctcccgaatcacattccaggatgaggtctgagaagcaacccttttggcagtccccacagatactcggcacagtttcagattcccacctcaggaacaccctgcgctctgccaccaactcaccccctactttctctgtgactggaagaccagactgctggcagccacctgcacatagagccttgagagcaatatccaaggcttccccgggccttcccaggcccaggcccaggcccagccccagcctcagcctcagcctcagccccctgagtgacatggagcagcaccttctgccttccttgcaaggcaacatcccctgctcggtctcatagaggtgttgacagacaaaatgtggtggaaaagtggtttgagaagttattatgccttctaagcctagtccctaaatcctgggccaaagacagcaagggtccacagtggtcaggccttgcgactctacctccgatgctccaggatggaagagagaaatggacaaaacaccatttcaatacttggtgtataaatatgaaccataatacaagcatatttccccctatggtctgtgcacctctacttcatacctacatcctcagcaagaataaaatcatcacctcataaagaataaaatcattcagtatacatgtgaggaaggaaggaaagaaggaagggaaggggaagatggaggaagggaaggaaggaaaggaaaggaaaggaaggcaggcaggcagaaagaaaaggagaagctgaggtttggattcaagggtatggtccaagaggccagagggtatagggtcttacctggtgcctctggtaggctgaaaacatcttttcaaaatcctctaggtccaggatccgaaatacctgcatgtcatcaatctcattccatacggtgccagggacacgctcctaaaattcagggtagggagaagatcccatggttggcccaactccatcatgaagatgctccatgcctccctaaccccacttatctcccaactgcacatactaagatgaccaggatttcagaccttcagaaggtagtcggttgctcccctcaacctccaactctcttgaatactctgctccagggtagaggccagagacaacccccttttcctcccttgtgcatggagccacatgtaaacatgttctagaaatcatggggggtgctggggggatgggtaggcagtaggaaagggggtccacttcactttttccaaaagcaaagtcagaagctgcactcagggtacttcacacaggcccactccccctaaagggcaggttgcctggagtcacccctgtccttggcagccatcattggaagattaaagccatacatattttggatcctc

SEQ ID NO: 3161 - DNA, 248 bp, Homo sapiens
gcaggataggttaagggaggatcaaggtgatgagggcctggaaagaggggctggggtcgaatcaccagatcctgttggttgcaatggaagagcctggagtttattctcagagcagtgagaagccactggaaagttgtttttttgtttttctgtttttgagacagagtctagctctgtcacccaggcagactgcagtggtgcaatcttggctcactgtaacctctgcctcccaggttcaagcgattctc

SEQ ID NO: 3162 - DNA, 4266 bp, Homo sapiens
agttttgctcttgtcgcccgggctggagtgcaatggtgtgatgttggctcactgcaacctctgcctctcatgttcaagtgattctcctgcctcagcctcccgagtagctgggactacaggggcctgccaccatgcccagctaatttttgtatttttagtagagacaaggtttcaccatcttggccaggctggtcttgaactcctgaccttgtgatccacccaccttagcctcccaaagtactgggatagagacagggtttcaccattttggccaggctggttttgaactcctgaccttgtgacccacccacctcagcctcccaaagtactgggattacaggctgaggcaggcggaccacctgaggtcgggagtttgagaccagcctgaccaatatggagagacctcgtctctactaaaaaaaaagtacaaaattagccggacgtggtggggggcgcctgtaatcccacctactcaggaggctgaggcagaagaattgcttgaacccaggaggcagaggttgcggtgagtcaagattgcgccattgcactccagcctgggcaaaaagagtgaaactacgtatcaaaaaaataaaaaaaaattcaattaaaaaaaaaaaaaaggccgagcacagtggcttacacctataatcccagctctatgagacactgaggcaggagaattgcctgagcccagtagctcgagacctaatctctactaaaaaaacaaaaaaaaagtagtaggtgatctaaaattttggcttattcatattaaaaacttcataaaaatgcaaaagaggctgggcgtggtggctcacgcctgtaatcccagccctttgggaggctgaggcaggcgtatcacctgaggtccggagttcaagacaagcctgaccaatatggagaaaccccatctctactaaaaaatatacaaaattagccaggtgtggtggctcatgcctgtaatcccagctactcaggaggctgaggcaggagaatcgcttgaacccgggaggcagaggttgtggtgagccgagatcgcgccattgcactccagcctcggcaacaagagtgaaactccgtatcaaaaaaaaaaaacaaacaggccgggcgtggtggctcacgcctgtaatcccagcagtttgggaggccgaggtgggcggatcacgaggtcaggagattgagaccatcctggctaacacagtgaaaccccgtctctactaaaaatacaaaaaattagccaggcgtggtggcgggcgcctgtagtcccagctactcgggagtctgaggcaggagaatggtgtgaacctgggaggcggagcttgcagtgagcccagattgcgccactgcactccagcttgggggagagagcgagactccatctcaaaaaaaaagaaaagaaaagaaaaagaaaacacaagtgtctggggctcagaccacagttcttcaaacttcttgtagctgagcttttatcatagcttttatcaacacacgtgtgcgcacgcacacacacactcacacatgttcctcagtcagaatgtggtaaacccaggctgaaaaacaaaaacatgctgaagatttcacagccaaaggaaacatgtatctagacagaccattttggcatggacttatcagaacttggaagaaattcagcaggaatgtttcaggaataccagggtggaccgagggtttttgaagcggcagcacaaatgccccaggaaagacgcctctggaaataatcctaacccaaacaaaccacggttatccaggcggccatttgtgctttccacactgccttttcttttccctccaagtctctctccctccctgttttaaccttgaatccccgtaaagactgacacatgctgagctttactttccctcaaggattcatggtgctgctgtgtgtctgtccgtctatccgtgcagcctcagggggcgctgaggcgtgtgggttggttgggccatttgtcacatggccccgtggtagctgtactttctgacttctgtttggtctttctagttcttttttccctgtagcagaccctcttcctgcttctggtctattcttcccaatttcagatgggcttaaaaacccgatacccatgttaataggtctagaattaaattaaaggtaaattctcagagccagggctgacacactaggaggacctcctcttcgtggtctgtgtccttagctggaggagccggggaccatgatctctgaggctcctcgagactctgaccgtggtacgaggtgggtatggctgcccggggcctgctgtgctgagctctctctctgtcctcactggcccgaagaccagcagttttccagcagcgcctgtggggccctggccttgcagaggtgcctcagggcccctgtggaaggggcagtttcatgggaccagttttgctgttacttgttgaacacatctggcttatgtacaagattttatttaaggctggacagctgggagtgttttttgtattttgtacacacacctgtagtcccaggtactcaggaggatgaggtaagaggatcacttgagcccaggaggttgaggttacagtgaactgagattgtgtcactgcactccagcgtgggtgacggaacaagagcctaactcaaaaaaatttttttttaatttgaagaatgggtcccactgctaaaaaacatttggaaacttctggcccagcagagcagggctccagacagaaacaggctccactgctgctctcttctggcctgtcagaggcctctccctctccgtggtgggtccttctgcactgactccagttactgctgggcctctacatctggtctgaggtgtgacctcagaatccagcaagaagctgcatctgctaattgtagggggtgcgctaaagaaaacgctcagaagcaggtttcctgggtgcctgtcacattctgtccttcctgagcaggggctggtggagccaactggccactcttcctgtctaccctccagaccttgtcactgataccagcccaacgactgcgccatggctagcaccaggactcaaatattgctgtgagacaagaagagcagaagctggacccagtggcacacaccctggtctctgatagctcatcgccctgctctgtggctgactctacagacaggctcggggaagcaccttctggatgagtgcagcccagagggagaggtccctaaagatgatctctgggctctgctcctctagggtcatggcaagcatcgcgaggggctccccttcctgccgctcatggttttactgggggcacacgcagggcaggctgggacaagcttccctaggtcgttgtttaaactactgggtcataagttgttaaagcacgatgaggggactgctgcaggacccagggcaccccgttagaaccctgtggtctacttctaggtatcatggccttccagaatgagagaaaagacttagagttcaatatggtgaagaggggtaatagttcctagaagcaagttttgaagaagagagctcaaaaacaatagatgtttaaatggaggtataggaaaaaaaggcaacatggaaaaaattaaaggaagtggcaaaaaacaatttagtttctctcaaagggagctggttccatcccacaccattagacagcagtttggggaggtttcataccttcatttgcaggcagcatagttgtgctgacggaacaacttacagtgtaacaggcagccccaccagcacctaaataccactcaaagatgttcagaggcttagaggaaaatagtggctatactctgaagactgtgataccagaaccgtggaggtgaaggggatgagctgcaccatggtgctcagcgctgggtatgtgcaagagtcacctgcagggcgctgaagaagccagaagcttctgggcagtgatgataatgagcacacaattactctttcactcccttctcaagcaccactaccatgagagggaatgggttaaacaaagaaaaacggggcgggcgcagtggctcgcgcctgtaatcccagcactttgggaagccgaggcagaccggatcacctgaggccaggagttcgagaccagcctgactaacatggcgaaaccctgtctctaccaaaaatacaaaaattagccaggcatggtggcatgcgcctgtaatcccagctactcgggaggctgaggcagagaattgcttgaacacaggagggggaggctgcagtgagctgagatcgggccactgcactccagcctgggtgacaaagcaagactccatctcaaag

SEQ ID NO: 3163 - DNA, 1224 bp, Homo sapiens
atgcgccactgcgcccagctaatttttgtatttttagtagagacggtttcgccactttggtcaggctagtcttgaattcctgacctcaagtaatccgcctgccttggcctcccgaagtgctggaattacaggcgtgagccactgcgcccagctacctgtcatttctaatatagcctgcagggggaaccaaagcctgactttttgtttttgtttctgtttttgtttttgttttctatgggaaatagtgctctcctgggaggtgggtttccaaatctctgcttggacacatgaatttgagggttgtgctctccactaacccaagaattcccatgctggggagggtagcttggccctccgcttgcttcccagttcatacagatggtcctttgctccctctatttctcaccttgttctaatgcctgtttctcaattattttgcctgaagtttcctggagaatgagggtgaggggagacctggagtgggagacctgggtgtggattactgtagcactaaggcaaaacaggattcctgcggaatagccaagtgcacatcaaaggcacttccaactccagtgcctcttcccggtccatgtcctgctccacccaaccttcaatcagggaacacaaacaacagcgaagtttgccaaaagaattcgagtatcagtgagatgttctggccagggtacaggagggatgagtgaggcagaaactatcaaagaaaactcatttccccacacccaagaaggagctggatgacccaggtacagatataattttgagatgggaaaattaagggattttaaagaaacagttccagcctcaacaagaagctagagaatgtggtgctcagtgaggggttatcctacttggaggcccagctggtctcccaggttcagccaaacacggaaatctcagatcctcggatgtcatgtggggtggggcagggaagtctcacatgtcttcagccctgcacaaggccaggagggctgactggcaatcccctttcactgcatcctgcagacaagggaattcagtgttagaaagatccaccaccactatggcccaagtgctctctcccctcctttgggctggtccatcacagttcatctgggagggaagggtcctcccgggagctcagagtcctgcactacattaaccaaagactcctgggttttcttttttaagatggagtcttgccctgtcacccaggtgggagtgcagtgg

SEQ ID NO: 3164 - DNA, 2831 bp, Homo sapiens
catgcgtgtggtgtgtgtatgtgaacatgcgtgctccctgcgctgccggctctggctctcccccatccttcctcacagagcagcgcaggtttggccacagatgtcaggagcccgcggcttccctgctgagctaagagccctcttcaggccttgtggtgtcactatagctgacagtgtcaagtctcacgccctttacgaagcagagaggggttttgatgccgcattgtttagcagtatgcagacctctccctaggggctgtagatttcctgccttctgaacaatctcgaggggagcgtggatttccgtcccggcggcaccctcgggttttccctcccctgccccctccgccgcgctctcccccttcgcacattcggaaaccctcttgggagctgaatcatgttctcgccttttttggtcctagttgagctctcttccactttcatcaccagaggcttgagatctgtgaaagaatcagttcctcgcaggctgcggtctgcgccgcgcctcctttgtatgtcacgctcagagaggagcagtgcccttggagtgccctgctcttgctgagagccgcacgatagatgtctttgaatgactgactttaattaaagtgtggcgggctggagataaaatgattctgaatatcttatttggggggaaaaaaaagccagcttctttcttaagggagaaaaaaaggactccagcgccaggagtctcttcggtatccctgagagtcgggggaactctttaaatgcggcccttgatggtgttgtggagggagagtgaattctgggaatctctcagcagctttttgccaaacagatgggccaggagccgcggaaccaggctgaggaatgttgcctcacgatctcacatatccattcctggcacccaccagcccagggaatgcctctaccagttgtcagcgagaggcttacacagcatcttaaataaaagggattattgaaccaagaggccagggactgatggaaatgcccaccttgctggctcattgaaaaagtttggcaaggttgtcaggagacatgaattagatgggcttgggtcttgtgccctttgctaaaccaagtgctgtattgggaaagagacggggagagaagtgttggagatgctctttagtcaggcctgagtcacttgcccaaccctggagttggagttggggatggagccaggatctccaaaccacatgcccctagagtttcagggaaaatatggattgtgaattgaagatggggggtgatgtaaggcagacaaggacagaaaatccctcttccagctgtgatttggctgtgagtttggcgctcgagacaccatacgctcctgaggtttgttaaggggtttcaggatattgtggacaaaagggaatagcaaacgatgttcagtccataagtaccatttggaggaggaaataattgaaattgctgctgatcaaaaagctttttgtctccagtttggatgttggagacaggtttctgtgtaagagagtgagggtgtacaacatgactgagaaagaaaacaatgagttaaggcacataagtgcgcatgggtgtcacctggaggccttcttataacacagatggtcaggcccaccccaagtttctcatgcagtagaggtggagctcaagaatttgcatttctattttactttatttatttgctttatttatgtttgagacagggccttgctctgttgcatgggctgtagtacagtggtgcaatcatagctcactgcagcctccaactcctgggctcaagtgatcctcccaactcagcctccctcccaagtagtgaggactacaatcacacgccaccatgcctggctgtataatttgcacttctaaggtgttcccaggtgatgctgatgttgctggcccagggaccacacattcagtactgctgttaaggcaaaagacttaaacactccatatatgaaagaaagaaaaagagagagagagagagagagagagagaggaaggaaggaaggcaggcaagcaggcaatgcttcaataaatccattaaaacacattcaaacttcagaaataaacgtgttcaaataagaccagcagtccttggtggtggcttatcatttcacccatttgacagttttaaaagattgaccgaactcagtattgattaaggtttaggggaaaggctgtctcatatactgtgtttacaaatgtgaatgagtacagcctttccagagggcagtttggctatgtgtatcaaaatataaaatgtgtttgttttgacactacaatctcacttctagaattttactctaagaaaagataagtgtgtgaaaagaaatttaagtgtgtgaaaagatgcatatgcatgggattgctcatcacggtttcatttataatgaggaacagcaaacccgttaaatatccctccatggggagcaagtcaggcaaattctgtacagacacacaaaggcatgttatgcagtgaagagaaggaggcacatgtgggttctgcagagaggcagatcccaatgaggggtcaggacgggtcttggctgcacatcctggtttcctcttcatccatggggagcagcaccttatgaagaaaacaagcggcataatgaataaatactcacctctagcaaaagataatatgtataattaaatcaataaatattaatttgttaaatgttaataaatgtaaataaatattcatatatattaacgtgttgatttaaatattactattcattaatataaacaataaattgatacttgttaacattaaatatcaataaattttatgtattaatataaataaacactaataaaacaaatatttaaacatg

SEQ ID NO: 3165 - DNA, 577 bp, Homo sapiens
cgggccgcctggccctgggaaagcgtcccacggtgggggcgcgccggtctcccggagcgggaccgggtcggaggatggacgagaatcacgagcgatgtggccctggcgttgagtttgtggctgtggtcgcttcggggccccggtggcgggaccaggggctcgtgagaaatactaggctttagaatttcaccatatgaattttgggagagaggagcacagttcagcccataactaacacacgacggaatgaagttgataatagtgagaccttgttggtacaagactatgtaacataacctgcgcttctcaacaaagaattgcttttctgacttctgcactcaatagcaagacaaatctctcctctgccttctccttatcagactactcaacatgaaggcaataagaatgaagacctctatgtataataattgacttccacttaataaataaggttacttggtacactggtcgacaaaaccttgaaatgttgatgtttaagggctgttgattgctggcagcaaagaagtccaactgtgctggtacccgagatagcgtctccacattttcttccaggatc

SEQ ID NO: 3166 - DNA, 806 bp, Homo sapiens
tttttttttttttaattttgaagctacctgaggtttagaattccttcagccctagctgcttttattctgctttttatttaaacaaaaagagggggaggatctgaaggaaactagttttctgtacaaaggctttgaggtccatggactatacttgtcccatttatcatcccaggtggtgctttgaccctgccataccctggctattaagataaaaagatttgtggacattaaaattatgaatatgtcagtaataatccagcacacattgaaatattgacacagattaccataatttgtgcaacatcttataaacaatgtcatttccatagtagtctaaggcttcaccagcctggcccactgtatctagactttaggttcattttaataattatgctttccttctctgtatcatttgggaagttgataaatatcacttccttagataccttcattcagtgatatatctggcttttacaattaaattggaaaaggtaagtttctctttggtgggttgagagttggaccatcaattctaatctacaaaaggaaattcatgatttcactctgacgcctaggatctagccaaggctggtctgcagtatcagatgtccaaactcatctactattagccatattttgtgagtcgtttgtctaaactttgtcaaaaatgcctttgccatgattttgttgctatctggatttcaaacatggacagttaggaagatgtgcattgaagtaggaaaattttgttcagatttgctgttatttattttttaaattaaaaatggaaatgtattttaaagttt

SEQ ID NO: 3167 - DNA, 9369 bp, Homo sapiens
ggcaggtcattggttgtcattgaggaagacaaggtgagtgggcccccagggggtggtggggaagatacagggcctgtctgtgaggaaacagaaaaattgcaaggacaaagccatcagcaccgttgccattcaggtctcccaccatgattcctctccttctagtttctttctatactaggccccaaatcctacccttatcttctacacacatttggccccattttctctctctgcatccaaacatctaacacacgcaaacacacacacaccaccaccacagacacacacacgtcacgcacacggacactggacaatcagagtcatagccatcacaatgcaacagcaggactgatctatgcagttgtgtaggttactgactgcacaagatctccagctgagagagggaagtggatccaattccagctgcactctgctgtccaaggtgtgcttcctggcacagtgtcacccagaggaagggacattatttttctaacacaaagatgccacctgtacagcctcaagggtctcttctatcctggcccaaggtctccatctcccttctccctcatgctggggtccttggcctctccgacacctgctctgcccacccagtcctgaagcccagggtcttggctcaactatgtaaagggggagatgcttgcatactgagagttcactgagctgggctaccagctctgccacttgtccccgagcctggcgcagctcctgggactcccgggccagcttgtccttcattttgttcagcgtccgcatcatctcttccttctccaatgtctttgtctcgcattcccgctccttcctctccagacggctcacaagctccatgtgttctggaatgggggtgggacgggagaggaaacagaaggagagaatgtgagtaatgtgactccctgcctggaagggcatggagttatgggctgggcaggggaagggcatgtggagtggacagcaggcttaagcagagcccctcacctttccggaacttctctgcctggtctcgccactgtttcacttcattctcgttgatgagcctggcagggcatagagggaaggggcaatgtgattgttgaccattgattcacagcttcccaggagacatcatctttctaccctccaggtggggaccctggtctccaatctgtccagccacatcaagggggctaggatttagacttcccaggtgtctctccaggtcccctgccccgttcacattatgtgtctgtggagaccgtgagagaaaagacctttagataccctataacccggcccctttgtgatacagccggagccactgaggctcagagaatggggatagggcaagagctaattaatggtagaactaggactgaacctcaggctcccaagaattatatcatgacttgcacctccttgtaaaataggttttacctttaaaagagatcaaaatattggccctaccatggtccaggtttccaaagaccaatgcgtaagagcaagagacatcacccacaccagcaatacagactgaatgtgttcagagtgacacagaggacagccttgttcatgccaagctcttgaaactgtgttcaaatttagcttttaccttgacaccaaggcctaacagaggtgaaatcccaaagcgagatcccaagaatcctttcctttataaatctgagaatgtggaagagttagacccatgacttttggcctcttcagccacatcaaggacatagagaacagagtatggagagggagagtatttcatgaagacatttctttgaagagggccactgctgttatccccaagatgctacctccttcaccaccatccaaggaaggggtttctttgggccttccccaagagttttgactcatgttccctgaagttgggagggaggtagggtagactggggccctacttggaaccaagcaaagccctgggagcaaaagaagaacactgctgtgtggggccctgccagcactcctagagttcgttggcacaagagatggcatgagggttgcccatgggtcagatataagcctcatggaggaactggggtgcagttttcacagtcctgtgcaaggggagctgtttccacctgagcgaaaagtgggaacatccacaccataagtctacaggcagtggactgccagggaaccagggacagatggaagagctggaagcagccagccagctggaacaaaaatcttgcatggccagtgagctgggttttgtagtgagaggcacccagcaaggaacttctgaagattccaggaacacactgacgtctttacccatatgccaaaaaggcaagagagcagggagcctgtttactaaattatcttatcaagtaagaccttttccctctttccttcctgtccccaggctgcctcttcagagggtcggactggtttgtagaaaggaggggtgggagatagaaggggttacagggtaaatagaacagagaaaagaaggcaaatatcacacacagacatatgtgcacacatatgcacatacacacacgcacacacacacacacacacacacccttcccattccagtttcctggccccagctggtggaggagaaagatttaaggctaaatcatgtctagaatgtcatgtcatgattttagtcctcctagttgtagatttcagactatgttgcacttgaaagtgatcttaggactcctgttacccaagaagggttaaaaacttcattggacctcaggagtttttatcctctggcagtggaaaagattgcctactaaatagtgtaatgaattggtaggaaataaaactaaagtcaccttttgatcactttcccagttgcacttgtccaacataccaattaggattttaactacatcaatatctgactatgcaaatgaaaacagtagcaagaatagctggaaaataattgtgtacttggctttggaatgcaacataatgaatcattgacagccaatttatctccttaagggcaagtggctcaaactcatactgaaagttaagtaaaagcttaaaattaaaaattagtatgttaatgtaaggccttattattaattgatgtagatttaaatgtttctctgtgtttctctatccaagatcaataaaatatggtaaaccagaaggccttaggctctgataaccttatccagcaacctcatgatcaaatggtcaggctctatgtcagtggtcagcaaactttctataaagggccagagtaaatattttaggttttacataccatgcatagtctctgtcacttatacttgtgtgtgtgtgttgtttgaaatgtaaaaattattagttcatgggccatacacaataagctggaggactggagtcagcccatgcacccatagtttgctgacccttgttctacgttaatgtgtttaaattccccatctatccaagccatgcagtggatcgtggagagttgagaacatgcccaatacacctgtgttggctgtccaagagagtaatcactagccacgtgtcatgtggctattgaaatttaaatgaaacaacctttaagattcagttccttggtcatactagccgtgtgtcaagtactccatagccacatttggctgccatgttgaacagtagagaaatgcacttttttcattagcttagagagttctgttggaccatgctgcccaagactcatttcgggatgactgggttgcgaaagggagctgaggtttcgctggtgagaccagagtgggagagtgatgaggaaggtggaggaagacagggcaaaggctggccactgctcacatgttgacgatgttcttgacattgaagttctccaagggagccaggtcagggtccacaccccgctcatcctggaggacaatctgctggaggatgcggtccaggagctgccactgctggaagtagccaccgttccgtttgtctgagggatgacaggtatcatatctttcctgagtcctgaagtcccccttgggccccaccctagagttgctgcctggggtctggctggtgaggcatgcccttctccacctatggtaagctcccagtctagaagaagaggcaatgccattgctgataatggcaactcactgattcagtcatctcttgattatcggcaactagacttctacggatgtgtcaaccacctccccaacatatttctctactccctgaaatactttctggctgcctttcttccttgtttggaccctgggcatactatgcccaggaagtgcagattgctttttacattatctataaaaaccacctgctccaaaatattacatgctgaataatgaagtctccagggaagttttttttaaaaaagattttaggattatccacattattactctacagagaaagatgaagggaaactgattgcaggtgtgcactgagagtcaaaatgggttagagaagtgcttaatggaactcgagaaaatttcttgtggaagtgaccttgaactatgaaggtaaaggcatagtgtgttgtgtgtgatctcatagagtctcactctcatcccctctaatgatagtcatctggctggacatggacttcctttttatgtaataaccacaaactctctttccttggtccttgatccctagcactttattgaccatcataaaaagccaacaagttcaatcctgacatcaaagcaaaccacaatgcctacaaggtagaatatcgagtctgcaaagccccattttggggcagagtagaagaacccattcacattgcccatggaacaggaaacacaggaatccctgggagcacaagaagtcaggtttcccagagatttctatgcccttcatgaagacctgctgcaatgagctttggagaactgatagcttcttaattcaggtcactgcatctatcctgtccacaagtctactgacacatgcattgcaaagttgtatcatttaccatctacttttcacccagcaaaatcgtgtaaagccaggtcactagctcaaagaggcagaacatgttttatctcaacccttgaccccgcagaaaccaaaattctttctatatgtaaatatctcgctgagcctcaggttcactcactattcaaatggacataataatgtgtattccttaggtcattctaaggttcagagatgatgtgctaaaggacctcacatcacgcctggcccagagttggcacacaataagtcacagttgtcatcactgtcactatgattgctgacaccgccaacatcaaccattatggtgggccacactggttttcaaaatattctcttttgtgaagagcttaagtaccaaggggtacagttaaagctcatttcaaattgcattctggagtggctattagcaattatgtacaatttattcaatcactgtgcacacctggatcttaagaacttagccatctgctcccatagatgctgacatttggtatttgtaggcagaagcaggggcaagagtgcaagagtggaagccaacaaggactagatgaaggagttgataaaaccttaaggaaaaaaacaaccatgttcattccacatctgtgctactcccccaagcacaaaactttttggaactccccagcatgactgatctctcccccgtcatgagctgaaagctgagctatttaattttgcaatgatcaagctaccgtttttggactaggatgttggagttgctcagggccaagtccccagctccttccccagatgacagtgaagacctgaccccaaggagggaaggaaaagcaggggcctccgtcatggggcctgccctcccaaaagcaagtgcacagggagacatggtcagactccccaaaccagggaggtcccaaagtcttgtctaaacctgccccaagtcaaggttcaggccagtcgagggaagcagcaagtgcagggtacttacagggcatctgcaggcagtggtgcagcacagagagcaggcaggggtaggcctccgtgtacttcagcttcttgtggatcaactcaaacatctgggaagcactcttggtgtcgatgtggacctgggagagaagagggcacagtgatcagtgggtaggcagcagaggaagtcagcaggagagagaagaccctgcttccatccactatgccctgtctcataggaaaggttttcttcccctgcctctggcccaggcttaaaaagagaaagacaaaaggaacagggagatagtcaattttataaactagagtttctcagtctcagcactattggcatcttgggtcagataattactcattgtgggggctgccctgtgctttgtaggttgtgtatcagcaccccagcctctccttagcagatgccagtggcaccccctcacacaagtcaaaatgtccccagacattgcaaatgtccccagggggagaggagagcaaaatcatccctgcttgagagctactgatccaaactagggaagggagcaggggcatagaggattcaaagtagcaggtggaatgtggcgcaggtccaccacctgggttcaaaccccagatctacgctttagttgtgtgatgacaggcaagctgcttatcccctctaacctctgtttctgtatctataaatccagggcttttgtgaaaatataatggatgcactcagtgactgtaaagcaccacccaaaagtagctttctatttggatggggattttataacacaataaagcagagttgtgtgctttcagggttgccgaggttaaaatgaaaatacaatttagtttgctaagcatgatctggttagggatggggagaggggactcaggaagttgctggaaggcaggggaaagtcagcccaggaaaggtatttgagactaatcacatgcaataacttgctccctttcctttgggggtttcagtctcctcctaggccgatgccttcccgggggaggcttccacagcctgcatactaccaaggctctggaagtgagatgtgatggttcgttttaggtgtcaacttgactggatcaagggatactcagatagctggtaaagaattctttctgggtatgtctgtgagggtgtttcccaaagagactggcatttgaatcagaggactgggtaaggaagatcccacaccagctccaccacagcacagggcctggagaaatggctgtggggccacctagaaccctactaccatactacgatcactccaccctgtgggctcctcaccatccaatcagcttagggtctggagagaacaaaaaggccaaggaaaggtgaattttctgtctacctcttttggagccaggacatccttcttttcctgcccttggacatcagaacagcaggctctccagcttttggattccagaacttgctccagtggccccttatgttctcaggcccttggccttggactgagccatgctactggcttccctgtttctccatgcaataactccgacctgtcatgggacttctcagtctccatagttgcgtgagccaattcgcctaataaatgccctctcatctgtctatctctatatatgtatcctattggttgtgtttctatgaagaactatgactgatcacaggacctggccatgggggtgcccaccagggaaccagcccacaccagccctgccacaacacggggtctagaaaagtggctgtggggccaccaagaaccctactaccccattgcaatcgctccaccctgctggctcctcaccatgtcaaacctcctggctagctccaggtcatcctcattccgcaccatctcgaagaagtctaaatgtctagacagaatggggagacagagagagtagacattacagccaggacacacccttggttgagggttacagccccttcgagccccccactggctaaatctgaaagcttcattcaagcaaaatgaaggcaaaatgggaaagaagccgctgtttgtaggacacccattgtctgccctttataagatcccatgaccttccttcagggaggccaatccagggtcccttcaccttagaatgggcttctatacttcggcactactgacattttgggctcgcttatctttggttgtgggaggctgatctgtgaggatgtttagcagcatccccagcctccacccactagatgccagcagcaccccctagtgtgacaaccaagaatgtaatgtctgcaggcatcgcccaatgtctctcagttgaggacatcagccctggtctattttccccagtactttcatagggtctccaagtcaaccctcaaaactaatctctccctcattttctatcctcatgcacacatccacttgttccacctcaaaaggatccatcctctgtcccttaaaacctagtgtaataaaatagcctaaactaatgggacagaaccagaggggcctcactggtatcacatgggaacataattgtgcccttggatcaacaagggcgttatagcaagcattttgggtgggacatttctttgttgagcaggaaggtactgcgggacatttagcattcctggcccccaacaaccaataccagtattgcccaccatcaaccagtttgaaaaccaaagagtaccctcatatatttccacatgccccccagggggaagtactgcaatggttgagggctactgggttcacctgtctataacatcagagatgagacaagcaggtcagcaaagaggacaggcaagggcaccccttccccccacagagctgattctgaatctgcgctgggaatggcagctggtctccagagggaagggcagccttcacaaaggtcccaactatccccatctgaggcactgtccccacaggtttgcaatggagacgggtgcttggaacttacttgtccaggatggcattttcatgttgccggagcttgtcaatcacaggctgtatacccagcatcaggaattcataccgtagatgtaggcggaactccagattatcctgggggtcaccaagggagggccagactcattggcagatctcagtttccacaacatccccagtggagccctcatcaccaccctagccacagacccaacacatctcccacagctaactcacctggagctgcttccaatcccagagttccaagaaagaatggagaccttatttcttagtttaaagcaaacccactgcccagcttcttttaggtctcctgccccacttccttcaagccccttgccagttctagccttcagcaccaaagagcagtgttgtagagtgacatggagcacaagctttggaatcagacagatcttggatctggttttgtgaccttgggaaaacttttagtttccccatttgtgaaatgatcatagcataactaatctacagggatgacacttgttataattacctgatgaggtgtggttaccagctaatcagagcacatgcc

SEQ ID NO: 3168 - DNA, 39498 bp, Homo sapiens
ctggccgtgttaggcttcgctggcgtaaagtccccgggagctttgcccctcacggagaacgttagttgaccctgatggggacccgtagggtaaaggttttgtttttgtttttttttacggaaaaggttgtggttaggccccttggaaagttgcgacaaaactcgagttagacaaggaaggtcggaactaagtggccacagcaacaatgcaccagcaagcagggagcgtgataggaagagctaaagaggaatcgggaaaccctgggtaaaagtcgtccaagtggaacttcctttggtcgggggtctgatactcgaaggaaacggtctttcacttctgggttagggcgtccgcccagagggcgactgcaatgaaggaaattgtgccctgcgacttcccgtaacagagctgtgtgtccacgctcccttttccgagcaggcgcggacgcttgtgccggaagtaaacttgttaacggttctttgccttttggggaggggagacagcccagagaaggctttggagacccttgagtcggccagcgagcagggtttcttacttgagcgcctccacaaataaacgctccttcgctcctccgtcgcgtgcgtttccctgggataataagtgggaaagtggtggcttttatttttttgagacagggtctcaccgccgtcgcccaggccggatggagtgcagtggcgcgatcacggctcactgcagcctcgacttcccaggctcagggatgggtttcaccatgtttcccagccttgtctcaaactcctgacctcaagtgatccgccgtcttgggtcttcgaaagtgctgggacagcaggagtgagccaccgcatctggcccggaaagtgttttggagcgtagaaaaatgcaaattatagggctgccttcaaggatcccgaaggacccacagatttgccgcatcaggctcctatgcacgccggtaatttgatgtgttgagatgcactgcccagtgcgttgtttttactggaggagcttgtgtgcggagctccttgctagtgtatgtgttgggatgggagagaagtgcgggagaactatgagataatgccccctgatcctcagggtcttaggaggtatggtcggagaggctaagctaaagtatgaaagccgtgtgtaggcccttctgtgtagtgcagaaaaggtagaggtatgtgatttgaaagagtagggatgacatggaggatgcgactcctggttggatctataaactaatgtctttggaacgaaagcacatgcaaccttttgaaaatggatgggtgataatgaaagaccattccagagaagaaacaccatggtgcaaaggctcaagaggcatactggaagtacaatgaagagagcaatctaactgaaatgggaaaaaaagaaacaaagagtaaaaagtaagatttgatgagaaagatggaatcgatttttaaatttttttatctacacaacaaaatttattatcttaaccatttttgagtgaataattcgttagtattaagtatatttacctcgtgcggccagtctccagaattcttttcatcttgcaaaacaaaccccgaacccattaaacaatttctcattcgccattttccagctagccttggtaacctccattctagttctgtctctgtgaatttgactgtgtaccccgtgtaagtggtatcatacagtatttgtatttttgtgactggcatatttcacatagcataatctccttgtggtttatccatcttgtagcatgtgtcagaatttccttcccttttaagactaaataatattccattgtgtgtatataccacttgtgttatttccaccttttggttattgtgaataatactgcttcaaacatgagtgtacagataactcttcaagatccttttagggtaatacagagatagtaagttatcttgattgttcactgccagttacagaccaaactccttgttctccttgtgctccacttctcaaccactgcacttggctagtcttaaacaaaaaaagaaaaaccctaattttaatagcttgtggggacagacgcagtggctcacgcctataatcccaacactttgggaggccgaggtgggtggatcacttgaggtcaaaagttcgagaccagcctggccaatatggtaaaaccctgtctctactaaaaatacaaaaattagccgggtacggtggcacacacctgtaatcccagccactcaggagactgaggcaggagaaatgcttgaacccaggaagtggaggttgtggtgaacggaaattgcgccgccgcactcaagctgggcgacagcgagactccgtctcaaaaattagtattaatagaatgtgggagattttgaaaccaagtatagaaattcatactttatattgtttaaggtccgtgactaggcatagtaacatgatgaaagaactgttttgggtttgtttggtttttttccgagacagagtctcactctgttgcccaggctggcgtgcagtggtgcgatctcggctcactgcaacctctgcctccctggttgaagcgattctctttcctcagcctcctgagtagctgggactacaggcacatgccaccacgcccagctaatcgttgtatttttagtagaggcggggtttcaccatgttggccaggatggtctcgatctcttgacctcgtgatccagcctcccaaagtgctgggattacaggcaggagccaccacgcccagctagaaagatctgtttcagaaagcaactctggcagtggaagctgaatacatactccatttctataaagcatttatggaggcctctagatgtgccaggcattgtactactgctttatgtaaattattgatgggtccgcgaatccattaatataaatgtgagccagttgttgtgcaccccaatttacaggcaagaaaatcaaggttctgagttgcagatgggctgagaaaaggctcaccaaccacatgtacgcacaagagattaggaaagaaaactgccattggagccaggctccagtaagcactgagtattcattggtttggatgaggatactgaaagaaaaaaatgacatgtaagagtgacttttctcaggagaaagaataggctgacatcaagagtctttgctgtcacattagtggtatgtataagggcacaacacaacagaagtacatttttcaaggttcgtaaaagaaccctggggtttgcttttaggtttgtttattacctttaacaaatataaaatgccaggtaaatatatctttgtatgtagtagagaaattaataagacatacccttccctactcaacatttcatctttgattttatattctcaaaaatattgtgaggtcttttaaggaaatgatctccttttggcagatgaggaaattgagggccagagaggaaaaattatcttcccaatgccacatgcctaattggtctcaaagctttgactggaacctgagcctccagaattgctgctatgctttcatctcccttagagagatagataacagtagtcagagtgagtggacaattcttctattcagtcagtctgatcttcctcagggatgcatatccagactcccatgcagctagtgatagttaaacaaagaggcagagaatatagtgcattataaatagcattcatacactcaaaaatattgtgtgccgatactgtgccaaacacttagcaaagcagggaaaaatccctgtcctcatagcagagactaaaaatattaataagtaaaatatatactaagacaggtaggataagtgttggcaagaaaaagtgaagcagtgagaggggaatagggtgagccgagagtagggagggaggtttttgtttataccagaggcagaggagccccactgagaaggcaaactgtacaaagatctaaaggaggcaaaggaacaagaaatgtgccttgggtggacagggaacattctgggtggaataacaagtgcagaaatcattaaggcagaaagatgcctactacattctgagaacagaaagcagtccagagtgatagaagcagagtacaggagggtaaaagtaggaaatgaagtcagagaggtaagaggaattcaaattgggcatggacttacaggccattgtaaggactttggctttttctgagggagatgggaagccatcgttgagtagaaaaatagtgaaattctacttatatatttaaagaatcacattgacttctagtttgacactagattattgaggagcaagggggaccacttaggaagctattgtaatactccaggtgagagataagtggcatagaaaaggtgcaagcagtggagggatgaggtatctggatatattcagggtggcacacaggatttgatgacaatttatataggatatgagaaaatgaagggagtccaaggtgactacgatttttggcctgagcattttgaagaatggtgttgtcatttactgaactgggaaagatggaggagcaggttggggatgggaagagataaattccattttgggccaggcagggtggctcacacctgtaatcccagtactttgggaggccaaggcaggcagatcgcttgagctcaggagttcaaaaccagcctgggtaacatggtaaaaccccatctctacaaaaattagccaggtatggtggcagatgcccatagtctcagctgcttgggaggatcacttgagccctggaggtggaggttgcagtgagccaaaatggcaccactgcactccagcctgggtgacagaatgagaccccgtctcaaaaagacaaacaaaaattctgttttggagcttaaatttgagatgcctgttagaatgccacatgaaaatattaagaagagagttagatatgtaggagtctggaatttagaaatgtccagactggagatgtaaatttgggagagagcatgtagagagtatttgaagccatgaaataatctacatataaagtgtagacagatgtttgagaaaggtatcttaggcactgaaacaggaggaaaccaggaaaagaatcccagttgaactgggtggggaggatggctcaaggaagaacaaccatgtcaattgctgggttctaactggccactgcttatgatagtggagtagtaaggataaaagcctgattggaatggatttagaatagtgggaacggaattggagagagggagaatagataatttgggtatggagttggttgtaaggatagcgggtagaaaagtgataactgcaaggggtcaagacagtggttttaaaattacttcacaaattttttagtatttctaaaagaattctttttttaataaatataacttcagaccgctattgttcctttgtatcaactaccctgttattcaaattaacccaactgtcttataaaattttttgctaccagctttattgagatataattcatataccatactattcactcatttaaagtatacaattcaacaactttagtgcattcaaagagttgtgcagggtgggcgcggcagcacatgcctgtaattccagcacattgggaagccaagacgaggatcatttgagccaaggagttcgagctcagcctgggcaacatgcaaaaccacttctctacaaaaattagctaggcgtggtggtgtgcgcatgtagtcccagctacctgggaggctgaggtgggaggattacttgagcccaggaggcagacattgcagtgagcgccactgcactccagcctgggcaacaaagtgagaccctgtctcaaaaaaaaaaacaaaagttgtgcaaccaccattacaatttgttttaggacattttcagcaccccaaaaagaaacattactatgcacttagggtgataatgatgtgtcagtgtaggttcatcaattgtaaccactccggtgagggatgttgataatggggtgactgattttgatttgctgtgtgtgtgtgtgtgtgtgtgtgtgtgtgtgtgtgtgagagagagagagacagggtctcactctgtcacccaggctagcatgcagtagcacaattacagctcaccacagcttcaacctcccatcgcagcctcttggtggggctgagctgggaggatcgcttgagcccaggaggtcaaggctgcagtgagccatgagtgtgccactccactctagcctggatgacatagtgagaccctgtctcaaaacaaacaaacaaaaaaagtgaaaagtatcaggagagcaggaagccaaggccaaaagcgttgttttctggattctagttctggctctgcagctaatcaacatgcactctcagtgtcctgtccatagggtaaaagattgcatgagtagctctaaaggcctgtaagctttatgattttatgcctattcttgatttttctcacagttttgaggatgctatttttgttaatatctttttttttatacttttaagttttaggatacatgtgcacaatgtgcaggtttgttacatatgtatacatgtgccatgttggtgtgctgcacccattaactcgttatttaacattaggtatatctcctaatgctatccctcccccctcccccaccctatttttgttaatatctttagcgctacttgtttttatctgcattctgattatgctttactcagcaactaactggcataggcctgccccaggtgtcagttcgtatagcaaattcagcttgagcataaagaactttctggaagcaaagacaccaaaatattagcaatttattatttctaggtggtaagattattggtcattttaaaatttacatttgtattctttattttattctacaaacatatatttttttggccaggcacggtggctcacacctgtaatcccagcactttgggaggccaaggcaggtggattagccaggtgtggtgatgggcgcctgtaatcccagctacttgggaggctgaggcaggagaataacttgaacccgggaggcagaggttgcagtaagccaagatcccgccactgcactcctgcctagatgacagagtgagaccctctgtcacacacacacacacacacacacacacacactctctctctctctctctctctatatatatatatatacacacacacacacatatgtatatatattttttaaaaaattttttttatttttagtagagacaaggtctcgctatgttgcccaggctggtcttgaactcctgggatcaagggatcctctcacctcagcctcccagagtgctgagattacagatgtgagccacttggctggcacttttttttttttttttttgaaatggagtctctctttcttgttgcccgggttggagtgcaatggcgtgatcttggcaacctccacttctcagtttcaagcagttctcctgtctcagcctcccaattagctgggattacaggcgtgcaccaccacgcccaactaaggcatatttttataatattttaaaagttattcttaaggcatttgatagcatatttttgattgcatgccccagcaaagaggaatcactaaactttaggtcagtagatttctttctcttcctataattcagtttggcagcatcttccattctaagttaacctaaatactttagtaataaagacttacatgtatctaattagatagtcagctttacttaatcttcttaatcatctagattagatgttaagtgaaaaaatattttgtgcctacagaaattaagattcggaaagaacagtagcacatacatgctatcaacatctgtgtcataactcatatggaatctggatttgcgctacttggggaacaggtagtgtctgctagagaagtggtgtgacagaaacatgggcaaaggcagggtgtgtcttttgtaaatgatgaaaacagaagattaaaaacaagtttgctaaatcatgttcataaccactccctggagagcaattactctgattactcgacttacctggtaagtaccacccactgtaggagaaaatacagatgtttggttcactgttatgggtttccccatgtgcaaaggtgttatgctgctgctatgctcgtctttaaacactgtagtagcagttactgaagaatggtagagtaaggggtgccctcacagctgtcaactcactgtgtgatccagacgagtaacgtagcctggtcgcaagctccaaggttacttatctttagtggaggggatagttctagtttccagtgttatcacgactagtaaaattgatattataaaatccacttctcagtaaggaaggcagtttgaaagcgttcttgttgtgagaagcatgacaaatacaggcagttctatggacagtgtttatgtaaaacaaattattgaatagccatttgaacattaactgttgcccagtgtgttataatgtgtacctgctcaggcattttgaagactcttcttacacctagtgaggaccaagggcaaatagcaaaaagtaacctgacatagagttttagtttggagattttcttttgaattgccctcagggagatttctcaagcaacactggtccatgccaatttgcaaatggactcttgtgccagtggctcaatcaacccatccaaatgcagagaaccatttggaggcattcaaaaccaaatgaggggcaattttctttcatttatatgctgtctgttaacctctctttcaccaaaaattaacctgattctgggtatgcatacctgaaaaaacacaatttttacactcaaggaagtttcattttttcataggaaaaaatcaactattactaaactatacagttactacagtgatggagatgtgtgcaggctgctgtaggaacataaaagggagcgcctaacaggtgtgggtgagtcaaagagagctggggaggaatgaaggcaacattcttgagctaaaccaaataaacaaaacattgcaactcacaattatgacctatttcaaactcttagaactacagtaatgatttagactagttctcatttggacagggtttatttactcttacggtttcaagcaccccttaatctttccattttaacaagggtatatggagcttcacagataatatctccaaaaatgggcatattttgacttgtagaccatcacctgcacacacacttcaaggtcactttcatacagcaaagtgaggaaagagtttattagctagatgagaatgtgtaaatgaggccgggtgtggtggctcacgcctgtaatcccagcacttcgggaggctgagatgggtggatctcctttggtcaggagttagagaccagccgggccaacatggtgaaaccctgtctctactaaaaatacaaaaattagctggcatggtggcgggcgcctgtagtcccagctactcaggaggctgaggcaggacaatcccttgaacccaggaggtggaggttgcagtgagccaagatcacgccactgcacttcagactggtgacagagcaagactgtctcaaaaaaacaatgtgtaaatgaaactgccctactatttctgctttagtaaaaacaacagattctggtcagtatttgttcacttatattgggcataagataattcctgctgtttgttgcagatcttggcatactgcctgattgtcctgcatgggaatcttggactgctactacagcaatttcatgactgtgtttcttctatttttgtttttaccacgttagttatatcatgcagtacttgaaacgaaggtggagtctgtcactctgtcagcctgcagtttaaaaagttagatgatgcattaaaaaatcaacaaattttgccaggaaggcagtgtgtgcctgtggtcctaacttctcggaagactgagtcaggaggattgcttgagcctagcagtttgaatccagtctgggcaacatagtgagaccctttgtcttaaaaaaaatcaacacattttaaaagtatttcaagatttgtatttgccatatttccaagctagtattatttatttagagtttcctattgcgggtgaaattctcttgtcttttgctgtttgcagtaacttgagtcttttttcatctcttcagataatctacttatattcatgccaagttttctagttttcctattgcttcctctaattttcaaatagagtatatacaatattgagcatagtttctcattagtctgttcacagtcactaaactaatcctcaaatgtatttgattctatcactttccaaaatttgcctttgctggttcataatatagttacctaacttccccagctctgccctcgctcatgaactgtatttctctacattacccccacactgcattggcattctgagtcatcggggattaggtatccttcctgctattaactacataatatttaaacttccccacttgcccatctcctttatttcgtattcaaacaccacatgaattaaactaacgttggttgcttttaacctgtaattcctgactgcaacaggtagttagttgccacctcttgaaatgaacagatttgactagaagctgacacttcttactcccgctgaacttagtattttacatttatataaattcaaaaagcaaaatcatacctttcttatcaatgggccctctttgtccattgataacataatattgcaatataaacaaaaagtatttgtaccatacctcagaaaacaaattagattactattagtgcaaaacaggggaaaagtagaaaaatgttattgtaaagagactatcacccacttcaagggatttatcaggtaactgcctgtgtaagttacaaagacaatgctaatctataactagtgtatacctagatgagccgccaggacatttgtctaatggcagatggggtaattggactccacatcttcaacttaggcacatggaaaacagcatccctaaaagttgcctggggatgaccagtactgagccaaccagcttagtggaactgttacgagagagaaacttcagagccaaggaatttcttggcagagcctcacattctgccttagaatcatgaaaagttagatctagaaggtaacagagatcatttaatccactgcccttattttacggtgaaaaactgaaggccagagaagttaaggagtttgcctaaggtctcacactcgtagttagtgacagattcagagctagaactagatcatcctgactgcatttcagtagtcttagagctggccgacaaatctgacaactcacattgaacccatgttccaaaaggtattttatattgagcttatgaacaccgctttttaaatttatgttatttatttatttatttatttattatattttaagatctgggatacatgtgcagaacatgcaggtttgttacataggtatacatgtgccatggtggcttgctgcacccatcaatctgccatcctgttttaagccccacattcattaggtatttgtcctaatgctctccctcctgttgccccccatcccttgacaggcccccgtgtgtgatgttcccctctctgcgtccatgtgttctcattgttcacctcccacttttgagtgagaacatgcggtgtttggttttctgtatgaacacccctttcacagaaaattaggcaaacaggttggaatatttagaatagaaaacatttattataaagtcacaagaaatacctgtgtagacttgctgactggaagtatttggcttccgtaagacaaagaagagtcttagtcatctggttaaagttaaaaacgattgtgtcaccaggctgaaagcagacatgctgtggaagcagtaggctgaaattagaactgaatacaagagtttagagaaaattgaatttggagctatctcacaacactgggagttattctgtttttgtttgcttttaataggcacacaaaaaagaatagtgactacaatgaactccttgtgtagccccaccagaccccattttcttccctccccactgaatttggtgcttatatttccatacctattcatgtggttttcctataggtaaatgtatccctaagtgatgtttagcattattttcatattttaagctacataaatgctatcatattgtatatatgtgtctacaacttgcatttttttttttgcttaatactacatttttgagatttatcctattgataaataggatttctctaactaatttattttattttttggagatgaggtcccgctatgttacccaggctggaatgcagtggcagttcacaggcacaatcatagcacaatgtggccttgaactcctggacacaagtgacctcttgcctcaggctcctgagtagctggggactacaggccccagccactgcaccaggccagctaattcattttaactgctttatggtgttccattgtatgaatgtttcaacatttagctaatctcctattgattgacatctagtgagtttccagttttttgatttgctttgtttcatttgctgttttattttaatgttgctactgtaaacatgtttataaaactggtgcatgtgtgaaagagtttgtctagtaacatttacaaggtctcagtgtgtgtgtgcaaatcttgaatttagcaagaagatctcaaaatagcaggttatgagactaacacaaggactgtgtatttttagagttttaattttttgtgaatctgaagagtgtaaaatactgttgccttctggttttaatttctctgattccttgtggggctgagtacctttccatgtgttcacagacaatttggatctcctcttctccctagctcacttttcagatgagctgctgaactttttattgttcattctgaaaaatgttctatagtcattatgtaaatccttattatatgcattgccaatatcttctcctaatctggagcttgacttttcacttttataatgatatattttcatgaacatatttatcaatcttttattttttatttatacttattatttctttaaaacatcattttttcactctaaggtcataagatattccccaatatttttctttagtttttttaaagttttatttttttacaatcttcaagtcttttatgtgccaggaattaacttgtgtgtagtgtgaggtcaggagctagttttatttttttctacatcgacaagcaattgtttagaaaccattaattgaatattacatttcttccccacagttgggtaatggcactttcatcatatatcctggactctctatcagtcaggttattattcctgtgccttattataccatattaactactatatctttatggtaagtctcaatatctggaaagcccctatttgtcaagtggatgcaatgggagctagatggatttgcactatccttcttgaataccatccaagaggtatgaatactgtggggaaggaaacccagaaggatgttatcttagcccttttgtgttgctataaaggaatacttgaggctgtgtaatttataaagaaaagaggattatttggctcacagttctgcaggccttataagaagcatgatccagcctgaccaacatggtgaaaccctgtctctactaaaaatacaaaaattagccgggcatggtggtgcgcctgtagtcccagctactcaggaggctgtggcaagagaactgcttgaacctgggaggtggaatttgctgaaccaaaatcatgccactgcactccagcctgggtgacagaatctcagggaaaaaaaaaaaaaaaagcatgatgccagcatctgcttctggcaagggcttctggctgtttccaccagtggcagaagggtaaggggaactggcagattcagagatcatatggtgagaggggtggcaagaagtgggaggaggttccaggctgtttttagtgaccagctttcctgggaactaatagagtgagaactcagtaccacaaggacagcaccaagccattcatgaggcacctgccccatgactgagcaaaacaccttccattaggccccacctctaacatgggggaccacattttaacatgaggtttagggggacatgaaaactatatcggagactatggggtcagtcattgttgcagtagctgagtggggaaatgggaatcctggaactggagatcagtgtcccacatcaaggaactgtgctctgtggagacctgtgggccctctaagaactcacatgtgtgtctcctgagagacatccaggccttggatacctgaccacaaagggcctcttgtggtccttcagtgttattaagtagaacaacagcaaccagcagaggactccagttgcttccagtgaagtaaaaagtcactttctctgaaagtggagttaagaacacaattctccttacaatggctggacgtgctggctcatgcttgtaatcctagcactttgggaaactgagatgggcagataacttgcggccaggagttcgagaccagcctggccaacatggtgaaaccttgtctctactaaaatacaaaaattagcagggtgtggtggcacatgcctgtggtcccagctacttgggggactgaggcatgagaatcccttgaacctggcaggtggaggttgcagtgagctgagatcacaccacacacttcagcctgggcaacagagcgagactccatgacagaaagagagagagagagagaaagaaagaaagaaaattcttcttacaataacagcaaaaagaataaaacaggaatagatttagcaaaagaagtacaagacttgtacactgaaaactgttgaaagaagttaaagaagaccaaacaaaatcccagccagcttctttgtacaaattgacaaactaatcctacaattaatatggaaatgcaagagaccaagaaaagccaaactattttggaaaaaaaaaataacaaagttcctggaggactcacactttctaatttcaaagctacaataatcaaaacttactacaaacccaaaataatcaaaacggcatggtattggcctacatatagacatattgaccaatggaatagaattaagagtttataaataaacccatacatctgtgttgaattgattttcaaccagggtgccaattcggtgagaaacaaacatcctttcaacaaatggctctaggacaactggatagctacatgcaaaagaatgaagttagaccccttgcctcacaccatatgtagaaatctacatgaaactaaaactgctttaaaaaatagtctatttatttagaaacagggtcttgctctgtcacccaggctggagtactctgacacaacaatagctcactgcagcttcaaactcctgggctcaagtgatgctcctgcctcagcctcctgatagctaggattacagacatatgccaccatgcccagctattatttaattttttgtacagaccaagactgggtcttgccatgttgcccaggctggtctcaaactgctgggctcaagtgatcctcccacctcggcctcacagcacactgctgcaaattccatgagatgggtgaaaaactatgagttcccaacatgtgagaagggggaaacctgcctctgaacacacatctccactggggaacctcaaaacccagattatggaagaaggatttaaccttgcctagagctgaaatggatttagtataaaatataaaagtagaaatagtagcaggaagagccttgtaggcgctcccattctccagcttgggccagggaagccatccctgactgtatctcaccgaggccattgaggaagacagttggcagaatttgggcagggtcgcagggtgaaataagcttccaactgaactgtgtaataattttgactgggcgcaaactctgtcgagcagaaatcgggggtgaaagtgaactgctgcagaaaggagcataggagccacagctgacagtgtgggcagacagggaggggcaaggcctgaaagccatgcttgctttcttagtggggaaacttataccctggggctaggtctgagtcctgcacaccagctgcctggagataaactgtgctgttagcggggcacagtgggagtgaaactggccttgccaactgtgtggtagctgggtgagccctgtggctacttactttcccccacttccctggtgacagaggcgccataatccacactggaacataaccccatttgcctgagaatcagccccctatcccccacagtggctgtggcaaaaagagtctgagctcagacctgcctaatcctgccccaacctgatggtatttccctacccatcccagtgcccagtcacaaaagacaaactcttgggagctttatggccctacttatcacatgagaaacctgaacacttatcctgaccaacttagggcaagcttatatcccccttctactatcacagctggtgctctcctgaacataccacctcctggctggaggccaaccaactcaagatatgacagcaactcatgacaaaataacactgctccaaggaaggaaaaaacagctaactccactatctgcaacatcctggctaaacagaggtcctgtccatgtggcaacatcactgctatcataaccagcatttgagaaagccagcacactaaacatctacaaccaaggcttctcatagagtctatgtcactaccctgccacctcccccagaggaggtgctggtatccatagctgggagacctgaagatggattacatcacaacactctttgcagacactccccagcatgatcctggagcttggaagccccactggatgcctagacccagaaaagcaataacaatcaccacagtctggctctcagaaagccccatccctaaggaaagggggagtgcaccacatcacgggatcaccctgtgagacaaaagaatctgaacagcagcccttgagttccagatttttccactaaaatagtctacccaataagaagaaatcaaaaacataattcaggtaatatgacaaaacaaggttctataacacccacaaaagaccacactagcttcctagcaatggatccaaacccagaaggaatctctgaattgccacataaagaagtcagaaggttgattattaagctactgaaggagatactagagaaaggtgaaaaccaacttaaagaaatgtaaaaatcaagccaggtgcggtggctcacgcttgtaatccgagcacttcgggaagccaaggcaggtcacttgaggccaggagtttgagaccagcctggccaacatggcaaaaccctgtctgtactaaaacaaaaacaaaaattagcctggcttggtggtacatccctttggtcccagctactcaggatgctgaggtggaaggatcacttgaacataggaggtagaggttgcagtgagccaagatcatgcaactgcccaccaacctgggtgacaagcaagaccctctctcaaaacaaaacaaaaagttaaaaaaaaatacaggacatggatgaaaaattccccagaggtatagatatcataaagaaaaaacaattgggccgggcgtggtggctcatgcctgtaatcccagcattttgggaggccaaggcgggcagatcacctgaggtcaggagttcgtgaccagcctgaccaaaatggagaaatgctgtctctactaaaaatacaaaattagctgggcgtggtggtgcatgcctgtaatcccagctacttgggaggctgaggcaggagaatcgcttgaacccaggaggcagaggttgtggtgagccaagatcatgccattgcactccagcctgggcaacaaaagtgaaactcttgtctcaaaaaaaagaaaaaaagaaacaatcacaacttctggaaatgaaagacacacttagagacatacaaaatgcactggaaagtgtcaacaatagactagaacaagtagaagaaaaaacttcagagcttgacaaggcttttgaattaacccaatcagacaaagacaaagaaaaaggaattttacaaaatgaagaaagccaccaagaaattggggattatgttaaatagacaaaactaaaaataattggtattcctgaggaagaagagaaatctaaaagtttggaaaacttatttgagggaataatcaaggaaaacttctctggccttgctagagatctaaacatccaaatagaagaagctcaaagaacacctgggaaaatcattgcaaaaagatcacctaggcacacagtcatcaggttatctaaagccaaaacaaaggaaagaatcttgagagctgcaaggcaaaagcctcagacaacctataaaggaaaacctatcagattaacagcagatttctcagcagaaactctacaagccagaagtgattgaggtcctatctttagcatcttcagacaaaataattgctagacaagaattctgtatccagcaaaactaaccttcatatatgaaaaagagagaaattatttttcagacaaacaaatgctgagagaatttgtcactactaagccagcactacaagaaatgctaaaaggatttctaaatcttgaaacaaaacttcaaaatataccaaaatagaaactccttaaagcatacatttcacagggcctataaaacaatgaaaaacaaacaaggtattcaggcaacaactagcatgaagaataaaatagtacctcacatctcaataataaaatgaatataaatggcctaaatgctcctcttaaaagatgcagaatgggctgggtgtggtggctcacacctgtaatcccagcactttgggaggctaaggcaggcagatcacgaggtcaggagatcaagaccatcctggctaacacagtgaaaccccgtctctactaaaaatacaaaaaaataggccaggcatggcagcaggcacctgtagtcccagctaaccaggaggctgaggaaggagaatggtgtgaacccaggaggcggagcttgcagtgagccgagatcgtgcctctgcactccagcctgggcgacagagcgagactccgtctcaaaaaaaaaaaaaaaaaaaaaaaattgcagaatggcagaatggataaaaatctaccaaccacatatcttctgtcttcaagagactggcctaatgcataaggattcacataaacttaatgtaaaggagtgggaaaagatattccttgcaaatggaaaccaaaagtgaggaagagtagctattcttatatcagacaaaacagactttaaagcaacaagttaaaaaagacaaagagggacattatataataataaaaggatcatttcaacaagaaaatatcacaatcctaaatatatatgcacctaacactggaggtcccaaatttataaaacaattattactagacctaagaaatgagatagatggcaacacaataatagtcagggacagccgggtgcaatggctcacaactgtaatcccagcactttgggaggccaaagcaggtggatcacctgaggtcaggagtttgagaccagcctgaccaacatggcaaaaccctgtctctactaaaaatacaaaaagtagctgggtgtggtagcacatgcctgtattcccagctactcaggaggctgaggtaggagaatcgcttgaacccaggaggcagaggttgcagtgagctgagattgtgccactgccctccaacatgggagacagagcgagactccatttcaaaaaaataaaagaatagtagttggggacttcaatactccagtgacagcactagacaagtcatcaagccaaaaagtaaacaaagaaacaatggagctggacatggtggctcacacctgtaatctcagcactttgggaagccaaagtgggcagatcacctgaggtcaggagtttgagaccagcctagccaacgtggtgaaaccccgtccctactaaaaatacaaaaatttgctgggtgtggtggcacatacctgtaatcccagctaatcaggaggctgaggcaggaaaatcgcttggaccccagaggtggaggttgcagtgagccaagatcatgccactgcactccagcctgggtgacagagtgagactctgtgtcacaaaaggaaggagggaaggaaggaaggaaggaaggaaggaaggaaggaaaagaatttaaactataccatagaacaaatggtctcaacagatatttacagaacttctacctaacaactacagagtatacattctttttagcaacacatggaacattctccaagataaaacatggtgggccacaaaacatgtctcagtaaatttaagaaaactgaagtaatatcaagtactctttcagaccatactggaaaaaaactggaaattaactccaaaaagaaccctcaaaactatacaaatacagggaaacttaataaactgctcatgaatgatctttgggtcagcaatgaaatcaagatggaaattaaagaattatttgaactgaatgataatagtgacagaacttatcaaaacatctggcatatagcaaaagtggttctaagaggaaagttcatagcattaaatgcctatatcaaaaagtctgaaaaagcacaaatagccaatctaaggtcacacgtcaagtaactagagaaataagagcaaaccaaacccaaacccagcagagggaaaaaaaattacaaggatcagagcagaactaaatgaaattgcaatacaaaaatgtataaaatataaatgaaacaaaaagctagttctttcaaaaaaaatgatagactgttagtgagataaaccaaaaaaagaagggagaagatccaaataacttcacttagaaatgaaacgggagatattactactgatagcacagaaataaaaaatgatttaagactactgtgaacacctttacacacacaaactagaaaacctagaggagatggataaatttctggatatatacaagcctcctagattaaatcaggaagaaatagcaactctgaatagaccaataacaagtagtgagattgaaacagtaatgaaaaaaaaaatgccaacagcaaaaaaaaggtccaggactagatggattcacagatgaattctatcaggcatttgaagaagaattggtactgatcgtaatgaaattattccaaaagataaactggaaatcctccttaaataattctatgaaagccgggtgcaatggctcatacctataatcccagcactttgggaggctgaagcaggcagatcacttgaggtcaggagttcaagaccagcctggccaacgtggtgaaaccccatctctactaaaaattcaaaaattagctgggcgtagtggcaggcacctgtaatcccagctactcatgaggctgaagcaggagaattgcttgaacctgggaggcagagattgcagtaagccaagattgcaccactgcactccagcttgggcaacacgagcaaaacttcgtcaaaaaaaaaaaaaaaaaaaactctatgaagccagtatcactctaatacccaaaccaggaaaagacataacaacaacaacaaaaatgcagaccaatatccctgatgaacatagatgggaaaatcctcaacaaaatactggctaaccaaaaccaacagcatatcgaaaagatagcacatcatgataaagtgggttttatactagggatgcagggatggtttaacatatgcaagtcaataaatgtgatacatcacataaacagaattaaaagcaaaaatcatatgatcatctcaatagatgctgaaaaagcatttgacaaaatccagcatccctttatgattaaaaccctaagcaaaatcagcatagaagggacatacctcaaggtaataaccatctatgacaaaccctcaggcaacattatactgaacagggaaaggttgaaagcattccccctgagaactggaacaagacaaggatgcccatttttatcactgctattcaatatagtactggaaatcctagccagagcaatcagacaagagaaagaaataaagggcatccaaattggtaaagaggaagtcaaaccattgctgtttgccgatgatatgattgtatatctagaaaaccctaaagattcatccaaaaagctcctaaacctgataaatgaattcagtaaagtttcaggatataaaatcaatgtacacaaataagtagcactgctatacaccagcagtgaccaacctgagaatcaaatcaagaactcaacccttttaacaacagctgtaaaaaataatataaaatacgtagaaatatacctaaccaagaatgtgaaagatctctacaaggaaaactacaaaatactgctgaaataagtcatagatgacacaaacaaatgggaacacatctcatgctcatggatgggtagaatcaatattgtgaaaatgaccatacagtcaaaagcaatctacaaattcagtgcaattcctgtcaaaataccatcattatttttcacagaactataaaaataaaatcctaaaattaatatggaaccaaaaaagagcccacatagccaaagcgagactaagtgagaagaacaaatctggaggcatcacattacctgacttcaaactatactacaaggctatagttaccaaaacagcatggtactggtataaaaataggcgtgtacatcaatgcaacagaatagagtacccagaaataaagccaaatatttaaagccaactgatcttcgacaaagcaaacaaaaacataaagtggagaaggacaccctgttcaacaaaggctgcaccctaaccacaaatggtcaaatggtgctgggattgttggcaagtcacatgtagaagaatgaaacttaatcctcatgtctcaccctatacaaaaatcaactcaaaatggatcaaagacttgaatctaagacctgaaaccataaaaattctagaatataatattggaaaaactcttctagacattggctaaggtagagttaatgactaagaacccaaaagcaaatacaacaaaaacaaaaataaatagatgagaccgaattaaactaaaaagcttccgcagagagaaaaaaaaatcagcagacttggctgggcatggtggctcacgcctataatctcagcactttgggaggccaaggtgggtggatcacctaaggttaggagttcgagaccagcctggccaacatggcgaaaccccatctctactaaaaatacaaaaattatctgagcatggtggtgcatgcctgtaatcccagctacttgagacgctgaggcaggagaatcacttgaacctgggagacagaggttgcagttagccgagatcgcatcactgcactccagcctgggcgacagagcgagaccctgtctcaaaaataaaataaaataaaataaaataaggccaggcatggtggctcatgcctgtaatcccagcactttgggaggccaaggtgggtggatcacaaggtcaggagattgagaccatcctggctaacatggtgaaaccccatctctactaaaaaatacaaaaaattagccgggtgtggtggcaggcgcctgtagtcccagctactcgggaggctgaggcaggagaatggcatgaaccctggaggcagagcttgcagtgagctgagatcacgccactgcactccagcctgagcgagagtgcaagactctgtctcaaaaaaaataaacataaaaataaaataaaataaaaataatcagcagagtaaacagagaacccccagagtgggagaaaattttcacagactattcatccaacaaaggactaatacccagaatctaccaggaactcaaacaaatcagcaaaaaaaaaaaatcccatcaaaaagtgggctaaggacatgaatacacaattctcaaaagaagatatacaaatgtccaacaaacatgaaaaaaatgctcaacatcactaattatcagggaaatgcaaatcaaaaccacaatgcaataccaccttactcctgcaagaatggccataatttaaatatcaaaatataatagatgttgatgtggatgtggtgaaaaaggaacactttcacactgctggtgggaatgtagtacaaacactatggaaaacagtatggagaatcctttgagaactaaaagtagaattaccatttgatgcagcagtcccactaatgggtatctacccaaaggaaaagaagtcattgtatgaaacagacttacacacatatgtgcatagcaatacaatttgcaattgcaaaaataaggaaccagcctaaccctgatttccagtggaaatcctaggaagttatgatgttagttctgggcttgtaaaagaaaaacaacagcaaacaaacaaacaaaaaagaaaaaccttggaagcaagtaatttgagatggtttatgtcagtttttgtgatgaaaactattttctaatgtttagaaagatgtttccacaattttttgtttcttaacagaactaaatatttagcttttctgtatcatatagatgactcagacattttatgattagctattacccaggttgacataacatgactctaagttattgaaaaagattttttaaacaatgtaaagctcatttataaacttttatttattctcttttgcaagtaaaccttatggtaaataataaaaaacataaaaaagtaaataaagttttatttattcttaggaagtatgcttgagtagctcattaaacaaagttagctactgaaactgtctttgcagggctgagcagtggctcacgcctgtaatcccagctctttaggaggcccaggcaggtgcattacctgaggtcaggagttagagaccagcctggccaacatggtaaaactctttctctactaaaaatataaaaaattagccaggtgtggtggtgggtgcctgtaatcccagctacttgggaggctgaggcaggagaaccacttgaacccaggaggtggaggttgcagtgagctgagatcacatcattgcactccagcctgggcaacaagagcaagactccatctcaaaaaaaaaaaaaaaagaaaagaaaagaaaaaaagaaactgccttcgcaaaattataactgagacagtgaaagaaatctaacttaactgaccatcttgcctctagcatataagctgtctttgttcattccatcttgcctagggactagattgtctttgtaggactaacatttgacacaagattagaaattatgatttaggagtcatgcagctggaggctaaaagattatgaccctccctaaatttctctcaagatcagtgcttgagatattttgcagaccctgcacttgatggatcagctggctccacccagattgataaactggctcatctgatcttgtagcccctgcccatgaactgactcactgcaagaagacagcttcaactccctatgatttcatctctgacctgaccaatcagcactcctggctcactgggttctccccacccactaggttgtccttaaaaattctgctcccaaaatgctcggggagactgatttgagtaataaaactctggtttctgcacagctggctctgtgtgaattactccttctctattgcaattcccctgtcttgagaaatcagctctgtctaggcagtgggcaaggtgaacccattgggtgcttacaccatcatcttcagttttttctttgtaatcatgtttacattccacaaatgttaggaacttaacactttagccagaactctaaagttaaatacacgggtattttgttaatcagaggacacggttgttttcagtaaatcaacagtattaaactagtcttatttaccaacaatttacacaaatcatttgaactaaaaggcatttgagttagcttatatttttctcataaaatatataatttaagtgcttactttttctttaacccaattaattagagttttcgtgtattttggtaatgaaatatcacatccacatggcatatatgaacatatatacatacagacatacaaacaaaagcagagtctgtagcttgataaacttcttcatttgtcagggggtttttttgttttggttttggttttggttttctttttctttttttttttttttgagatggagtcttgctctgttgcccaggctagagtgcagtggtgtgatctaagctcactgcaacacccacttcctgggttcaagcgattctcctgcctcagcctcccgagtagctgggattacaggcgcctgccactgtgcctggctaatttttgtatttttagtagagatggggttttgccatgttggccagggtggtctcaaactcctaacctcatgatccgcccaccttggcctcccaaagtgctgggattacaggcgtgagccaccgcacccagaaaccatttgccagtttttaaatagtttctctcccctctttagactatggagccctaaacaactgttagcaacataacccttaatttgcacttccaaagacatgactcttaagtgaaaatttacatcccaaaggcacagcacttagatctaagcaccattctctgctgagatgaagaaggatatgggtaaagattcagtcgaagtgagattgccaggaaaagtatcttaaacaaaggcagggattgttatgtaaactttaaaccaatgtcttccccatcttaagagttttgtgggttttttgtttgtttttttttagacaaggtgtcattctgttacctggactggggtgcaatggtgcaattttggctcgctgcagtctccacttccctaaggccacaagatttgaagttaggataatacatgttacactgttaacttttagcaaactttacttttgttgaaaaccatgtaagtttgggatttttaattatcctttgctattactaagacctctttagtccaaatcaacttggaattagtatagatggttccttcctggttctgtaagtactttaaggcttggctgagtgcagagctcacacgtttgagcagactgattattaggcaattttcctaactctatttctacgagagtttccctatcaattactgaatactcgttgtgtctttttccctcaatcagccaggagaaaccatccatcatcctgtcctgaagggagttcctcctaggtctggtcggacctttgtatggtagttaattaagatttagatcccctgttaggaaacctgcagggttaagggaattatcagtggttaatgttaaatcatatttttctaacagaatggcctcatatgttaatattcttaagtcagtaagctgcctttttgcttttttgacttaggatagttctgacctggtgaggtgtgctcacaatgaggtttcctctaaaagttatttttgtactttcttcagttagcaaagcagttgctgctacagattgaatgcatttgggccatccccgggttactgggttaaggatttttgataggaaggctactggttgtcagtggcctccgtgcttttgggatatgcccttgtttacactgacaacaagatggaatagctacttgagggtaaatctaggacaggggcagttactaatagatgttttaacctttccacctgttggatttctggtaattgccaaatgaggagggggttttgcccatcttgcgtgagctttttgtataagggttttgtttttagggcataagaggctatccatagatgacagtatctgacttatcttaaagttttctaagttcttgtttggtctccggcagaggcaaggatatgatactttcagtccattcaagctcaatttgccatttacctttgctaattaaatgacttgttctaatatttgactaaataaatttgaagacttcgtaaacccttgaggtaagactgtctatctgtattgctattttcaatcagagtgagggtcttctcactcaaaggcaaataggtcctggctgtcttccgtgaacggacaaacccagaaggcatcttttaaatctattaccataacaacagggtgggtagtttggacttgattaatagctctaaggtcttgcactaactggtgtgacccgtctggcttctttacaggcagtattggagttttatagggtcacggagaagactttcaattataggttttacatttaccctggcttttaaaggaatagggtacattgctttctctttactacttctagctctctctctctctctctctctctctctgactctctgtctctttctctctctgactctcttaagtttttttttttttatccttctaatattttaacattagtcctgggggattattgggggaatattattgttgctagctttatttcttttatcctgtaccttacttggggtatttcccatttttggggtgaggctcaatttcccttaccagaaatatctcaccttttggagggaggctcaatttcccttactggcaatgtctcaccttttggggtgaggctcaatttccctcactggaaatgtcttgccttttagggtgaggctcaatttcccctactggaaatgtctcaccttttggggtgaggctcaatttccctcactggaaatgtctcaccttttggggcgaggctcgatttcccttaccggaaatatcttgcctctttttaatccccaagataccccgaccaaggaatacttcactgccccctgtggtttttctttccttagtcccggctaaggaatgctttaccacccctacggcttctttttccttggtatgtcccaaccaaggaatgtttcactgcccctgcagtttttctttccttagtccctaccaccaaaggaatactttaccagctcctccgctgtttccttctttggcttgtgcgtgatgttgtctggtccacgtggtatgtaaggatcctttaccccaggtcaccggccagtttctttccacattgctgagagtctgggtttattcatcacaccaggtaggtctcggttcctcacccctgaggctgccgaaatgaggcggcggggcacctccttacaagagaggactggagaccgcccagaggagagtgggtccctgcatgggccaccaaactgttagaaatgcaaaatgcttgttccctggtgctgcaaagaaatagcactcaaacatacatttaattttctcagcaaggcaatttttactttctgcagaaagggtgctcctcacagatggaacaatggtgagatcataccaggacaggggaggggcaggagttcttattcctgacgctagtagcccctactgctgtgttgttgccctaatggctaggattggaccgcacagtctaagctaattctgattggctatgttaaaaagagcaggagtatgagctggagtggtgaggtgagtagtttggtgggaagggcagttaggaacaggtaactaaaggtgacttaggtcagagcaggtgaccaccaagggaacagctgtgaactactgatttggactggcgggaaagttgtttactgaaactagaggcaaggagttgaagagaactaggaagttaaactttaaaatgaagaatcaaagaataagagagctggacatactgacatactgattctttgaagagaaacttagggttcactatatttaacaggaggccgagacaggaggatcgcgtgagcccaggagtttgagaccagcatgggcaaaatagtaaaaccccatcttattaaaaaaaatttttttttttgaaatggggtctctctctgttgcctgggctggagtgcattggtgctatctccactccctcaacctctcagccaatcctcccacctcagcttcatgagtagctgggactacaggcgtgcaccaccctgcccagctaattttcgtatttttttgtagagacaggttttcatcatgttgcccagcctggtctcgaactcctgagctcaggcaatcctctcacctcggcctcccaaagtgctgggattacaggcatgagccaccacacccgaccttaaaaaaaattttttttaatatgtggaaagcagacacgagtagaagccagcacaactagctaacttcccctagtgatagaggcaggagacaggcaaatgccatctatgtcattatatatagggagcttgcctaaacatgcccacagtggaaaattccatcccttaacacatgcacagtaagagaaataaatcaatgcagagtggccatttcctttattgccttctgaacatttacctttctagtgtcctttctttttgcatctcgcacattaatctctagcctcatccggctcttgaatccttgcctaacttgacttctttcacatctacatccacatccatgtcctctcacggtgctaatttttctttttatgagagctgttgctaacagattggcttttttttcttaagtctttaatttacttttttttttttttttttttttttctgagttctcctgctcctacggccagctggcggggctgggcaacggcacgggccttgcccccgcgcactgctgtctgtctctcctgttttcttctgattctctttttcacacttactcttagtgtttctttttcctttgctctttcccagttttgttccttggtcacagttaacatacaccttggtggccacttttatagactaggtggtattcatgcctgcagcttctgcttgatgttaccctgggcttgctttacaaataaaatattcagtgcatactgattttcagcagcctcagggttaagtggggtataaagccagaatgctttatagagtctcttataaaactgacttaggctcttgtcagctccttgaaggatttctgaaatcttttttatattacttgcttttttctaccaacttttagactctgcagaagtgcttctcagtacctctgcaaatgctgaagctgaattgcattctctgggtctttttttcccttttttctagagtttaacaggctcttttctttatacaattttttatgcacttggagggttaaacaggcatacccagagtcagtgtaaatgtttacaagtcttaccttcactgagttctaaggcccgaattaaagcaatgagctcagcttaacaacagtgtccagggttaccaccgcatattctgcacctctctctccttgggggttgatgaagctgttcccgtccacgtatagctcccagtctattgatgcccaaggctggtcctggaggttaggtctgctagagtaaatttgagtccaacacctctacacagttatgctcgacagggctttagctgccgggagcaaggtggtgggttcagggtgtttccagtttagtagatcaatggttgaaaagggctgatagatgaaagtctgttgtcccccccaaccccccggatgtgggcctggtcattataatagacaggtcctcgtgtctccctgagaggcatttgcatagcctctcagatctgagatggcccacttgactatcttgatttccttccttggtctctcgaagctccgatcctccccttcaaggtaaaacctggagcgtgttagctcctgaatctcatttctgagggggttgttggcctcagtaaagcggggtaggctgggatatatggagaaagaatttctgttatctctggcggctcccgcaaaactggcttctcttgctgtttctgggactccctttttaactctgtctgccggcgaagctgctcttttacttttggcttttttgcaataagctgttcaacagggctaaatttatgctggttttgcctatattatatttaaccatgagtcaatataaaggaatttgatctaggtacactggctgccctctgacccctgtcaccaccttaaatacatggccaatagttccctgtctatagttccttcggtgggccatctaacaccaaaagagggcaattctaattcacacagagttcttaacctctagggggttaacttaactctataatctcccacagaacctttcctaaggttctgtaacatgcattttaatagagtaagttttgatgctttgatgactttccttttatttttctttttgaaattttttaacatagttcctagcggagtgggcttactttgtgtctgacctatttttctcttgaaacaaaaaaaattcacactacaagaaggaaagggtaaaaggtcactcactcgtctaattcacactaaatcaaaatcaaaactaaaaccaaagtgttgttaaaggcacacctgttcgtcaagcaatttatgccaagtcaaaatcagaaccaaaaccaaagtaccaataaaggcatgcctgtttatcaagcaattcaagtcaagtcaaaatcaaggttaaaaccaaagtatcaagcaattcaagtcaagtcaaaaacaaaaaccaaagtgccagtacagacacgctgtgggtgatcaggccacgcttccactcaaacggagtgggcaagttccaaagaccagtcttaccaagtttcagatgtccggactccaagtgcctgttccttcccggtgttcagccactgcgttgatcctccaccggggcctgccacgcgctgctctggcaaggcgttccactggggcaaatgcctacccgggagcactctcaggatccgcattgctcaagccggagtcccccacagggatgctctacagagcatgcataagctgcctaaggggctacctcgaccgtcagttaatcacctcatttcccggtcagggaaccaagaaatgtagcaggacgagccacagacgaaactcctcagacaccgaattaaagaaggaagaggtttttattcggccgggagcatcagcagactcatgtcttaagagccgagctctccgaaaaagaaattcttggcctttttaaaggcttacaactttaaggggtccatgtgaaagggtcgtgataaatcgagcaagcgtgggaaatgtgactggaggctacatgcatcagctaacagaacaaaaagttttacagcgcttttttcatacagtgtctggaatttacagataacacaggtagtttaggtcaggggttgatgttactattattactttttttaactcctagggccaggtggtggtgccaaggttgtctggctatttatcttacttttgtttttttccaactttttgctttttatctcctcctgtcttgtgaactaggcaaggtggggggaggagggcagcaggagtagtagtggtctccttccttaagactaagggccagcatgcacactggaagaatggggtggagccaccaggaattcatgcctaatgctggagaggagccacgccttttcaacttgcatgtgatggccttgtattcaatttgtgaggtggatacctgcatataggaccctccttttgcttaataaattccgccctcctcacctttcttttcttttttttgagactgagtcctgctctgttgcccatgcaggagtgcaatggcatgctcttggctcactgcaaaactctgcctcccaggttcaagtgattctcctgcctcagcctcctgagtagctgggactacaggcatgtaccaccatgcctggctaattttttgtatttttagtagagatggggtttcactaatttgcccaggctggtcttaaactcctgacctcaagtatctgcccacctcagcctcccaaaatgctgagattacaagtgtgagccaccgcacctggcaccatcctcacctttcaatgtttctgcgtgcctaatttttctggatttagctgaaccaaggaacaaaaaattctgcatcattagttgtgctggcttccacttgtgcctgccagtatcccacatttacatttaatcttgggttcccaaagacaggaaccccatgagaccaggccacacagtgcttccacagcacacctttctgtaaagacattcccctgaggctagtgggcaacccaatgcaaatcagcccactctgtgatcagctcatcttccatcagagtcttaaccattggtagtgaatgttcccacaacctccaggtgttcaaacctgccttttaatctaagtgcgtaaagaacaaatagcccattgcaataataatcattcactacaaccctgtcagccactttccaggttttgccagtgactcgtcagccactgcacacgcaaaagtcaagttctctctcatagtaaaaagtaattcctggtaccccaaaagccaaagatcaggtactacttttaacagctcttggcctggcacagtggctcatgcctgtaatcccagcacattgagaggccgaggcgggcagatcacctaaggtcaggagttcaagaccagcctggccaacatgttgaaaccgtgtctctacaaaaatacaaaaattagccgggcatcatgatgggtgcctgtaatcccagctactcgggaggctgagacaggagaattgtttgaacccaggaggtggaggttgcagtgagccgagatcgcaccactgcactccagactgggtgactgagactccatctcaaaaaaaaacaacaacaaaaaacagctcttagaattcttcattagttacaattttgtttcctccgtggcaatatgaattgcaatttgtgaattaaaaacattagaatttgaaaaaattttggctggacatggtagcttatgcctgtaatccctagcactttgggacgccgagcgaggcaggcagatcacctgaggtctggagttcaagaccagcctgaccaacatggtgaaaccccttctctactaaaaaaatacaaaaattagcccagtgtggtggcgcatgcctgtggtcccagctactcaggaggctgaggcaggagaatcgcttgaacccgggaggcagaggttgcagtgagccaagatcatgccactgtactccagcctgggtgacagagtgagactcagtctcaaaaaataaataaataataataaataaaataaaataaaattcaaaattatctggacatctgaattttatctgacatgccctttcatcatattgctatatcctttgtctttcctcaattatattttatcaagaaggccttttccaaccattttatttagtatggctcccccacctccacttctctcataaattgttctggccctagcaccagcatacagcatagtttcctgtttatttgcttagtgtctgtctccttcagtatagaatgtaatcttgtggcggtcatggtggctaacacctgtaatcccagtactttgggaggctgaggcacgtggatcatttgaggtcaggaattcaataccagcctgaccaatgtggtgaaaccctatctccactaaaaatacaaaaaaattagtctggcatggtggcacaagcctgtagtcacagctactcaggagactgatgcaggagaattgctagaacccgggagacagaggttgcagtgagctgagatcgcaccactgcactccagcctgggcgacagagtgagactccatctcaaaaaaaataaagtaatcttgtgagggcaggattttgatgctatgttcaccactgactccaaaatggcacatagcgggctctcagtagatatctattgaacaaatggaagcataaataaacaagcaatgctacacttgctttctccagcaccatgggagcagatccagggagcagacagggaaagaaggctacagcccctgccccctggtggagctggaagaatcaataattttcatttatttattcatctaatgtgctttgcacgctccctatctgccaggatcagcttgttgccagggataccgggtaaacaatcccataaggttcctgtggtctggaggaagaaacagacattaacgcacaatagggagatggttacttaattatagtggtgaactgtcaatgaaggaaaagcaaaaaaaaaaaaaaggtctaacctggtataggggtcaggggagacttcctcaaggaagggatatggagttgaggcctgaggctgagcatgaattaactggaggcagagctctgtgggtggagatgtcattccaagcaggaagcccggttaatgcaggtaccttgatagaaggaaggccagggtgaggaaaaaggccgggttacaggcagttactaggaaccttgtggcctgacttgttgctgaggaggaagcaatagccagctcagagggccttgtagttcaggtgatgccccatttctgtgttagtctatttttgcgttgctataaagaaatacctgaggctgggtaatttatacagaaaagaggtttaatttggctcacagtttagtaggcgccaggaagcatggcgctggcatctgctcctggtgaaggctcagggagctttcaatcatggcggaaggtgaaggaggagcaggtgtgtcacatggtaagagtgggacagagagacagagacagggagagagagagtgcaagagagagcaaaggagggaggaggagccagccttccttaaacagccagctctcatgtgaactaacagagtaagtactcactcatcaccacggggaggacaccaagccattcatgagggatccgcccccaagacccagacacctcccaccaggccccacctccaacactgggaatcgcatttctttttctttgttttttaattttgtactttaagttctgggatacatgtgcagaacatgcaggtttgttacataggtatacatgtgccatggtggtctgctgcacctatcaacctgtcatctaggttttaagccccacatgcattaggtatttgccctaaagctctccctccccttactcctcccccatagaccctggtgcgtgacattcctgtccctgtgtccatgtgttctcattgttcaactcccacttatgagtgagaacatgtggtgtttggttttctgttcctgtgttagtttgctgaggataatggcttccagtttcatccatatccctgcaaaggacatgaactcattcttttttatggctgcatagtattccatgttgtatatttgccacattttctttattcagtctattattgatggacatttgagttggttccaagtctttgctattgtaaatactgctgcaataaacatacatgtgcatttgtctttttttttgagtcagagtctcgctctgtcgcccaggctggagtgcagtggcaagatctcagctcactgcaaactccgcctcccaggttcaagcaattctcctgcctcagcctcccgagtagctgggattacaagcgcacgccaccatactcggctaattttttgtatttttagtagagaaggggttttgccatgttgtccaggctggtctcaaactcccagcctcatgatctgcctgcctcagcctcccaaagtgctgggattacaggtgtgagccacaatgcctagccatgtgtctttatagtagaatgatttatattcctttgagtatatgccccatgggagggaatcacatttcaacatgagatttggaggggacacacatctgaaccacatcacacagcatattcccaactccagctccctcctctccacaagaatgtaggatacccatcactcccaggatcagcttccttgagcccaatcctctgtaactcactgagatgctatgaagtgcctggtaggtgccacactgtgccacagtcatgctccaagacagtgtggagtgagggccagagggccaggaggcaggattggtttggagacattgcctttcttcaaacctcagtttcctcttaaatcaaataaatgattgcagaagataagctcatattaattccatttctaggaaaaatctgtgttccaaacagtagcactgactaatggaaagtacaactggctgtttcccttgaacagtgggtttattgttgtttttccaattataaaagtaataagattatttgtaaactatagaacagtagaaaaagtttcttgaatgagatttggttttcaatcagggcaaataaagacttttctgggattaagagggctgtttcttctccattactttatacggacccgtactggggacttgtcagctgttcaagtacaacgcacccagttttggttctgtaccaggattaggcctacaatatttcagaattcatatacaaaccccaataaagtgttaaaggagatgactgccctataacctatgttttgctgaatgtttactatgaggttttttttttaccatcctcatgagtatggtattgtaactgaaactctccaggaaaattcctctgcttaaaactaaaaatcaagtgtatctcaggaaactctactgtcccatctgaaatgcctctgttgtgtgttgtctgcaaaggtggagtctccctgttttgttcaggctggtctcgaactcctgggttcaaggaaatctctctcctcaccctcctgtgtagcggggactgtaggcacctggctgtggtggatactattaagccaaattccagtcagcatcctcttttcaatgaagttgaaaggagagatgatgaaactggcagtgttactgaatgggaaataaaggtgggaatacacattgtgagtgaagacacggaagtaacttctgcaatacaaccttgtaagagtcttaatgctacactcctttgtttatcaaatgatgtacctttatcgtaagggaagaacctgggccattccctctggtgttgagaggcaatttggaaactctgccatttcttaggactgagtatttaatatactattttgtggaaatctgagaggcagaaatgggatttaatgatctcaactgtcatccatctaaaaaacctaatttgcaattttaaataaaatggcatgttgccttctactattctctttttgttttttgagacggagtcttgctctgtcacccaggctggagtgcagtggcacaatctcagctcactgcaaccactgcctcctgggttcaagcgattctcctgcctcaacctcccgggtagctgggattacaggcacacgccactattctaggctaatttttttattttttgagacggagtctcgctctttgcccaggctggagtgcagtggtacaatctcagctcactgcaacctctgcctcctgggtttaagcgattctcctgcctcagcctcctgagtagtgggattacaggtgcgcaccaccacgcctggctaatttttgtatttttagcagagacggggtttcaccatgttggccaggctggtctcaaactcctgacctcaggtgatctgcctgcctcagcctcagcctcccaaagtgctggcgtgagccacggctcccagcctactattccccttttaaaacaggaaccaaccctgcatttaattttatgaagtctgatttatttatttatttatttatttatttatttatttagagatggaatctcattctgtcacccaggctggagtgcggtggcgcaatctcggctcactgcaacctttgcctcctgggttcaagcgattctcctgcctcagcctcccgagtagctgggactaaaggtacctgccaccacgactggtgaatttttgtatttttagtagagatggggtttcacgatgctggtcaggctgttccactatgttggccaggctggtttcaaactcctgacctcaggtgatccgcctgcctcggcctcccaaagtgctgggattacagacgtgagtcactctgcccagccgaa

SEQ ID NO: 3169 - DNA, 1629 bp, Homo sapiens
ttactagctgcaagcctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggagcccgcgggggccgcgcccttctctcgcttcggactgcgcaacgctgcgctctgggctgacaggcggataaaacggtcccatcaagactgagaaaaagcacaccagctattggcacagcgtgggcagtggggcctacaggatgactgacttagtctacagagatcccggcgtacttaagcagatgaagactcttaagatgacagaaggtgatttttctggtgatcgaggacttccggggtaatgacagtgatgaaatgcaggggacctggtaggtttcttttggagactaactgggggctgcctggtgggacagaacagcatgtttccaagggctgtggctggtcatagccatgggatctccaactgcatgcaagagcaacctggaaagactttgacagcgcaggtcagtacaatacctgcaagctgccactcagctttcctataatgtttcaggaccagggctggaagccttccatgtgtcaacttcaatgtagatgggtttttttttttttttttttttgagacggagtcttgctctgtcacccaggctgctggagtgcagtggcatgatctcggctcatggcaacctctgcctcctgggttcaagcgactctcctacctcatcctcccgagtagctgggattacaggtgcccaccatcacacccagctaattttcttgtatttttagtagagatggttttcaccatgttggctagatgggtctcgaacttctgacctcgggtgatccgcccgactcggcctccccttccaaagtgctgggattacaggcatgagccaccgctcctggccagtttagttttcacgctaagctttttgttctgcaggttgcccccaagtttcctggcagtgtgtgatactgaggaggtgagcttgtttctggagctgtgctttaaggtaaagttgatcagcttaatcctcctgatccctttcccatcggatctgaacactggtcttggtggtcgtaaaaggaggaaaagtaatagtgaagctggcctaaatgttgtaatctggtatatggcatgtgggctagtttcagacaggtttcagagatggttggatctctgaaattgtaaaatgaagtataatcttaggctaagggaaggatgcgtgtgaagctctggaggttggtatagtaatagctgacctattactgcatttgggagggatctgtcatagcttccttgcctcttaattaagggtggtgtttttttcttttagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagta

SEQ ID NO: 3170 - DNA, 1352 bp, Homo sapiens
agccactcttactatttattcacataataacacaggagaagaaaagaaacactctaagaacacatcgaagcgaaatttcaagggaaacatattatcactcaggaattatcactcaggcaggaaagaccaccccttgctaccaacaccagccacttgcccttttagggccccgagccctctcaccccctcccatctgtcacccactcctcctacctgttacccactcctcctacctgggtctttccctcatgcgttagccccacggacaccatcggaactgctttctcccagattcctcggcctttgattccttccacctcacgcacatgacaaaaccttaaccctggtacaacaatctacctttttcttttcttttttgctcctgagcacaaaatcttccagggtttcttgaaaatccttacatgggctctttctcaactctttctcccatttcccacaagagatattccaaaattacaccattctcttgaaactctataacctactaccttcctctccaaaaggcagcagaggccatgaggtagggaccacaagcgttggttcattgttcctaaatctctttattgctctggaagctggcccctcccttcaccttctctgtgggctctcagcccttggactagaaatgaacttgctacatccacccatcttccaaaaatcactccccgagcctgttgtccgtttcctcctcttcactgccgaataacttgtcctccaggctgcaaccttctcacatccattccttactccatccactcaactccataccctgttgcttccccacatctgctgtgggagaggccctcaatgaactctccattgctaacaccaatggacgttttttccgtctttaacttccctctcctctccactacatctggcatggccactgcctcctccttgcaattctctccgatcttggcatccaagatgcttctttccagctttccctcttctcaggcttctccttcccagtctcttttgtgggctcttcttcctctgccttcccgtaaatgctgatatcccccatggttttgttctagactgtcttctcttctactttcaaggcattaatactacttacatgctgacagttccaaaatccaggtctccagccagatctccctcctatatccaattgattattgaatgtcaccctttgggtgtcccaaggtgtctgcacccaacctcatcattttgcttaccaaatgccccacttgctccttggacttcttatctgaatgaatggcacttttacccatcgtccgagccagaaacctgggattcattcttgacctttcaaatctattttccatgctgcttacaaatga

SEQ ID NO: 3171 - DNA, 3307 bp, Homo sapiens
ggagcgggtgtttacccgggagccggacggaggaggccggggccggtcgagcccggaaggggggaggggagcgcagtcggagaccgaggctgagaccttttcggttcctttcccctaaatcgacttccaaccctcgttcctgagcgtgggagaacgcggcagacagacagatgtctcccgccccttatcctatccagttccgcaattcacactcgttgccaaagagtggggagcgggaatggatacacccgggaacgactgcacgtcctgcgggcgcccggggaagaaggcagcgcagcacaaaacctctcctgcggtcacctcccaccccatcctgcacctgagttcttgcggggagggggtgcccacagcaggtcgggcccagaggatccggcaggggtcactttgaggtgtacggactaggagtctatcctcagaacgcgtcagctcgaccccatccccgattaataccagtgcgggtctcagtctcttgtccctcgcgtcccccagccctctccaaggcctccagatttagctcccactctccacgggacgcaggcccgaggacccggaagaagctgagtggggtccggttttcacacttttattgtaaagctcgggaataattacacgggtctttcattgacagctcagcaaacaaaccggaaacgaaccgaaccggagggggtaggggcggtgcctgcgcatgctcgcggcggggtgggggggggtgggggtgggggtgggggggtcagagaaagagaaagacagaaagagacagaaatcattacaaatcaacgggattgtgctcgcagcgccagggatggggtggggtggggcggggcgggggcccttcccgggaggagcgaggcagtgggaagtggcacgaaccaagagaaacacgaccccaatgtgggcacccgacgcgcccaaaaccccccaccccgacccccacccccctacacacgagagagacacggcccccctccccactagataacccgaggagacacagtctcccctccccatgggcagacacacccgcccgaaaccccatgggcgggacacagtcccccctcccagagaagtccccagtggagacgccccttaagagactttctcatggccaacacaagccctcccaacacccggagacagccccgacccagggaagaaatggctccagaggccctaccctcgggagagagaggtatcccagggctcctaggagaaaagacaactcagagatgcccagcctcatcctaaagtgctgcagggcagagaaacccccataggagagatgggggtagggccagaaacatcccttcccagacgtgtttcagagatagcccccttccctgggaagagagatggcccgaaactgacttgccttaagtactcccaggaaccctgggaggaaaacaggctccccagagagcctgggtaattgggggagacatgctcccgtggtcctcagcgggaacacatgtcccccggagactcccaaggggagagatagggcctagagagaccccagaggtgagggatgcccagagaacttccccccaccccggaatgtgaaacatgcttcaaggaccctaggagagaaatatgtccccatataccctccccctacggagagacatgccctgaagtagggggatggggaccgactaggtcccctctgggaagacacagactgggtcaggctgggtttgaggggggctctcctctggccaaatgtcgcctattggtacataaaactgtacgcgacacaggcattggggaggggcttcacagacctaggacccacagggatagtccccagtgctgtcgccaacccctgcccacctttggtttcatctctccagtgcccagttggtgacagactcagtgccctggccccaaccagggggctgggggctctgtctttgcctgtgggaagggcttctcagctctcccagccatctgggccaccctctttcttctggcttctccattgtgcaaaatgctcctctgctcttctgctcagtgctcaggggtctctaagaccagggcaaggtacccaggccactaggggcttccagtgggagtccactgaccccaggaatgccgcctgtctggaccaccttctccaccaagcaaatgggcctcatacaatcttcttgcccgaatcctgacctccaggacccaggacaatccttgaggccactgttccaccagctgggcacccaatactaccaactccaagactattgcacctgccccatttgtgcaggggaaaggggctgtctctttaacaagccccaagcccatctcctgggcctccccaagggaaaggagcctttggccaacccctagacctggctgctgccaccccatcccattctaccccttcccctctgtagaagggcttcgtatgccagggctaccagcctaacaatgctctccttcctagcactgtcaccccaagccaagttgggggtaaggggcagataaatagggtgattcttcaggcccctggcttttccggggtgggggtggggtctctggggtacaagagtcaagaccccagcagcacagctcccaaaggcaccagacgaccccgcagcctgtacccaccgctcgcaatcttggaccacctccccaagcttagactaagtcaagcaagggccataccctgagtctccagcctcccagcctgggcccctagggagctggagaggtatgggccaaggcagtgggggtttctggaaggaagaggggctgaggctttgagatggccacagtgggagacgggggctctgcaggacgccccttacaccctggccccctgaggtgaagaagagaacttcacctcatcatggctgactgggcttctctgccccccaacctccctaccccctcccccatgggacccctgaccctgacaaagggaagcccaactggaagaagggggcctggagcccagggtgccctgaggcagccctcccaccccctgagatcaaggcaatggtggttttacaggctgacgggtcagtcatggcaggggctgggggttgagagggcagggagggggcaggatgcaggccccctatatcgggagcagcacccagccaccccctgagcaaaccttcctgctcccaactcacccaaccaggccagaggcacagtcatcaacaagaaaagttgcaaatcaggcagaaatggggacgtcattccaaggtccttatatacagacactgcatgaccagcagggaatgggggcccagatgggactaggcgtgggcatgtggcaggcaggtgg

SEQ ID NO: 3172 - DNA, 2584 bp, Homo sapiens
ctcagacaagcagctggaagcctggtgcgcgtggatgtccccatggctttaaaggacgccccacagaacacggattaatcataatagagagaaaggacagcgttgcaggggaggctgcagacacggcatcaattaaaccgtcagcgttcacgtcaccagagaccgcccagggtgagattttacacctgccgccaggacacctgcagaagcgcagcctcaccccctgctgtccccgcccacccaggatctcatcaccaggaatccaaaggcaaagcagtccgagtgcccacagcacggaggggccaggagcctgcacaggctgacagagatggaggagagacggcggcttggggaagggcgtgacaccatcagactctgctctcagaaactcgtggggacagtggtcaggctgcagtggggccttgcagggacctgtccattccctgattctgacgatgctgagggcttgtgaatgtccttgtgtgcaggaaacacaccaaagagcctggctgtgtggaccacggtgcagcccagctgcgcacactgcgtttcctgtaccatactcggcactccggccttgcctgcgcactgcctgagtctgcattatctctgtgtgtaacttggccccaccccgggatccggggaggctgatcccccacgggcctctcccaacctgagcagcgccctcctggccactgtccactgctgcctgaggccctgccccagcagaaggcacaggctgggacaggcctgcaagaatggccaggaggggcctcccagggtcgaggcatctgagcagcaccctgcaggacgggcaggcccctcatgccccgggcacctgcacagggcctgcgatctcatgcattcgaatggtgccgaatgggccagggtgtcctgggggatcctgtcgggcgccctcctcagctcttccactttccacagtaagtacttcgatagtatggctcatggtcaccccaagtccccgagaaggaaagagagtgacgccatggagatgggaggtcggccctgcaaagggcaccatagtcctgggcactacttctcctggggaatgggggcttgggcaccttcttctcctccttcctccctccctccatcctccctctctcccttctttctccctccctccctcctccctctgacttacacccccaaattgccagtatcgccccctccccagttgcaacaaccccaaacattcagatattgatttgtgtttcctgcttgggggcagaatcactcctgttccagcaccgctgggcccccacattcccccacgggcagggacccacctcactccccccacacccatgagcccacaaggctctggcccccacccccatggctgcttggtgaaatgacagccccgctctgctgagagccggggaagaggaaggggctggggcagggagtccagcttgggagccctgtgagcccctctaggagcctggccctggctggagagagcagcactgggatgaaacccacttaattcatggcggcacagcattgccatctgcagcactcgtgctaaactccatcaaaaagcagacgcaggctttccttcctggctccgcagcccggggccggaatcagctacgcccactgcaccgagatcagctttgaaaagtccccattgcagacgtgcggcaaaggctggagtaagctggaagctttgctaaggccgctctgctgtgatcagcctggcctggggcgccctgagggattcctgagccgcctcctgcacccctccccgtcctccaggatgaggccctcattcaggcatgcctggcccctggaggcagagagcctgggactccatggagaagccgtgccctgcgcccactcggcctggatgggagcccgggccctgtgtggtcacacccggaggtcctcgcctgcagcggcgggggcagactctgtgggggcaccccctcctccagcagggctggccccagtggggtgggaggatgtggtggagtgcgtgacctctggagaagcttggccggagcagccctggggggcagccaactgctgggcaggggctccggtggcccatttcccatgacaggcggcctggccgggaggcaagcacagttcccactacttggtcccagctccccagctccgggcattcagatgggctcgtggccaccaggccgttgggtccaagtgaggacttggtgcccagcaccttcctgtgcaagaagtcagggagttcaagacgagatcaaggctgatccaggccttgcgcggctcctgctcacaggatcctggggaccgtttcaagaagagcctcaggacacggagaatgctcagtctcctggctctccccgccaggcaagagggcccgggggtggagggaatccaggggacacagtcctcaccccactgtcagcgccagcagaccccaacactcatcccccagccccaggcacacaacccgccctgccgcccctcgccaggccctgccgggtgtccaccctctgcggcagcaggttggggaggagacgtgctggggaggggcccaggcctgggcgggcgctgcccttcctttcactcccct

SEQ ID NO: 3173 - DNA, 484 bp, Homo sapiens
cacacacaaaatacaccacacacaccacacgcaaaatacaccacacacactgcacacaaagtacaccacacacaaaatacaccacacacgccacacacgaaatacaccacatgccacacacacaccacacaccacacacaaaatacaccacacacaaaataaaccacacacaaaatacaccacacaccacatgcaaaatacaccacacacaccgcacacaaagtacaccacacacaaaatacaccacacaccccacacacaaaatacaccacacgccacacacacatcacacacaaaatatacacacgccacatcccacacacaccacacacaaaatgtgccacacagacaccacacacacagtacacgccacagaaaatataccatgcaaacataccacacagcacacaacacaccacatacaaaatacactacatatatacacacgccacacaaaaaatacaccacacacacacgcaacatc

SEQ ID NO: 3174 - DNA, 1326 bp, Homo sapiens
taccacaatacctgcctcatccctctacaccagccgccacatccaccacacacacctccacacaccacacctccacccatagacctacacacacaccacacacacatctacacccaccacacacacctccacacacacctacactcatacacctacacagacacccctacacacacaccacacctacacactcatgcacctacacacacccctacacacaccacacacacatctacacccaccacacacacctccacacgtcatacctccactcatacacctacacacacccctacacacaccacacctacacactcatacacctacacacccccacaccacacacacatctacacccaccacacacacctccacacaccacacctccactcatacacctacacacagccctacacacaccacacctacacacccatacaccacacacacccacacacaccacacacacacatctacacccaccacacacacctccacacaccacacctacacacaccacacctccactcatacgcctacacacacacccctacacacaccacacacacatctacacccaccacacacacctccacacacctccactcatacacctacacacacagccctacacaccacacctacacacccatacacctacacacccccacacacacaccacacacacatctacacccaccacacacacctacacacaccacacctacactcatacacctacacacacccctacacacaccacacacacatctacacccacacctacacacaccacacctatactcatacacctacacacacccttacacacaccacacctacacactcatacacctacacacacaccacacacacatctacacccaccacacctacacacacacccctacacctacacatacacacctacacacaccacacacctacacctacccacacctacacctacacatacacacctacattcatacacctacatacacacccctgcatataccacccctacacactcatacacctacacacctgcacacacacccctacacacaccacacacatctacacacaccacctacacacaccacatacatctatacctacacaacctacacctacacatacaaacctacactcatacacctacacacacacctacactcatacacctacatacacacccttacacacctacacacacccctacacacacacgcctcccaaagtggcagcaggcctcctgacccgaaaggcgcacccctgttagaagccgcgccctccagtggccctggcgctgccgtccctccg

SEQ ID NO: 3175 - DNA, 2219 bp, Homo sapiens
agaacttctagtgctctgggcagctgcgaggggtcaagaaaccacatccccaaatccagcgggatctcagagagaaaggctgatgggaagctgcccagggctgacctggcacatgctgggaaaacccctcggtgccagggcaggaggcagagcgtctgcagctcctccctccccaacacagggggtaaggaatacagcagaacgggaatcgggcgccttcatgctgctgttaccgcccttggttcatggcttctttcacttggaaaccccaggagctaagttcctgttgacgaggcggcccagctccccaggcgtggctgtgttccggatatccacatcgtggggcgacacataaagctttgtgtcattcaagtcaaagaactcgacttctgtgagacccacccaccacgagttgccccagttggacaggatctccatggtcacgtagatggcatctttgatctcgtctgccctcattctctgtttgtccttaaagaagagaaaaataacaccaaaggattaagtcatgacaggcttgaattcggctctgcctctgccaccactgccttcaaaaagttagttaaccttcagggtctcagtctctccatctgtacaatgaggataagaatagcacccactacctatggttattacaatgattaaatgaattcatactgtaaagcattcaaaatagaggccctgtgtaactggcactctgtgagcattctgtttgaaagtttacaaataaataaaaatgtctaaaaagcattgaattctgcctgaacatgcacgtctctcccccactactcagtgttcggtacccagaagcttgtcacgacatctgctgaattgagtaggtgttacgtgctaaggccgggcacggtggctcacgcctgtaatcccaacactttgagaggccaagctcggaggattcctcgaggccaggagttcaagatcagcctaagcaacaaagtgagatcctgtctttacaaaaaaattaaaaaaaaaaaagagcttggcacagcggcacatgcctgtagtcccagctacgcaggaggctgaggcaggaggattgctggagcccaggtggttgaggctgcagtgagctgtgttcacaccactgcattccagcctgggtgaaagacccagtctcaaaaaaaaaaaaaaaaggttacgggctgaatttatcccttccaaattaatctgatgaaactctaatccccagtacctcagaatatgactgtatttggagataaggcctttaaataggtgattaagttaaaatgaggctgtgggggaggggggcactaatccaatctaactggtgtccttataagaggaaagttggacacacagagagacacaccaaggatgcacacacagaaaaaggccatatgagggcaaagcaagaaggcagctatctgcaagccagagagaggcctcagaacaaaccaaacctgccaacaccttgatcttggacttccagccttcggaattgtgagaaaacaaatctctgttgttgaagccaccccatgtgtggtattttgttatggcagccctggtggactgatatagtaggtaacatggccccctggccttggacaagtcacttgacatccctcggcctggttggggaagaggacatgacaccatctatgtgataatcctgtcacagatgttaaacaagatatcaatacctaagaaggccctatcatgagcctcggccctgggtgcgctctgtaagtgtctgtttctttctgtttctctccttcattggttttaatgcctgcctccttcctgcgtcggctgtctgctctgagagcctgcgtgaatgccatcaataaatggccaccgttcggaatggcttcctgaggccctccagggctgattgcagcactggtcgccacggatcagtcactcacaaaatggtgcattccccatgtgcacatgccctctgttaattagcatgggtaatctgcaatggttctgtgagcagggagccaagcaaatgaacagcaactgttccccacttatttttttaattaatagccagcgagacgtgctattgctctcagtgtgtgtttggaggggccttgattgccacacggtgggaacgcggatagggaggagggagagaggtcagctcacagctcctggataaaagatagggcctgttttgatcagctgggccctcgaaacccacagcttcctcctgctcc

SEQ ID NO: 3176 - DNA, 723 bp, Homo sapiens
cgtgcacaagctgccagaatggaggccccattctcaatgtgggggctgcccaaagagcagggagcttcccacaggacagaggctgggcacctgcttggcctggttcttccttttcccagggctccaacacccaccccctcaggtcctcccaaaccctgcaggtccctggcctggtccgtccacacctacactcaggaatctctacacatctctgagttgctgcatctgtcttcaggcacagcccaccagcccccctgggtacccaaagacaccgcaaatatcagccattccagacaacgtcctcctcccgtgtccctatctcatggagtaatgcctctaattcagccacaccaagaccccacgctccacatcccctagaactctcatctcctgtggcccaacatggcccttcctttcagcagtgggatgtgggaaggatcaaggtcacccttgtccaaatcccatgcagacaacggtgttggagtcttgggcccaaagaccagctcctagaacctgcagggaagcaacggcacgttccatctctccccatgccactgaggaatcattggtggcaggattctcagcaggcatggccgtgggtgcacagaacagagaaaggatggcctggaccacacacatcactgtgtgcagatgctttcctagacactgcagccaaggacacagaggctcagagagtctcactgttttccaggctggagtgca

SEQ ID NO: 3177 - DNA, 522 bp, Homo sapiens
atgatgtatgctttatttctgttgagtgtgggtttagtaatggggtttgtggggttttcttctaagccttctcctatttatgggggtttagtattgattgttagtggtgtgattgggtgtgttattattctgaattacgggggaggttacatgggtttaatggtttttttaatttatttggggggaatgatggttgtttttggatatactacagcggtggctattgaggagtatcctgaggcatgggggtcaggggttgaggtcttggtaagtgttttagtggggttggtgatggaagtaggattagtgttatgggtgaaagagtatgatggggtggtggttgtggtaaattttaatagtgtgggaagttgaataatttatgaaggagaagggtcagggctgattcgggaggatcctattggtgcgggggctttgtatgattatgggcgttgattagtagtagttactggttgaacattgtttgttggtgtgtatattgtactagagattgctcgggggaat

SEQ ID NO: 3178 - DNA, 1321 bp, Homo sapiens
gcctcagcctcccgagtagctggggctacaggcacctgccaccaaacccggctaatttttttgtatttttagtagagacggggtttcaccgtgttagccaggatcgtcttgatctcctgaccttgtgatccacccgcctcggcctcccaaattgctgggattacagatgtgagccaccgcacctggtccaagaacccaagttttagatctagagtgatgtcagcatgacattgatttcctgaggcccaggggcgaaggagctgaggacagcagaggggtgaaggaactcagctacagacagcagcagctgatgcacagggctcccagcgcctgaagtcacccggaattgggaagtgctcagaagcttacaaagctgcctcgaggtgggaacatgacataaatccaagagcagatccctgatcctataaaaatgtactagatgcagtgggggcattttaaatgagcagagaaggacagacagataaacagaaggacaaacagtattgggattgggataaatgctcagcttttgcccaaatcttagtgacttaagcatcacttatttgctcacgattctgtggctggaccatttggtttggctcacagggcagggactgtgctggtcttacctgagcagacctgcatgtctgcggtcaactgggttggcagagacagagtgactgtcttcctccaggaagcagcaggttaactggttggcagagacagagggacagagggactgtcttcctccaggaagcagcaggttaactggttggcagagacagagggacagagggactgtcttcctccaggaagcagcaggttggctctgtttccttcgtggggcagctggtctccagggcagcaagagagaccaagccccagtgcacattctacagcctctgtgcacatcagacttgttaatatcccattggccagtgtaagtcacatggccaagcccagattaaggagtggaaagatggaggctatctcctcctgggagaggaggccaaggaggtgggagtattatgtggccacttatgtttgcaatctaccatacttagcactttgagaaaagaattaactgagaaacttgcttcaaatagggcattcagtaaaatgaagccccaattgaagtaaaatgcatatataaaaaatgaaactgtgaccgattttaaggacagtattggcaaatatttctgtgctcttggaggagaagacccttattggcatgacatgtcagaaaccacaatgaaagaattattttaacttgcattcataaaaattaaaattattcattaaaaacatcgtgaatgaaatt

SEQ ID NO: 3179 - DNA, 8784 bp, Homo sapiens
ctctcccgctgaagcgggttccaaggccaccgtgagggggaccatccatccaggagagtactgggcaggctgcaaatgtctgtgttaaaacagctctgctgggctaagacaggacagaagcagacagcaggtggatgagacacaatttcctatccagcagaacctgcagcaagctccacagcaccctccatgggctcagtcttgctcccgggaagatggttaattccatcagctccttctggccggcagcaggaagagtggccctgtgtgtgccaggccctgcagtctctcctctcagctggtgtctccagtgagggacctgagtcatcgcacacatgagcctgtgctcagcctgcacatctcccgcctcccaccagctgctcctcaactgccagggccagactgtggcaaaatctcactcctctgccgatgctggggtttccctcgtgtctgggaggtggtgtgcttggtggcctgagcactgcagtgaatccatgtttccctcccagcaccctgttctgtcctccaacttggccgacagctctggccagggacgcagcccagctggtgcccaccccgcactctgtccatttcataagagcccttggtttcctcacttccctcagattttgccaagagaatggtcctggtgtggcccagaaaggccagcggggtgcagcctgggactgaaagcagaggcggctctggtggggaaaaagtagctctcccagcctagccctactggtgggcggcacctcctggctccaggccatcttttgtcccagtcctaggtaagaaaaacacaaacaaaagccagtcccatggcactcgagaagcaggaggccgttccctgacagcaacatgctgtgtgcacagacacacgggtggacaggaggcagagctcggggttgctgcggagcgggcaggacactggagcggcaggcagtgcggacccgccgggcagccgtgcacggttgtcgtcctcagcggcaggagccagtttgttgctcagggccttgtctttttacaaagagccccaggccccgggggcttctctgggtgcctctttgctgccatgtctgcacgcgggcggagagcagaccaggctaccgaccctctcgctttgctgtcttcacgtggaaaagccagtgtcgtagccccaaaggaggggaaactgtattgatttggggagcctctatgttgatttcaaaacagattgtctcctgtgttctcaaagactggaagcgaaccccacaaccgccttaggccacaaaagctttatcctttctaattagcatccctgtgacctgctctgcgccctgcagatattttgctcagccagccagaaggagggaggccagacaccagcccccacagacctgcggctgcgaccccctgcctggggacgatggggtcggggtccagtagctgccccagaaacaagtggggctgcaggaggctgatggtgagcttggaggttggcagaattctaaatctgggcactgcagggtccccacaggtcacgaccctactctgctccacccaggctccggaggacctgagcaggaacctctgcagggggggcccggggctccctgtcctctcagcagccggcagtgctccctgacagcccgggcctctccctccagtagttcggtagtttgctgtcaccaacatggctgggcctgggacaggctcctcctctccctccagaagccaggcagtccctcctgcctcagtttctcagactaggccgcctctcccatcgcgagacactgaagaccctcagctgtttccatctgcccagtctgactgctggatcgccctctgtgtgcgttggtttgctgtgttcttgctactcgcccttggataagatttcttctctactcatgaagctgcgtgtcctggagggcagggccgcacctcacatgcatgttgcccacatagctcagcaacagatgctctcacgcttgttaaaagtaaaaccgggccaggcgcagtggctcacgcctgtaatcccagcactttgggaggccgaggtgggtggatcacctgaagtcaggagtttgagactagcctgaccaacatggagaaatcccgtctctactaaaaatacaaaaaattagctgggcgtggtggcacatgcctgtaatcccagctactcggaggcaggagaattgcttgaacccaggaggcggaggttgcggtgagccaagatcacgccatagcaattgcactccggcctgggcaacaagagcaaaactctgtcaaaaagaaaaaaaaaaaaaaaaaaaagtaaaaccaattagccaatgtaaaggagtttaactgagcaaagagtgattcacaaatcaggcagcctcccgacccagagtggactcagagactccagcacagccatgtggtggaagaaaatttaagaccgaaaaaggaaagagatgtacagaaaatggaaatgaggtacggaaacagccagatttgttaagcttggggtttgcagtagttgaacatggttgaagagctggccaccttagattggccaaaactcagcgattggcacaagagtaggctacggtctgtttacaattccatttaggttactgttcgtgatgtacagagaaagctttaggtcgaaattaaaatacacaaggaggcagctttaggccacacttgatttgaaagctagagaggtctggtggaggctgcattctcctctccaggaagtacatttgtgggctgctaagccacaagataaggaagaacacaagacagctagagaaggccacgagctggacccaatacccacatattcaggagtaaacactggtgctgtgaaagggtcagtgcctccataaacgtctccacagacatagagctctgagcggacacggaccactacacacaacagagctacacacaacagagcttgacaagccacagagctccacaaaccgcagagctctctacagacacagacatctcctcaccacagagctttccaaaccaaagagctctccacatacacagagctctccacaccacagatctctccacagacactgagctctcctcaacacagagctctctactgacacagacatatttatagacacagatctccacacaagactctccacaccacggagcactctacactacagagctcaccagaccacagaattctccacagacacagagctctccacgctacagagctctccaaagacacagaactctccacaccagagagctctccacagacagagttctccacacaacgtagctctttacagacacagagctctccacaccacttaactctcaacagtcacagaaatctccacaccacagaactctcctcagtcacagagctacccacaccacatagctctctgcactacagagcttgccacattcacagacctctccaccaacacagagctctccagacacacaactctccatacaacagagatctccacagacacagagcttgccacaccacagaactctccacagaaacagagatccccacagcgcagagttcacagacacagggctctccacaccactgggttctccacagacatagaactctccacagatacaaaactccccacagacacaggactctccacagacacagagctcttcatagacgcagagctctccccaccacagagctcttcagaccacacacctctccatagacacagaactttccacagacttagaattctccacagacacagagatccccacaccacatagttatccacactacagagctctccacagacgcagagctctccacagacacaggactgtccacaccacagagctcttcaaaccatggagctcttcacactgcagagctctccacaccacagggctctccacagacactgagatctcctcaatacagagctctccactaacacagatctatttacagacacagatctccacaccacagagctgtccacaccacagaactcttcacagacacagagctctccacatacatggagctctccatagacacaaacctcaccacatacacagagctcttgacaccacagagctctctgcagacaaagagctcaacacaccacagagctctccacaccacatagttctccacatacagagagccctccacatacacagaattcttcacatacagagctcttcacaccacagagctctccagatagagagttcttcacaccacagagctcttcacaccatagagctctctacaacacagaactcttcacaccgtggaacactccacagacacagagatcaccacaccacagagctctccacagacacagagatccccacaccacatagttatccacactacagaactctccacaccgcagagctcttcacagacatacagctctccacagacacagggctctccataccactgagctctccacagaaagaactcttcacagacatagagtctccacatcactgagctcttcacagacacagaactttccacagacacgagactctccacagacacagaggtctccacaccatagacctctccacaccacagagctcttcacaccacagagttcctcataccacagagctctccacagacacagagctctccacagacacagggctctccacaccacagggctctccacagacactgagatctcctcaacacagaggtcttcactgacacagatctatttacagacacagatctccacaccacacagttctccacaccacaaagctctccaaagacacacagttcttcacaccacagagctctccgcagacacacagctctctctacagacacacgtctctctacagacacaaacctcttcacatacatggagctcttcacaccacagagctcttcacaccacagagttccccacattaagagagctccccacatcacatcacagagttcttcacaccacagagctctccacgtaggaagttcttcatgcctcagagctcttcacagcacagacctctcaacatacaccgagctctccagaccacagaactccccacatcacggaactccccacatacccagagctgtccacatcacagcgctctgtacaccacttagctctccacagacacagagctcgctacaatacagagctctccagaccacagaattctccaaatacacagagctttccacaccacagaactctccacaccacagagctcttcacaccacagcgctctcctcaccatagggctctccacagacacaggggtgtccactccacagatctcttcacaccacagagctctccacatacacagaggtctccacaccacagagctctttactgacacagaactctccacaccacagcaatctccacagacacagagctcttcataccacagagctcttcacatacacagagctcttcacagacatagagctctccacagagatgtccgcacagcagagcactccacatacacacagctgttcacaccacagagatctccagaccacagaattctccatagacacagaaggctctgcacacacagaactctccacaccacagagctcttcacatatgcagagctttccacagatagagctctccacagagatgtccacacaacagagctctacagagctgttcatgccacagagatctccaaaccacagttctccatagacacagaactcttgacatacgtggagctctccacattacagagctcttcacatatgcagaacacttcacaccacagagctctccaaaccacagagctctccccaacaaagctctccacaacacagagcactccacagacacagagctccccacaccacagagctctccacaccacagagctctccacatacacagaactcaccacagacacagagctctccacacaacagagctctccacagtcacagagatctccaccacagagctctccacatgcccagggatctccacaccacagagctctccacatcacagagctctccacatacagagtctagctctccacaccacagagctcttcacaccacagagttcttcacatacacagaactctccacaacacaaagccctcaacagacagcgctctccacaccacagagctctccacatacacagagctctccacatacacagagctcaccacagacacagagctcaccacagacacagagctctccacatacacagagctcaccacagacacagagctcaccacagacacagagctctccacatacacagagctcaccacagacacagagctcaccacagacacagagctctccacatacacagagctcaccacagacacagagctcaccacagacacagagctctccacatacacagagctcaccacagacacagagctcaccacagacacagagctctccacattcacagagctctccacaccacagagctctctacatacacagagctctccacatcacagaactctccacatacagagagctctccacaaacacagagctcgccacaccacagagatctctaaaccacagagctgtccacatacaaagagctctttacaccacagagatctccacacagcagaggtctccacaaacacagagctctccacaccacagagctcttgacaccacagagctcaacacaccaaagagctttccacagacacagagctctccacagacacagagctctccacagacacagagcttccagaccacagagctctccacaacacggtttttcacaccacagaactctttataccacagagctctccacagacacagagctctcaaggccacagagctgtccacaccacagagctctccacagacacagagctctccacatacacaactttccacgccacagaggtctccacatacagagctctccacagacacagagctttccacaccacagacacccatgtacttacccctaggtctgactccccttagcatagacccccaacacttaaattttctgcactcacactggcagctgtgacttcagcggcactgatgccctctacactgaccccctcatcaatgacatttgcagcactgaccttcccagcactgacccctctagcactgaccccctgcactgaccctttttgcactgaccactgcctgcaatgagcacccctcccctgataccacagcactgacacccatacgaccgacctccccagcaggtacatctcctgcactgacctccacagcactgacacccccagcactgactcccccagcactgacaccctcggcactgacacccccggcactggcacccccggcactgacacccccaacactgacaccccagcactgacacccccagcactgaccccccagcactgctccctcagcactgatccccccagcactgacaccccagcactgaccccccagcactgctccctcagcactcatccccccagcactgacatccccagcactgaccccccagcacagctccctcagcactgatccccccagcaccgacgtccaagcactgacttccccagcactgacctcccaggtactgacaacccaggtactgagcccccatcactgacactccagcactgaccccccaccagaattgctccctcagcactaatccccccaccactgatgcccccagcactgatgcccccaggtatgggtatgacacccatacaactaacaccccaacactgacactgccagcactaatgtccccagcactaacagccctgcactgacactcccagcacgaacaccccaacactgagacccccagcactcatacctccagcactgacagccctgcactgacactcccagcactgacaccctcaacactgagacccccagcactcatacctccagcactgacaccctcaacactgagaaccccagcactcatacctccagcactgacacccccaccactgagacccccagcactcatacctccagcactaacagccgggcactgacactcccagcactgacacccccaccactgagaccgccagcactcatacctccagcactgacagccccaacactgagacccccagcactgagacccccaacactgacacccccagcactgacacccctaacactgagacccccagcactgacacccccagcactcatacctccagcactgacagccccaacagtgagacccccagcacttatacctccagcactgacacccccaacactgagacccccagcactgacacccccagcactgacacccccagcattcatacttccagcactgacagccccaacactgagacccccagcactgacacccccaacactgagacccccagcactcatacctccagcactgacacccccaacactgagacccccaacactgagactcccagcactcatacctccagcactgacagccctgcactgacactcccagcactgatacccccaacactgagacccccagcactcatacctccagcactgacacccccaacactgagacccccaacactgagacccccagcactcatacctccagcactgacagccctgcactgacactcccagcactgacacccccaacactgagtcccccagcactcatacctccggcactggcatccccaacactgagacccccagcactaacaccccaacactgacgtccccagcactgacaccccaacattgacgtccgcagcactgacacccctggcactgagacc

SEQ ID NO: 3180 - DNA, 2946 bp, Homo sapiens
gctgctcccaccgccgcggcaacggccccggcccacggaggcggctggacggacccccgacggttggacgtacggactctgcttcgagagtaggtgagcgagcagtgccggggcgccccccatttcagcgcatctcgggggccacctggccgccctctgtctctcccgccccttaatgcttctgcaccccaccgcctgtccgtctacattcctgcctcagtttccgtctgtctctctgtcactctcgctgtataggttagggggagacagattgagtctcaattgccccccttggcgtggggctctgctctgggaccagcacccccatcccccatgtggactctagtggactctgccccctttaactgtagggccgcaggtgctcaggccagattccagaaccctgagggcattccaggcggtgggcagctgggccagccgtgcggaggtgggcatgactgtagcttctagctaaaccaggcatcggtccaggcatcggtggcggggagccaggcctaggccagcccgggcccacccagactggcccctaatgagctcccaagtggcctgtggggacttggcctcagttttgccagctgtgaactgggaccgtcgctgctaaggtaattggcaggtgatctgaaggacacctgccgcctcctggccttttctgtgaagtcgaactaggcccatttcctgggatgggaaactaaggcctagaaagaggccaatgcttccaatgtttgtccagggaagtggggacagaggcaggacagaatctgttttctctgcatcctcacatttcccagcaccttctctatggaggggggaagggctggtggaggagcagccccaggtgtaaacaggccgccagagtttatttcctgagccagtcccagctcagctggaggcgatgaacgccttgggaggccccaggggggccagcccagtggtggcggagcttggaccaatctaggtttgagctctgccacccgcatgatatcttgaaccagtttttcaattctgcggagcctcagtttcctcatctgtaaaacaggagtgggtcgtaactccccaagttgagggctgctgggggatcagatgcaggaatacaggccctgctcataacctgcctgactctcgctgtggctctgccccagtcacactggcctcctcctgtttctccaacaccccaggcgaggtcctctctcagggcctttgcatgggctgtgccctctgccactacggcaggtccgagggcgccaactttgaaacataacaagctccctggatgggccggacccaggacctgcacaggcaagggctgggaggggcagaggaggggccgctcagggacgctgtacctatggaaaccgtgaacaaagggctgtctccagccacacaaacacctgggtgaatcgggcactggccagaggctggagcagcctgggatacaggtggtgggtgagtgcctggacccctgcagggaatatggggccgggggggggacttgaaccctgctccaatggtggggtggctctgcagacgggtgcaggtctgaggccccgcggtacggcccctcccactgtgtggccttggaccgacggtcaggtgcccccagagcctcagtttcctcatccccgttcccccaggggtcagcccaggtgggtgaggggtcttttgattgcttgacaattcagtatggtgggttccggaggcctcagtgtccctgtctgtccaatggggccacgaaagggtgccttgaggacaaaactccagccgttgacaggggaacactcctcccagagagacgtcaacgctaaaaaatgactcacacttgcccaggtacagctcaggtgttacagacggggagcagggcaaggaggcagagcgagaggcaggaacggcccagttccacagcatgcctgccccttcccagcatctcccgacacccctcagcagatgacctccctggaatcacacccgctcgagctttgacgcagggacctctggcagagttcttgggatcttgtaaatccccagcttctaggcctcagtttccccatctgtccaatggggctggtcatctcctttttcttgtggggctgagataactgtggggagggagggtgctttgaggggtgggggagattcaacaagatattgttaaaagcccgaggaggggattacaggacacagtacttctagaagcttcctaaggcttcgatccttcccctctggggtgggctctgggagagacgagacttgaaccccaaatgtgccattgactaggatgaggaaaggattgcactaggttaaaggctgggttcaaattctgattctgccacatcactgctttataaacaggcaagctcctgaccctctgtgactcagtttccttataaccaaaaacttgcaggtccatctagagaatttcccagcctgggcaacatggtgaaaccctgtctctacttaaaacaaagaaaaaaaaattagccaggtgtggtgtcgcaggcctgtagtcccagccactctggaggctgaggtgggaggatcacctgagcccagggaggttgaggctgcagtgagccgagctcatgccactgcacttcagcctgggcgacaggagtgaaaccctgtctcaaagaaaaagaagagaattggctgggcgccgtggctcacgcctgtaatcccagcactttgggaggctgaggtggccggatcacctgaggtcaggaattcgagaccagcctggccaagagggcaaaaccctgtctctactaaaaatacaaaaatgaggcgggcgtggtggtgggtgcctgtaatccagctactcaggaggctgaggcaggagaaacacttaaacccaagaggcagaggttgcagtgagccgagattgcaccactgctctccagcctgggttgacagagtgtgagactccatctc

SEQ ID NO: 3181 - DNA, 4507 bp, Homo sapiens
gagggcgcgcgaggcgccgcacgggggaggcttctccgaaagccgcgagggcagctcccgtgtgtccgctgtgcaaaccggtccttccgccaaaaacctgctgtctggcttttctcagcaggactttctgtagatttagacaaactgattctaaatgcaccacacgtggaaaaatgaaagaagactcacataacccaacgttacactgactgtggagtgacagcgtgaggccagcttggtgttggagaaggggcagacacacaccgagggaagacgatggagatcccagaaacggacgcacacaaatatggctcatggattattgaccaaggcctccctggatggatgttgggagagtttacgcgtggccttgtgggatcgctgtggcggactctcagctatcagagggctccatcactccatcgtaaggaggcagctggtggcgagtcctgagcagggatgtgatccgacgggcaggcggcgcccgggacagaagctgacgtcacacaggtgagtcccccacctccccacaggcttcctccaccccctcggcagcccagcagggcctgtcaatcagtgggacctggtcagctggctgctaggggacctcaggcaggggggcttgtccgcagggcctccagcaaggggggacattcatgacacccagcagggctcaagaaggtgagacagagggacactgaacccagccctttacagaagacctgagtccaccgaggaagggggccaaccccctccccgcgtctgcatccccaggaccaccccgggtggagagggccgagtgtggtgcctccgcgggtgctctgacgatcgtctcgagccacgggggtgacagtgacaaggacctgtgtgcacgttagtggggcagccaggcctagctggagaagaaacacacacacgcacacgttcacccacatacacgtgcacacacatgctgccagttcagggggtggaggacgctgactccaggcccagctgacctgcgcggggccctattgtgatgtgtgcagccaccccatgacgtcaccggtgccaagtgccggctgtgtgcggagcagttggagacacagtgggtgtccgagggggggctctgcgtccggaggtgagaggtgggtctcaacacagctgccctcccccatggtatggtgacagtcactaacaggtggcctgcgctggcctccacgtggctgccaagggccatccctgagcactcagcgggtgcctgttccacacggactatgaaaatgactgtctcgttcacctcacggcgaccccgtggggtggatacgaactcacgccatttgacaggcgagacgtccgaggtcagaggggaggagacggacccgaccttccttggctgtgctctccagccctgtcctgtgctggacccaacctaacctctgcagcctccctgccctggacacaaatctggctgagaccccagaccctgatggggcagagcctggcactggaggagccaccaggatgggcccctgtgggtgtgggcagagggtgatcctcagttcaggtttttgccagaagatgggttcctgcaggagggggtctcagcagctcagacttcagatgcgctcactgctgctcactgtgggacagccagacacggagccctctgttctccagcagttgtggacaatgagggatccctggagggatgcctggtgggcagcaggagtccctcttgtgggtcagggtgcggggatgggctctccctgcagggacttcccagtcttgtcctctgggattggcagtttgcaggggtatcctcggcatcagaccaggggggccacacagggacccagatctatggggcccagccccgggaagaccagatgggctcagtggagaagctgaccacatctgctttcctttcagccaaaccggggagcgtcccggcacccaggcctctgcgggtaaccccaggcatcaagaccctccctcaaggggaggagctggctctcccctgcccatcagcacagctccagaatcccaaggggtcagctcccacatgggggcctggtcctgccacacactggcctagctgggctgtccccgaggccaaggcctagcggcatgagggggcttccgtggagcccagggcagtgggctgctctctggagtccctaggactcggggtgtggctggcctgtccccagatcaggacacaccccaggttgtccagtggttcccgtgctggaactcctgttgaagccacccagggacctggatgcttcccacagttcagcatggagcaggggtgctgggccctgacccctccacgtctgtcctggacaccccaggaccacagcacaggcccagccctgcaaccccagcggggccctgataccaggccctgcccagccccgtaatgaccaagaggcaggtccagagatacctcctgcacagggtcacctgcatctgacgcccccagcaggcagtgaccagcacggtgtggaaggagccagggtggcacccggcagccctagagggctcctggcctcgggaagtctatcgatggggaagctggtcactcggaggctgctggggagaagggggagtgtggcattccctggacagaagggcaagtgtggcgtcccctggagagaagggcgagtgtggcgtcccctggagagaagggcgagtgtggcgtcccctggagagaagggcgagtgtggcgtcccctggacagaagggggagtgtggcgtcccctggagagaagggggagtgtggcgtcccctggagagaagggggagtgtggcgtcccctggagagaagggcgagtgtggcgtcccctggacagaagggggagtgtggcgtcccctggagagaagggggagtgtggcgtcccctggagagaagggggagtgtggcgtcccctggagagaagggggagtgtggcgtcccctggagagaagggcgagtgtggcgtcccctggagagaagggcgagtgtggcgtcccctggacagaagggggagtgtggcgtcccctggagagaagggccagtgtggcgtcccctggagagaagggggagtgtggcgtcccctggagagaagggggagtgtggcgtcccctggacagaagggggagtgtggcgtcccctggagagaagggccagtgtggcgtcccctggagagaagggcgagtgtggcgtcccctggacagaagggggagtgtggcgtcccctggagagaagggcgagtgtggcgtcccctggagagaagggcgagtgtggcgtcccctggagagaagggggagtgtggcgtcccctggacagaagggggagtgtggcgtcccctggagagaagggcgagtgtggtgttcgctggagagaagggcgagtgtggtattccctggacaaaagggggagtgtccctgcagccctggccagccagcggcatgccctgctagctctcccccaacctcagggatagggaaccctgacagggcacaagtccccgtcccagaggggcctggcccagcctcaacccgggccctgggaggggaggggcaccaggggcgctgtgggcccccagcagaagccaggatgaccacacaggggactgagctgtctgtggctgtggccagacctagaacttggcccaaggcagggcaagccccttggagcagagtgggtggcagagcctgtgtatacccagcaaggctgagccagtgacactaccaggctccaagagcaaccagccatgaggcaggcgtggggcaagggtagggtgagggcaggggcgggggagagtggggcaggagcagacggaccagctgccaacctcgtccactccaggaggcagggatggccaggctcccacgccctactggccgctacccgaccaccaatgaggcagaggcctgaggccagtcggtgctggagccctacttccaaggtccacagaccgcttcaggccacagagccgaagaaaactgggcatgtgaaggcccaggaggcggggtccctatgtctgccattcttggcaggtgcatttcacgctgggagcaagtcaggaaaggtgatgcctctcaccgccaagaaggctcccagcagagaccagagccaccggcacagatccccaacccctgaaaccacctccctctggaggaccaggacgccctcctagttggtagaagcacagtaagctctctgtccttatgatctgcctgcttgtccagagctctctgccagaagccgtggacactggggcaggcgggaggagagagcaccacagcccagacccctgaccggcctctcccaacctccccctcccaaaggctatggagagcccagggctggacaggcctgaggttccgacatacctcatgccaggccacacgcgcaccgtgtcccaccctcagccgaaaaccaagatcaagaccatccaataatttactgtgatcccatctgtgcccgacaagggcccacagaggcctgggaggggagctaagggctggggttccggtg

SEQ ID NO: 3182 - DNA, 924 bp, Homo sapiens
accacacacacaccacactacacaccatacactatacacataccacactacacagtacacaccacacacactacacaccacacagtacacactgcacaccacactacacactacccaccacacactacacacacaccacactacacactacacaccacacatactacacaccacacactaaacacatacgacactacacactacacaccacacactacacacacaccacactacacagtacacaccacacactacacacacaccacactacacactacacaccacacacactacacaccacacactacacactacacaccacacacggtacacaccacacactacacacacaccacactacacactacacaccacacactgcatacacacactacacactacacaccacacacacaccacactacacaccatacactacacacataccacactacacagtacacaccacacacactacacaccacacagtacacactacacaccacactacacactacccaccacacactacacacacaccacactacacactacacaccacacatactacacaccacgcactacacacataccacactacacactacacaccacacactacacacacaccacactacacagtacacaccacaccacacactacacacacatcacactacacactacccaccacacatactacacaccacgcactacacacataccacactacacactacacaccacacactacacacataccacactacacagtacacaccacactacacactacacaccacacacacaccacacacactacacaccacacactacacacgcaccacactacacactacacaccacacactacacatacaccacactacacactacacacaaatactacatacacacaccaca

SEQ ID NO: 3183 - DNA, 14191 bp, Homo sapiens
attcgctgtgtgactcagggcaagtgtgcgcacctctctgagcctccgcggccttctctagcaaaatggtggagccggtacccggctgtaaggcctgttctgccccacacagcagaaaatgcccacgatgcaataccagagtctgcatgggaccatttcaacaacccttagaagctgactcagctgtctcctggccctgacttttctaagatgagaggagctggtaggaacaatttgggaaccctcaaaggctgagagtatcccacccacttcacagatgaagcaaactgaggcccagagaagggaaattacttgcccaagatcacccagcaagtaagaaacagagctggagatgagctcaggccagcacggaaccacgcaaactccttctgtaggctttgtaaaggattgatgagaaaagcagatggttaagagctctacaacttctgtgagtttctccacgttggtcaggctggcctcgaactcccaccctcaggtgatccacctgccttggcctcctaaagttctgggattacaggcatgagccactgcacccaacctgaataatctattagagtctttatctctaagaagagaaatacatctgaactaaagggtaaaaaatggcatgttttaattggtaagtctaaatgcaaaacgatgacaataaaattttaaaggactgcttccttcttaagctttattttcgtcctctgtcagtgtattgctagactcatctttcccagacacccagacctcccacgagagtatgtacattccatttggcttgatttcaagtgctaatgtataaagcttctgggttctgggtctggcaagctatttctcatgttctctgataaaatattgaaaaccatctctaaggtcttccaagaggggatatgtggaagatacatttcaattttccactgcatttcaaccttaatataatgtgattagctacagcattgaaaattagcttaatactggcccatcttattataggggccaaggaaaaactttccctttatcctctgaaggtccactgtaatcaactgacacaaaaggcagattaatagaagaaaaggcataaccattttattttaatgtacatagcacaggagaactgaaggagaatgattaccctgctatcttaatttaattccaatgtggtctgagagcagacattgtatggtttctattattataaattggttaagctgtgctttatggcccagaatgcagcctgtcttagtgaatgttctgtgggagcttgagacgaatgtgttttctgctgttgctggatgaagtattctatagacaccaattatatccagttgattgatggtgttgttgagttcaactatgttcttactgattttctgcctgctgaatctgtccatttctcagagggatgctgaagtcttcagctatactagtggattcatctatttctccttgtaggtctgtcagtttttgcctccatagtttgctgctctgttgttaggcacatacccattaaggatttaactatgtcttcttggagaattgacccatttatcattatgtaatgtctctctttatccctgataattttccttgctcagaagtctgctctgaaatgaatatcgctactctcacattcttttcattagtgttaacctgttatatctttctccatctctttacttttaatctatatgtgtctttgtatttattttttatttttttttaattttttttttctgtggggtcagccaggagagaggggggacaggtgactggtccatccctgaggcaaggatcccagcacctaccaggcttcccccgagaccaacactctgcagctctgggaggaagtggagagccccagagtctggcgaacttggcaggacgtgagagaacagctcaagggagaaccattccagtcccttccatggccccaggaggtgggagacaggccctccccattctgcaggtgagaaagcaaggctctgagagggacagtagcttatataggggacacagcacaggcaggtggcagaggcagaaataaaacccttgtgggtggaaggcgcaggttcttccaccccatgggagtcccaccatggctggctaggaggctgagatacccacaaggaaaagcctgaagtggcagcagagcctggagatggggctgagggaagaaggaggaggagcggggagagggagacaggtgtctcaggagacagaaccgcagagtgagtttagtgcttggggattaggctgactgacctggctttgccacttactagctacatgtccctggcataggacctagtgtctctgagcctcagtttcttcatccaaaaaaatggaaatggcaccaccacagggctgctgtgtcatacgagaaggtactgtgtgtgggcgatgcatactctctgcccactacctatggggctgggctgcccgcccggctcgcagtggcacacctgcacgacaccgagcagtgaggagcagcgagtctttgttgagatgggctgcaagcagccctctggtccagatgaactccctcaggccgagcctcatctcacccagccccggctttcctccttcccaagacacggggcctggggaagaccctgccctgtccctgcacgaggccttgatccttgcctacagttttctgactgttgtgtgcttcaaggagatgtggataaggatccctctcctcatatcaaacctggtgcttctaagctgtgcatgctgcaggagcgcctgtgggcatggaggcagcaggcctatgtctggattctgccctctgagggccactaggctgcatggggtcatcttctaggctcactctcctaccacagagctgctaccaaggaaccccagtccaaagcgtggctgcaagcctctcattccccagactgagcctgtactgtttggttgtctcatgaagacaaatatggaagagactaatggaaagcccaaaagagaagctgagatgtggttcgccatctgcctttggtcttggcagcccagggggtttgggcccttttttttttttttttttttaaacacggagtctcactctgtctcccaggctggagtacagtggcacgatctcagctcaccacaacctctacctcccgggttcaagcgactctcctgcctcagcctcctgagtagctgggattacagccacatgccaccacacctggctaatttttgtatttttagtacaaatggggtttcaccatgttggccaggctggtctcgaactcctgacctcaggtgatctgcccatctcagcttcccaaagtgctgtgattacagttgtaagccaccgcgcccggctggtttgggccttttctgtacattgcctgtccctgtaggggctggcatgctgtcctgggttcatcccagtgcccaggtccactgacagtatctagcttgaggtgctagcgtagccagctgagaccaaaccccagggagtggctgataatctgaatctccagtactctccctgtccctcccactctggagttaagaacatgttccccaggagaccaggtgatactccactttcagctgtgtgccctcccctgttgcctgggatggctgtgacttgggccccaacaatggcagtagtgccctctatcaggatcccctccccaagtgatggggccttcagtcagggcatggtgggcagtctcttgagggccaggcaggcctctggtgtctttgtatttaaagtgggtatcttggccgggcgcggtggcccacgcctgtaatcccagcactttgggaggcccaggcgggtggatcacgaggtcaggagatcaagaccatcctggccaacatggtgaaaccccatctctactaaaaatacaaaaattagctgggcgtggtggtgcgtgcctgtaatcccagctactcgggaggctgaggcaggagaatagcctgaacccgggaggtggaggttgcagtgagcagagatcgcaccactgcactccagcctggtgacaaagctagactccaactcaaaaaaaataaaataaaataaaataaaataaaatagagtatcttggccaggcatggtggctcacgcctgtaatcccagcactttgggaagccgaggcaagtggatcacctgaggtcaggagttcgagaccagcctggccaacatggtgaaaccccgtctttactaaaaatacaaaaattagctgggcatggtggcagttgcctgtagtcccagctactcaggaggctgaggcaggagaatcgcttgaacctgggaggtggaggttgcagtgagccaagagcgtgccactgcactccagcctgggcaatagagagagactctgtctcaaaaataaaataaaataaaaaagtgttctttttttttttacacagcgtatagttgggtcttgtttttggttcactctgaccaaatctctgtcttgtaattgatatatttagatcattgatgtttacagtgattattgatgtagttggattaatatataccatatttgttattgttttctcttcattgcccttgtatttttgtcttccacacattttcttcctttttagacttaagtgagcattttacataattacatttcgtcttattttcagcatattgatattgattatacttactttttttttttttttttttttttggagatggagtctcgctctgtcgcccaggctagagtgcagtggcgggatctcagctgactgcaacctctgcctcccgggttcaagcgattctcctgcctcagccttccatgtagctgggattacaggtgcatgccaccacgcccagctgatttttgtatttatttatttatttttttttagtagagacggggcttcaccatgttggtcaggctggtctcaaactcttgacctcattatctgcctgcctcagcctcccaatatacttactttttaaaaattttttaggctgggcatgctggctgacgcctgtaatcccagcacgttgggaggctgaggcgggcggatcacctgaggtcaggagtttgagactagcctggccaacatggtgaaacctcgtctctactaaaagtacaaaaattagctgggcatggtggcgtgtgcctgtaatctcagctactcgggaggctgaggcaggagaatagcttgaatccaggaggcagaggttgcagtgagctgagatcacgccactgcactccagcctgggcgacaaaagcgagactccatctcaaaaaaaaaagtttttttagtgctcgccctagagtttgctgtatacatatacactaatcccagtccactttcaaatggcactattctgcttcaataatgaaatattcctaattcctccttccatcccgtttcactgtattcattttgcttatatatagctatattcattgttgctattattattttgaacattctcttatttgttagattaagaataagaagaataaaagtattaattttctctctacttgttctttctctattgctttctttctttaagtggatctgagtttctgatctatattattttccttctctctgaataacttctttaaacatttcttgtaaattaggtttactggcaacaaattccttcaattttgtttgagaaagtctttgtttttctttcactttttaaaaaacaaagccgggcgcggtggctcacacctgtaatcccagcactttgggaggccgaggcgggtagatcacctgaggtcgggagtttgagaccagcctgaccaacacggagaaaccccatctctactaaaaatacaaaattagccaggcgtggtggcacatgaggcaggagaatcgcttgaacccgggaggcggaggttgcggtgagccgagctagcgccattgtactccagcctgggcaacaagagcgaaactctgtctcaaaaaaaaaaaaaaaggaatataatttttattttgttaatataatcaagtacacaaattgattttctttctttctttttttttgagacggagtcttactctgtcacccaggctggagtgcagtggcatgatcttggctcaatgcaatctccacctcccaggttcaagcaattcgcctctctcagcctcccgagtagctgggactacaggcacgcatcaccatgcctggctaatttttttatttttagtagagatggggtttcaccatgttggcccggctggtctcgaactcctgacctcaggtgatccaccagccttgacctcccaaagtgctgagattataggcgtgagccactgtgccaggccacaaattgattttcaaatactaaaacaaccttgcattcctgagattaaactctattcagactagatttattaaactttatatatatgtctagatttgttgactttttttttttgaaatggagtcttgctgtgttgcccaagctggagtgtggtggtgccatcttggctcactgcaacctccgcctcctgagttcaagtgattctcctgcctcagcctcccgagtagctgggattacaggtgcatgctgccatgcctggctaatttttgtatttttagtagagatggggtttcactatgtggccaggctgatcccaaactcctgacctcaagtgatctgcctgcctcggcctcccaaagtgctgagattaacaggagtgagccactgtgcctggccaacttttttcttttagagacagggtcttgctatgttgcctcaggctggcctggaactcctaggctgaagggatactcccacactagcctcccaagtagctgtgattataggcacatgccacctcacccagttccttcacttttgaaggaaagttttcaggatacagaatactaagttggtgggtttttttctcccaacatttaaaatattcacttcattctcttttagcttgcttggtttctgagaattcagatgtaatgtctttgctcctctataggcaagtttttccccactgtggtttcttttttaaaaaatttttcctttttttttttttttttttgttggccggagtactgttggctacccctctgctttcattccaagattttttctttatctttgattttagattttatgcagtttaaatatgatatgcctaggtgtagcatttggggctttgtgtgtgtgtgtgtgcgcgcgcgcgtgtgtgtgtatgagggcgagagagagagagacagagagagagagagaaatctctgagtttcctggaactgtagtttggtgtctgacattaatttggtgaagttgcagggtgcggtggctcatgcctgtaatcccagcactttgggaggccgaggcgggtggatcacctgaggtcagtagtttgagaccagcctgaccaacatggtgaaacctcctgtctactaaaaatacaaaaaagttagctgggcgtggtggcaggcgcctgtagtcccagctactcaggaggccgagacaggagagagaatcgcttgaacccgggaggcagaggttgcagtgagcggagattgcgccactgcactccagcctgggtgacagattgagactctatctcaaaaaaaaaaaaaattggtgaaatgttcagttatccttgcttcaagtatttcttttgtcctcttttctccttcagctattcccattatgcatataatatagcttttatagttgtctcacagtacttggatattctttctcatgttttttcagtcttttctctctttgcttttcagttttgaaagtttctactaatatatcttcagtctcagagattctttcctcatctgtgtccaatgtactaatgagtccattaaaagcattcttcatttctattacagtattttttatctctatcattaaaaaaaaattctttcttagaatttttgtctctgtggttacactgtctatatgtgcttgcatgttatctactttttccatcagagcccctaacattaattatagttgttttaaatttttagtctgataatctcaacattcctgtcgtatcccagcctggttctgacgcttgctctttttcttcaaagtgtgtgttttgcctttaatatgtgttgtaatttcccattgaaagccacacatggtatactggtgttggggctcagaaaccgatacaacaaaatatggtgctttgacatgccaaactgaagaagaagcctcaaggtctctctgaccttccctcatctcctgtctctcagtcctcccgtccctcccaaagcacatgataaagttgttttctgaagttcccctatctgcctaaagtccagttccgccaaagaagaaaacaattacctctagtcccttctttgagttttcattaactgaattcatgtcacaggaagaaagacccaagtctgtcaacaaatccagacagactttttttttttttgagacagagtctcactctgtcgtccaggctggagtgcaatggcgtgatcttggctcactgcaacctctgcctccgggttcaagcggttctgcctcagcctccccagtagctgggactataggctctcaccaccacgcctagctaatttttgtatttttagtagagatgggctttcaccatgttgaccaggatggttagacagacttttgtcacaaaccattgtctgctccgcaggcccaacagactttgttcaaggaaattgtatgttcttcaagcccattgaattctcctaaaactcatttcctatcccctaaaatcattatagtttcccatcttcctttcccctaagaagaagggtatatagtgctcgctttggcagcacatatactaaaattggaacgatacagagaagattagtctggcctctgcgcaaggatgatatgcagattcgtaaagcattccattttttttaatttaaaaaatttataaaagttttaaaaaaagaagggtaccatcttactccattgggatattgggtaatcactctgtgattctcccctgtgcatgctaataaatttgtacgccatttctcctactaatttgccttttgtaagttgatttttttttttttaaaagacagagtcttgctgttgtcgcccaggctggagtgcaatggcgcaatcttggctcactgcaacctccgcctcctgggtttaaatgattctcctgcctctgcctcccaagtagctgagattataggcgcccgccaccatgcccagctaatttttgtgttttcagtagagacggggtttctccatgttggccagactggtctcgaactcctgacctcaggtgattcacccaccttggcctcccaaagtgctgggattacaggtgtgagccaccaagtccagcctgtaaattgattttttagtgaaacttcagagagtgaagggaaagttttcccatagctcctacactgggtaaaaggaattcccgtaaaataggcctttagtcatgtggtggaggaggtgtggggcaggggtggcgttccacagtcctgtgattagctctcactcttttcatgagcctgggaaccctcctgggctgtgaagttcaccagtgcttctccatttttttctccccttaggtgggacagagatgggagtggaattggctatttcccctccctcaggtcagctaggctctgataaagctccagaagattgggctgggctaaaatagtttctcttgagaagcaggccttgttaagaacagaatgctctggcatatttcaaaatggttacttttcccatccccctgctgaaagcacaaggagatttttctctgacattcactgggaggactcgatagagatcctgaagattaaactcacaaacatgtggggacgcccctatggctggctcttgctggaatgtttaatgttcagatttgcccacgctgagcctccagctattcttcaattacaggttaggttgtcctgtcctggtaccggttctagagcaggtttctacttgggggtttctccttctctgtctcttcaattttgagggcagtgatttgccctgtgacctgactcctctaaaggatctaagaagaattgttgattttccagtttgctaaactttttacttattattaggacagagagacaacgtccaagccccttacatgcctgactggacactagacgtctcactaccatgtattgaacacccaggtggaagtaagcactttttacatattatctcatttaatcctcacattcaccctgtgaagtaataccactaccccatgttgtagaggtgattcttatggctcagcaagaatttagtgactccctcaaggtcacacagttagaaagtaggatttgagccgggcgcggtggctcatgcctgtaatcccagcactttgggagactgaggcaggcggatcacgaggtcaggagatcaagaccatcctggctaacgtggtgagaccccgtctctactaaaaatacaaaaaattagccaggcgtgttggtgggtgcctgtagtcccagctactggggaggctgagacaggataatggcgtgaacccgggaggcagagcttgcagcgagctgagatcacgccactgcactccatcctgggcgatagcgagactccgtctcaaaaaaaaaaaaaaaaaaagaaagtaggatttgaacctcagtctgtctgttaacaaagtcagtgtgtgtcccgcgcaccatgccatgccccagaactaagcagattcggattaggtcttcagacccagaggcagacaaaagccagaaacagagacaggagcccaggccaaaatagaggatgggacccagagcctccgaaagttcccaggatgtatgtttgacagaccatcccccaggtctccagaggtaagtgttgaatccccctttttcccctttccagctgcgtcacttgggtgagcagctttacctcttctagcctcaattttttggtaggtagctcagggcctggcaaatagtaactgctcgaaaaatggaagtttgtcattgttgttgctaggtagtggctaatgttaccagctgggaggccgtaagtgctaatcccctccagctctggccaggtgaggtcagtaactggagatgaggtcagagcccttagaggaaggcaccctgaccccagctgggctggctggagaggtggcagcattggaacctcggtgaagaagcattctgttgacagttataatgagatatgccagctctagtttcccatgggcacaccagttacctcctctccctggtaactgacccagttggcacccagtgcctgagagcttgacggcacagtaggatcagtctttctctgggggcaggtgtgccagctggtataaaggaagaaaagcctccccgctccagtgcagagccagctctgacacttcctgaccaactccaatgccaactctgacaccgcaaacttctgctttttcagaacggagtcacagagactagatttaccctcccttctgaaatgccttaaaatacaaaaccaaacagacagacacacacacacacaaaatggcactcaagacactatctatacattagataatggcaaacagtgatcaatgagagaaacgaagaaatacaggttagtcctactgacttgtcacctggagaaaattcccatgccatggctcccctcattaacaagacatgtccaggggcctgggggaagccaaagaggctgaagtttgtaaggcagagcactggagagaggagaactacagagaaagagcactggagacactcagagggtcccccttaactattcagttgagtatatatatatatatttttttgagacggagtttcgctcttgttgcccaggctggagtgcattggcgcgatctcggctcaccacaacctccgcctcccgggttcaagcaattctcctgcctcagcctcccgagtagctgggattacaggcatgtgccaccaccccggctaattttgtatttttggtagaaacggggtttctccatgttggtcaggctggtcttgaactcccgacctcaggtgatccgcctgcctcagcctcccaaagtgctgggattacaggcatgagccaccgcgcctggcccatacgtagaattctttgagcaaacttttcacctgctaaacctttgctgctatcgtcatcatcatcatcatctacctcagagggttcctggggacctgaaacaaggcaagctatacaaactgtttgacacaggcatcactaaataattatggggcagagtgatgcatgctgggatatagaatggtgggaggtgctgggagactcacaggaaagagaaaagacttctgactggctggttggaagaaagatgtggaaggcttcccagaggaaatagtgttttagctggcctcagaggacatgtgtggaagtttcccaggtagacaagggggatatagaaagacgaacttgtgtgaagactcagatgtgagagagcctaagcatgtcgggaacatggagtggtttcatgagactgcgtgtctgggtgagggcaaggtgtgagcctgcacaggacatgggggccggatggcaaaaggctggaaatgccttgcctgaggttttaaacttgacctggcaggtgaggtcctgttaatatggcagaatcacaaagggcacttaaaagaacaaattctgtggtcctacccggcaacattctaagtcagcaggtctcagatgggacccagaaatctacagtgtttatttttatttatttgggtttttttggatacagggtctcactcttgtcactcaggctggcgtgcagtggcacaatctcggctcactgaacctcaacttcccaaacttaagtgatcctctcacctgagcctcctgagtagctgagaccacaggtgtgtgccaccacgccaggctaatttttttgtatttttatttttttatttattttgagacggagtctcactctgtcgcccaggctggagtgcagtggcacgatctcagctcactgcaaccactgactcctgggttcaagcaattctcctgccttagcctcccaagtagctgggattacaggtgtgagctaccacgcccagctaatttttgtatgtttagtagagatggggttttgccccaggctggtctcgaactcctgggctcaagcgacactcaggcctcaacttcccaaaatgctgggattatatgtgggagccaccgcacccggcctacaatgtttatttatttactttatttatttatttatttatttaatttattcactcctctcagctcatgcctaaggaatctacagtgtttaaagctccccagggccaggcgtggtggttcacacctgtaatcccagcactttgggaggctgaggcaggcggatcacctggggtcaggagttcaagaccagcctggctgacatggtgaaaccccatctctactaataatacaaaaaaaaaagctgggcatggtggcatgcacctgtagtcccagctactagggaggctgaggcacaagaatggcttgaacctgggaggcgaaggttgcagtgaaccaagatcgcgccactgtactccagcctgggcaacagagcaagacagagactccatctcaaaataaataaatagaaggctctccaggacattttgatgcccactgggatatgggaactcctgccatggggaggagggcgtctttaagaaggaataggccctattgagatgccagctgtagacctctaggagttgaccatcgagcctgagaaggtaaggagagggtgtaggagacccctgactctgacctccaccctctcattcctctccagggcagtcccgcactctgatggccacatctggtgccaggtagtttctcgtaaagatctacactcacattacaacctagacatcccactagtaggtatttacccaagacacctgaaagcatgtgtgtacccaaagactcgtaaatgaatgcaactctatatgtaatagccaaaattagaaacaatccaaatgttcatcagcaggtgagtggtaaaacaagttgtgatatgttcatacaatgttgctactcagtaataaaaagaaatgagctacagatacagataaggaaacttggaggtgatatgttcataatcttgtttgggtcaaaggtttcagggatgtatacatgtgtcaaaacatatcaaaccgtataatttaaatacgtgctgcttattgtatgtcaattatatctcaataaag

SEQ ID NO: 3184 - DNA, 21197 bp, Homo sapiens
ctctgtggtccttccgccaaaacatctgggctcctccacctccccgagcccaaatggccatgcaggtcgaacaccagctctgaagtgggcagggcccccagggaggacagccacgggagctcaggcagcgtccccgccggcacctgcctctttgtgcagcggcagtcagggccctcggcaatgagctgaactcgcagtgcggttacgagggcaaatatgctccttgagggccggcgaaactcagcagcccgaggaaggctactgatgtgcatttcatagccggctgcgaatttaggaaaacagactttgcttctcgtcactcagcctacgtgaccaggttcagacacagtctgcagccgcccgcctcgcacccccactctgcagtgcggtatgtggggagctcagggcacagcaggccaggcctccccgtggacgtccaggaaccagaaccaaactgcccagggccccagaggggaagatgtctcagcagacggacagccgaggctcacatggcaagctctggcagcctgtcggtcccaggagagagggggaggtgagtgaactgagggagggccaggtgacaggtcacaaacaatgaaacttcctctgggcacagcagaggttggttttgttttgggggtgatgtggcgcggcactgttgcttggggaatatttggtttttgtcttattttgtgggggtcgtggagcagtgctgctgttctaaggatgtttggtgtctgtcgtattttgtgggggttgtggagcagtgctgtttttctgggagttatttggcttctgtcttattttgtggggttgtagagcggcgctattattctggaaatgtttggtttctgtcttattttgtgggggtcgtggagcagtgctgctgttctaaggatgtttggtgtctgtcgtattttgtgggggttgtggagcagcgctgtttttctgggagtatttggcttctgtcttattttgtggggttgtagagcggcgctattattctggaaatgtttggtttctgtcttattttgtgggggtcgtggagcagtgctgctgttctaaggatgtttggtgtctgtcgtattttgtgggggttgtggagcagcgctgtttttctgggagtatttggcttctgtcttattttgtggggttgtagagcggcgctattattctggaaatgtttggtttctgtcttattttgcttcgcccagcctcggcctgctgtgtttatggttaaaataactctgtgggcaaacccgagtctccagctctcatccgctgtcccctgggctccctcacttcctttcatccacagcgcccactgcaagtgatattcttataatacactgagcaactattttagtaacacagaaactttctggggatatgacccactttaaacagttatctagggagagggaagaaagtgatttcgctccaggcctgggcatctcctttcacccacatttcattttgcttaatcccacaaaagccgcttaaccgcacctgccatgttttcccagacagccttgcaaacatgcgagggtggttactggagccttctcggacccgcgtgattccaccaccgtgagatgcaggaactgtctagatttgcagacagagcttgtccttgacccccaaagctccagccctgccctgtgggcgaggagctttggtgaactcagctcacctcagtgctgcaaggttatggcaccccacactcatgcgcctcccaggtgcccagcttcttcactggaggaggggacggtgaccaggctagggcccttggtacgggctgaggagctctttcctcactttccctggagcccgtgttctgcaagatcaggtcgactgaagcacatcagcttctgtcccaggcccctctgcggatgagcaagagctgctgaccaatgggagtgacagctcagcacaccagccagcggcccagcggaaacacgttctgcaggctcatcttgggaaaacttctactcacatacaaatatgcattagagtcagggtctcaccctgtcacccaggctgcagtgcagtggcaccatcatggcgcactgcagcctcgaacccctggcctcagcctcctgagcagctgggactctgaccccatgtgcaccaccacacctggctactctttccttttttgttgttgtttttttattttttgtagagatggggtctcactatgttacccaggctggtctcaaacttttggcctcaagaaatcctcctgctgtggcctccttagtagctgggatcacaggcatgagccaccgtgcctggctaattgttatttttattttttgtagagatgggggtctcactatgttgcctaggttggtcttgaactcctgggctcgagcaatcctcccacctcagcctcccaaaatgttgggattacaagcatgagccactgtgcctggcctgcaaagttatattttagttaagctttttcaacctcagaaaataactggaggcgcccaacttccactgagcacctaggctgggaaataggcagcagaccagctctgagctttaagatgtctgggatagggcaggagctgagaggcatttgggactaaattttttttttttttaggtggagtcttgctctgtcgcccaggctggagtgcagcagcgcgatctcagctcactgcaacctccgcctcctgggttcaagcgattctcctgcctcagcctcccaagtagctgggattacaagcgcacgccaccacacccggctaatttttgtatttttagtagagatgaggtttcaccatgttagccaggatagtcttgatctcctaaccttgtgatccacccaccttggcctcccaaagtgctgagattacaggcgtgagccaccgcgcccggcctgggactgattcatttggggtccagcccactcccttaaggcaggaggctgcaaagttgctggggcctgcattccaggccacaccgctggccagtggtggaagctgagccacctctctcactttcctgggcctccacttcctcatgggtaaaagtggaaggaaaaatacctccctctgcaaaagggttgagcgagatgatgcaggtgaagggtgtggtcctcaatgagcccttaacacatgccagccatcatattccagccctgactatgttggtcatcagcagagctgtggccttccagcttcatcctgacatgcggaggccgcctttcagaaactctcccaagcaccttcccccagcatctgggccctgggcatggccactgctcaaagtcccagacgaggccatccatcaaagctgtacttggcaacagcaagtaagagaaggttgtcagggcactgcatggccccaggcccccctcctctgtaagtggaccatcagagccaaacgtcagggctgagcaggcctggagaccagcgaccccagcctcctgcaaccctgccaggccaggaactaacagcagttccagaattgcataggatttcctcagtgccttctaggcactgggcctgctctacatcccaggatactatggggaacatgtgggactctgtccctactctcacatggagcctggcagttagacatgacacaacccacaaacccaccagccaaccaaccaacatccagattccagaacgacaggggatggggacagggtgggtggagggcaggaaaggccctccaatgaagtgaggcttgaatagagagagacagcaagtcctgactctctctgggagaagactgttctaggcaaagagcatgccaagggctcaactggaagtcatcatgcccagactcaagcaaacaggacacgtgtatctagttcactcagaatgggagctagaaggggctttgacatcagctagttcattaaggtcctcacattgtcaccatcgtcattactattgccatcataatcaccatcatcactatcatcaccaccaccacatccaccatcgtcaccaccaccagcaccagcaccaccactaccatcactaccaccactgtcaccatcaccattaccatccaccaccaccaccatcaccgctaccaccattaccaccatcagaagcaccatcaccaccatcaccaccaccaccactgccaacatcaccatcaacatcaccaccactaccatcaccaccaccaccaccaccactgccatcatcaccatcaacatcaccaccactaccatcaccaccaccatcaccaccacttccattacagccatcagaatcaccatcatcatcaccatcactaccaccatcaccaacaccaccaccatcacaatcaccaccacatcaccatcatcaccaacatcaccactaccaccactaccatcaccaccaccaccatcaccatcgcagccaccatcatcaccatcaccaccaccgcccccactactcataagtaagggtgatgataaaagcaccagccacgttagcagatccctggttatagttccagcatatgtgctcaattctttacagtcaggaccccactgtattctggaaacaactccaagagacagggactatcgtgtctccatcttacagacaaggtgagggaggtatggaaaggcaggagtacatacatgtctctaagggggagggcacttggcctggtcttggccatcccttgccagctccaggatgctcctgtttgtggctgcaggagcctccacacggccataactaggtggcaccgtgtccatttccccctcctcctctcatgccatggtgagacgcacactgagagcaggacactgggggcagcccttcctgctgcccgctgctgggccattaggccctgctgacacctagcagggcggaaggcctggcagtggagagaagggagcagatgttcccccaacactgacctcgcaccttggaaagaagcaagatgggaggagctgagagggaggacggtgctgagcatggctgaccccgagggctgggctgccgaggtcctgcagaagctataataaggctgtgcaccaacaagctcacagagcaaaccacccccaaaccagcctggaccccgtgtgcacatgcccccaggcctccaagccggatcctgcgggccaacctgcccctcccccagccgccaaggcttccctcccagcctctgaccctgcgccctgtggggcccagccttcctaaggaccgcagagggtcctgggtcagctgtgggcacaggcccggatgcctgcagcattgcaggggccacgggatacagcgctccctcaccggtgaggcattgctgggcctccccaggtgggacatgtactcatggtgcctgtggacctgcaggaggtcccccagaggcttcccgcccccaggcccaccggagcccccatacttattgctgatgtcctcgatcttctgctcgggccgctgcttttgctggaactgtcggttctggaggtagttctccttcaggtagatctcccaggatagcagggccgcctcctcgttcttctccagcttgttctctgtcagggtgggcggacagaccaggggacctggaatcctcaggaggtgggccctgaagccctgacccaccgggggggccccgtgggagggggccagtcctgagtggcaggaagagcccatcgcacacctgcccccaagggggcctctgggctcagcccccaccacttgctcaaggccagcagaaggccagcagcctgagtgacctgcacgcctgctgagcgtccagggttctgggcagagctgccatgccatctccaccccctctgcacccgggtggccaggacattcaggagaggcactggggctggcatactgagctgcttgtgcctcttggccggagtcttcaggaccaccctcttgatgaagagctgcaggtggctgaggaggatgaaggggggcggcgcggcggggcggccgtggtactcctcgatcaggtcatggcgctggaacttccaaatctggtccgtgtgctcctgcacctgctggaaggtgtagctgtcagggaggagaaagcaacacctcgaggtcagggtgtttacccagaacagacccctctcaccgcctgcgtgcccactgtgatgccacagagagcagagccacgcccacatgcccactgtgatgccacagagagcagagccacacccacatgcccactgtgatgtcacagagagcagagccacgcccacgtgcccactgtgatgccacagagagcagagccacgcccacgtgcccactgtgatgccacagagagcagagccacgcccacgtgcccactgtgatgccagagagcagagccacgcccacgtgcccactgtgatgccacagagagcagagccacgcccacgtgcccactgtgatgccagagagcagagccatgcccacgtgcccactatgatgccacagagagcagagccacgcccacgtgcccactgtgatgccagagagcagagccacgcccacgtgcacactgtgatgccagagagcagagccacgcccacgtgcccactgtgatgccacagagagcagagccacgcccacgtgcccactgtgatgccagagagcagagccacgcccacgtgcccactgtgatgccagagagcagagccacgcccttgtgcccactgtgatgccagagagcagagccacgcccacatgcacactgtgatgccacagagagcagagccacgcccttgtgcccactgtgatgccagagagcagagccacgcccacgtgcccactgtgatgccacagatagcagagccacgcccacgtgcccactgtgatgccagagagcagagccatgcccacatgcccactgtgatgccacagagagcagagccatgcccacgtgcccactgtgatgccacagagagcagagccatgcccacgtgcccactgtgatgccagagagcagagccatgcccacgtgcacactgtgatgccacagagagcagagccacgcccacgtgcccactgtgatgccagagagcagagccacgcccacgtgcacactgtgatgccacagagagcagagccacacccacgtgcccactgtgatgccacagagagcagagccatgcccacgtgcccactgtgatgccagagagcagagccatgcccacgtgcccactgtgatgccacagagagcagagccatgcccacgtgcccactgtgatgccacagagagcagagccacgccacacgggaggccagctccaggcacagaactcagcccacagacctcacaattccaggcttcctgggaaccaaagcaagaaaaaaggagaagcacacagactttcgatattataagcctcactggctaataacacgaagtgggtgtttatcaggagacagacactgtctggcactgaactctaggacctgatctgtggattctgacgagcacaagagccagaccctccaggggtgcatgtggaaggggcagggctgcaggggcctccttggtgtgtctcagggtgacaggcacagagccctccgcagtgggagccggaagtgtgggtgccatacttgctgcagggacagtgtcctgccaccagccccttggcctcgagatgacagtcctggcccatgctcgggttctctcaatgttcagaacccacgttctgaaaggtggcaacctcagcaacttagccaatgaaacaagaagagaaacggttggttcctaacaaaaccaggaacacaaggattttcagagtcctgggtagcacagggtctgtctgcagatgctgggaagggctctgagggcctgggaggctttctgaattatgggggcaacgtggggagactgggctttctgtggaccatgacagctccgcagccgtgctgggctcctcagctccactgtcagggctaggaattggccacagaacccccagagccaaccctggggcccactaggaccccaaacacctgtgttttcattctgcgtggcctcctggttccctggagttcttttttatgctgcctctggtgtgaggtcctcagcatttaatttgttctaagtttaaaagctgcaagagcaaaacagaacccccaaagcctggggcccacagctgctgcggctgatcagagatacgaccccagaggaccacgtccaccaggggccggatggacagccacctattttgtactccttgtttcaaaagcaacaatagcaaataacattccaaaagttctatgataagacttcaagacactaggatttaaagaaaatcctagacattttcaaagagaagaaacagctactgcatgggtctcctgatgctgctgtagtgaaccgccacggccttggcagcttaaagcaatcagactcttctctcagtcctggaggtcaggagtctcactgggctaaaaccaaggttcggcagggctgtgctcctcccgtaggtcgggagcctccatgccttgcctttcctgccttccagaggctgcctgcattcctgggctgaggctctcccctcccgccgacgctcactgccaccgtcacattccttctccgcctccctcttccacggcccctcatgatgatgtcgggcccatgcagataaccccagataatttcccacctcaggatcctccacttaaccccaccctcccagtcccttttgccacatagggccccatagccacagggttcgagtgtggacctccctggggctgttattcaaactgccacagatgccacaaacaccaggcccagaggaggtggacacgtgtgtgcaaatccacaaaaccagcaaagcacgtgaagacgtgcagatgaggaagaccccaatggcacgggagggcagacacagagccgtccacagatggatcggagctctggggaaggcaccgcagagccagcgccgtctgaggcacacggtgggggcagcaggaacacgtctagggctggggaaccggccccaaagagctaaagaacccagcaactaaccgaaatgctcacacttacagatggcagacgggaaaagaagccacctgctgggatgctgagactcgcttgcaggagcttttggaactggctgaggtcacagctggaaccactgtggccagctggagtctgcacagcccgagtttccaccccagggtcccagtaactccgcccaaatgtgcacacgagacctatgaggagacataactttccagaacccccttttcttccaccagccacttactcatccaagaacccacccccgaaccttccctaatagaaacactgcattaaagccagcgcggggagacagacgtgaactgcgcccctgtctccttgtgggttggcctagaataaaagcttttcttttctcaaaaacctggtgtcatagtattggcctcctgcacatcgggcagcgagcccttttgctcagtaacagggagacacaggcagagcccttggggtgacaaggggacagccctgagcagcagcggccccagcacgctccccgggtagagcagtgagcccatgaataatgctgcgcctgcgcagaaggaacgaggctgacaccaacatccctgccctgcgggaggaggctgcctccgcagcagcaccgtgagcagggcccttgtggatccacagcaccgcgggtccccagcagccacaaggacagacccacgccagctcaagagacagactcacgccagctcaagagacgcagcagtgaccacagagagtggctgtgcacactccaccaggatatgagtgacgcgcctctgtgcaccagcccatcatccacactgtccacgagaccctggagacagcatggccactgcggcccaggaacgccgcccacccacccacctgcactgctccgggttgaagttcacacctggcgttgggaatgggggtgggtgagccaagaaaacaacacagagtcaagaggagcttggcaggagggggccctcgaggcctccagtcactgccaggtcccccgcaggcctgatgctgctcatttgggtgacctcagctgtcacctctgggccagaagtccagaaagaggcatctgtctccagccagatgcaggtaggaggccccgggggcagagctgcacccaggctggcccgtgcctccgcccagggtgtgccacccaccagggcactgccagggtcccagccagggccagcaccaggtcccaagcctggggagttcaatttggtggaaataatttaaaaggaaaggccaggagcagtggctcatgcctgtaatcccagcactttgggaggccaaggcgggcggatcacctgaggtcaggagtttgagaccagcctggtcaacatggtgaaaccttgtctctactaaaaatacaaaaattagccaggcatggtggcgggcgcctataatcccagctactcgggaggctgaggcaggaaaatcacttgaatccgggagggaggtggaggttgcagtgagccgaggttgcctcattgcactccagcctgggcaacaagagcaaatgtctgtctcaaaaattaaaaaaaaaaaaaaaaaaaaagaattgaaaaggaaaaaaataacaactatcccaaagagaagggagacgtggagatgtggaaaagggaagatgttgcagaggcaatgtatcgacaagtgaaacgggtgattgtgaagaaaaatagcgtcctgcgtgcatagaaagtaagggctattgaatatggaaacagcttctaccttaaacaaatctctaaggaaacatagtaagttgttaacagtagttaactccgggaggtgaaattatgaataacattctttccttatacttatcttgaattttaaaattgttcaacaatgagcaatgcattattgggtaatcaaacctattttgaatgtgttactaattttctaagatagaaacgcactctgatggctataaattcctatattaataaagaagagctgaaattattaacgtaacttcccactgtagtaaactagaaaaagaagagcaaaccaccctttcacaataaaaacactcaagaagttaggaatcaaagagaacctctttgattgaaaggacatttacaaaaaccctgcagctaacatcatacccagtgggaaagactggatgctttccctgagacaagccaaaagcaagcagaaggaaggaaagaatgaagattagaatataaatgagatcgagaaatcaaaaacaatgaatgtcaacaaaccaaactcagttcttgaaaaagagcaacaaaaataattaccaccttgtagctaagactgatcaaggaaaaaaagagagaaggctcaaattgctaaaatcagaaatgaaagagaggatattactactaatcttacaaaaagaaaaagaactcaaaggaaatcctagagaaaattgtatgctaaaaaaattagatgatctagatgaatggacaaattcctagaaagacacaaactaccaaaggtgactggagaagaaatagaaaatataaatagacctataacacataaagagattgaattagtaagttaaaaacatcacacaaagaaaagtccacactcagaggagttcactggtgaattctaccaaatgttcacggaagaattaaaaccactcttttacaaactcttccaaaatataagaggaggaactacttcctaagccattttatgaggccagtattatcctggtgccaaaactaggcaaacatattacaagaaaagaaaaccacagaccaataaccttcatgaatataggtgcaaaaatcatcaaaaaacagctagcaaagtgaatccagcaccatgtaaaagagattattcaccaagaccaagtgggacgtgtcccaggaacataaagttggtttaacattcgaaggtcaattgatggaatgcaccatattaatagtaaaaggatcaaagaccatctgaacatttgaataagtgcaggagaagcagctgacaaagtctaccactccttcacaataaaaacactcaagaaactaggaatagaagggaacttcttcaacctgataaaggacatttataaaagccccacagctaacatcacacttaatggtgaaaggcttgttccctaagatcagtggactcgtcttaagatcaggagcaaagcaaggatgtcccccattgtcccttctgttcaacattgtactggaggttctagccagggcacttaggcaagaagaagaaataaaaggcaaccagtttggaaaggaacaagtaaaactctctttttgcagatgacatggtctcgtatatgacaaatccactaaaaaactattaaaagtaataaagaagtttagcaaggtttcagagttcaagatcaatctacaaaagacaatgtatgtctacataccagtcattaacaatttgaaatgaaatcaataggacaattctatttataatagcttggacaataataaaatatttaggaataaatttaacagaagaagcattaagacttattactggaaactataaaacattattgagagaaattaaagaattaaataagcaaaaagacatcccatgttcacaatcaaaatcacagatgccctttttggagaaattgatgagctgatccaaaaattcttgtgaagccaagggacccagaggccaaagcaatcctggaaaagaacaaattaggactcacacttccgaatttcaaaacttactacaaggctacgctcaccaagacagcacggtcaaaacttactacaaggctacgccaaccaagacagtgcggtcaaaacttactacaaggctacgctcaccaagacagtgtggtcaaaacttactataaggctacgctcaccaagacagtgaggtcaaaacttactacaaggctacgccaaccaagacagtgcagtcaaaacttactacaagactacgctcaccaagacagtgcggtcaaaacttactacaaggctacgctcaccaagacagtgcggtcaaaacttactacaaggctacgctcaccaagacagtgtggtcaaaacttactacaaggctacgctcaacaagacagtgtggtcaaaacttactacaaggctacgctcaccaagacagtgtggtcaaaacttactataaggctacgctcaccaagacagtgaggtcaaaacttactacaaggctacgccaaccaagacagtgcggtcaaaacttactacaaggctacgccaaccaagacagcacaatcaaaacttactacaaggctacgccaagacagtgcggtcaaaacttactacaagtctacgccaagacagtgcggtcaaaacttactacaaggctacgctcaccaagacagtgcggtcaaaacttactacaaggctatgccaaccaagagagtgcagtcaaaacttactacaaggctacaccaagacagtgtggtcaaaacttactacaaggctacaccaaccaagacagtgtggtcaaaacttactacaaggctacgccaagacagtgcagtcaaaacttactacaaggctacgccaagacagtgcagtcaaaactcactacaaggctacgccaaccaagacagtgcggtcaaaacttactacaaggctatgccaaccaagacagcgcgatcaaaacttactacaaggctacgccaaccaagacagtgcggtcaaaacttactacaaggctatgctcaccaagacagtgtggttctggcacaaggacagacatcagtggagtcaaactgagactctagaaataagcccttatgttaatggtccactgattttcaacaaggatgccaagatgcttcactggggaaacaacagtcttgtcaacaaatagtgctgggacaacaggagagccacaacgaagactgacccttaccgcacaccagggcaaacaaaaagcgaaagctataaaacacttagtagaacacaggcataaatcacggcaatggttttcgctaggacaccaaaagcacaatgatcaaagagattgataagttgaacatcatcaaaatttcaaaagctcgtgcatcaaatgacaccataaagaaaataacaagtcagtgcacagattgacaaaaaaaattcaaatcatacctttggtaagagactggcatccttacgtaaagaactcttacgactcaataatataaaagacaactcaataatataaaagacaactcaattgaaaaatgggcaaagatggctgggggcagtggcttatgcctgtaatgccagcactttgggaggccaaggcgggtggatcacgaggtcaggagatcgagaccagcctggccaacatggtgaaactctgtatctactaaaaatacaaaaattagccaggcgtggtggcgtgcgcctgtagtcccagctactcgggaggctgaggcaggagaatcacttgagcccgggaggcagaggttgcagtgagctgagatcgcaccactgcattccagcctgggtgacagagcgagaccctgtcggaaaaaaaaaaaaaaaaaaaaagggcaaaggagagggagagacatttcttgaaagaagacttacagacgacgaggttagcagaggaggagatgctcagcatggcgggtccttagagaaatgcccgtcaaagcgacaaggagagccacttctcacccaccgggatgcgagctttgtttttttaatggacaataacaaatgttgacaagaaggtagagaaattggaatcctgggactgggcaggcaggaatgtggaatgcggccggttctttggaaaacagcccagcacgtccacaaaaacttaaacatggagttcccatatgagccagccgtgcattcctaggtgtctaagagaaataaaaacatacccacacaaaaccctgtaaataactgttcatgctacgttattcacagcatgtgaaaagtggaaacggccctgcgcggtagctcacacctgtcatcccagcactttgggaggccgaggcgggtggatcacctgaggtcaggagttcaagaccagcctgtccaacatggtgaaaccccatctctacaaaaaaatacaaaaattagccaagcgtggtagcaggtgcctgtaatcccagctactcgggaggctgaggcaggagaattgcttgaacccaggaggtggaggtcgcagtgagccaagattgtgccactgcactttggcctgactccctctcgggaaaaagaaaacagagcgagactccctctaggggaaaaaaaaaattaaatattaattaatttaaaattttttaattaaaaaattaaatattaattttttttaaaaaaaaggaaaagtggaaacaacccatatgtccaccaactgatgaatggatgaacaaaatgtggtgtgtccacacagcggggtcctcttcagccataaacgggaagtaaatactgatacacggtgacaaaccttgaaaacgggacatcaagtgaaagaagtcagacaccaaagactgcctattacatcatccagtttctatgaaacgcccagaaaaggcagctcacaagtagcttcgtgggtggctgtggctgaggggaggggaacgggagtgactgtgagtatgcagggtcttttcagggtgatgcagatgttataaagttagattctgtaaagatactgaaaaccactgacaggtgcactttatccaggtgaaatttctctcaatgaagctgttaaaaaaaaaaaaaaaaaaaaaaaaaaccttctatatgaaaagtgttctctctggcaggcatggtggctcacgcctgtaatctcagcactttgggaggccaagggggtggatcacttgagctcaagagttcgatactagcctgggccacatgctgaaacccccatctctacaaaaaatacaaaaattagccgggtgtgttggcgtgcacatgcagtcccagctactcagcagacgggtgggaggaggacttgagcgcaggaggtggacgtgccactgcactccagcctgggtgacagagcaaaaccctgtcaaaaaatggaaggaaggaagggaggaagggaggaatgaattatttccatcaagagaagaaggaagttatttctgattgaggtgagagggaaaggggatacagggtgacattccatttcagggggctgtcagctgatgccccaggtgccctcggcccactctgacctctgcgtggcaccactcacccccaccaggcccccctcctccctcccctggtggggccccttctacttcctgccacaggagctggggaatgaatgcccccagggaggacaccggccaggtgggaaccgcaggaccccctgatggagccggcctcactcccactcatgcggcccctttccagcctctctcctgcttcccggcagcaccacccgagctcccatggcgcccggctcctaccgtcgatgtagcccgggatctgcccgaagatggtgaggtaggagtggtagacggcccctcggaacagccagtccacccggcgctcgttgtggatgaggatggcctgcttggccaccccgaaggacaccacccacacagccagcaggaagaggaagaagaagacgtccttcatctgcaggacagagagtgtgtgggctacactctcctggcccccgatgctcactgggcccagaggcaggcccagcagcggtggagacagcactgccactcacagcacagacacggcatgcaggaggctcccaggagcagtcctggggctgcccccacaccctcgtggactgccgacatctttgtgctagcaccacaaagtgcaagaggggtcagacataaccgtgacccaaggaggaaagctcctagagctgaatcagaggccaggaatgagtgcggtcagacataaccgtgaccaaggaggaaagctcctagagctgaatcagaggccaggaatgagtggggatcagaggggagaatgagggaaggcttcctggaagaggtgacgtacaggcaaagatacgagaagggcattcttgggagcccaaggggcaaagcagggacggggaacctacaggtgtgtttaagccccagtccgagccactggcaaggggcctgccctccccgaggcccaccctgggctgcaggccgcgatggagccggtgcccccgcccccttaccatccgcttcacaatgatgatcttgggccccagcgtcttactgatggtaaaaatgtgcatgagccggaggcagaacaggatgaagtccagagagaggatgacgcgcccggggtacagcgtcgccgggatgagcctggccgccgggcagaagcacacacatctcagccacctgctcacagcagcccccagagctgtcccccgtcgcccctccacctgtcctagcccaggtgggccctggaggcaaagggctctggtgggccctgcatcccaggtgttcaaagctggcatgagattgaggaatagagcctcccacttttcttcagacgcccagccccacagggcagcctggcatgggggcacctggagagccagcagttagccagggccctattgcctccgagaaagggggccgcggcctcgcagagacacgagagcatcacaggcagtgcagtgagcccacagtagggaggcagagggagaaagcggcagccgcgtgtccgtggagctgggacaattccagaggttgccatctatggccccttgcacatggacaatctcagctctgccaggagctctcatgccccttctgtgctccctcaacaatcccaagggtaggtggggcgctgttgcctggacacccattggacagatgacaatccagggttcacagacgagctgagcctcacccggtgtggctggttctgggcccggcctgtgctcatcccctgcagggctggctgcctcagacgggcccgccatcggggtgaggccactcacctgcaggtcagccctgccacgaagagcaagattgcgccgacgtccagcttattccagaagtcactgaagtacaaggctgccttcttcatcagcccgcactcgtcagggtcatagaagagctactgggaagaggggcggtaggaaggcagacaggttgtcactcttactatcctcactgtcactgtcacatcactatccactatcatcatcacagtcactgtcactatcatcactatcactgtcactatcatcactacccttgctgtcaccatcactgtcatatcactatccactatcatcacagtcactgtcactatcatcactatcactgtcactatcatcactatccttgctgtcaccatcactgtcatatcactatccactatcatcacagtcactgtcactatcatcactatcactgtcactatcatcactacccttgctgtcaccatcactgtcatatcactatccactatcatcacagtcactgtcactatcatcactatcactgtcactatcatcactatccttgctgtcaccatcgctgtcatatcactatccactatcatcatcacaatcacagtcactgtcactatcatcactatcaccgtcactatcatcactgtcactatcatcactatcactatcatcactatcatcacggtcagcaaatccgaacattggttctgatctgaagagagctgggtcagtgagggagatgggaacaggacgtggaggaacaatgcagaatagcgctggcagcagctacctcggccccctgctcactcagcacctgtgtgtgcatatatgtgtatgtacatatattctgcatgtatgtgtgtatacgtgtgaatatgtatgtgtgcacatatgtgtgtgtatgtatgtgtgcattctgtatgtgtctgcatgtatttgtatgtgtatgcatgtgtgtatatgtgtatgtgcatgtatgtgtgcatgtatatgtgtatgcacatacatttgcatgtattgtgtatgtatgcatgtttgtgtgtgtgcatgtgtatgtgtatctgtgtgtctctgtgtatatgtgtatttgcatgtttttgtgtgtgcatgtgtatatatgtgtatgtgtctgtatgtgtgtgttcatatgtgtatgttcattcatgtgtgcatatgtatatatgtgtgtgtatgtgtgtacatgtttgttcatgtgcatatgtatgtatatgtgtatatgtgcttgggtgatgtgtatatttgtgtatgtgcatgtgtgtatgtgtatgtgtgtatgcatgtgtatgtgcatgtgtgtatgtatgtgtgcatatgtgtatgtgtatattgtgtacatgtgtatgtgtgtatgcatgtgtgtgctgtatatgtatgtgcatgtgtatgtatgtgtatatttgtgtgtatgcacacgtgtaatgtgtgtatgcatgtgtgtgcatgtgtatacatgtgtttatctgtgtatatttgtatgtgtgcatgcatgtatatgtgtatgcatgtgtgtgcatctctatatgcatgtatgtgtgtccatgcatatgtgtgtatgcatgtgtatatgtgtgcatgtatgtgtatgcatgtgtgtatgcatgtgtgtgcatgtgtgcatgtgtgtatacatatgcatgaatgtgtgtgcctatgtgtgtactgtgtgcatgtgtgtgcatgtatgtgtgtacatatgcatgtatgtatgtgtgtgtgcctatgtgtgtgtgcatttgtgtgcatgtgtacatgtgtgtgcatgtacctgtatgtgtatgcatgtgtgtgcatgtgtgtgtgtgttggagcagcgccctcaatgtcaggcgccagctgccttcccacaaggatctttgttctgtcaggggccacactgtttctttagcaggccaagagtgcaggacctggcaggggctgtgggagcccccatttggcctacttggcaggagtccccacaccctccctagccccaggccccaggacccagcagctggacaggtggggcaggtgaccagcaggaccaaccagggccctccctggatcacagacagatgcagggagaaggaagtgccccctctgctctcaggctgctgcccatggggctggggctgggggtgcatggaggcctctggccccttgtagagagggtctggtggcagaagccctgtggcaagaggagagccaaggagagcccagcagagccagggccacagcacagctcccaggccccgccaagtcctggacctgatcttccttcctggggacgccggtgcctcccccagggccccagtaggcagtggtatttacacagtgcacactgctttctaactggggtaactgggggcctggtggtccaccaaggttagagagcagaggtaagtctaagccaggaccactgccccgtgggctgaccccaccccctcaccactgccctgagggttccaaggacctagttcccattcaccggctgccagcaggtgcaggcaccgtgggggcacagtggagaccccacacagtaagggattcgccccacctggggggcagcttggcctcgcccagctccagggagatagcctctgagcccttggaatgtccgcctgatgagggtgtctttgttcctggggcctgggccatgccaggtggtcccacagtgtgatttggggtggggccccgggcagttttcagtttgacctttggagggctggagactgaggtcaaccatgtggtgtcagcctcgcctctgtgactgacctccagtagacaccaaggcccgcgagcctctctggggacgtgcctccatgcatgaggccacacatcatcaccgggaggatggagtgccacccacacctccacagggagggactggccggatgccctgggctcagagctgtcctggatgcagctgcgtccctccccctggctggtttagtctgtagactgttgcttaataaaccataagtgagcattgccactccccagcgtctgtgggtccttctggctcgttattgaacgtgagaggggtcttagggaccccacaccttgcactgctcttcctgggggaagggacatactcatagtccacaaggtcagggcatccaccttgagctgatcagccggtctccaggagggaaggatgcctgggccgagggaaagcagggaagcaggcgcagggggcatgaggagggaggggcttggagggcagcgccccagccacccattttggggaggaaacaccggctctgctcagcttgcagggagctgggcaggctagatggggtgggctctaagccatgggtcccctatgagaatgcagccaagtgggtggccccgggctggggcgtggaaaagcg

SEQ ID NO: 3185 - DNA, 2936 bp, Homo sapiens
acataaaatatcctaggagttacagctgacacaggttttccaaatctctaacttagtaaactgaccctggaaccagccgcctcctccccacgctcccaagggttgtagagaaagttcagggaaaggtggtcccacctcctacaggataaggaccaagcaagcccctgagcctggtgttcagggccctctctatcccagcgtctgctgacttcccagtcccatgtcccagtcccccacgttgtcacgtggctccccacattggactggacacccatgcctctgggacccgccaaaaccaaaaggaaaagctgactgtcgacccaaaagtgtaaacggatctactggcctgggaagcaggaaggatgaaagggcacatctccaggtccatgaagctggaaggaggccaggccctcagacaacccagagggcttccttcaagtcctctcgccgagtctgtgtagaggcagccagtcatcaggggaaggagtgagctcaccaggctgctaggaaggaccggagctggagaaccagaggtggtcaggtgagctgggggggttcagggcaggagaagggttgctctgtcatcctcatcccagaaggacacccagacggtccttcccatcagacggcagttgaagacttccagattctttccccactgtcgtcctctctgatcctcacaacagccctgtgaggtaggcagtgggtgccttccccctttgacaaatgaccacagcagggtgggaagctccaggcagcccctcctctgctccctcgggctgctccggctgagggggcgggtgggtctgtggttccctcgcatgactggctctggcttctggcagacagacctgcctgaagggacatttgttctaggagccagaagcccactcagcctctgctagtggccttccctgacttcccagctgcctccacagcaggagcagcccccagaggcggggaaggaggtgcctgggcaaccccggcctggcctcctggagaacatgcagccttgggccgcccctgccctaggactgtaatggttgaccccatggcgcagccgccacctcctgggatcagctacacccatcacagtcatagacacacagtaaacacggcagacacgccctggagccatgtcaggacacactcacactagcatctgcagactaacacaggcccaggtacacactcacacacacactcctccagatacacacactcctgaacacactgtgaacccacgtgtgccctcccacgcacagccgtacacctgccaaggcggaaccccgagggtgggatggagaagtccgcagcctctctaggcctctgtttccctgagttgctcccctcgtcctccatccaggatggggcagaggcagaggcagaggctgccagccaaggggacacttccgtagcaatgtcccgagccctggaagcagcttccttgggtctccaggtagaaaccattcaggacctccaggtgctggtgccagcagccaggctggcctagatgagtctctcctccggtggcaccttgaggacactgtccatctccagccgggccccagccacctcctgctggcttgggctgtaggtgccctcagactggcggcgctttcgggctgccaggatccctgaaaggaggcccaggaggaggaggaggaggcaggcacaggctgcaggtacggccacctccagcagtgggaatggcagcggcaggggcaggcccttctgcaagagacacgacaccgaggcctaagaccgcagagaaggggaggacgccggggccctcagagagcagagagcgcagcacaaggacctactcagagaaaatcagagctgggagcaggctgccctgggagcagtgaagacccagccccaggggtatgcaggcaagtgccaggaaaccacctgtcacagccactgctcggggaggcctatacaacaaaggagttctggctagaaggacagagatgggcgtttattgaacacccggcaggagctaagcagggtgcatgggtttcacagaagcctacgagggtctcatgaggcagagcaggagcaggggcaggctgagcggccccctgccacaatagcaaggtcagaatccactggggcccacctgcgggggcagggtggcaggggggccgaggggctgttatgacagcttgtccctgcgagcctcggcccaggcttcggggagcccagcaaacctccctggtgtctccagtcacaggctcccaggattccccatcaaagcctctacatgcctgggactctgtagtcccaggatgcgaggattccagaggcatgggctctgggactcaccagcctccctctgtacctccaggcttcccagcccactgtgacctgggtcctaaaacttgacaggaaagttcctctggtcctgagagggtcctgccagcctccaccgttggacattttgagggaggagctgtaaagccatttcctccccctgccctggggaggtggctgggtagggaagccagaggctgtaaaagttcaacttgaaaggaaacattccccgtaagcggaggggatttgtggtttatgacccaggctgccagaagcctgtagagatcaaggctgctccccagacttcccttccaagcctctcctcgccagcacccactccccccaccccgccccaggaaggggtgtggcggggaggttcacagctccagcgcctgctgccttcgtctgtccaggctcctcctgggctgagccacccggggttggggccagcctgcacagcgggccgagcctgctccagtgcggactcccaggccccctgcccctccgtgtcttcctactcaggacactggctcagaaacccctggagatgagtctcctggattcaccaacctaaatcccagaacaccaacatggccctgagtcctggttggattggc

SEQ ID NO: 3186 - DNA, 3776 bp, Homo sapiens
gctttccccaagaaaggctggcccagggaggcttctataaaccttctccctaactcttccagcctgatttctccttgacccaagaatcgcagcctcctgggggctgttgggaaggggcgtggctgcccgctgggttcagttccccttccttcccacgagggtcctcacctgctccagcatgtccttagcaaggtcctcctgctcatccatcttcaagatggcctgccggatctcctcgttagaaagcttcaacctaaggcaaaaccccacctcaatccaggacagccctcaaaccttcttctccaaaaggtaccacctccgccttccctcattccctaacaggacttgggaatatatttaatagtattcccccctcacctcctctacaaagccttcttagattagactagtatgattcagtccacaaacttgataatgagcattttagtgtcaaaatagagacgtgagggtctctgttctcttgataatccatcagagctgataggggcatttgggagtaaaagagatgtcttcaatgtagaccaaagggacagggcaaagggttcctgatccttctcctcctcctcatgcttaaaaaatgcacagcatctccacgggaggacaggattatcggcaagccactaagagggcaatttcctgctgccttcattctcagaacacagaatcgctctcagtcttctgacagcgcctcagctcccacacagctgtcccaatcagtcttgctgtctgggagagggagaagccacacacccccatagcccttccctatcccctccacatgcacccccattaggaaccctggggattcagaactctttccaccatcaagtgggggaaactgaggcctgggggcttgtgagaagaaagggaggaggatgtctcagaggcggctggggcagcactaagaatagtatgggaggtggtgccctctgaccctgctcaggcaggaggcccccccgtacagaagctgtgctgttagcgcagatactgccctgtttgttctgcagccgcgggaaatgcttaggggctgagatcatgctgctccatggcctgagccaagcgaggccctccgtgggcttagagcaactcagctgccagacgctgaccaggctgggcaagggcctcgtgactgggcagtttcctgcctgcagagccccaaactgctgctcaaggcaggttcccgagagacagttccagatcaatgcctgcccctcccaggggacagcagagagggagaggcccgagactgccaccactccgttcctccaccccctttgtcccccaggcatccaactcaaccaccttcttttgcacatacttggaaagaaggatgatgcagttttgggccctccggccatcaatgaccgacagctctttgaccttgcgggaagccaggtagatgtcttcagtggagcccagctctttctgcaaccaacaagtcaagtggacagttgaggtgtgggttccctaatcctcctcttacccgccccgcaagagccacctcctaccaatccaggaatgctcctggtgtgaggggaagggggaagaaaaagacaggagagagaggagggtggataatagctaactttaagagacggtatctgggacttttccataggctccaatgggttggggaaggacaccgagaagccccccttcctattttttttatttttttagagattttttttagaaattatccactctgggcaatgagggaaggggctgtgccagtgggtcagggtatgactgatctctgtggctttgggcaatgtgacataacctcccatgactccaacagaatcaactcccattcccactgcccaacccagaggccctcctcaggcttatgctgagaacctggttgcaaacccccctagggaacagttgctgactcctagggacttcaggcacagcccaagatgcccagggtagagagcatccacaagttcagaggtatggaaactgaagcagaactctctcctctgagtcccagcaggcagattctggagaaatcattgatcccgccccactccttctcttgggcccctggcgaggtagacaggaggctgtctagtgtgctgttcttcctctgggaggtccctcttgcacaacttcaggggccgccttgcatggttatctttgtgaattgtgtcgtgcctaccctgtgtgtccttacaggaaaggctctcctttggcctggtgggtaagacagtagacctagaagccttctcctcattccaggagacattgacctccactgctgccaggggtctatttgattacctccctctgctacatttcttctttctctttgggggccctctcccataccaccctgtatgaatggggaataaggtagaaagtggaatggacaagtcctctctgtcaggcccagtacagagcagcagcccgggacagcagttaaaagttggagtggtcagagccccgagagtaactcacctgctgagaaggattagttatcagctcctaggcagcagccacagccaacagagaattaaacatgcacaacattagccaagacatttggggacccagaaatagcatgacagacacagggatccctcagcatctacactgtccacttcatcccagtgagacccatggttgtagacaggcacccataagtggcactagacaggagctgcttctagcagacatgcactcacggagaagccaaacgaagcggagatcaggcagctcctcccatctgcctagtgcgaccaccactccccagttagggcagaccaaacccctgagttctcccaccccaggctttgctgcctgttcttccttttcctctgctgaaaacctgcagagagggtggaggacattcctccatcctgggatgagttcacctttctaaatagaggaggagtcacaaatgaactcgatctggaagctccagaaagttgtgtttactgaggcagagaaaagcaagtgcccttgaatttgctcactgcccctcatctgtcctttgatgtgcaaggggaactgaagaggcacagcacgcacctctgttctccctgacgccgatggagtggaagctactgactcaaaactcgcatggggcacagagaagaccatgactcccaggacctcccctgccccacaaccaactgagagaagaggcaacaaggtccaggatccgaaatacctgcatgtcatcaatctcattccatacggtgccagggacacgctcctaaaattcaggcccacccccagcttccagcatctgccagaaggacttgaggctcttcgaggaggtataactgaggtctggagccagagagcggtaagtctgttcctaatattccctacatgttgacactcaccgcgtcgccctgatgtgcccaccttgcataattttcaaatttaattttcccaccactctggccaagagcccatcatctctagtctagactcctgggacttctgcccgctggagatatccttcacatgccagggaaagctttctcaaaagcatgtttcattatgtttcccccgtggtgcactgcctttggggtcaggcgggcctagctggctgacgctcccagccctgccatcctgtgggactgtgggaagatggagggatgagatttttctcccatgtcacataaaaggaaactgagtctccatgattttttttacctcaccgagatgacgtgagaagtgagataacatacttcaaacatacatggtagggccactaataataatctatttattatatg

SEQ ID NO: 3187 - DNA, 1531 bp, Homo sapiens
tagaggaggccatgagggtctcacctgtaacattctgtagatatgacttgtttattctgtctactgtgagtgcctgactctgagtagaatcaaggccgggggattgtcatctgctttgtttatgaaattatgccaagccccaagaagagcgatgcacaaatgaggtgttttgaatgtatgtgttgaatgagtgaaccccaacctttggagaaccccagtgagcctctccagatgtctgagtgggcctgtggctcctttttcagcaccaagggacccctcttctgtctgtgtcaaggagaaagaccagccagaaggaatctcagacatcctttaccagtgccatcgcagacttggtttctatgtgtttttccaaacagtgagtgatacaggccattgaggcagaatgctgagagctgcttcaagtgagggggaagagaaaagtaacaaacatgaatcacagcacccccagcagattttccagagttttaggctctagggacccctttgtttgctgtgtcttagatcattgagtccctacaagaaccctgtgaggttcgtcttctcactactccctgttccagaggagccaaccgaggctccgagaggtgcatcttcaagacagagccagtaggggacagaggcacctctgtgtcttggagggggatggacactcaccttctaaccagtagttccaaaaagtgtggcacagtgataaagtcccaggaggggcccaggcaggtggcataggaggagatgggtttagttagaaaggctggaaccagggactcccaacagcttctccccagtgccgggctggaaagttagcatcctgcagatctcattttcatactagggggacaaggagggacatgggagtcagtggtaacaccatggaccaccagaggatcgggatctggaactcacaccaagaagcaccaacccttcagggacttgtgcatatggagaacctgggtgcccatggtgaaaagcgttctaggctttcaaagtaacattgcatgtgaggatggagaatgataaaacgattcctgccttcaaggcatcgtcccggtgtttgtcagctgtggggcaacagcaccctctgtgtcagcaacctgcatgaagagcatcatccctgcaagtcctcaaggcctggggaggcctcatcccctcctcatttcagcaacagcacacaggacaatacgctctagaagaactctttgacttaaaggtatatgattgtttttgttcctttaacatgaacgtgagtctggagaaacagctacggccatcccagccctggccaaggggaaaatgccggaagactccagggtgggaggaagcgcgtcccaaggcccaggatctgcgaggcgacttggggaaaacgcaggacctgctgaagctcacacccgtggaccacccagactgcctgccgctacaggatgccctccgcatctcccaggacttctttccggcatcagtgtggacattgaccccactggactgcagtcacagtggactcccaaggggcagg

SEQ ID NO: 3188 - DNA, 1873 bp, Homo sapiens
gaaataatcagactcaaaaagacaactactacatgattccacttaacagagcagctggagtgcatcccggggacttgggagctctggaaagaggagcaggaaagggccatggccggaggaggcctgaaaaagatcatctctgccacagagaagaagctggctcggatgctgctggcccctatggagacagggagacccggggagacaactgtattcattcaaggaggaatgggtggtgatgcaaacttgggtggaggccacagggtgcagaagacaggacacagcagagagagatgtaggacatggaagggacagaaaggagtgaccacaggacataaaggggcaaggaaagtggaagcatgataacatctgctgggcatccggctgaggggttgggtgcctagggtgcccttccctaagggagaaccccaggagcagattcagagaaaaccgcccagctcactccagcaagaatcagaaaaggaccggttaaaggagagggtaggaaggtcaccaagctccaagggccctcatgaatccggcttggaggccacagggcccagggcaaggacaaaccacaggcacaggacagctccggtcaagatcttctggctactgcaggaggcagaaaccacaccctgcaccctgcactgctgaggctggcgctggagtccagaagcttctacaccagaagcttcggtcccccatccctgctcaaaaaattaaaacaaaaacaataacaaatcggtgtcatgcaccctctgcttcctggtgctgttcgggaccctgagtctttcacgggagcacctgatggggaaagcctggacccgtgtcggtgtccctcctgcaaggagtgctgggaaaatgaactttccagcttcctccttgcgaaggcagaacattccccatgtgtactggtggcatttaaaaactgcagggcagccagagaacatggactgtgttccaccgggagagttcctggcgggatgtcccggtgcagaagcccgtcccaagagattattccaggaaaagaagtggccctcagtgtcaaaggatgcaaaactaacctctgagttcctggcaggtttagcaataaaggaggatgttgctgatctcagtacaagcaatgttagagaaaggggaagatggaagtggacaaggacgagtgagtggaaggtgacaaatggaagcaaagaaacgtatccagaccattgaagatgcttgagcgagaagaaagaggcggtggagggaatggaagcccgaggaagtcatatgttgcaataaggggcctcagagcacgtgtagagtgtggagcagagcccttgcagaggggctgtggaaggctggcagggtgcaggtggccccactctccgtcaccctgaggagtgtgtggtcagagttaaagctcagtctgtttctgggatcaggctttcacaagctccaaaagattcaccgtgcagaactggacgttctagagaaagaccacgcctcctcctgcaggtaactcttcattcaggaagcagctcttggcttatccctgggcttagtggaattggaatacctgaccataggacaccaagggctttaggacctgagtggcacatcgtgtcctggtgacatctgagttacctggggcgtgcacagcagcctccagcatcccagggagagctgtgtatggggtcaggctcaagcaggtcccagggcaccagtgacccaatgggtgaatcagactcccgtggcacctgctccttctgtatctccctctgccatatatatgagctcatgggaagcactgtaacctcttacagaggaggaaagttcatggacttctagcttctagaactgtgatacaataaactcctgttgcttatct

SEQ ID NO: 3189 - DNA, 3115 bp, Homo sapiens
atgttcaataaatagttatggaatgttttcttttatctgattagtcatatttatagtagattcactattcactatttagattcactatttatcaataacctgcactcaatagttttggtgcattcttctaattctgtttatttgtttcctgataatagaagtatcacatgcattctatagataatttgaaagtataaatgagtattaaaaagaaagcaaccacatatcatcccccaaactgagattatcattattaacattttagtttattttcaagcatttcctaagtatattttagttatttaatcatattatacagtattcaatatatcttttatttttatagaagtattttctgtattataaaacatgctacaaaatgttttgatggatatacagcatttcaatatatcaaagtcataattgccctaatcctttctgatatcatttgcatctgtgtccccagcaaatcttacactcaattgtaatcccccatgttggagggggacctggtaggaggggattggatcatgggggcagagttctagtgaatgacttagcaccatccctgcttggtactacatacaatatcattctatcacttttaaagtgtgctgtgagacctcacacttttaaaagttgtttaaaagtatgtagcacctcccacttctctctcttgctcctgctccagccatgtcagatgggtctgcttccacttcgcctttggccatcagtaaaagctccctgaggctccccagaagcagatgctgctgtggttcttgtacagcctgcagaaccatgaaccaagtaaacctttcttctttatgaattacccagtctcaggtatttctttttttcttctgcacaaattaaccttagcagcttaaggtgtttatttatagcaatgtgagagcagagtaacgcactttcccaatcataagacacttagattgtttccaatcatcacgatctataatgctgtcatgagtacctttgtactaaatcttgtaagcatctctaattcttttcttatattagagttttggaagatgaactacagagtcaaagaatacaaacaattttaagacttttaatatgtattgtcgagttgatttacggttaagttttaccaacttaaacacccacaagcacttgcttcactgcacggtcatcagcattgtagctggaaatgggagagcctgggcttcattcctggcctactaaatccataagcaagaggaaaaaacaacacaatcaagggacaaactacatcgtgtgaggccagctcaggctgctactactctgtcatcctaagagaagaatctctgaaattttgacagcatgtggaaatattcccactgattattggattatgaagatggagaagagtattttaaaggagttttgtaggagctgcaggagaggattcaggtatatttatattcatagtatatgtgtaatgctttgttcctgctccttcattacttctattaagaagagacaaggagagagacatggaaatgactaaggcaccaaaggaaaggcattttttacatttcaaagtcacaggtaaaaaacatttatcattttcatgtggaaacattcttccaagctgtaactaataatggtctctcctactatttcctcccacttctgcagctgctaaaacacctttgccaccagctccgacaatcaaaccatgcctttggatttcttcagtttctaaaggggaacatctttttaaagcctttgttgtattaattaagaatccagggccaagcccgtggctcatgcccataatcccagcactttgtgaggccaaggcaggtagatcacctgaggtcgggagttcgagaccagcctgaccaacatggagaaaccccgtatctattaaaaatacaaaattagccaggcatagtggcatatgcctgtaatcgcagctattcaggaggccgaggcaggagaatcgcttgaatatgggaggtggaggctgtggtgagccgggatcgtgccattgcactccagcctgggtgacaagagcgaaactctgtcaccaaaaaaaaaaaaaaattcagtggctggcatagagtcaagaaactctatgaacagaagataactgacttagcagcagcagagtaagcctccaaaaagaagcaagatctttgaaagtggctgggagagctcccaactgaataggcttcagcctcccactgtcagtacttaaggttcaaatgcctcaggctgcgggaggggacggggtggagactggccatgtcggaggtgacctggagtctgctgcagctctggggcgccagttttaggagaggcgccaacttcgacttttggggccagccggtggaggcgatagatgagtatcagatattagcaagacatctacaaaaagaggcccaagctcaacacaataattctgaattcacagaagaacaaaagaaaaccataggcaaaattgcaacatgcttagaattgtgaagtgcagctttacagtccacacagtctcaagaagaatttaaactggaggacctgaagaagctagaaccaatcctaaagaatattcttacatataataaagaattcccatttgatattcagcctgtcccattaagaagaattttggcacctggtaaagaagagaatttggaatttgaagaagaagaagagggtggtgctggagcaggatctcctgattcttttcctgctagagttcccgatgctttagataccagggttgccattggaaccaggaatgacattactcactatcagaattgagaaaattggtttgaaagatgctgggcagtgcatcgatccctatattacagttagagtaaaggatctgaatggcatagacttaactcctgtgcaagatactcctgtggcttcaagaaaagaagatacatatgttcattttaatgtggacattgagctccagaagcatgttgaaaaattaatcaaaggtgcagctatcttctttgaattcaaacactacaagcctaaaaaaaggtttaccagcaccaagtgttttgctttcatggagatggatgaaattaaacctgggccaattgtaatagaactatacaagaaacccactgacttt

SEQ ID NO: 3190 - DNA, 20425 bp, Homo sapiens
ggtgtagcccagaagagagtgatggcggcgccgcccaatggacgcgtgggtggaagggcccgagcctcctcatccaccccctccttccgccccccacttgtgcatgcctctgcccccccgggccgcggaactctcctggggcgaccccgagtcccaccccgctgctccgtgccgtcctcgcagctcgagccctcctccagcccagcagtgctcccgcagcgtctggccgctggtcgtcggcagacgaaagggcttgaaccgcggctgaccttagcctttgtccctcggcctagttccgcagctgccgtcgaggccgccagcccctcccccagcatgtttgggctaagccgcctcctttccgcctgcgttggagagagaggtaccagaaggaatgaaaggactggggcttgtctccatggcaactgaaagaaagagagaaaaattggtcacctccaggactgagaccctgacccttccaagcatccccactaccaaaggctgcccaagcccggaaggatcccatcccgttctgtactctgaggtcacttcctcactccgtcaaatttcactggactgtgggctaattaaaagtgcctccgtattagcggggcgtggtggcccatgcctataatcccagctacttgggaagctgaggcaggaaaattgcttgaacccgggtggcggaggctgcagtgacccaacattgtgcaacaagagcgaaactccgtctcaaaaaaaataaaaaataaaaaagagtgcctccctggggagactgtaatgcccactgggcagtgatcctaatgccccttgggcagtgatccttattcccctctcccataatgattggttgtagcaggctgaacaaaaaggttgagcttcgcttgtgcttgctgaatagaattctcacgcccactccacgttagctcccctcactgtaggactagctctgaaaattctagctcctgtaggaagccaacacagacggatctacaagaaccaaaaacagctatagctactcttctaaatctcagtgcctgacattgcctctctttctgcctcctctctccaccccccaaaaaatgtggtcctccttgacctgagggagcttccgtccaagtctgagctctgatcatcctgaagaatcaaagtatcatcatcccttggctggcaagatgaactccaacatcaaaacacttgaaacagtagtatttttacacaatttgcccactgcctctacatctcacttagtccttgcagtaacatttggatgatgaggtaacttatccagaagcacaaagcctaaagaatgacagagcttggactcctgagaagttcagctactgcccgccttatgataaccaaaagaaagcggccgggcgcagtggctcaactcctgtaatcccagcactttgggaggccgaggcgtgcgaatcacaaggtcaggagtccgagaccagcctggccaacacagggaaaccccgtctctactaaaaaaaacaaacacaaaaattagttgggcgtggtggtgggcacctgtaatcccagctacttgggaggctgaggcaggagagtcacttgaatccggtaggcggaggttgcagtgagccgagatcgtgccactgcactccagcctgggagacagtgagactccgtctctaaaaaaaaatgaataaataaataagaaggcacaccacaagttcgagaccacttctacaaaaaataaaaaataaaaaaaattaggccaggcacagtggctcatgcctgtaatccaagcactttgggaggctgaggcgggcggatcactggaggtcaggagtttcagaccagcctggcccaacatggtgaaaccctgtctctactaaaaatacaaaacttagctgggcgtagtggtgcgtgcctgtaatcccacttactccagaagctgaggcagaagaactgcttgaacctgggatgcagaggttgcagtgagctgagattgcaccactgcactccagcctgggcaacagagtgggactctgcctcaaaaaaaaaaaaaaaaagaaaatgaagatgaccaaatgggcttctagatggctaatgatattctgtttctttgatctgggtgggggttacatgggtgtgttccctttgtaatatgttatcaagacattttgtgcacttttttgggtattatactgaaagaaaacatttattttttaaaaagttgaaaaattgccttggagcagagtaaggtaaatctatgattaagcttagatttttttattttttattttttattttttttcaaaaaaaatgaggccaggcgcggtggctcacgcctgtaatcccagcacgttgggaggccgaggtgggcagatcacgaggtcaggaggtcgagaccatcctggctaacacggtgaaatcccatctctactaaaaatacaaaaaattagccaggcatggtggcaggcacctgtagtcccagctactcgggaggctgaggcaggagaatggcatgaacctgggaggcagagcttgcagtgagccaaggtcacgccactgcactccagcctgggtgacagagcaagactcgtctcaaaaaaaaaaaaaaaagtaaaatgaacctaacaagaggcatcctttctctgtggttattatagtgagaactaagttctttatcactctccggttatttacccctagagagaagccaactttctggttgtatacaccagaataagtacaagaatggtaagcatagagcttcagagaaactagccagattctaaaggaatgacttgaaaatcgagagccgtttcaatgacaaaacatcatacaaaatattcatctaccacattagaggcctatcgctaggtaaaaacaccaaaacttcagcttaaacagtagtatgtatgtatgtattatcccagtttctgtgagtcaggaattcaggattgataagctgggtggttcttgttcagaatctttcaagaggttgcagtcctctgaaagtgtagtgggttggggtatccacttccaaggtggcttgctcatatggctggcaagttggtgctggctgttggcaggaggcctcagctcacaatgcaggctttcataggactacgtgagtgtcctttcaacatggcagcaggccttccctagagctagtgaaggatgagaaaacgacaaatcgcaatgtcttttatgacctaggctgggaagttatactccatcatttatgcaatatcctgttatcacacaggtcatccctattcagtgtaggttggtactacacaaggacatgaatatcaggaggaagagaatctctggaggccatcttggagcccatagtccgccttctgccccctaatgattcacgtcttcgtctgttcctgctctctaagagccaggaggcagacttcccttgagctttcttgcagctaaagtagagcatcattagcagtaaaaattaagatatcatcacaaaggccaggcacagtggctcacgcctgtaatcccaacactttgggaggccaaggtgggcggatcacctgaggtcaggagttcgagacatgcctggccaacatggtgaaaccctgtcttcactaaaaatacaaaaattaacctggtgtgttggcgggcacctctaatcccagctacttaggaggctgagccaggagaatcacttgaaaccagaggcggacgttgtagtgagccaagatggcaccactgaacttgagcctgggtgacagagcaagactccatctcaaaaaaaaaaaaaaaaaagacatcacaagattgccaggcacagaggcttaaacaccaagttctttctcatgtcatcgtgtttcgtcggtgccgaggacatgaggggtgtagatcaggcctgtttcaaacacaaggccttttggccagagtgtaatggtgtgaggacttgggaagaccttacctacttaactgtctctctcaaaggacaaaggtatgagggggttaaaaaaaaaaaaaaaaaggcaaagctatgaagaacatgaagttcttaagcccctagacactcttccaaggtctggcctgtatcccagagtccactgctgaaaaggggcagagatgtgtgttatatgcgcacatacgtacgcatagtatagctagcatatggcattctggtggcctcgacggagctcacaggcaatataacagcattgactgctttcacagtttccacttgtctcaggaaaatagagaaaattcaagatgaaatacagtgagtttaggacaactcagtttcctaaatatggaagatcctgtcccttcccaagtattgaaagagatgaaaattttcccttagttttcaagctcaaagtctatcttatctttgactaaatagccctgatttggatactgttaacttgctcttaactactaatagtctagtgcttttactttattttattttatttattttctttgagacggagtctctgttgcccaggctggagtgcaatggcactatctcggctcactgcaacctccacctcctgggttcaagcgattctccttactgagcctcccgagtagctgggagtacaggcgcacaccaccatgcctggctaatttttgtacttttagtagagatggagttttgctacgttggccagggtggtctcgaactccaactcaggtgatccacccaccttggcctcccaaagtgctggaattacagggatgagccactgcacacagcctatttgttttttaagagacgtgatctcgggaccaggcatgatggcccttgcttaatcccagcactttgggaggccaaggcaggcggatcacatgagtccaggagttagagaccagcctgggcaatgtggcaaaaccccatctctacaaaaatacaaaaattagccaggcgtggtggcacatgcctgtggtcccagctactcaggaggctgaggtgggaggatcgcctgaaccagggaggtggaggttgcagtgaaccaagatcgcaccactgcactcagcctggaccacagagcgagacactgtctcaaaaaaaaaaaaaggatctcactctcaccgagtcacatttcaagtagtcaatagccacaagtaccaggcacggtggctcacgcctgtaatcccagcactttgggaggccgaggcgggcagatcacgaggtcaggggatcgagaccatcctggctaacatggtgaaaccccgtctctactaaaaatacaaaaaattagccgggcatggtggcgggcgcctgtagacccagctgcttgggaggctgaggcaggagaatggcgtgaacctaggaggcggagcttgcagtgagccgagatcgcgccactgcactccagcctgggcgacagagcaagactccgtctcaaaaaaaaaaaaaagaaaaaaataaatagccacaggtgtctagtggctatcacaaacagaaagctctaattagtaatttatttcaatggcctcctaagagtttgttctgcctctagtctctactctccaggcccacagctcccagggtaatcttattaaagcattctcctgtttataatctcgcctatgttaaaaaggttatggtggcttctttgcctacagaatgaagttcaaacaacttgacatccaaggagctccaccatttggtatcttcccactttttctttttcttttttttttttttttttttgagatggagtctcactctgtcacccaagctggagtgcggtggcacaatctcggctcactgcaagctccacctcccgggttcatgccattctcctgcctcagcctccggagtagctgggactacaggcgcctgccaccacactgggctaattttttgtatttttttagtagagacggggtttcaccgtgttagccaggatggtctcgatctcctgacctcatgatccgcccgcctcagcctcccaaagtgctgggattacaggcgtgagccaccgcgcccagcatcttcccactttttctcattgctttattatgcttgcataactgttctaacaaaacaaatctcacaattctctagataagccttattcttacccagctttggctcatccttcatctctacatcttttttttttttttcttttgaaacggagttttgctcttgttgcccaggctggaatgcaatggtgctatctcagctcaccgcaacctctgcctcctgggttcaagcgattctcctgcctcagcctcccaagtagctgggattacagggatgcaccaccacacccagctaatttttgtatttttagtagagatggggtttctccacgttggtcaggctggtcttgaactcccgaccacaggtgatctgcctgcctcagcctcccaaagggcatctctacatctctacataaaattccttcccgccacatttctgcttatcaaaatccaatccaacttctatggcatggcccaaatgatacctcctccttaatgtcttcattgattaccacagttcactgtaaacctgatctttttttttttttttttttttttttggagacagagtctgtctctccatcgcccaggctggagtgcactggcgcaatctcagctcactccatcctccatctcctgggttcaagtgattctcctgcctcagcctcccaagtagctgggactacaggtgcatgccaccacacccggctaatttttgtattttttagtagaaacagggtttcaccagtctggtcttgaactcctaacctcaggtgatccacccacctcagcctcccacagtgctgggattacaggcatgagcctctgcacccggccaaccctgattttttttttttttttgagacatagtcttgctctgttgcccaggctggagtgcagtggcacgatctcggctcactgcaagccccgccacccaggttcacgccattctcctgcctcagcctcccgagtagctgggactacaggcgcctgccaccacgcccggctaacttttttttgtatatttagtagagacggggtttcactgtgttagccaggatggtcttgatctcctgacctcgtgatccgcccgcctcggcctcccaaagtgctgggattacaggcgtgagccaccatgcctggcccttttttttttttttttgagacagggtctggctcagtcacccaaggtggagtgcagtgacgcaatcatggctcactacaacctccacctccccggctcaagcagtcctcccacctcagccactcaagtagctgggactgcaggtccacaccactatacctggctaattttgtattttttgaagaggcagggttttacaacgttgcccaagctggtctgaaactcctgagctcaagtgatccgcccccctcagcctcctaaagtgctgggattatggtgtgagccaccttgcccagccttatgtcactctcagtggcatttctcgtacttcctggtcctaagattcttggtgtacacgttgtataatcccaactagatatgagagctatcagattaagactttgcatctttacatcccccagtacctttcagagtgtgagtgcacacacaccatttgctaaggaatgattgcagtgacaataccaagtttaggatcccttaaaatacctatatcttgggcagaggttgcattgagctgagatcatgccgctacactcagcctgggtgacagagcgagactccatcttcaaaaaaaaaaacagtccgggtgtggtggctcacgtctgtaatcccagcacattggtaggccaaggtgggtggatcacaaggtcaggagttcaagaccagcctggccaacttggtgaaaccctgtctctactaaaaatacgaaaaaaaattagccgggcatggcggcggggcacctgtaatcccagctactcaggaggctgaggcagagaattgcttgaacctgggagacggaggttgcagtgagccgagatcacgctactgcactccagcctgggcgatagagcgagattctgtctcaaaaaaaaaactacatcttcatagtggacatatttgacatctacccaacttacaaccattcctcctatagatcatagattaggccccaacagccatgtttgtacctcctaaaccccaccaccttggaatagagacttacttctcaaagtgtgatgccacattcctcgtggggtcaaagaagcagaaaaaattggtttgcggccgggcgcagtggctcacgcctgtaatcccagcactttgggaagccgaggcagacagatcacctgaggtcaggagttcgaaaccagcctggccaacatggcaaaaccccatctctactaaaaatacaaaaattagctgggtatggtggagggagctactcgggaggctgaggcaggagaattgcctgaacccaggaggccaaggttgaaatgagccgagatcgcaccgctgcactccagcctgggtgacagtgcaaaactgcatctcaaaaaaaaaaaaaagtaggtttgcacagagctccaagagtgaacagatgaacagaacagaaaaagcactttgccagctctcccagtcctgcctgtttctatccattccctaggctgaatacattcctgtctgtgttccatatgtctccccccgcaacattaaaataagtttattaagtctcccgccccatattttaatctagcttacattgtcttctgttacttggaaccaagagtctttttttttttttttgagacggagtcttgctctttcacccaaactggagtgcagtggcacaatctcggctcaatacaagctccgcctcctgggttcatgccattctcctgcctcagcctcctgagtagctgggactacaggcacccgccaccatgcccagctaatttttgtttgtttgtttgtttttagtagagacagggtttcaccgtgttagccaggatggtctcgatctcctgaccttgtgatccacccgcctcggcctcccaaagtgctgagattacaggcgtgagccaccgtgcccagctggaaccaagagtcttaattaaacaatcatgatggagaccaagcccacatttttcaggtcacctaatcctggcctctccatgatccagtaacctgagttacagctttcctaccataaggacttagagctaatttcttaaagcctgtagtggaggctgaggcgagaggattgattgacacaaggagtttgagtccagcctaggcaacataccaagacccagtctcttaagtaaattttttaaaaaatcaatttagtttccaaatgagatcaacatattaacatattatatttgattgctttgccttttttttttttttttgaggtggagtttcactcttgttgctcaggccgaagtacaatggcacaatctcagctcaccacaacttccgcctcccaggttcaagcgattcttctgcctcagcctcctgagtagctgagattacaggcatgcaccaccacacctggctaattttgtatttttattacagatgggtttctccatgttggccaggctgatctcgaactcccgacctcaggtgatccgcctgcctcagcctcccaaagtgctgggattacaggcatgagccaccgcacctggcccaggtttgatttctttaaaagaattcttcacaggtgctatttacctttttaaacattatttttctatttttgttttgtttttgagacggggtctcaccctgtcacccaagcaagagtgcagtggtgcagtcacagcttactgcagcctcaaacccctgggttcaagcaattctcccacttcagcctcccaagtacctggaggtacaggtgtgcaccaccacgcccagctaattttttttttttttttttttttagagacaagggtctcactatgttgcccaggctggtctcaaactcctggcctcaagcgatcctcccaccttggcctcccaaagtggttcccacttataagtgaaaacattacaggtgtgagccaccatgtctcactatttactttttattcatctcatcaagagaagagaaattcataacattaactacttacgttaggggctacagcccctaccgtaattttctaatcaggtagtttcttctatgcttggttaactggaatttgtgtgtgtgtgtgtgtgtgtgtgtgtgtgtgtgtgtgtgacagagtctcactctgtcacccaggctggagtgcagtgacacgacctcagctcaccgcaacttcctcctcccaggttcaagcgattctcctgccccggcttcccgagtagctgggattacggctgtgcaccacgacacccagctacttttcttttgtatttttagtagagatggggtttcaacatgttggccagtctagtctcgaaatcctgacctcaagtgatccacctgcctggcctcccaaagtgctgggattataggtgtgagccaccgcacccagcctaactggaatatttctataaagaatcttccctcatcaactctttgttatcctgaagtacctcaacctcagcctccagaggagctggaactactcaaatagaaaaggcaggatcaattctttccctttactgaccagttttcagaatgagttggtttcctggggcatcctctagaggtcaacaatgaattctttttagtattatcatgaactggtggctttttttttttttttttgagacggtctcactctgttgcccaggctggagtgcagtggtgcgatctcggctcactgcaacctccgccttctgggttcaagcgattctcctgcctcagcctcctgagtaactgggactacaggcaagtgccaccacgcccagctaattttttctattttagcagagaggaggtttcaccatgttgcccagggtggtctcgaactcctgagctcatagaatccacccactttggcttctcaaagtgctgggattacaggcgtgcgccaccatgcctggtgttttttttttttttttttttttttttgagacggagtctcacactgttgccggggctggtgtgcactggcgtgatctcggctcgccacaacctccacctcccgggttcaagcgattctccttcctcagccccctgagtagctgggactacaggcgcgtgccaccacgtctagcttatttttgttttgttttgttttgtttttttgaggcagagtctctgtcgcccaggctggagtgcagtgacgctatgtcggctcactgcaagctccgcctcccaggttcacgccattctcctgcctcagcctcccgagtagctgggactacaggctacctgccactatgcctggctaattttttttttttttttttttttttttttagtagagtcggggtttcaccgtgttagccaggatggtctcaatctcctgacctggtgatccgcccacctcagcctcctaaagtgctgggattacaggcatgagccaccgcacccggactgtatttttttttttagtagagacggggtttcactatgttggccaggctggtctcaaactcctgacctcgtgatccacctgccttggcctcccaaagcactgggattacaggcgtgagccaccgcgcctggccaactcatggattttaaaagcctatttgatgagtttcagtccactggagtcaggtctttttttttttttttttggaagtgctgtgatcgtgactcactgcaacctctgcctcccaggttcaagcgattctcctgcctcagcctcccgagtagctgggactacaggcgcgtaccaccatggccagctaatttttttgtatttttagtagagacggggtttccccatgttggccaggatggtgtcgatctcctgacataatccacctgccccggcctcccaaagtgctgggattacaggcatgagccaccacccagcccaaagattctatattatatatacagttttccactttttttttcctcttagcaaaacatcatggagttcactccatagcagtatagagatactcatttctattcacagctgcatagcactccaatgtagatataccttggtttattgccaatgttctgtagatggacattgtctgagttatttccagtcttttgctatttacacagtgggctataatgactagccttggacatatatctttatttttgccaatgttatctttggcttagactactagaaatggaattgctgggtcaaaaaacacatgcatatgtcattttgtaggacagaatcaaattcccctcctgaagaggcagctgctataatggtgcttccagtggttcctacttctgggtaaattgccccttgactgcaatttacagaagtgatgggagtggatgcagaggctcctgcctgtaatcctagcactttgggaggctgagccaggaggatcacttgagcccagcagtctgagactaacataggcaacacagtgagaccgcatctctactaaaaatcatgaaagttagccaggcatggtagcgtgtgcctctggtcccagcaactcaggaggctgaggtgggaggattgcttgagcccaggagtttgaggctgcagtgagacattctactccactctactccaacctgggcgatagagcatgcccttgtcttaaaaaaaaaaaaaaaaaaaaaaaactgctgggatgtcactttcaagattaagtaccaaaggactgtgacttctgttttgctctcatacattctctgtctgagagctgggagcttgtctttaagtagaaacccacccatccccagggagaaggcaggagggaaaaggaggagaggtcacagacaagccccctgactctgttgatcttcactgcagtagcttctcattacaagcaggcatctggccattgtagaccattataactgtagttctagaagtaataatagcagatttattgtacagaagtgtccacgggctcacaattctaaggacatcatcatgacagcaagtaggaaaaaaaattaaagtaattctttcaccaattaccagtttatctcttctccaattcctttggatacgcctcctgcaagaagccgatttccagctgtatgtgataatgaaagggtttttctttcttatgttaaatacaagcgaagtgattaactggaagatagcgtctgattgcgaggaaatcagtgattcagatggtgtgggaatggcacctggggatgggggaggcaggacggagatggaggaagctggtgcagcctagcctgccttgtgccaaggacacccaagggcagagggactgagctctgggggaggacagatttgacataactggtccagcctcacagtttacaggtcctggagggtgaggaaagtgggagctggctgcggatgcaggacaagaacccagggcttcccttcattttgcctgccctgccacttcctcccgccacttccacccttcctacccctccacctcccttgtgcctttcactgccttttacagcatttacattacacttcagtaaaaagttgtggttttggctggttttttttttttttaaataaaaacagcactgaagaagtagaaggaagatattcagggtttttatttttattttttgagtctgggtctcgctctgtcacccaggctggagtacagtggtgagatcatagcttactgtagcctcgacctcccgggctcaaagatcctcacacctcagccttccaagtagttgggactacaggcatatatcatcatgcctggctaaattaactattttattttaagagatgtggtctagctatgttacccaggctggtctcgaactcctggcttctagcaatcctcccacctcagtctcctgaatcactgggattacaggctggggccatcatgcccagctctaggtttttaaaatgtaggcaaggaggtcagcatttacacaaaagcagggtttgatcttaggaagcttaataaagagaggggtctaatcaaggtttcctgtaggatctgggctttaagttaggccttaaagaacgaagaatgtttgtgggtgtagtaagcaatgacttggagcagagccctctagccattgggctcaccctcacaggcaggcgccactgaccctaggggggtgtaggcagctggaggaagtactgtgtgtcccccattccagcgatggtggcccctctcagagtcaatacccttccttccaagagactgaacatacaactggacaatggccaggccacatatgacaatagactctggccagaaacccatgaccagcctgggaagccaaggaagccaaaccacagcctcagcagcaatcggacccagaacagtctgaacttagtggctgccagcttcttcccaatccccagccaccacaccccctcttccaactccagaccaaccagagaaagccaaatatacccccccaaccaaccaaagatgcccctccagttagtccgctctgtccccatgccaacaatctccaatcacagcacacccagagccttccctttttttccactataacatttcacagtccctgcctgcctttgacccctgccaaatacaagcaatcatggctgactcctttgcaaactttgaccaaatggcctctctgctcttgtttaggtggtttttatttccacatctccaacagggagtctggaaacaaactgacaatactcgtgaaatcaacacccagatgaggtagaccagcactccaggatgcccctccccagtatccctcccctgttaactgttcccctggcttctaacaccatggatcagttttgcttatttctgtactttttgtaggaagagaatcatacaatgaattctctcttgatgatgaggactctgacctcttttgcttgacctcatgtctgtgaaatttatccatgttgctgtgcatagcgatattttcattcatattcgttgctgtgcagtagtattcgaccctgtgacttcactgtagcttcaactgtggatggacatttgggttggtggatggacatttgggttgtttcaggtttggggctacagtcagcgtgtggttagaaacattcttgccaatgtctcggtggacatagctttctgtggtgtacatacccaggagtggaactgctggatcagtttatacgtatgttcggcttttggtagatactgccagttttccaacagggtcacaccagcttggtccattcaggttacaatgaaacaccttagcctgggtaatttgtaaacaacaaaaaattatttctcacagttctagaggctgggaagtccaagatcaaggtgccagcagatccagtgtccagggcgggctctctgcttcagagatacggtgccttctcactgcatccacacatggtagaagggacagaagggctccctcaagcctgttttataaggtgctaaccccattcatgatctccaccctcatgacctaaccacctcccacaggccccacatctttattatttttttgagatggagtctcgctctgtcacccaggctggagtgcagtggcacgatctcggctcactgaaatctccacctactgggttcaagctattctcctgtctcagcctcccgagtggctgaaattacagatgtacgccatcacacctggctaatttttgtatttttagtacagatggggtttcaccatgttggccaggctgatctcagactcctggcttcaagtgatctgccccctgccagcatcccaaagtgctgggattacagtcatgagccaccatacccagccccaaaggccccacctcttaatgccattgctttgggggttaggattcaacatatgaattcaaagggtacacctacattcacaacacagcactgacttagattccctgcaaaacccatgagagtttcatttcctccatattttcatcagcatttcatcttgtcagatttactctctataggttctaagtattattccccctctgctgatttacttattataaacagtacataactgatcagataaacacttgtccctttgccacccctaatgcctgcccccacttcatattccaggaacactccattaaaccaccccctactgtactggtgggtggtgggagggggctcatcgggtggggtctttgccgtattattctgtgtcactgaggcctatcacagtgctctgcacatgtaggtgcaaatatctgttgtatgattacataaaagaatgatgtgaaagcctatttgtctgtaccacaatcatgaacgtccccaaccacttgaaggcactcatagtgtcttaatcatcttaggccttcgatctggcataggtaactcctttaataaacaatgtctgctaaaccaaatggcttcctgaggcctggcattttaggctgtgtcccctgccccacctcgcccagcctggggcattgagcctggctgggcacacacgtgatagttgtaatcatattgtcataacatccctgagactacattaattacatattgagtgttatagtactattatagcaggtggcagatgttggcacactgggcagagatgtgttggtgtgaaaaacctctatgtactttaaagacagggtctccctctgttgcctaggctgaagtgcagtggtgccatcatagctcactgtaacttcaaactcctgtgctcaagtgatcctcccacctcagcctcctgagtagctggaacttgaggcacataccaccacacccagctaatttttaaattttttgtagagatagggtctagctgttacctacactggttttgaactcctggcctcaagcagtccttctgccttggtctcccaaagtgctgggattataggtatgatccaccacctccagccaaaatctcactttaagtggggtccctaactccagacatgtgataagctgtggttcacaggcataaagaacatccagcctggggccccggggtcagagttttccctcgcattgtcccctgggtccttcatccctcctaatcttgcaaaccagctgtcaattgggttgagatggtatctctttcatagggtcattatgaggattaaatgacttaatatatgtaaagcacttagcttaatgcctggcagacagtaaggtatggagtaagttgtaacccttattattattgctgttgctgttagcaacagagtgaggaatgctaggagtgaccatgcccagcaccgaatgaggccttcatagccttgggctaaaagaaaaagagcagaaaggtgaacacaggggaaggcctcaatttcaacacagatgcattagaccaaggactctgaactcactttccctggaggtgggggtgctatcagctgcttaatggagcatcatggaaaatgtgggactcaaggcctgaaggactccattcctaagagatgggagcaggagacatgctacggagtttgaatcttgcctagcacagggatttctgcctgctggaagggctctgtcagggcctagtggaagcccctgcctcagtggggcaaactgccactggacacacccatcattcatcatcacctctctgggacagtagtagcagccaggcacctccaaagagcttgacaacagaggaacccgcttcggcccctcctctgaagacaggatcctgcgctactccaactctgaactggttcaaggtgagagacgtcatccacagaggccacaaaaccaagaggtggatgcctcattgttacttcatgctgtctgggagcaaagagagggccttaggcacaaaatcctccagacccgcatctgccccttggctttctcaacccttcactctccaacttctataaataacctgtacagtggccaggcaccgtggttcacacctgtaatcccagcattttgggaggccaaggcgggcggatcacttgaggtcaggagttcgagaccagcctggccaacatggtgaaaccccatctctaacaaaaatacgaaaattagccaggtgtggtggcgggcatctgtaatcccagctacttgagaggctgaagcaggagaatcacttgaacctgggaggcggaggttgcagtgagccgaagttgcaccactgcactccagcctgggcaacagagcaacactctgtctcaaaagaaaagaacctctgcagaatgaggggaagcagggaagcaggcaggggtgaacaagatggccatgaattgataattactgaagttgggtgatgggctcatggggatttgttattctactctctctacttttttgtgtttgaaagttcataataaataatgttgctcaaaggaagctattaatagtttgaggccaggcagggtaaagagcatctcctagattttttttttttttttttttttttttttttttttttttttttagagatagggtcttgctttgttgcccaggcttgtctcaaactcctggcttcaagggatcctcccacctcggcttcccaaaatgctgggattacaggcacaagccaccacatccaacctccctcatatttgactaagaagtctcataaatctgagaacacctagcaaggaattaaggcgagggtgtggcactgttctggcttcagtctatcaccaggcagagtccacgcattcttcccagggagaaagaagcagtgacagctcttgggctttgagggaaatgattcagcgggagaaagaaggtggagaggggctaatatgcagataccattgctgcaggtggctctgcccctaagcactgaggagggcactggtccctctggccccacccagccttcaccccaaggtgaagtacgctttctcaggtccccaaggatgggtggccaggtcccccactgggagtggaggtctcactcccttccttgggttctgacctccacattatctggctgtgagggtgacctgcctggctttccccaccaagtgcagctccccgcagctgaaagccacactctcaacacaggactcctgagatctgacactggccaattcacaccctgcttgaagctggcatttgagaggccttcaggttgacaacagcagcaacaagtttgctgttcaaagtaggccaagtcacggctttgagcggcatcatttgaaaagtgctgggatcagccaggcgcagtggctcactcctgtatcccagcactttgggaagccaacgcaggtggagcacttgaggtcaggagttcaagaacagcctggccaacatggagaaaccccgtctctactaaaaatacgaaaattagtcgggtgtggtggcaggcctctgtaatcccagctactcgggaggctgaggcaggagaattgcttgaacccgggaggcggaggttgcagtgagctgagatcatgccactacactccagcctgggcaacggagtaagactgtctcaaaaaaagaaaaaggaaaaaaaaaagtggtggggtttgggtgcagtgtctcacatctgtaatcccagcactttgggaggctaaggcaagatctcatgaggccaacctgggcaacataacagcatgacctcatctctataaaaaatttaatttggctgggcgcggtggctcacgcctgtaatcccagcactttgggaggccgaggcgggcggatcacaaggtcaggagatcgagaccatcctggctaacacagtgaaaccccgtctctactaaaagtgcaaaaaaattagccaggcgtggtggcaggcgcctgtagtcccagctactctggaggctgaggcgggagaatggcctgaacccaggaggtggaggtcgcagtgagctgagatcgcgccactgcactccagcctgggtgacagagcaagactccatctcaaaaaaaaaaaagaaaaaaaaatttaattagccaggcatggtgacaggtacctgaagtcctagttactcagaaggctgaggcaggaggatcgcttaagcccgggagtttaaggatacagtgagttatgattgcaccacttcgctccaggctgggtgattctctaaaaaaaagaaaaaagaaaaagatgggaggatgggaggcggggctaggggactgggaaggtccctcaaccctttctacatgccttacccagggtatctcccatcatggctggttactgtgctaaaattataattttttttctttgagacagagtatcactcggtcacccaggctggagtgcagtggtgcgatctcagctcactacaacctccgcctcctggcgggctcaagtgacttatcttcccacctcagcctcccatgtagctgggactatagatgggcgccgccatgcccagttactttttgtattttttacctaggctggtagtgtgctaacattctaccacttgggcaacagtcttcggggctacatactgcctttttttttttttttgaaacagaataccactctgtcgcccaggctggagcgcagtggcacaatctcggctcactgcaacctccgcatcc

SEQ ID NO: 3191 - DNA, 351 bp, Homo sapiens
ctgcctccgtagccaaatcctggtctctggccttcggccccctgcaagagaagaccacggagctcaacctccacccgcggtgctgggcacgctgcttgagccactgggagctgccaccagggccccggggaagggcccaggccccggactggactgggaacagttgcttaccttcacgctgtggggtgttcaagagaagattagcaaacatcaagcaaatcaaggtaaggaggctcctgcctacacgggtttggaggactcggaccctggggggctgtgcgctgtgtaggtgccggtccccggaggccccggcctgcgcctttgctgggggctccttttgctgattgattt

SEQ ID NO: 3192 - DNA, 1674 bp, Homo sapiens
ccagctatgggtaccagatcgaagcccagccaagcagaatcctgccttgggctttacactaacggaaggtcctttttcttatggttaggggacccagaaggccagcagccagggttccctgacaaaagcatgtagttgagtacaagttatcaatccgagggacaagagggagggacaagaaccagtctcagctgcattcacatcctggaccctgtcatctcaaagccagttccctccctgccttccaacttggtttcattcactttggattgagttgcgttctcactgaacagaaacccacaacccaaaacaagggcagcccatggccgtgattaagctctgcaccagtggcgaagggatcgagtgggagaccagaattccagctccgccctctgtgcggcctcaagggagttatgaacttctgagccttagacatgcttcctgagctgccaccaagctgcctcatggggctgtcctaaggattaatgtattaatccaatcccaggcacatcagtcattaataaaattaagaatacggtgacaactaagcccactacctttggaagtaactccttactaactacattaaacccaaactcgaggctctggaaaagagaatgccagctgggagacaaaacggcagaaaggaaggtttctccaggctctggccagacaaaatccttctctgcagaggatgctgctccagggtcccaactctggccacagtccccttttcccaccaagtttctgtaccccagcagttctctccaaaatccatcagaccccaaaacccgagaatggacctctgatgaaagcatctgagagccgtccagccccaaaaggagacaagcagggtcacatctgggttccagaagcatccagggaagcaaaccactgatttatacacaccagaaaagatacctgagagtgtatatttatagaaagatacatagaaatggacagatggcatctatctatagatacagaaagctctgttagagaaccgtgtaggtacgtatatatgtgccacatcctccaccacaaccaacagcacacaattgcctggatcttggaaaaccacgcttgtttaagtggttggttccctccctagcagtttccaaaatgagaaggatggtctcagggatagtccttaaatacgtgtgtgtatcactgtaaagtagagagagaagaaggagaaggaagagaagtggattttcatgtcgtgcatggcagaagagatgggactcttggggaaaagggcttgatcccactggaaaagcatgaaagacaactccagaaaagacagctaaggtttctaggttgggacataaaaacacaacagcaagacgttcgcactctgcagtccactgaaatcccttgtagcatataacaatcagttaagggcaaaataaaatcagaataatactaagaggtagcagctgtttatcttctcggagatttcgagggtctctggaagccgggccaagtaagggtgctctcctggaagaggctggggtggggcagagttgaggctaagggctccctggctctgggaagggtgtgggctgatccacatagatgctgcagatcccgagccccgagggagcctctgcccattacaggccactcaaaaccagagtcatttcctgggctagttatgcagtccccacaaca

SEQ ID NO: 3193 - DNA, 14005 bp, Homo sapiens
ccccgtctcttccttccctgcttgcctttgctttttgctgctttcccgcctccctcctttttctccgtctttccgtctctgccttcgtttccctccctccctttttctttcatttctctctccctttctccttcctttcttgctacgtttcttccctctttttcatttttttccttcctttttctgcttttctccctccgcccttcctctgttttttctttgctccctccctcttttttctccctctttccgtctctccttcccttttcctctttccttcccttcctcccttttctgcctttccctccttccctctcttttccttttcctctttatttcctgtctcccttcctctcgtccctttctcccctctctcttttccgttttttttttcttttgagacagagtttcgctcttgttgcccaagctggagtgcaagctccgcctcccgggttcaagcgattctcctgcctcagcctcccaagtagctggaatgacaggcatgcgccaccgcgcccagctaattttatatttttagtagagacggggtttcgccatgttggtcaggctggtctcgaactccggacttcaggggatccgcccacttcggcttcccaaagtgctgggatgacaggtgtgtgagccaccacgcctagctgtctcttttccattttttaatttttttttcatttttcctctctccctttgcctctctttttcttcttccttttattctttcctgtcttgttctttccttcctctctgtttctccctttctccctgttttccttttttttttttgagatggagacttgttctgtcaccgaggctggagtgcagtggcgtgatctcagctcactgcaacctctgcctctcaggttctagagattcttgtgcctcaacttcccaagtagctgggattacaggtgccagccaccccacccggctatttttttttttaaggacagatggcgtttcaccatgttggccaggctggtcttgaactcctgacctcaggtgatccgcccacctcggcctcccaaagtgctggattacagtcgtgcgccactgcgtcccgcctccttttcttttttcttctctcctccgtctttttctatcctacctccctgcctctttcctctctcctccctccttttcctttttcttctctcctccctccctcctgtttttctccatcattccctctcccttcctttctttttctcccgttccccgtttgcctccctcccctttttctttcctgtctccctgtctcctttgctcttttcctccctttctcccgtccctccctccccgccttccttttcacttctttcccttcccattgcttccttgcgtttcctgcctttccctgtctctccctttctttcctgcctttccctgcctctctctttcctgcctttccccatctctccctttcctgcctttccctgtctctccctttctttccctctcctcccactctccctccttcctcccttcttttctttcctcttctttccctgtgtctttcttttttctttccttctctcttccttttctctccctgtgtctttctcgctcttgtttttcctttctctcctttgtgtactgagaaaatgacagtccccggctgtgggtgggcaggagtgacccgccccagagagcggggtcaccctgggtgactcctgggtgcagctgtgagccctgcctgaggcttttcctgacctctggggagggcggctcagcctggggctggaggttggggccagctctggaggctggagtggctgctgggcggcgggacgggtgtctcagaagtcactgaggcatgggtaggtctaaccttgggacattgctgtggggagggctgtggagaccaagcacattcctgaggctctgccagggcagcgggggtggacagtgtcccctgaggacccaggaccaagccaggctcgctacaggggtcctggaatagaggacagaggccaggagcgctgtgggtgctgggcaggggtggggagtttgctggggagctgcgccttacagacctgtgtttgtttcccagcctcagcgaggccgggctggacggggccctggtgctggttttcagtgcctcagcgaggccgggaccagagctgctatttccagatgaggctggctcgcatctgctctggccggggctccaggcctgagccctgcaacacggcgttccctttccaagtctgcaaagcctgtcttaggggagagaagaagtttccttccatgcgggtggggacggctaaccatgtccagacactgagaccggtgctctgtgtgctcagccttcagcctgcactggcttggtggcttggtgacccgccagcagggtggtgctgtctgtgggctctgctcaagctcctctcagagccaggaggatgcccgcctgcttgggcctggctcccaggatgtgcttggcaaatgcttctgggatggatggatggatgggtgagtggataacggatggatggataatggatagatggataatggatagatggatggatggatggatgatggatggatggataatgaatgggtgggtggatggatggatgtgctcgatcggcaaatgcttctggaatggatggataattggatgggtaatgggtgggtggatggataatggatggatggatggataatggatggatggatggataatggatagatggatggataatgtatagatggatggatgatggatggatggatggataatgggtggatggatgatggataatgggtggatggatgaataatggatgcttctgggatggatggataatgagtgggtggatggataatgaatgggtggatggacagatggatagatggatatgtttgcttggcaaatgattctagaatgaatggatggatggataatgaatgggtgggtgggtggatggatggatgcactctgttggcaaatgcttctgggatggatggatggataatggatggatagatggataatcaatgagtgggtggatggatggatagatggatgtgtttgcttggtaaatgattctggaatggatgggtggatggatggatggatgcgctcgatcggcaaatgcttctggaatggatggataattggatgggtaatgggtgggtggatggatgcatggatagatggatgtgctcactcagcaaatgcttctggaatgaatggatgatggatggatgaatagatggatggatggatgaatggatggatggatggatggatgaatgaattgctaattggggctgtttttccatacagagtgctgcacgtgggacttagccttggacactaactcctttgcccctcgtatctgggagggaacaacacagttgctatgcctgactagggcatgacctgggaggcctttggggccacacagcctccttgggaaaggaggatcaggtgggcctcacacccaggaattggaagtgggagagacaacagctgctgggtagtgggggtagagctgtgtctctcactgccctgcccctccaaggaccaagaagaaaggaatgagccccgatccgcctgccaggtacccacccatgagaaccccttctctgccagcatctgataaaattacctgcgtagctttagagatcactgctgcctgaccagcagccgctctgctggaatctgtccagaaagccccttggggctcagaaaagtaggtgggttaataatagaagtagatgtgggtttttttgtttgtgtgtttattgagacggagtcttgctctgtggcccaggctggagtgcagtggcgtgatctcggctcgctgcaatccctgcctcccaggttcaagcatgtcttctgcctcagcctcccaagtagctgggatagcaagtgtgcaccaccacgcctgatttttgtatttttagtagagatggggttccatccatccattccagaagcatttggcaagcacatcctgggtgccaggcccaagcaggctggtctcaaactcctgacctcaagtgatccgcccacctcggcctcccaaagtgccgggatgacagctgtgagccaccgcgccccgcccagaagcagaggtgttttaacgggaagacttcaggcttcatcggacggccgggaaggaatcagagcaggggtgaggttggctttgtgcggggtggggtggggtgccaggctctgtgtcgggtgggggcagcagcacatcttttgtaattaatcattgccgaggctctgcctgtacgaagtgtggtccggggagggctgatgaggctgcaggatgagggggcttgacagacccctttccccagaagagggcccccaaaaggcattgcccctgaagagggctccccaagacctcatccctgaaaagggactcccagggtcacccccctgaaaagggctcctcaaaaggccccccgaacggggtccccccaagactgccctctgaaggaggcccccgaagacttcccccgtgaaggtgccccccaagacctgccccctggaagagggctccccaagacctctccccctagaagagccccctaagacttttaccctggaaaagggctctctgcaaagcttccctggacgtgcgccttcgagctgggcaggtagggaggagctgtgtactcgacatcatccttaggatctgttgtcctcccgcttcccctgccccggcccccagatgaatccagaggctgttttagagccagacggacactcctggtatgcaccagacactcatagtgcagtgctcgctgagtagaggaggagttagtgggtgaacccggcccgccaggctgccctgcacagaattccagccttgtcaccccactggtttttaaatcatcacaatcctcgggatgttctgtgcatgccacacacagactcttaagagtccagaggtcctgtttttgcacagttactccaatgaataaaaagacgggctgggcgtggtggctcacgcctgtcatccgagcactttgggaggccgaggcggggtggattgcctgaagtcaagagctgaagaccagcctggccaacatggtgaaacctcgtctctactgaaaatacaaaaaaattagctgggcgtggtggtgggcgcctgtaattttagctattgcggaggctaaggcaggagaatcgcttgaacccgggaggcggaggttgcagtgagccgagatcacaccactgcactccagcctgggcgacagtgagactgtctcaaaaaaaaaaaaaaaaaaaaatttctagcagacactgaagggagagggagaggaacaagccccagggaccctttatccgacttccttccacctgggggactccctccacgggcccttgctttaagggcaaatggcgagggcaccagaacacagggaggccatgccggaggtccctgctgcaaccatgcggccccccagctcactcccagcagccaagacgaaggggggcctgggctccccctagggcaggcgcctctgattctctccaccgagaggcacctcccatgccggcctcttcctggggtgactcccagaaccttcttggacccatgaacatttcaatctggggtggggccttccctgggcatccaagtggtgggaatctgtccctagcccctagaactcctggagggctgggcccacctctgtctgcatcccgtccccattccccgccccgggtggcaggggctggagaggaaggagcttcaggcttcaaaaccatcaaagcaggtttcttccgagatggccagtggtcacctgagatggagcagagagcacctgtggcgggcatcttctctagaagccgcctgtgagccctacggaggccctgggcttcgtgccgtaagacagacggtgtcctgcaggtacgtgggggaaccctgtaggcagggactttgcctgctttctcagaacaggacagaggagtttggctggggcagcccgaggtgaccgggatgctgtcgccccagctctgggccaggctgatgtgggaagggaggaaggagggacagttacgggccaggctgacgtgggaagggagggaggagggaggtaggagggacagaggcctggctgctctgcagggctgggctccgtggcatctcctggtggctgtcaggtcctgcctggccccacgctgaggccagtgtgatggaggggcctggaagcctcatccttcttgattgccacgcggtgagggccacaggcatgcgccaccgcactggactccccctttcatcatcaaagccaaattttcttcttgtttcatctaggcctcccatggagacaccatgtgtgattgtaaaaaaaaaaaaaaaatgagtcaggccgggcacggtggctcacgcctgcaatgccagcactttaggaggccgaggtgggcagatcacctgaggtcaggagttcgagaccagcctggccaacatggtgaaaccccgtctctactaaaaatagaaaaattagccgcgtgtggtggcgcatgcccgtaatccctgcactgtgggaggccgaggtgggcggatcacctgaggttaggagttctagaccaccctggccaacatggtgaaaccccgtctctactaaaaatacaaaaattagctgggtttggtggtgcgtgcctgtaatcccagcactttgggaggccaaggtgggcggattacctgaggtcgggagttccagaccaacctggccaacatggtgaaaccccatctctactaaaaacacaaaaattaggcgggcatggtggtgggtgcctgtaatcccagctactcaggaggctgagacaggataactacttgatcccgggaggtggaggttgtagtgagccaagatcgtgccattgcactccagcctgggcaacagagtgagattctgtctcaaaaaagaaaaaaacagaccaaaaaaaaaacggagtctgtccagaattatacacagtcacctgtgccaggtaacaacccttcagtcaacaacggccttcctagacagcggaggtcccaggagatggtaatacagtagttttcgtgtgcctttatttgtagacacacaaatccctaccattgtattacagcagcctgcagcactgggcacactcacctgctgtccaggtttgtagcccgggagcctggggccctgccgcacagcccaggtgagtagcaggctgtatgtgccacggcggtatgtgtgagtgcaccccgtgatgggcacacaaagagaattgcctaaggatgcatttcccgaaacaggtccctgtcattcagtgacacacgtgactgtgtgtgtgtgtgtgtgtgtgtgcgcacagatgggtgtgtatgtgtatgtatacacacctgaacactcacacctctacacacgtgcctgtacacggatagaacacataatttacagaatttatggaacacataatttatattacataaaatatatagagatcagttttgttttcttttatttatttatttagacggagtctcactctgtcgcccaggctggagtgcagtggcacaatctcggctcactgcaacctccacctactgggttcaagccatcctcctgtctcagcctcccccctgtagctgggattataggctcctgccactatgcccggctagtgtttgtattttgtgtagagacaggatttcactctgttggccaggctggtctcgaattcctgaccacaggtgatccgcccacctcagcctcccaaagtgctgggatgacaggcgtgagccactgcacccagcctatttcagctgttttcttaaagcacaaagcaacctacacattcttttgtgataccaggccactgtaagggtggagcagcatgtgactttggtgttattgagatcatccgtgaccattgcagaaaaccactcccatctgtgcagtgagcaccttgaaataggccgcccaggaggcagagggtgcaccttgaaattgggctaggaggcggagcttgcgccttgaaataggccgcccgggaggcggggcttgcaccttgaaataggccgcccaggaggcggggttgcaccttgaaataggctgcctgggaggcagagctcgcaccttgatataggccgcccaggaggcagggcttgccccttgaaataggccgcccgggaggtggggttgcaccttgaaacaggccgcctgggaggcggagcttgcaccttgtaataggccgcccgggaggcggggcttgcaccttgaaataggcctagaaggtggggcttccaccttgaaataggccgcccaggaggcggagtttgcaccttgaaatagactgcccaggaggcggaggttgcagtgagccgagattgcattattgtactccagtctgggtaagaagagctaaactccagagtctgtctcagaaaaaggaaaacagctgaaatataggagactgacgcccagcccaggaacaggtaagctgggtgcacgcgccgtgaaaacagcacctaggcctgctccggttctcgctttgcagatgcctcctgaacctcagtgcctcctaaggtcaaggctgtgagttaaagggctccaccccagcccagccccaggttggcccagccattccctggtggaggggccagggaggaaagggggctgtgtgggcaccagagggtgaactgaggtctgagggtcgggacacaggccgggaacagcagctgggagcggagcacgggggaaacgtggatgcgctgagctccctacaaccgcagtgagcatgtgcccaggagggcctcacggggtgggtgtgagtctggcctgcctgggctcggggtggggggtgtttacagacgcatttcagccccgcagcaggggctggggaggtcccgctcgtgacagtctctgcaccaaggcaggagagatggaagccgcccagagaactgccactccatagcctgtgggcatccaggggtgagcggcagcgatggcgccccatggaggaaacacactggaaatcgtgcagaagatgggaagatgcaggctggagtgcggagaaggactgagaccctgcctggtagacggcaccgtcacagcagccgtctgcctgctaggaggagcgtctccaccagcagcaggccggcccctgagggagacagcagagagctggagtcctggccagccaggcggggatccttcagcaggacacaggggacacagcaggcaacaggagctcagaacggtgagcagaggctgctgagaacccttggccagggggcccacacaggtaggggaggggagagagacagagacttgatgcagggcggacagacagggagaaggagatttgatcgaaagatggatggatagatggatgcatcacctgggccttttccggttctcctggatgcatggatgaacagatggtagatgatgggtgggtaggtaggtagaaagatgtatggataggtggacgcatggatgagaaggatggatggatgaacagatggtaagtgatggggaggtacatggatggatggatagatggatgcatgtatgagatggatggatgggtgaatagatggtagatgatgggtaggtaggtagatgagtggatggacagatggatgcatggatgtgatggatggatgggtgaatagatggtacatgatgggcaggtagacggatggatagatggatgcatggacgagatggatggatgggtgaatagatggtacatgatgggtaggtaggaagatgaatagatgggtgcatggatgagatggatggttgggtgaatagatggtagatgatgggtacgtaggtagatggatggatagatggatgcatggatgagatggatgggtgaatagatggtagatgatgggtaggtaggtagatgaatggatggatagatggatgcatggatgagatggatggatggatgggtgaatagatggtagatcatgggtacatagatagatgaatggatggatagatgaatgcatggatgagatggatgggtgaatagatggtagatgatgggtaggtaggtggatggatggatggatggatgcaggcatggatgagatggatggatgggtgaatagatgggtaggtaggtagatagatggatgtatagatggatggatggatgggtgaatagatagtagatgatggttaggtaagtaggtagatgaatggatggatagatggatgcatgcatgagatggatggatgggtgtatagatgatagatgatgggtaggtaggtagacgaatggacggatagatggatgcatggatgagatggatggatgggtgaatagatggtagatgatgggtaggtagatgaatggatggacagatggatgcatggatgagatggatggatgggtgaatagatggtacatgatggacaggtagatagatgaatggatggatatatggatgtatggatgagatggatggatgggtgaatagatggtagctgatggataggtaggaagatgaatagttggatgcatggatgagatggatggttgggtgaatagatggtagctgatgggtacgtaggtagatgtatggatggatagatggatgcatggatgagagggatggatgggtgaatagatggtagatgatgggtaggtagatgagtggatggatagatggatgaatggatgaatagatggtagatgatgggtacgtagatagatgaatggatggatagatggatgcatggatgagatggatggatgagtgaacagatggtagattatgcgtaggtaggtagatgaatagatgggtgcatggatgagatggatggttgggtgaatagatggtagatgatgggtacgtagatagatgaatggatggatagatggatggatgggtgaacagatggtagatgatgggtacgtagatagatgagtggatggatagatggatgtgatggatgggtgaatagatggtagatgatggatcgttaggtggatggatagatggaggcatggatgagatggatggatgggtgaataggtaggtaggtagatagatggatgtatagatggatgcatggatgtgatggatggatgggtgaatagatagtagatgatggttaggtaggtagatgagtggatagatagatggatgcatgcatgagatggatgggtgtatagatgatgggtaggtaggtagacggatggatggatagatggatgcatgcatgagatggatggatgggtgaatagatggtagatgatgggtaggtagatagatgaatggatggatagatggatgcatggatgagatggatggatgggtgaatagatggtacatgatgggcaggtagatagatgaatggatggatatatggatgtatggatgagatggatggatgggtgaatagatggtagatgatgggtaggtaggaagatgaatagatggatgcatggatgagatggatggttgggtgaatagatggtagctgatgggtacataggtagatggatggatggatagatggatgcatggatgagatggatgggtgaatagatggtagatgatgggtaggtagatgagtggatggatggatgaatggatgagtagatggtagatgatgggtacgtagatagatgaatggatggatagatggatgtatggatgtgatggatgggtgaatagatggtagacgatgggtaggtaggtggatggatagatggaggcatggatgagatggatggatgggtgaataaatgggtaggtaggtaggtagatggatgtatagatggatgcatggatgagatggatggatggctgaatagatggtagatgatgggtagatagatgaatggatggatgagatggatggatgggtgaatagatggtagatgatgggtaggtaggaagatgaatagatgggtgcatggatgagatggatggttgggtgaatagatggtagatgatgggtaggtaggtagatggatggatggattcatggatgagatggatggataggtgaatagatggtagatgatgggtaggtaggtagatgaatggatggatagatggatgcatggatgagatggatggagggatgggtgaatagatggtagatgatgggtacgtagatagatgagtggatggatagatggatgtatggatgtgatggatgcttgaatagatggtagatgatgggtaggtaggtggatggatggatggatagatggcatggatgagatggatgtatgggtgaatagataggtaggtaggtagatggatgcatggatgtgatggatggatgggtgaatagatagtagatgatggttaagtaggtagatgaatggatggatagatggatgcatgcatgagatggatggattagtgaatagatggtagatgatgggtaggtaggtagatgaatggatagatacatggatgcatgcatgagatggatggatgggtgaatagataatagatgatgggtaggtagatgaatggatggatagatgggtgcatggaacagatggatggatgggtgaatagatggtagatgatgggtacatagatagatgaatagatggatgcatggatgagatggatgggtgaatagatagtagatgatgggtaggtagatgaatggatggatagatgcatggattggatggatgggtgaatagatggtagatgatgggtaggtagatggatggatggatggatgcatgcatggatgagatggatgggtgaactgatggtagatgatgggtagatggatggatggatgggtgaactgatggtagatgatgggtaggtagatagatgaatggatgtatatagatggatgcatggatgagatggatggctgggtgaatagatggtagatgatgggtaggtaggtagatggatggatggatagatggatgcatggatgagatggatggatggctgaatagatggtacatgatgggcaggtagatgaatggatggatagatggatgagatggatgggtgtattgatggtaggtgatgggcaggtaggtagatgaatggatggatatagatggatgcattcatgagatggatggatgggtgaatagatggtagatgataggtagatagatgaatagatggatagatggatgcatggatgagatggatggatgggtgaatatatggtagatgatgggtaggtagatgatggatggatggatagataataaatgatagacagatgacaggtgacggagcattgttagaaggccagacgcagtggctcacacctgtaatcgcagcactttgggaggcagaggtgggaggatggtttgagcccaggagtttgaaaccaacctgagcaacatagtgagaccctgtctctattttattttttttaaaaaaggatgatagatgtataaagagagacagagacagggtggagagagggaggaagagacagagaagataaaggaggaaggaggagagaagagaaacagagattgatgatgatagatgagatacctaaaaagacacagagaggaggagacagagaggaagagggagaagagagagaaagagagacagaggccgggtgcagtggctcatgtctttaaccccagcattttgggaggctgaggcaggaggatcgcttgagcccaggaagggtagcctgggcaacatcgcaagatcccatctctacaaaatttaaaaaaccctaacagggcatgataacaaatgctggtactcccaaatactcgggaggctgaggcaggaggatcgcttgagcgcaggaggtcaaggctgcagtgaactatgatggcaacactgccctccagccaaatgctggtactcccaaatactcgggaggctgaggcaggaggatcgcttgagtgcaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaac

SEQ ID NO: 3194 - DNA, 12734 bp, Homo sapiens
gaagtgggtaaaaatctgtaaagccacgttaccattagcacgcagagagccttttctggagattgaaaggaagttgaagagctgggttagctatcatcgtaagctatcatcgttagtgatggcgtaaacctggctgctgtgttagaagtttgacttctcagacttactgcctgtgaaaagcccaaccaaccatgtgaagaagaactgaggtttgggccaacagcctcagttgaactcccagccagcagtcaacaccaacttttgccagccacgtgaagaaggccatttaaaaagtggattctccagcccactggagccacctcaggtgactgcgtgtggagcaaagaaaggctatttgagcccacattgcaaaattacaagcaaataaataaaattattgtagttttaagccactaagttgtttaataatagatagctaaaatgtacaggcaaacttggaagatactgtgggttgggttccagaccactacaataaagccaatatcataataaagtgagtcacagggatttttttgttttgcagtgcatataaaagttatgttgggccggcatggtggctcaggcctgtaatctcagcactttgggaggctgaggcaggtggatcgcttgagctcaggagtttgagaccaaccttggtaacatggtaagaccccatctcttaaaaaaaaaaatactaggccgggtgtggtggctcatgcctgtaatcctagcactttgggaggccgaggtgggtggatcacttgaggtcaggagtttgagaccagcctggccaacatggtgaaacccgtctctattaaaaatacaaaaattagccaagcgtggtggtgggcacctgtaatcccagctacttgggaggttgaaacaggagaattgcttgaacctgggaggtggaggttgcagtgagccgagatcatgccattgcactccagcctgggcaacaagagtgaaactccatctcaaaaaaaaaaaaagaaaaagttatgtttacactatactgtagtctcttaagtgtgcaataacatgtttaaaaaacaatgtacataccttaatttgaaaatattatatcgcttaaaaatgttgatgatcatctgagccttcagcaagtcatatttttactggtggagggtcttgccttgatgtttgttgactatcaaggtggtggttgctgaaggttggggtggcataaaataagacaatgaagtttgctgcatcaattgactatgcttttcatgaaagatttctctatagcatgtgatgctgtttgaaaggattttacccacggtagaacttctttcaaaattggagttagtcctctcaaaccctgctgctgctttgtcaattaagtttatatgatattttaaatcttttgttgtcatttcaacaatgttcatagcaacttcaccatgagtagatgtcatctcaaaaaaccactttgtctagaagaagcaactcctcatctcttaaagttttatcatgagattgtagcaattcagtcacatcttcagactccacttccaattctagttctcttgctgtttctaccacatctgcagttacatccctccataaagtcttagactcctcaacatcaaccatgagggttggaatcaacttcttctaaactccagttaatgttgatattttcacctcctcccatgaatcacaaatgctcttaatggcatctaggagggtgaatcctttccaaaaggttttcaattgactttgcccagatccatcataggaattgctatctatggccgccataactttacaaaatatatttcttaaataatagacttgaaagtcaaaagtacttcttgatccacaggctaaggaaaagattttgtgttagcaggcatgaaaacaacattaatctccttgtacatctcgatcagagctatagggtgacaaggtgcactatcaatggtcagtaattttttttttaatggagactgagtcttgctgtgttgcctagactggtctcgaactcctggcctcaagtgattttcctgccttggcctccttaaatgttggggttacaggcatgagccactgtgcccagcctgcaataatattttgataggaatctttttttctgaggggtaggtatcaataatgagcttaacatattcagcaaactgtagggtaaacagatatgctgtcatccaggctttgttgttccctttatagaacacaggcagagtagatttcgcataattttttttttaagagacaagatctctctccgttgcccagactggagtgcagtggtgtgatcatggctcactgtagccttgatctcccaggttcaagtgatcttcctgcctcaggctcctgagtagctgagactacaggtgcaactaatttttgtgggtttttttgtagagataaagttttgccatgttgcccaggctggtctcaaactcctgggctccagtgatctacacagctaccttggtgtgtcccaaagtgttgggggttataggtgtgagccagcatgcctgtcctgacagttttttttttttttaaagcactttaaatgtattatcccactgcgttctggcatccagggtttctgctgagaaaatggccagtagtctttttttttttcttttccctcagagtgattggacttcagctgatagtgttattgaggatcacttgtacattatgagttgcttctctcttgctgctgtcaagattctctgtctttcaacagtttgattataatgtgtctcagtgtgagtctctttggatttattttacttggagtttattgagattcttggatttgtagattagtgcctttcatcaaatttgggaagtttgcagccatttcttcaaataatctttttgcccctttctctaacccctctttgggaatcgtaatgcatatgttggtctacttaatggtattccacaagttccttggtctctgtccacttttctttttttctttttttgagacagagcctcactctgttgcccaggctagagtgcagtgacacaatcttggctcactgcaacctctgcctcccaggttcaagcaattttcctgcctcagccttctgagtagttgggattacaggcactcatcaccatgtccagctaatttttgtatttttggcagagataaggttttgctgtgttggccaggctgttttcgaactcctgacctcaagtgatccacccgccttgacctcccaaagtgctgagattacaggcatgagccacctcacttggcctatccacttttctttatttatttttctttatgctcctcagatttgaaaatttcaattgtcttattttcaagttcactgattcttctgtgtttgagctcctctagtaaattttcatttcagttattgtgtctttcagctatagaatttctgtttagctcctttttacaatttttgtccctttcttggttttctaattttgttaatataccattttcctgatttcctttagttttttgcccatgttttcttttagctctttgagcaaatttaagacaattgttttaaagtctttggtaagtcaaatgtctggatgtcctcagaaatggtttctgccaattaattttactcctttgaatgtgccatgttttcctgtttctttgtatgccttgtaatttttgtagtttttgttgaaaagtagacatttgaaaaaacagctaactcccctagtctttgcagattggctctatactggtacagttcttcagcactgagcaaggcttgctttgagcctagggatcagctgaggtgaaggcttaaggtcttttcagggcttttctgaccaagtgtcttacctgggcatgtgtaacttcccaatttccccatatacatggctgcttttgaatgtcttatttcctaaagagtctcagtccggtttctcctggggccttacatggtctactgtatgtatccacccatagtcttttactccacatgtcagtgggtctgtagtctccttgcagctttcatgagcaatgactaccgcttttctgagacctgaggccagtcctttaggtaacccccatatgcgcacaataatttgcaaaaagctttgctcttctcccttccatttaagggagggaacttggaattaggctgctgcctcttccagactaagagcactgccgcatcagggaggaggaggggacgagggcaaataaagacacgacaaaactttcttaacatttggaaggtgggcattcacttggttactgtaaacctttaactgttttttggagctcttacaggttagttcagctcatttctggttgttttatgaagtttctgttggataatgaaagcttggagctttgtcgtccaccattttgctgatatcacatgagcatccattttaataagatagaagaaaagagcacattggaccttaagtaagtgtaagaaaaggaatagaaagttaagagaataggccaggcatggtggctcacacctgtaatcccagcactttgggaggctgaggtgggcggatcaccggaggtcgggagttcaagaccagcctgaccaacatggagaaaccccgtctctaccaaaaatacaaaattagctgggcatggtggcacatgcatgtaatcccagctactcgggaggctgaggcaggagaatcgcttgaacccgggagatggaggttacagtgagcactccagcctgggcaacaggagtgaaacttaatctcaaaagaaaaaaagaaaaaaagatcaggagttcaagactagcctgagcaacatagtgagatctcatctctaaaaaaaatttagggccggtggctcacacctgtaatccagcactttgagaggctgaggcaggaggatcacaaggtcaggagtttgagagcagcctggctaacatggtgaaaccccatctctactaaaaatacaaaaattagctaggcacaatggctggcgcctgtaatcccagctacttgggaggctgaggcaggagaatttcttgaacccaggaggcagaggttgcagtgagctgagatcgtgccttgcactccagctggggcgacaagagcaagactccgtctcaaaaaacaaaaacaaaaaaataaaagaaataatctatattttgattattgtggtggttaagtaggtgaatacatttatcaaaattcagcaaactattcatttaaatgggcacattttatgtaagttatacataaataaattttattcataagtaaaaaaacagtttacagaggacacttccctgtcaaaatagtacatttgtctcgattaattcatatattttgagtgaaaaattttaaaaagtttattctctggataattactttgccttgtcacctggtatggacatttagtctttggtgccttatgagataaatgaataaagtgcttgggtagttctgatgagagagattatgtctaagaatacatcagggatggcttcatggaggaaaccatttttaatcttggccttaattaatagatacagagaaagaaagataaaaataaagaaaatagcatggcattccaggcagaatgaacaataaaggaaaacaatattgccttttgcaaaaatacactgtttttttttttgagggactctgtgttttcattgtttgtaatatcacgtctccgtgttaaagacctgtgtgtaattttcagtcattaattatgcacggatgatttctccctatgcagaatgctgtttgggcttaatcaggcaatcttttaaaagatgtagtctctagggatttgctatttaagaagtggaactagctacgttataattaaataattcctgctacagtaccatgtaaaaggtcattcatcattcaacatttatttattctacaaaatatttatcgagtgcccattatatatctggtactattctaggcaatagagatacacataagtcaatatttatccctcatggggcctaatattctttttttgttctttttttttattattatactttacgttctagggtacacgtgcataacatgcaggtttgttacatatgtatacatgtgccgtgttggtttgctgcacccgttaactcatcatttacattgggtatttctcctaatggtatccttcccccatccccccaccccacgacaggccccggtgtgtgatgttccctgccctgtgtccaagtgttctcattgttcaattcccacctatgagtgagaacacgcggtgttcagttttctgtccttgtgatagtttgctcagaatgatggtttccagcttcatccgtgtcactacaaaggacatgaactcatccttttttatggctgcatagtattccatggtatatatgtgctacgttttcttaatccagtctatcatcaatggacatttaggttggttccaagtctttgctattgtgaatagtgccgcaataaacatacgtgtgcatgtgtctttatagtatcatgatttataatcctttgggtatatacccagtaatggggtggctgggtcaaatggtatttctagttctagatccctgaggaatcgccacactgtcttccacaatggttgaactagtttacagtcccaccaacagtgtaagtgttcctatttctccacatcctctccagcacctgttgtttcctgactttttaataattgccattctgactgatgtgagatggtatctcactgtggttttgatttgcatttctctgatggccagtgatgatgagcattttttcatgtgtctgttggctgcataaatgtcttcttttgagacgtgtctgttcatatcctttgcccacttttcgatggggttgtttgatttttttcttgtaaatttgtttaagttctttgtagattttggatattagccctttgtcagatgggtagattgcaaaaattttctcccattctgtaggttgcctgttcactctgatggtagtttcttttgctgtgcagaagctcttgagtttaattagatcccatttgtctattttggttttgttgccattgctaatattcttaaattatatttaatatcaaacattctaagaaatcactctgtaatgaatgtaaaaccactttgggtagagagtatgataccagtagttctatttaatcttccttttaaacaaatatatatttattttaaaacatgggtttttcatgattttttttttggttaaattttcagcaatgtgtttaatactccaggataccaaaaaaaaaaaaaaaaaaaaaaaagcctggggaatttatagtctagatatggagaaaatacctatacatgacatgattaaagtacttttaagtagagtgtgtaatgaagtttgaggtaacaaaatacaacagggtaactgtgagggtgaaattgacatggggtcacaatattcaggggacatttatgaaggagtgttggtgagattttagttggtgcttccaggcagagggaacaagacagcaggcctggaagcagtgatgagtggggtatgtggaggacactgtgaagactggcctgtaataaagtttaacctgtaattcctttataaagatttccacttaggaaattaatcacagttatattcatagaggttcattacagtgttatttaaaatgatgaaaattggccagacgcggtggctcacgcttgtaatcccagcactttgggaggccgaggcaggtggatcacgaggtcaggagtttgagaccagcctgaccaatatggtgaaaccccctctctactgaaaatacaaaaattagctgggtgtggtggcatgtgcctgtagtcccagctactcaggaggctgagacaggataattgcttgaacccaggaggcagaggttgcagtgagcctagatcacaccactgcactccagcctgggcaatacagggagactctgtctcaaacaaacaaacaaaactccaaaaaagatgaaaattggagggaagtgatgacaactgtgactgttgtgtgacactgatttctctcatatttgtactggctgatcctgaggtgagtcaaaaaaagacaaaaatgtataaaaataaagaaaaataaaatgattaaaaaatggaaacaactgacattttaatcaataggggaatagaaatgacttagactgtattcattcaatagagcaatatgtagccatttcaaaacatgtttttgataacaaggtggtaaaatgtccatgatgaaataaaaatgttcaggccaggcgccgtggctcacgcctgtaatcccagaactttgggaggctgaggcgggtggatcacgaggtcaggagatcgagaccatcctggctaacatgatgaaaccccatctctactaaaaatacacgaaaaaattagccgggtgtcgtggcgggtgtcggtagtcccagctacttgggaggctgaggcaggagaatggtgtgaacccgggaggcagaggaggttgcatgagccgagattgtgccactgcactccagcctgggtgactgagcaagactccgtctcaaaaaaaaaaagaaaaatgttcataattatgtaaaagaagcagaatataaaactgtaagtacattatgatggtaattttatgaaaatgaaaaaaaatatgtatatcttagaaaaaaagcctggaacaaaatactccaaacattttatttactttaatataatttatgtatttattttatagagacaggttctccctatgttgcccaggctggtcttgaactcctgggctcaagtgatccttctgcctcagcctcccaaatttctgggattacaggcatgagccaccatgcctggcctccaaatattttatgatggttatcacttgttgatggaattataggtgatttttatttccatctttatatttttctgtaattttaacatttattgtaatgattacatattttgtttatgctcttagataatatttgtattagtttgctagagctgccataccaaaataccatgcacttggttgcttacacaacagaaattcattttctcatagttctggaggctagaagtccatgatcaaggtaccagtaggcctggtttcttctgaagcctgattccgtggtttgcaggtggctactttcccactctgtcttcatatggttttccctctgtctgcacatgtttctggtgtctcctggtatgcctaaatttctccttcttacaaggacaccagtcatattggattagggcccaccctgaaaaaaaaacagagcacctcattttaacctaagcaatgctttaaagaccttatcttcaaatatagtcacattctcaagtactggggcttaggacttacacaaattttgggaagacacaattcaacctatacactaatttaaaaagtaattggtatattattggtaatacagacacaaaaactggggcaagcctgactagagtagaaagatatgtggcaaatagcaataggagggtaggtgaaataacttcaatgataccttaattattgattgttcactgtgtactgggcattgtattaagatatcttgactgtctcacgaaatcattgatttaaatattgatttaatgtggcatcaagtttgggaaaacattgaatcatgacaagctgcggactttgggtagacataaggaatgatttcaaggtaggaaaatgacacgaggaagagtattttatttatttattattattattattattattattattattattattattattattattttgagatggagtctcgctctgttgcccaggctggagtgcagtggcacaatctcggctcactgcgacctccgcctcttgggttcaagtgattctcctgcctcagcctcccgagtagctgggattacaggtgtgcaccaccatgcctggctaattttgtatttttagtggagacggggtttccccatgttggccaggctggtctcaaactgctgacgtcagatgatccactggcctcagcctccttacaggcgtgaggcacagtgcctggccatttatttttattattttttttgagacggagtctgactctgtcactcaggctagagtgcagtggcatgatctcgactcactgcaacctctgcctcccgggttcaagtgattcttttgcctcagcctcctgagtagctgggactacagacatgcaccaccacgcctggctaatttttgtatttttaatagagatgggtttcaccagttggctaggctggtctcaaactcctgaactgtaatctgcttgcctcagcctcccaaagtgctaggattagatgcatgagccactgtgcccggccacaggaagggtattttaggaagattagtttggtaacagaatggattagtgggccaggcacagtggctcatccctgtaatcccagcacttcgggaggcggaggcgggtggatcacttgaggtcaggagttcgagatcagcctggctaacatggtgaaaccctgtctctactaaaaatacaaaaattagctgggcatgataatgggtgcctgtaatcccagctactcgggaggctgaggcaggagaatcgcttgaacctgggaggcggaggttgcaatgagccttgccattgcactccagtctggaagataacagtgaaactctgtctcaaaaaaaaaaaaaaaaaagaatggattagtgtcagtttaatttcagggatcagcaaacttttctgtgaaggactagaaagtaaatattttggggcatacatatggtctctgttgcaaatactgaactctgtcattataatgtgaaagcagtgacagacaataactaaatgaatgagcatggcagctgctaaatctcaggtttaagctaaagctaccttcttacatattttaagttcagcctaaaggtttctttgtacattgtgaactacaacctaaatggaattgtaaacagactgtagcctactcttgtgccaatcactgtttcggccaatcaaacatggccaactgttcaaactgttcaaatagggcaaatgccgagctacaagcaatccggctgtttctgtacctcatttccattttctgtatgtcactttcctttttctgaccacgtggctgctctagagtctctgaggatactctagctcgggaggctgtctgattcatgaatcatttttttgctcaattaactgttttaaatttaattcggctgaagtttttcttttaactcagtgtaccaataaaacttatgtacaaggaaaattgcaatgttcccaacacaaagaaaagataaatgtttgaggtgaaggatatccaaattatactgatttgatcattacacattgtatacaggtattaaaataacacacatacccccccaaatatgaacaactattatatattagttaaaaaacccttgatgtacaagaacaggtggtgggctagatttggctgattggccactgtgtggtgactcctggagtagaccatgtagaagggacagtagcagataaaaactggaggttcaagccaagttaggaagaaaatacggcaataattaatatctgcagtgaggagggccagaattaagctgggccaatgtgatggaaatggagatatattggagcccttttagggtaaaaggactgcagaccaggtgatgactggaatgcagaacttgaagtggagaaaatgaaagattttggggattctgagcagggaagtggggaaagggcagggcagtgccaccgacataaatggatacatccatgaactggccatttgcctggatgctcccaaatccttttctgctcttaccctctctaactcatatcacgtgaaactacttgccccctggcttctgagtgggttctggcaatggaagtgtaaaccaaaaataaaattctaagacccctcctcttggccaagggcattccagaattaacctgaaaaactagctcaggccatgatggaagagagggttggaaatgcctcgttataccctcttcccttttggaattcaggaaaagcccgaccagcattgaccaacacagatcttaagtctgatcagaaacatttacaatctactctctcagaagcccgctacctggatgcttcaagtgcaggataaaaccttggtttacacaacccctcactgtaacccagacattcctttctactgatagtaacactttcaacctgatgccaatcagataatggtttcttttttctttttttgaagcagagtttcactcttgttgcccaagctggagtgcagtggcgtgatcttggcttaccgcaacctctgcttcgcgggttcaagcgattctcctgcctcagcctccttggtagctgggtttacaggcatgcaccacgatgcctggctaattttgtatttttagtagagacaggctgggcacggtggctcacacctgtaatcccagcactttggaagactgaggcgggtggatcaggagtttgagaccagcctgaccaacatggtgaaaccccgtctctactaaaaatacaaaaattagccaggcatggtggtgtgtgcctgtagtcccagctactcaggaggctgaggcaggagaactgcttgaacctgggaggtggaggttgcagtgagccgagatcatgccactgcactccagcctgggtgacagagtgagactccatctcaagaaaaaaaaaataactaaaacaaattagccgcgcatggtggtgtacacctttggtcccagctactagggtggctgaggtggg

SEQ ID NO: 3195 - DNA, 688 bp, Homo sapiens
aagactatactttcagggatcatttctatagtgtgttactagagaagtttctctgaacgtgtagagcaccgaaaaccccgaggaagagaggtagcgttttctcctgagcgtgaagccggctttctggcgttgcttggctgcaactgccgtcagccattgatgatcgttcttctctccgtattggggagtgagagggagagaacgcggtctgagtggtttttccttcttgatggctcaatgacagagactagctcgtaaactccggggcgtttctgggctgttcgctcctgcttggcagtgtagcgagaaaggttttcgcctcctgtttcagcggtgacggctcttgggttttctcggggtggctttttaattttagtcttggcgcgaggcgggggatgctgtgtggcacctcctattgtctctttttgcgttttctcccattctcgctccctcttttgtcgccgtttcccgcccgccactcccacccccagacggggtctccgggtctcttgttctgtctgccgccccggctggagtgcagtggcgcgatctcggctcctagcaacatctgcctcccgggctcaagcgagtctcccgcctaagccctcccgagtagccggggcttaaaggcgcacacgccactccaggctttttttttttttttttttggcagaaacggggtgtcagc

SEQ ID NO: 3196 - DNA, 2641 bp, Homo sapiens
gttccggattaacgttcctcaataactaatgtttcccccggaccaactttccgttcagatcaactttccgtctgtgccaacgttcgccgcgattaccgttctgctgtggttagcgttccctcatccattggggtcgaggtcttgtaggtccatttggggcctattgaagattttttacgaatccatgcattttcttattaaaccttcattacgggcctggaaaatagatactgtgtttctatagtacaaatgccatcttctcagggagcccttgcccagacatccttttctaaaattgcaaccctccctttcccttaatgtacattctccctaccttcgttctcttccattccccccattcactttagactcatcaccatttaccttatacatttaacgtacatttgatgattttctgaggacctgctccgccctagcatgtaaagtccacgagcacagcgattttgttcttgctctctgctctgtcccagagactgggggagagagagaccctctcattttgttttatattgttttatactcagtacctgttttaagaagaaacaacaaggaagtgaaaccaaagacgggcagcccggcgccaggcccgaaaccaggcctgggcctgcctggcctaaacccagtttcatgtgtgtgaagagaccaccaaacgtgtgtgaagagaccaccaaacaggctttgtgtgagcaacatggctgtttatttcacctgggtgcaggcgggctgagtccgaaaagagagtaagcaaagggtggtggattatcattagttcttacaggttttgggataggcggtgaagttaagagcaatgttttgcgggcaggggtggatctcacgaagtacattctcaagggtagggagaattacaaagaaccttcttaaggttgggggagattacaaagtaccttaagggtgggggagattacaaagtacattgatcagttagggtggggcagaaacaaatcacaatggtggaatgtcatcagttaaggctatttttacttcttttgtggatcttcagttacttcaggccatctggatgtatacgtgcaagtcacaggggatgcgatggcttggcttgggctcagaggcctcacacccagtagctaaaaatcaactcataacttagaaaccgatgttattcatagattccagacattgtatagaagaacgttgtgaaactccctgccctgttctgtttctctcttaccactggtgcatgcagcccctgtcacgtaccacctacttgctcaaatcaatcacgaccctttcatgtgaaatctttagtgctgtgaggagcccttaaaagggacagaaattgtgcattcggggagctcggattttaaggcagtagcttgccgatgctgccagctgaataaagcccttccttctacaactcggtgtctgagaggttttgtctgcggctcgtcctgctacaagactagaagagtagcatattatattcagtaactgtttgctgaatacatgagggaattgagctaagtgtttggcccaacactgcacacacaaagtggcagagctagaatttgacccaagcatagttttgaatctggaggctttaccacctcacacattgcctcacctcctgaaggtttgatttgtagtgggattagtatcattcacctcacaatggatgtgcaatacaaatgtcagaggcgtgtgaaccagagcaactccatcttaaataggagctgggtaaaatgaggctgaaacctactgggctgaattcccagacggttaaggcattctaagtcacaggatgatataggaggtcagcacaaaatacaggtcataaagaccttgctgataaaacaggttgcagtaaaggagcctgctataaaccaccaaaaccaaaatggtgacaagagtgacctctggtcgtcctcactgctacactcccagcagcgccatgacagtttacaaatgccatggtaatgtcaggaagttaccctatatggtctaaaagggggaggcatgaataatccacccctcgtttagcgtatcatcaagaaataatcataaaaatgcctaaccagcagccctcgggggctactctgtctatggagtagccattcttttattccactactttattaataaacttgctttcactttgcactgtggacttgccctaattctttcttgcgctagatccaagaaccccctcttggggtctggatcgggacccttttcctgtaacgtatttctggcaaccacagaagggactatagtgcagaaacctgacccaatggctacctttgggtaagtgttggggtccgttaacactaccaggtgttcacctgcaaagggaaggtgtaatctgccatgttaaagacactgtgcaccaacttcttcatttctttctccacgatctcctctttcacttctgctgtccttttcaccttgctgtgcacagaactgatgacaggctctttccactggtacagcttgccactcaccagagcaaagctaaatggcaggcacaggaaagcatcaatgggaggcatagcacagtggggtgggaggcaggctctgcaggccacttccgttccaatcctagctcggctgcatgacttgcttccgtgtgactcgttttccc

SEQ ID NO: 3197 - DNA, 2485 bp, Homo sapiens
ctggagtggagccctaggactgaaattttccaaattgctcctggcaattcttatgtgcagccaagattgagaagattgaggggactaaaatagaactcaccatttctgtggcttccaggacacttcccagagacttcataagtatttctgttcctagcctcagactctttaaggttgagaataggagacctcacaatcatactgctgacttaggctttcttacctgtctgtaagagccttatgagcggacacacacagtctatatatagatacacactttttacattatactagaagatgatgcctgtgatgtttatggtcacttactatgtttaaaaaatgcatgactggcctatggtgactcattatttcttcccagatgcttgaaccatgatgccagtgagtggaaatgactctattgggtgggatgggcccagcaggtcagacttacttaggcactggcactgagaaaagcaatactgactgggtgtcgtgtacgtgtgactgcccatagcaataaccctctggtactgtgtctgtttatgtaaaaacttcttgtttggtagttttgactcgtatttgtagagctaggtactggttattattgtgcttcatcctatcccagatttcccagtacattcctttagaagacatgtccatctccaactgctgggggctggccttttctgtaggccaaggtgctgccccattagccccacctggttgtcatcactcacccatgtgttgtgtccatctctgacccatttcccctgccaccttgcctaaagcttctcctgtcagcctccccaccaccatgaagtgctaagagtactatgtcctgaggtaagggcacctgcaacggagattgtgaagagaagactgtgggtttctgtggttacaagcacaactctgggtcaaaaacccattccaagtcctcagaggggcaagtcccttccattcagtattaatatagctcatcagtgcctctgatgaaattgcccaggatgctggcagtgtggcctgggaggcttccagctcttggggtctggttacacatttattcacactgcggccatgtgttgaggacctactatgtgctgtgtttgaccacacgtcctgtagaatgccgtttggttctgagtatgcctggctggaatggaaaccaggaaattctagagtaacaggctctagtcctttccaaccaaaacaaacctcatgggaatgtttgagggaccagttaatgttgagacagagagagtatggtctagaatggtggttttcagattgtgttttgagaagccagaggtcatctttaggcctctgaagagtggtaaggggaggagaagctctcaactcccacacccacctcactccaagcagctcaagttccatctgatttatacattagcattctaagtaaaattttatttggaggcagtaaaaaggtctaggagaaataaaaacaatttgttatggagtgtattccagggcctgtttttagttgttgactctgggcataagacacttaattagatctaacctgatggttaatacagcattaacctgagcaccaatgctaaaacattggttttgtatgctgttgagtgaccaacatcctggtttgcctgggatgatcgtggtttagacctgttgtcccaggataattattcaagtgtcaccttaattctcaaaagtattccagtttgggtgagaaattacatggacactttatgcaagagcacagagttaagggaagggttggccagccttgcctaatgagctgatgaaccagaaggcaagccttgaaggagagtccatgtgggccatctcagagaactaagggatgaagccttccaagattaccagcattccaaaaccagaatatcatattgtgagactctgaaaataggtcactaccaaatgctttccagccttttgaccactgtcactttgaacaaatcaatggaccagcaaagtggcatatttttcttttattctttttattctttcctatgattactcctcatgttacctttcaattcctctttctgtctctctttttaaaaatttgactccccaccggccatgagactaaggctgacctttcataaacccacaagagtaactggtatatttgtatatgagtagttgcatgagaaagctcaatgtgcatactgtatttattaagccctgaacgcatttaataaaatattaacatggtgttttgaattatgatctttgtctgctttgctggaacaaaatataacagagctaacgtttgaaatccttcgcatatttggacaacattacaccaaatgttgattttgtacagaactctggcttgctatttaaaaactaaaactctaagtatatagcagcccaagttgtgaatattgctttctgcttcactgaaaaagcagtttacctgaaaagagcatgtaacctatattttgttaatttaagcaaataaagacatgttgaaaaa

SEQ ID NO: 3198 - DNA, 2489 bp, Homo sapiens
ctggagtggagccctaggactgaaattttccaaattgctcctggcaattcttatgtgcagccaagattgagaagattgaggggactaaaatagaactcaccatttctgtggcttccaggacacttcccagagacttcataagtatttctgttcctagcctcagactctttaaggttgagaataggagacctcacaatcatactgctgacttaggctttcttacctgtctgtaagagccttatgagcggacacacacagtctatatatagatacacactttttacattatactagaagatgatgcctgtgatgtttatggtcacttactatgtttaaaaaatgcatgactggcctatggtgactcattatttcttcccagatgcttgaaccatgatgccagtgagtggaaatgactctattgggtgggatgggcccagcaggtcagacttacttaggcactggcactgagaaaagcaatactgactgggtgtcgtgtacgtgtgactgcccatagcaataaccctctggtactgtgtctgtttatgtaaaaacttcttgtttggtagttttgactcgtatttgtagagctaggtactggttattattgtgcttcatcctatcccagatttcccagtacattcctttagaagacatgtccatctccaactgctgggggctggccttttctgtaggccaaggtgctgccccattagccccacctggttgtcatcactcacccatgtgttgtgtccatctctgacccatttcccctgccaccttgcctaaagcttctcctgtcagcctccccaccaccatgaagtgctaagagtactatgtcctgaggtaagggcacctgcaacggagattgtgaagagaagactgtgggtttctgtggttacaagcacaactctgggtcaaaaacccattccaagtcctcagaggggcaagtcccttccattcagtattaatatagctcatcagtgcctctgatgaaattgcccaggatgctggcagtgtggcctgggaggcttccagctcttggggtctggttacacatttattcacactgcggccatgtgttgaggacctactatgtgctgtgtttgaccacacgtcctgtagaatgccgtttggttctgagtatgcctggctggaatggaaaccaggaaattctagagtaacaggctctagtcctttccaaccaaaacaaacctcatgggaatgtttgagggaccagttaatgttgagacagagagagtatggtctagaatggtggttttcagattgtgttttgagaagccagaggtcatctttaggcctctgaagagtggtaaggggaggagaagctctcaactcccacacccacctcactccaagcagctcaagttccatctgatttatacattagcattctaagtaaaattttatttggaggcagtaaaaaggtctaggagaaataaaaacaatttgttatggagtgtattccagggcctgtttttagttgttgactctgggcataagacacttaattagatctaacctgatggttaatacagcattaacctgagcaccaatgctaaaacattggttttgtatgctgttgagtgaccaacatcctggtttgcctgggatgatcgtggtttagacctgttgtcccaggataattattcaagtgtcaccttaattctcaaaagtattccagtttgggtgagaaattacatggacactttatgcaagagcacagagttaagggaagggttggccagccttgcctaatgagctgatgaaccagaaggcaagccttgaaggagagtccatgtgggccatctcagagaactaagggatgaagccttccaagattaccagcattccaaaaccagaatatcatattgtgagactctgaaaataggtcactaccaaatgctttccagccttttgaccactgtcactttgaacaaatcaatggaccagcaaagtggcatatttttcttttattctttttattctttcctatgattactcctcatgttacctttcaattcctctttctgtctctctttttaaaaatttgactccccaccggccatgagactaaggctgacctttcataaacccacaagagtaactggtatatttgtatatgagtagttgcatgagaaagctcaatgtgcatactgtatttattaagccctgaacgcatttaataaaatattaacatggtgttttgaattatgatctttgtctgctttgctggaacaaaatataacagagctaacgtttgaaatccttcgcatatttggacaacattacaccaaatgttgattttgtacagaactctggcttgctatttaaaaactaaaactctaagtatatagcagcccaagttgtgaatattgctttctgcttcactgaaaaagcagtttacctgaaaagagcatgtaacctatattttgttaatttaagcaaataaagacatgttgaaaaagctg

SEQ ID NO: 3199 - DNA, 40234 bp, Homo sapiens
agagcagccagacacttctagactccggatggagttctgcacttgtgatgttcttgaggacacttcggtggaaaggaaagcaccacaacgcaggggtgcccctggaagttcctggtctgaagagcagatgggaatctactccctgggggccaaggcctacacagaatgatctcctcctgctcaacacacagagccataaaacagacccagggttctgtggcaggctgcacagccggcaggaatccaatactcccggcatctggctgataagaggaccctgcggacccagcacatgctaagggcccaggcctggaagataaagcacacctacaccaaggctcacactgctttatgttcacctgctcacacctggatttttctagagacttctccaagtaacaagagggggcatatttgtgggaatttcctgtttggtctgcttgggtttctctccaggaccccacggctggcagcctggctggccccaggccccaggggtctttttcactcaagggtttggagggcaacctttcactcaggttagtcactgtttgctcactctcccatccctcaatctgtgatgcccttgctggcaggcaggggacatctcttcgtgggcatccccagtatcctgcaggagccagggacactggagacaccagcaaagaatgctcttccttagcgactctttcaggtctgcactccttccctcatccacactctataggagctggcatcaaaggggcctgcaatcttgctaaaccagagtctttttttggttactcaagaatcgaggtgtccttcacccaaaatggaaatgttcctaaccctccctattgggcagggcccagcaaatgctccatctctggtgagaaggtcattaacttggctcttccctcctcctctctcctggattccatcctcttaagaactaaaaataatgaagggctagaggagagaggcgagagaggaagaaggcacaggaaatgctgtgctgaacagaggcctcgcagagctcacaccaggggcctcgcagagctcacaccaggggcctctccaggcctcaaaggctgctgggcccggaggctaggaggggaccaacaataggaggaaacagggagtggccaaaggggctggggaagagcacgaggcggatgggcagcctttcgaggctgacttcctaatggataaagcccagaggacagaagggctcagcctttcctctgggaaagggcgcctgggctctgcccagctggttaagggccacccctgcaacacgcagcagatcctctcccgccctgcgctcatccactcctccccagagattttatttttactttggtaaatgcaaaacaacaaggccaagttacagagggtggaaatttaccaaaggccttcactgatcggcagacaattggcactgaagttctggaacctccgagcacccgcagagtccatcttgggccgctctctcagaggcgccagccaggggactcagccccatctccacccccaacacaccttcttgggaacagcttcctggtctggggagctagagttgcttaatccttcctttatagcccacagagaggtaaggcagggcaggagcgcagcccatagcatgcgagctgttctagtgccagttcaagaaatagctcgtgtgcttaccagagccagacacagggctgagtatttgctatgtgtgtgtgataagagtctctcaacccatcacagaggtgctgtcactgtcccacttcacagatgggaacactgaggcacagagtcatgagacaacttgcccaaggttctgtacatgtgtagtcaggcaggctggctgcggatccaagctcttcatcactctgctgggctgcctcatttcctgtcatgtggaacaggtaacattatagccagataaactgagatttagatcctgccactcctggctggtggcactaggcaagttaccaaacctctctgagcttcagtttcctcatctataaaatggaaataccatgtatcctaaagtattgttttcagggttaaattaaattctctgtgtgcagtgcctggtacatacacaagagcactcaacagaggcagatacattttgcatacctctcacgtatactgtctggtctgaccccctcaaggtcaagagcctatggatcggatgaactgtatgggagacagctctgtatgagcccagcagatgttagcagtagggtctgaccacctcctcttctatccctaatcccagccttgaatcccacctttccacaaggaaagggcagaaggtgtaggccacagccaggaggaagtggatccccaatgaaaagtcctattccttgacagaaacagagtctttctggaactccaaaatgcccaggagctactttctagtcgggtgtgagagggagtgcacggacgatgaggcagcctggcaggagagccactagaggctctcgtgtttcctgaaaatccccccacccaaacctcccccagggacctgggatctgaaataagtaactctgcctgttccccgggagactgagctgagcaacagggacacaggcagctctgccaggtggccacaagtggaaacagacttcttcatcccatgctggaggatgacatttacaaagccaggaatctaaaacgaagttttctgcagaaagttcaagaatctaaaatgccatcttctctccccaaagctctcccaggcacagccctgctaaaggaaacacacttacttctgtgtgaacagctctttagtaacccctggttctttttcagagattcctgagattgaaaaaacttcaggttatacattttaaaaccttaggatactactggatatagtagaagggacaagatttcctcaacctccaattgctaaaagtttacctctctaggccaagaacattaatggacaaaacactgccttttaattagtttctgggaatgcaaaaaagaccttgtaagagatttggttaagggggtcatcctggtctaaatccaaagccagagttttgggaactcccacttaaggaatttccaacaaggaaacttttgagggaggacttgaataccacatgacggcttataagcagttatcaagctacactggtgcaattcatatttctgacagattatgctgatgtgcctgtggctaaatggcactcagcaagtgagaatgcagactcgcagagagaaccagaaaccccaagctgctttccaaagaagcatctgcagccctgccccagcagtggccaatgcgcagctctgaattctgctatgagtcacccagcttccctctcctgaccagagctgttcagggtagagaccctgtgtctcggttcagcagtcatgcatctgttcacgtgcagacctctggaagcacaggaaacgggttgccaaaaagggacaccagagaacccccaagtatgagcaagactcatcagctctcagggctcagctgtcccccgggtcatcttgacgggcacatctgtctcggagtgaagtcaccaaggaaaaacccagctgaagaaaatattttcaggcagtcgtcatttgaatcttcggaaaaggaagcgagccgataaactgccaaagagccccgggattcaaggtggccaaagaggcgcatggaaagtatttgccttgggaatgtgggcagctgagctatttacacagtgtgtggccagcacgacgcaaatggaccagaagctcctagaactgtttcctcttccctttcctttccccctttcccttaacaggatagccagccagcagaggctccctgtaaacctgagtcaggaggaaaggccgtgggtgagtgactagcagccaggtgatatagggcagaggccagcagactcaccttgtttggctacattttttttctaaattagttgctaacatttaaaaatcagattccacacaaaaatccgaattcccaacttctctttgaaatcctgggcctgtaatcccggacagcggcccctgcctggggctgagcagcagccacttaagatgggaccttctcttcccctgtcactgggtcccgctgacacaggtcacctgcccggcccctggtggcatttgagtttgagccgctggatttagagacaaaggggaaagtgctgaggaaagccaaagacctccactgtagtctactcactggccatgtcaacgcgggcaagtcacctactttgctgagctgctgtttctccctctgcaaacagaaatgaaaatgcacagcaaggcctcatccccaaaactgtagggaggactaggtaggaaaacacgggacatgcttgaaaacctgaacacacaccatgcaagtaagatgtggcccttcgggtctgaaagatgaaatagaacaccaagacaaaacgggcctctctgatgagatgagtagcggaggaaacgacagatcacacaaaagctacctcggtggtcaccggcgggggctgagatggaagccaggatttctaaaccacccagccccaccaacctggccctgcctgcggtaccacctccccacccagagaagtggaacatcactgtggtcgtggctgagcagtacctgactctgaccaacctctgcctctaattagttacaacacaatttagaacccgggatggttggcgtttgggacttgcagccacggcccagcccaggtgaggcgaggagacactcacggaagcacctgtggtggggccaggaggaagcctagcatcctggcaatgaaactcaacactcaaaatgctaggagtaaatcacagggcactgtggcctctggggatttcacagtgtagcggccaactgcattttgaggggtgacccaaaagctcctggccatctgcggtcttccccaccagcctgcctaaaaatgaaagaaatgacagacatgaccgcagagggctaccaatgggcttctcagaagataaagagaggtttaaatgataaaggcatcagtcctatatctgccccaaagccctccttaaggccacatgtggagagcgagcagctgtgataccagaagggagcacatggcacggtgggatctggtgcctgtcgtggcagcaatgactcaggccacccaatcagggcaagactcagcaaggtctgccagctcccatcaagccagaggcgctcagagggagaagctgtaagtgcttgctgctctcaggagcaagaggtcatcttgcttcttaccagctccttaccaaggcatcatatgtgacggacatggctccctggtgtccaggggctccaggggctctgggaagatagagcatgtgcagcgtcatgccccagcacactgaccccacagatctaatgggaccatgctgaacatatgaggatcacaaattccatgggagaccctaagatctaccctcagggacagctaaggcgattctggaacagggctgccaaaacagccagtcaatcactaaagttcctaatttaccaccctgacaactctccctacggctagcaccccttgctcttcctatctctccaggatcacaacagcctgtcctgccttgggtgtgccttcctgcaacccactctccactcatcagccttgcagatctttctaaaacatcaatctgatcatgccaatttcatcatgtccctcccctgctttaaaccttctgtggcttccctaaagcctgcaggacaaagaccacagaccacacatggactctcaagggctctcgcctctccccaccaatgcgtcccttcactccctgggctgttgcaaaactgatctggttgtgtttgccaacacacaccacactgcttcatgctcctgaaccttttgtgctggcccctctggctggaagacccttcccctaacctaccgagagaactcttcttcattctttaccatgcgcaattatcacctcctctttgcactttttgcccaatgcactcaaaaaggctaatcgcttctcccctatacctcacacacgcatctgcttctctgctgagaggacattcacgtgatctggtgatgacatgagtgttacccccactagagtgagcattccttgaggactggaaatggccagttcattgctgaacccctaggccctacctggcacactgctttcccagagttgggaatcgataaatataggctaacataaacatgtgggaaccccgccaagacccaagagtctggttgagaaagcggaagagtgctcagaatgcctagcccttactgtggggtctggcttaagggcggggtttctgaagcagaaaggtaagttaagtaagggttgcctcacacccagaggccaagaaccagaggcagcagcatccagactcagtgaggtcccacaaccagggccagcccatcagggagagaggcaaacaagaggagctctggaaccaggacccaggcaggtaacctgggctggctcctggactcctttgtccaatcagaccacccacattttctgacatcagtgctgtccctggatgcactgggcacagctgtgagtgctttctcctgcagatctgggatagggctacaggaattcagaagaggaagctattactttgggagaaaaagggaaaaaattaaaaattaaggaagcttcatggaaaaggtgacatttaagctaagtcttaaaaagatgaggaaaatgtgtgtgtgtgtgtgtgtgtgtgtgtgcgcgcgcgcgtgcgaagtggaggttggtatttcaggattgagaaaagcataagcaaaagcctagaagcaaaaaagcaccaacagcacagccaacagcacagccaacagcacagccaacagcttggctcagctcagcactaagggcctggcacggagcagtttgccccagagggaggcaaaaagagggaaaattgtctgtaaggaatttaaaacaatactgaaactgatgggctttttaccatgaccatgagctggcgattctgatttaaacataatccaacacctcccccaacaaccttttgtctaattctgaacaattgctgcattattcttgacttttaataatatatgtaagcttcaaattcacacagactaattaccttttcataaacattacattctctatggaagttaattcaaataactcatattaatagttgcaaagccagcccctgacacccgtggactcagctacccatgtttcaagagcaagttcacaggattcggtatcagtggcactcactttggggtggctcgtcccccgagtcctgtggtacgatgtgttcctaagcttgaagaccagaccaaaaataaaggctggaagcacagtcattgtaaagacaaagaaatagaacctgggctattccatcctctcattctaccagaccacttgggagtttctatttatgtttctgacttttcaacaatgagatgttaatcaatcctgaagaactgaagaacaggactttgttgcaatgtctggaatttactgtgaaatgggattgttgtgaatttctgccaaattttatgtttaagatttatcctatttgtatatctgctgtttcaaccaaaagaaatttttcaaaattaacaggaataaaaagtgctctgcgaccagctttgagggaagatagaccaacaaatgcggctttgtctattgatcatgatgaatagggaaagatcagtatttacgaagtctgatcaatttacagaagactcaaaaccagaaactatagtttttattcattactgctacagaccactatgaaagtgtaacctttcccctttttcaaaataagcattagcgtcattaaattcattactccctgcccccctttttttattgctggcatcatatacacaaaattcaataatagaaatgtttaactgtctgaaattattttctggccattatcatcatcattattatttatttcttaattattgaaataattttgttactatagaagaggggagtattttaaaaaatctactcctgagctgggcatggtggctcacgcctgtaatcccaacactttgggaggccgaggcgggtggatcacctgaggtcaggagttcgagaccagcctggccaacatggtgaaactccgtctctagtaaaaatacaaaaattagccgggcgtggtggcgggcgcctgggctgaggctggagaatcgcttgaacccaggaggcggaggttgcagtgagcggagatcgcgccattgaattctagcctgggcaacaagagcgaaactctgtctcaaaaaaaaaaaaaaatgtactcctggtgtaaaatatgctagatgcaccactgattcagcttcccaacaagaaggtcctaagagaacagaaggtgagtcttctggaataacaaagccaacatcaccacaggcctcaactgccaggctaatgaacttggactactgtctctaggtaaataacagagaaaattaccaagaactatgactatccaaaacgtgaaaactcaaagtatcaaaagcaaagacacctgcaaaccaaagcagaagtcaaataaactgcagaaaatattttacaaaataaagtatgcttgaagggttaagttttatatacaaagaactcaaacaaatgggtaaaaacaatctcaggtgccagtagataacctggcaacatacatataattcaacatacatataatgaaataataatatatgtttgcctattagcaacaaaaaaaatgtttttttggtttgttttttttttgtttttgtttttctgagatgttgtctcgaactgtcgcccaggctggagtgcagctgcacaatcccagctcactgcaacctccgcctccaggggtcaagcaattctcctgcctcaacctcctgagtagcctggactagaagatgcacgccaccatgcctggctaatttttgtatttttagtagagatggggtttcactacttgcctcagctggtctcgaacccctgacctcaagtgatccgcctgcctcgccctcccaaaatgctgggattacaggcgtgagccaccaagctccgccgcaaaaaaaaaaaaaaaaaaaaaaaaaaaaatttcaatagtgaatcctagtgttggtgaggaggagagtaaggtgtgatacatgccaacccactgctgggaggcatccccaagacacatgaccttttgggaaagcagcccaggaatattctgcaagggccataaaaatgtttcaacctttcagttatttattttacctctggaaatctacttaaggaaatactccaaaaaacggaaaaagttacatgcaccaagatgttaattatgccattgtttctaataacaatagtagtgaaaatagcccaacttccaacaacagaggatgattaaacaaattagaggcacatccttgggatggatcgttcagtccttaactatcagggttaagaaagaaacgtggaaaatgttgctataagattaaggggcagggagcagaattagctacggaaaatatacagacttaggctaagaagaaatataccaatttataagagtagttgtactaatacgcatttctgcacattaactttatactggctttgatcaacgatttaaccctttgctctcatttctcagttattatattctattgcactacatgcatatttgtaagtatccacaaatcttttgaataaggtagaatacaaattaaccaattaattaataatgcatagaatcaagctgtttcatcattatgatcgtagggttatgatgatacctattctttttattttcgaaatttctgtagcctggttagtttgcttttacaatgtaaaaaatatacagaacaccaaataaacaagtaacataaagaaactgctaccatatcttacaccttcagtgctccttcctatatttgatctgagaacacagcactctccaaaatgtcccttcagctaagggagaaatagggctttcttcctgtaggttctgtgagctcaggactgaaaactgttccctgaatgggttgactgctccgtgaagaccccaaggatctctagaagcccaggaacattagtggaggaccattcggatgacagacagcagctagactcctagggtggaggcgccttcccaatattcaaacaacatgggtaagaacaggatcagaaaagagactgatgtgggaaacccttccacaaagaacagatcaaaggagtgagcccctgagggcagggaccgtggaatccatctttgtactccttgctacaaatgtgatgccaagtaaaagaacccaataaatgctgttgctaatggattcacgcatgcatgcacacatgcattcactgttggacaaatatttacagatgtgccactgttctagccgcaggtgatttagcagtgaacacaacgaagtccctatccttaaagcagcttacattctaagtggggacaggcagatgataaacaaataaagacatattgcatcaggcagctatgagcatcctgaagataaataaagccaggtaggggaaaagggagaaccccagggaggcggggagaggggtgtgctggcttagttggccatggtctttctgcaggaagtgaggggctgagccatacacaggcagagggtatggcactgcagacagagggagcggtcaagtgcacaggctttgagacaggtgtgtgggcagcttcaaaggccagcaggaacagcaaagtggctggaacagagtaaacaaagaggagaatatatcacatatgaggtcagttcttgcagagttttttaggctgttcttaggacttcggattttatgtcagtgagataggaagctgctggagggttttgagtgaggagtgtcatagtctggcttatgttctaaaaggctcacgctgcttctgtgtgtacacctggggaacagaaagcaggcgagaaagggtgaaaacaagaaagatccattttgaagctgctgtaattgtccaagtgagagaggaagatggatttttttaaaactctccattttagactgagaaataaaaattttttatctgagaatccaagccccctttaattatcaaacccagagaggcaccgaaatgtgacagcgtgtgacagcgatcacgtctcactccccgcctgagctaaataatcacctcttgaagccacttgctatgtgggctcaagactaactgatgctaagtagccataaaatgacatatgcttgacaccatcactcgtactccatagttcaacagtgtagagcaatcactatccaatgttatctctgtaaaccagggaggattcctgtcaaacaactttgtatcagcccacttccttgttccttttgcctttgaaaacctgcttgtaacaaaggccaaacagagcactccccaaggcaacttggaagtgtgtcctgggcagctgtcctccaccttggctcagatattaggtcgacaagaccacggctgtctttcggtgtgaggcatatggcttcttctcactcccactctaacctggagctgcaatccctgctgaaagaattgccctctaaaggcctaaggatctcagcaacagggaagtgggaggaatcttcatgccagagataaagagctggtccatgggcatgtgtgggaagcactggggtagggcgaagaaatctatctcctgggaggtgttatcactacataaatcccagatttgatcaggcaatgtagccatctcactatttcaggctgcagctgctaagacaggtgtgaagtgggcagacaaacaggaagaaggtcccaggtggagaacctgcatttggcttctgtaccccaattccagtaattaacaaagcaaaaacctgccacactgtgaatgatggcccttcccaaccagaatcctgtttctgacaagtggtgaagacactctaaaatgcaccgagtgtatgacaaggacaatcttctggatattcccatttaaacagggatgggccggatgcagtagctcatgcctgtaatcccaacactttgggaggctgaggcaggaggactgcttgaggccaggagttcaagaccagcctgggcaacatggtgagaccccttgtctctataaaaaacacaaaaattagccaggtgtggtggcgcgcacctgtggtcccagctactcgggaggctgaggcaggaggattgcttgaacacaggggtagaggctgccatgttcgtgccactgcactccagcctgggtgacagagcatgaccctgtctcaaaaaacaataaataaaataaaacagggatgaactggagaaactgtgaaggtataggtgctgtcttgcttaggggtggggatgatttacggaaggctaacacaagggccttggttagtctaaagataatcacggcaactaggtggtggtaccaggaactagtccaccaaatcccaacctgcagccaaaaagtctcaactctcacctataaagggatccttctaaattctctagatgtatggaaatctttgacaggtcttctgaagcctagagtcatcgtataaacatagataaatagtgtagatattgcatagctatagattgatatgtacatataccatatacattagatatatgctatatatttacacttcttggcctttcggctttattatctatctccacaaagtaggacaagacaagcttgtttcccatttaagtttttctatctgtactgttttgcaaatccaccagagagttgcaggacactcctgctacagaaagatttctgccaggcaggctcagagacctgctctgttactgttctatttaataacacaaacacacaaatgggggcctttcttccccatgactttcatggcatggctgggggcagagctgggaggttttcacggcccatatatcctcaaactgctccatttccccccgatctcagttgccaccccactaactccggggtgatcagctccataccacaatcatctcctggtgatagagttccatggattttaaaagctgtaagaaaaactgagacagattcagaagagattctagtaaccccaaaccagcaattacaaatattttttaagtatttatatatacacatttttttttgagacagagtctcactgttgcccaggctggagggcagtggcaccatctcggctcactgcaacctccaactcccaggttcaaaccaatctcctgcctcagcctccgagtagctgggattacaggcacctgccaccacacttggctgatttttgtagttttagtagagatggggtttcaccatcttggccaggctagttttgaactcctgacctcgtgatccacccacctcagcctcccatagtgctggaattacaggcgtgagccactgtgcctggcctaatttttgtatttttagttagagacggggtttcactatgttggccaggctggtctcgaacttctgacctcaggtgatctgcccgccttggcctcccaaagtgctgggattaaaggagtgagccaccacacccagccacaagttttagatacttaaaatacttttaagtatctaaaattagcacctctctttaaaccttttactcaccctttcctgaccctttccttgtatcccccattccctttcgatttcttcaccatccctatttgcctccttttcctcactatctacccaccaagtcctgctctgctcccatcccacttaagattttcgtgtctattctgtatcacccttaatgatccactgaggctgtgagcttcctgtttacccacaagcgttcagcggatccagccatcctaccaagggttaaagatgctgtagtcctactgtgctgcctccgacccagttccttccaaaacaaagcaggatgacaaggtgactccacgagaactgcgtttgacctctgtgtgggttttctgtttccaaggccacagcagggtactctgaaaactctaaaccagaaggaaaggagacctagccttcagaactctgtgtgtatgtgcttacaggcaaaaaaaaaaaaaaaaaaaaaaaaaggaaccaatgaggttgtcagaaggggatactctgctgtaactggtgtttaccacgacccaccgggtgctgaggaggaagtggttgctataaccccaagggggaaacgctcgcttgaaacaggaaaatagaactcttacaactttccattagcagcgttcaagaagccggccacactgggaaacacttgcacaagcactccccagagtcctgagacgagtgtcaagacagtccaatcacgaagcacagatcaggacacagatacaggtccatgttttttccagaacgtctcagcactggaaaaactctcatgatcacttcccttacctccagcaggctgaacttgcaaggagctgtggggaggaggaaggaaggggaaaatggcaggatgacatattggaaagaacgctgggcccagtgagggtcagaagacctgggctttagtcccagttctgcgatttactagtggtggaactttgggcaaattacccaaccttcctgcttctcgatttctacttcctctataaaacagggatattgtttactgctctgctcacatccttgggctgctgtgagaatcctatggaatccttcataggatgaaactcgtatgtgctacgcaaatgcttgttatcaatgtaagattcgagtctgcataaagccttcttgagtcccagcctcttgctcctcaaacgcatcctctcggctacacttccacctgtgcacttcctcaacccaccttacttgtaattctgcccacacttctgtagaatttctgtagaagatcccatagtctggtcagaggagtataagcaagtctaaataaccaaagtggggggatctcaaccaaatcatttgactctgggctctgtgctcccacattctctcctctccagaggtgaagacttcatcctcaatggctaatttgcctgcttggaggctcagattggcccgtgttctgagtcatattttccatttagtaaaatgaacatctggctgctgtatgatgccttttgtgtaccatcacctaagccacaattacctgcaaggtaattcataccactacagcacggtgcaaaaacagggttggtttgggatggtgaaagtcagccatcttagtgtcaatcttgcatgcaaattctaatgaagaaaagccactaccagcaggtccacacacactcacaaagaactcataaattattttaatccaagcgttcaaagggatcctgggtcccaggaaccatcctgctgtttcatctcagtgagaggcaagatggttaaggaaaaacagctctagtttcctccatccccccaattcccctaccggtgtgaccttgactaggccacccaaccttctaaaaaccttggcttcctcatctgcaaaatagggataataacaagacatgcccttcccggctcccagggttattatggcaaccaagtgagaaaacagatgtgaaagtgctttgcaaaccacaaaacaccgtccaagtgtgaggtattgttatctagcaaaagtgccttgagaataacacagaaatctggaagtattttaattcgttaatggacttataccacaccttgacttaaaaaggacgtagggtaactgcctggaggaattctgaaataatttctaaataagtttatccaagcaagttgccaaaacaatccactgaattgggtagtaggcttttggataataggaaaactgcagatcgctgttctttattcttatttcaccttttgagctctaaaaagaactggaaggaccatattgtgttgtcttttacgcaagaactaaacagtctctttgtaccctccacaccctccctattctcacttccatcccctgagcacctgggaagcagctccttctccaaacctgcaaaccctcctcccagagcccaggctagcttggaagcctggagcaatttgaaacgccgtcctaagatcttgaggccaaaggcatccccatcatccttccaagagggtgttacccccagggacagcaggagtttccagaacacacaaagacttattctgctcacaaggatatttaccgaatcagcccacaagaatttgccaggatcagggcagaagaacagagctgggacagccttctgattcactgcctggcagattcacccttctctattattagcaacccaggcacgatgccaccagggctggggagagaccttggtgtcagggtagagaaggcaggaagaggtgtgtgtgcagagggggaagtacacagagctgcctgaggtttcctccagagagagacagcagaggggtgggttaaagccttctccccttcctccttagttctctaacctcctgtgaatctcagacaagcccagccccaggatcagaagccctggaacccacatccaccctgaatattgctggaggtactccctcttccccttaagggcccagctcagagctgcacagcactgcttctgccggataccactggactctgggctgtgccagaggctgcaagatggagaagcaaagagaaactgacgggaaaggtggagaatttctcttcccatggcaaaaatgcaacttactgcagccctaatgcacatgtgttccctcctcataacaatgactaccactgaaagagcacccattacatacatcacagggcgttcgcctcctgttataggcaggaaaacaaccatgtggaggctcagcaggctgccctggagaacgtggctaatgctgattgagagggacaggactgaaggaggagacgaggagcttcaccttcatgcatcttgtattatttcacttgtacaggtatttcgcgtgcattatttaacgtgctatatcaagcttgtacaggcattacttgaatacattgaaaaccatgaaacgaaggaattaaaaaaaagaaagacatgttgccagtcaatagtagagtctagatttggatagatttgtccaactccagaatatactctctggccacacctccacaatttgtccaaataccaaaccaggacatggacgctaacaaagactatttttctaatgttattcatgtgaagaattttacaaaataaccaataaccaaataacatttggttattaaatatgataaatgtggcctatggaaaataaaacgacacaaaatgaaaactggctgccatgcaaacttaggagagggcaaaggagccacagtgaccccagacttgctttccctaaagggggaggaaaatcaaatcccctgcagatggctgcagacctcaaatagagtgctgccactgagggcagaggccgagcccctggagcaggctgattagtctagtctagtggttaggaacatggtctctggagccaggctgagtgtgaattctggctctgttcttcatagctgtgacttcaggcaagcttatctgtgccccattggtttcctcacctgtgaaatgaatttgggacactgtgtagattaaaatgtaaagtgtctagcactaaacactacctaagtgttcattattattatcattatcagtcctggccagagagaaaaagggagaattatctattccaaaaggagccaggactgggataaggctttggtgagctttttacgtggtcttgacaacggtgttcatgataggcttattctaggccgctctctgctgtcaggaaggaggtttcctgtgtgaagagaaggcctcccaggaagtgacaatagaggtatcaatactcccagcaagagaaccacaggcccagagtggatgtcagaaagaggggcatctcagggagcacgcctctgcggagggctactgatgaggaagagaccacatggttgcctagaaggcaggcctgcggggaagcactgacgccagcactcaggctaggggagtccctggggtcaacttgtgcagagactggcgctcatatcccaaagaactgggtgcctctctaagatagagctccctgcctcccagtatctcttcctgcaggtgttttgttccaatggctgacagcgtctattcagaattcttaaaaatgtcactttgtttccatctgtaaaaaggaattaaaatgtaccaaaattccaaagaaaattgccccttttcagatgtggctccctgtctcccctcttcccttttctgcttttgatcttatttaaaatctctgacctaaaagtgaactctgatattccatgctcctggagttttgggaggaccctgacttcagaagcagaactctttgagttcttctggttccagctctgcagctaatttggaaaccccaagaaagttgtgtcacttctgtctcagtccagaaagtggaaagattaaccacataaactcaaaaatactatctggctctgaaatgctgtgttcttgggatagtctcaaaaaagctgagttgtggggactaacctaagtcgatattctacctcccttttgaactgatgttgaaagaagaaagacgataaaagaaggttttcctcatcagtcattcaagactatacttaaaattacattttgcagaaataaaagcagtatttttaatgttaggaaaaagtctaaaagggtgactacgggtgattttcatttctttatagttttctgtatttatccaatgatctgtaatggacatgtcacagtttaaaactcaacttaaaggttattgctctaaattcgattttgctggggagaaggttaggagtctggcttctgaaagcgtccttttcaccagtgaaactgccctcactcccaaccctgcagcaaacccgggaagagttaaagcgcaggccaggcggagagggcagggagaaaagggaactgcaaaaagcctcaacacccagtagatttcctactgctgctgacactttggcccagcgtctgcgcctccgaccagcttacggaaccaaccacacctcgatcctaacacatcacctgtgagagcagggtcaactctccagcggcctcagatggcctcaaactaagcttggggaggggttttcaaccctgaaagcccagaactgagcctccaggcagcgcagcgcccgcgaccacgtgagcacggacccacctccccagcctttccatgacgtgactgctggggcggggatggggcggggcacacccagctgcccaaatcagcatgaccccaaaagagcaagcgagttcctgaaattccttgaggtttgaaagacagcttagagatcctaagtcccttttggcagagaggggggaggtagggaagcctgagggcatcccagaaccagcaggaggcacagaaatgtgtcagctctttccccaagagaggaggcaatgctgaatgtgttaggtagggtccttttccgggaccagctggtgaaccgatgtgaagagtcggctctaatgattacttgtattaagttatccacgattcttatgaaaaaggaaagcaaatatcccacagtacaagaaggaaagaaaagggggccccaggcttttcagcaagggcgtttggaaagagatggatattgatgatagggacttttcagagaccaggctcagcccagttgggatgcaactcaggaaagtcagatcgagggaactaaaccaaggtactgttggccaagagacattttaaacgctttttctcaccaggattcataaagcccttttgccttgaagcccatagggcacaggagagctaccctgtccctgggacaaacgggaaaatgttcagccccatcctgggtgaatgcaagacctctgccacccccaacacacacaccctgtgactaccctaagtggatgtgttctttcacgttgctaagaaaaagtccgcagctatgaagtggtcagcctctgaggtccagtcattgccctgacaagactttgagatgcatgctctctgaaactcccctcccctcacctggcaaaaattattcatgccatccttgatagcctttcagctgagcgccttggtcagaaaactaaccacctgcctcttctcaccatgtcaaacccagtcgtctggtgagaagacctaacgtggggtgcttctcagtccacagacagtgttgctggttccgaggccagattgttcctttcttcctagcctgtgaataacactcccacctagaaccagcccttttgctcttaaggggttacacttcatttccctttgatttagccagaaagtttaccattgcagacacctccatctgtaaaattgggcagagaaggcagggaaagcaattaatatgtgttgagtgtgttctctgagcctaccattatgcaagacagcttgtgtgtccattctctaagttggtcttcacaaccaccctggcaagggcacagagttggtaagtgcagaaaatttgataaatccagagcccaaatctaacccaggatttccctatgccaggctgctttcctgcaatcgcctggggcatacagaaaaatacctatattgaggtaaaaggtttgatttaaaaattaaatataaacattttcttttaaagcccaatttgcatatttttgcattgtgcagatttggatctgtgcttcatcctctcccacctgcaacaacatttaaatgcctcagcctgggcactaaaaaagggagcaaatgcaggtctactagctggccatgtttttggcaaccctgcaaaacaaaatttccaactctccagatgatacccctgcctcctccaaaacaaatgcctgtactccagcatctgtcactcaggagtccaagctgggagttcagacgctgcttataagctcataggctgaatgagggcattacataaaaaggctcagagctatgtggaagcagtgtagaagcaatgtcagcagtccacctaaaggcctggctgaagaatttctcagcctcctaaaggatccccaggcagctgccaccatctcatctccagtagtcaaaggaccaccactagctgaaggctgggagggcaatgcagtggtccttgaccttggctgcacatcagttatcacctgggagttttacaaccattgttgcctgggtccccccccgccccgagattctggcttagttggtgtggagtgtagtctagcacagggatttatttgttaagctcccacatgtttccaaagtgcagtcttggcaagaaccactggacaccattggtcaaagtggcccaaaagagctaggaaaatataaataacattcagcaggtcattcagggttcttgagaacagagaatgaccgaagggacttctgtgtactggcagtgcaaggcaaggtagcaacatagagcaaagggtttggagcaaagcaagcagaaatttgagtcctagctccagcattttgcccaccatgtgacctgggtaaagccactcattcattctgagccttagtttcctcacctgtaaaatgaggctgcttcccttgctggactgtgctaggaattagctgcactagggcattgcctggcacatacaaggtcttccataagtgacacttatgattgttaataaacaaattacacctgggattgactggtgtttggtatgaagagaggctgtgggctgacagtacccttcagaggggacccctttagtgaatgagattcagacttccttggggaggagctgtggaagataaaagaagctgaaagtggtataggagacaggcagggcagccactccagcatctggggcacctccagcctttgttctccatctctagtccctttttctctgcaagttgagcctcaggaggaggtgtatatttacagggagagtctagctgtatttggccacgttctacctaccaaagtgggtagcaatcagactggattgtgtcaccctggattgtgtcatccgaagcagctctgcccaagacaggtctgtctgcccacagactcacacctgccttttccctcctactttacaccatgatgctctgagggaagccaggccctagaggggcagccagcactgcaacctgtcactgtgctgtccacgcttgcataaacctgggtggaagacacagaccctgggaatgtgtgacaactgtcccaaggcagagagggctggggaatcccaactctgcaacacctcccccttcgtgctttgagcagcccagcataaaggaacccactgcctacatgattctttctccttttccttttctctcctttctcccctaacacctgtagagttgatggagctctttctcatccattatttcttatgatgttcaaaacagccctgtgaggcagctgactgcaggaactaagatgacctggattcatcggtaagaaaacagaggctcaggcagatgccatgacttgctcccagtcacagaactcatcagaaacaggatttgaacccatgtatatgtaccaagaacccattcttctccaccatgctatgccccatgaccgcctacccatgtcaaaggccctcctgcttgctgtgtagtataagacatctgtgaagtggagacggtggcgggggaaggggagtgtagacatgcaactaatctaagctctagctgaactcagagtccccccgacttgatgctccattctaaaactgagtttgagcaacacatcattccctcttttctatgcctctctcctttcttcatctgagaaaatggcaaagccagctacccaaggacaggctggaggaggactcaaaatcaaccaccaaacatcttacaacatctgtgcctcagaacacagctttcatcttaccaaacttcactttaaagaaatgaaggtaccacaaggtaccttcattacaaagagattttgttcaattgctgggccaaagtgggaaatattaaattccagtcaaagaaggtatggatatcctgctaattccctgaggcatgttccatactgacaaaccatctgactttctgagtgtcagggaaatttccaatccaaagagtaaatgaacttccgtgagtagaaaaatagcctcttcacagcacccgattctctcccaccaagaattctctctcacctttcgcatgcagtactgacgttggggccattaggaacaaaacgaaggggaaggaaatggcaccagtccaggtgttaccagacggatatgtgaaagcaagtgtagaatcacccccaagaaactcaaagtaggagaagcacttgctcatctgttaccagatactcactgtccagctggccagcctagtgcatgcttccagaaggagaccagcaccagccagggagcagagcagtcaacctgtgcaccccaccatcctccctcgaaagcctgcatggaaggcctgcatttggattcacagagcagccattctttcaatgagcatagcagagcaggatagagcaacactttttttttctttaaccagggaaggggacccacagaggcagtacatacaaacctgaaatcagacttgttctagaactggggtctcttaaaagcccttcttctcaggcacagggtcctttccacaatagagaacactggtgaaccagctctgggaaaggtcagctaccgaaatgcagatgattgcatgcaaagatctcaggccttgtgcttttcaaatgatatcctcatatgttctttcatttgctctgcatggagactccagaaggttaagcagtcactcatatataacttacaggtaacaaaacccaagtacagagggccccaaagacgtccctagaggcacacaggtgggaccagagtccagatctgccaaggccactgagctgctctgcccatcatggagggcccctgcctgcctccagcgctccaccgttcacacccctgggtcaacattcccagggtggcagatgctgaacccacaatcagccaactcacaggtcctacatggggagagtggaatggggtcaggaaaaaccattgctttccttttccctttgaatgcctgagtagacatttaagccaagctggggaatgaaggagttggcctctgccccaagagggaaacagcccttcaacgggaacaacacagtaagagattcatccaagagtccctgtcttcagagctacctccctacacctccatctgcggacgcccctttcaaaactcaacctgtcctcttgccatccacaggatgttttaatttccttagaatgtggcacttcaaaattcagctcgtgctgagctcagtgttcagcaccctggctccacgcatgcccgctctgccccacccctgcccctaagtcctggcgacattgacccactcaccatttcccggtcccgccacattctctcgggtttcctggccattgctcacgtggaccttcaacttggaatcatctttccctccctgtccagccactgaagtccaactcaacagtaaagatgttattgactgtcccctctcccacagagcctccacagatgagctctgggcctcccagcaggctccagggcagtagctgttcttccctgtctgcacccacacggcatgaccctgccctcacaggcctccctgcagcctctacccaacgactctgtgatctgactgcatgtctctgtgaccagtgacacctccacgtcctcaagggcaggcaccagggcttgctgggctggaatgttcagcatgtaacaggtgtttagttcattgtttataaaatggacacatgagttaactaattaaaagctccacaacattgtacaaggaaaaaaaattccactttctcatccatgaagctctggagctggggaaatgaagcggctggctgctgggtgccgcggtgagctgtggggcagcacgaggaaggttctgagccaatgaatgtgatgcaagacaagaaactgaggatgggggaggaaacgagaaagagtgagggagaagaggagggggatgatgaagattccaacctgagacattattgcagaaagcaaccccaggttaacaaggcaagttgctaaaggaaagggaatggcagataaagcgaccccccgccctaaaaggcttaccagggcacttcagcagaacccaagggaaagccatgtgggccagcaggcttccgaaccagttctgtctgctctaatgaggccatgggggtggatgggcagggggcaaatcacagaagcatctgctcttgaatcaacagtgaggctctggctggctgaagaatgtctccaactccctagtcacccagtgggcctaatttcattcctggacatgtctagtatagattgaaagggaagccatagtcagtttcaaaaagaagtggaaaagttccctggggttcactgagataccattattagattggggttcccaggagcatttcttgttaagtgtcaagtccagagtttgacctttggggaaatgggggaaattcaaaaggatcaaagcccccaaactccctttagctcagtgggaaaaacccaaagctcctgccctgcctctgtgcatcctctggggccctgaaactgcgtcagcgtgcggtgtaacgtgccctccatcccagcacagacataacacaacgtaaaactcattaaagaccagaggactctgtacctatctggcactaaaaggagatctcctgccacatgtctcccatctggattctttcatgaaagatcatgtgtagctgtgcacaatgtcgaaaaaggacatcccaaagggtttaggtgtgtgtccgtttttcctaaggcttgtcctggggtgccaagtgtgcacatgccactgtgccctgggggccacatatggctgacttatctggcaatgggaggggacagagcagaactggaggtagagaaaaacgtgcagggagagtgagttattgccaagaggatttgactgtgctgtgacaacagaagtcccctgggtcttcaagcctcaggctgggatgctataatctggaacctccagggagtaacatcaccaggtgctggcagggactaacgtcctgcctcactgatgtggcacaagtcatttgctgccttgggtctctagtactgtatatttgtagtcagtgagcaaaaaggaatatttaaaaaaggaatctttctatagcgtcatttacacttgggccaaaataagatcagagtggaacaaaataaaatctggtcaagaagagaaggcagaaatagtgcagaatgctgccaaatatttccaccatgagatatagaaccgtaagttattcataagagagctcttcagagtcatgagtctatggcttccatcctcgggatgaaaacaaaaatctcacccactgtccacagtgaaacaaccaaaagtgggccttaaaggggaacactagggtttggagtcttctgtgccatctgccctcccacatcacaccctgatcccttgtttccagcctccagctcagaggccaacataggaacagcctctaccctctgtccctggaacagctttttccactgagaccaagggtgctgcccgctgtaaaggaacatgaatgagctcagaaaccacatctgcttttgcacttgtcaacttgaggctggcaaaactgaggggttccatgaaactgcagccccagcagttccagcactgtagggagcacttacctagagacacagtgccctcctgccctcctgtggccttgcttggcacagaggggccacacagataccaactgtgggaaggatctctagctgggcagcatcgccattgctcctcattgtccaggggccttttgtgtgtggctctctactcaagaccatagggatggaggtaaaaagattaaaaagatactgcttccgagtttcctcaaggagctcaccaacttccccaggtgtctggggaggaggaaagagcagctcctacaacctcaagagtctttgccaggaccagccaagggagtgtctgtaacaactatttttaaaaagaaaccaggataaagctcccaattgccctacgttttccttaggagaaatacacccaaagtagaagccataccaagtctcaggcccaagcctctggcaagaaaaaacaaatgggcttagcacttctgatagggttcacacttctgatagggttcagcaatgattaagcccctatgaaatggcaaatagtgacattatcatacaagagatccctgcagccctggagggttccagaaaagagcatagccttttaaactgcagctgcctatatatggcaggtaccatgctggcactggaaatgcaaagacgaattagacaacatcccttggggagctgttttgcagagctgttccgggaaactcagaatgtaaccacccccactcctgaccgccccccatcaggattgtctcgtgtgttcagggtcccacagaacccaagccaagagtcacccccactctgtatctttggcattagatagtaatgagggccaagaggagaggacagaaaaggaggtcttccatctgcaaagcaactcttgacagcagcagcccagctgctcggggccactgcccaaaatgctaatgaagccagtcacaattagcaggctactcaggggctgcccagaccacagagctgctgccacagtcagctgtgccagagcagcctgccgggtcccaggcagagcttttatgctagcactttctccttcccctttcacctggcatttggaatccaccaacaatctttgtacccttctctctgcctgacccacaaaaccacccaaggacgctggtatgactctcactgataaagtcaaagacagatgggtagggatagggatgggaattgggagaagggtccagaaaaaatgatttggactctttttgctcccattaccaaccactccattttcccccccaacaaacaagtgcttccccactttactgacatctggattccactggctagttccactagcttgggagcaagtttgctctccgacctctttagagtattcagcagatggtgatcaacacagccctctccaaggagagacgtttagctttatgaaaattcctaaagaaagccactgggatatgttttcgtgccaagacatctgacaactggcctatttttaaagttccaaccaataatctctcaaaagcactctacccacagacaaaggggcaatgacgaaaaaagtaatgaggccagtattatgtttttgtttttcaaacaatccagaatttacccatccaaataaataatattctcttcaaagcctacccccttagaaagctctgtgctgattccactggggctgtgttttctcagaacatttttggaaagtcctattgtggagcagcctttgtttcccagagagtgtccaggataaagttaataagcatccaaccagcagccgctgctgcgggccaggtactgtggtaggcccagggaaggggaatcctataggtaaatacaacaaggtgtctccctggcaagatgctcactatccgggtggagaaaggaggagaaggtttttgtgggtttttttcctttgtcggaaggttttatttgtgtgtgtgtgtgtgtgtgtgtgtgtgtgtgtgtgtgtgtgtgcatgcatatgtgtttgtgtacttttaagttcagaggtacatgtacaggtcacataggtaaacttttgtcatgggggtttgttttacagattatttcatcacccatgtattaagcctagtacccattagttatttcccctgatcctctctctcctcctaccctctacccttcaaaaggccccagtatctgttgttcccctctatgtgtccatgtgttctcatcatttagctcccacttataataacatgcagtatttggttttcggttcctgtgttggtttgctgaggagaatggcctccagctccaaccatgttcctgcaaaggacatgatctcattcctttctatggctgcgtagtgttcaatggtgtatatgtaccacattttctttatccagtctaccactgatgggcatttgggttgattccatgtctttgccattatggaacagtgctgcaatgaacataaacatgcatgtgtctttataataaaatgatttatattcttttgggtatatacccagtagtgagattgctggattgaatggtatttctgtctttaggtctttgaggaatcgccacagtcttccatagtggttgaactaatttacactcacaccaacagtgtataagcgtttctttaaggaagagaaggtgttttgaatacataccatcagccaggcaccgggcaacagcttttgacatgttacatttaatatggatcccaaaatcctcttagatgtagacaaccaggctcagaaaagttaaagtgacctagccaaagtcacacaacaaagaaattctgagactggtcctgatctggggctgtcaggctcccaaactggtcctctcatccccacagcagcctgcagtaaacacactctccaggacaggaggctgaggcaggataactcactcctcctacgtcaagcactcacctcctgtttaccctttcatcaagaggctctgacaagccagtgggcagggagagtttcttcagatataaaacaggacttttcataaccctagtatttacgtcaactgagaaggacagacactcagacacagtcgcacacacttcactcacacacaggaccgtcaattcaacgtgtccacctacctcacaagcaggcagggaaatcaggcctgcatctcaacacgtcaaaactagtttcctgcaatagccaaaaggtggaagcaagccaagtgccatcggcagatgactggataaacaaaatgtgatatagacacacaatggattatcattcagccttaaaagggaaggaaattctgacacatgctacaacagggatgacccttgagcacattatgctccatgaaataagccagacacaaaaggacaaacgctgtatgactccacttatcccaagtaccgaaaataggcaaattcacaaagacagaaaagtagattaatggttgtaggggcctaggagagaggggagagggattatttaatgggtagtttcagtttgagaaaatgaaaaagttctagagatggatggtggtgatggctgcgtgacagtgtgaatggatgtaatgccactaaactgtgcacttaaaatggttaaaatggtgaattttatgttatgtacactttgccacatttaaaaaaaaaaaaacctctgttttttctctttggaaatatggatgtataatctcttcctcaaacaaactctgggcacatgcatatgaccagtgtcttctattctcttcccagcctcagcccatgaggcttcagatgacagaggcaggagccgtgctggggtggggcctggctggggggactctgcatgcacagtaagcaagcattctaaaatcggccccagaaaatcccccaaatgcagcacagaacgccttagactggcctgagtcaacagcaggaaggggagggcccacaatgagcagccgcatcccctcccctgaaatttgcaaaacagtattttggctggtgcatttggcccaatatagagcagagcaaaacatttttatggaggaacaatgaaaagagactgctagtcctaagactgaggtctttaggaaaacttcattctctgacccatttcaactttccctaataaataacaatgctgtaatgccaagcagtctatcatgccaccttagcagctgtgctctgctcccaaatgttctgtttatgtctccccatcatgtcattgtgatggattcaattttaaactaccccaagctaatagcaaatcccccagagctctggaagcagctctgtgttgcgtgggccctgatcatgaaggtggattcagtggtcacccagggcccacctggagtctgtagcactctttttcctctgggctcccaggtacctgctgaaccccaaatgggtgcctacaaaggtccagtgaggaaaagttaagagccccagaaaaaacaaagataaaacgcctgggagggaatcagtatttatcaagggcctactacatgcaagagccttcaaaaccctgtaactttcaagttttatacatgaggaaatggaagaaattcagcaatatgtccaaggagcagagctaggattcaactctaagtcatctgactctaaagcttacactctttccattacactaggctgcctctcaaaatcatgtgggttttttttttcccctggttcttgttttttataatcctgcttgcctggcttctaaacttctccagcttttccataggccctagcccaacccaactttccatttgggtaaaaggaagatcatcccagctgctgtgtcccaagtcacatgaaatggcgggaagacatttcataaacacaagttcaaaagcccctttaaatagataggaaagtggaaattatttttaagggggtaaacttctaaagaaagcattcccattctgcagccctggacttcttaacataaaccaccaggtccaattctcaccctacactgccacagaacagctgacgctaaacttgggctccaaagcctctgtcttcctccagagagcctggcagtctgtgtaataagtgtgctggctatttctgagccggccactaaaagggaaagccacccccaaatcaccactcagcttagtcccaagaatgagagctgaaggtagcatgtcacgcaggggatttattcttcaaatgtagaattgttagtgctcaaaatataaatactcaggtttgaagaacataccaacttctttaaaaaaagaaaagggtaaaaaactcccccatgcaactgtgaatatactctcatttctcctcctcctcctttcctgacaagagccaacaatcagcagacaacaaaatctcaacatctggctcctaagtccacagctttcagctttttcctgggcctgggaacttttgcctcaaacaaatccctgatgagctgcttcaagtgtgatggtaataaggttcggctgctcagggagcaaggcaggcatgtgagccgtggcttgggtgctctgtcctccagggtggtccagaagcccttgaaggtagcacattacaagagccacttctggtcaacttcggtgagcagacagcacccagctctgctttctcaggagcaggactgcagtttctgttgggaatagtgacagccaaaaactcagaagcagaacacacaagacactgagctgagatctcttcgggcttctggaagcagtcagaccctccaccatgcccttcctttccctagctggtctaaactgctgtcgagcgatgatgggcagctctttgcacacagatattaggaaaacccctgcctaagagtcactgctttagaatttaatttctagactttagaaccacttcctactgggtccgtagagatcactgcctgtccccctactgacatgttttattgtaagcaatctaatttatggtgtgctcagtatattcttcatatacccagacacatacaactgaaaacaaaagtttcacacaacagtacttaccattgctttgtgcaatgaatgctgttattttctattctactctatcatattctattttattaaaatctattggttgtaaccatctaaattgatccccatttgaagatcacaatctgtagttttaaaactgctgtggtcataggagccagtcccacgtttttgaattaaaggcctgtgctgacaccatgggtcagagggaaggtgatttgtaccttattcccctttcctggataactcaagtttactcaaaaagctccacatcaacacttttaaaagagaattcaaatgatccatgcggccctacccacaatgggttctcacagcacaccttgtcttcaaggatagctctgaaagaactcaactctgcattcacagaaccattgctaataacctttaagaggtgtcagaggactaaagatgggtaactatttgcctaacattttgccaaattggattctggaagcttcagactggcaaacatagggctggattacctaacaagtgatttgtgagcatttacagggaaagatagaaatcactaaaaatatacatgtgttcattaagaaaaagtttcaacaaaccaatctcatttcttcttttgatgcaggatacaaaatcaggaagaatgccataaagaatgtgttcagatttcaccaaggtgcatgaaaagacagaaaaagaaaaatctgtgtcaaagtatggttgaacagttttgaagctgttagaacaactatacccctagaggctactgataacagacccttaagaacattggaaattgcttttattaggaccctagaaggttcttttctgagactgatcctagtcaacctttctatctatgacttctttaattagtgacagcaacattaccaattggtatggcgtgtcctcaataacaactgatcaactgatgaactgggtacccacagagcactttgcagttttatcaggtacttttacacatcttatctcatttgagcctccaagtcaaggagctaggtattattatattcatttcatagtaaagaaactcaggcttagccatcagtgtttctcaacctcagcaatatgaacattttgaactgggtaattctctgctgtcctgtgcactggaggatgtcggcagcatcctggcctctacccactatgtgccaggagcagtaccacccttacagttgtgacaaccaaaaatgtctccagacattgtcaaacatcccctaatggccaaaatcactcctgttgaaaaccactgggtaaatcaaactttgatctggcttgatcaaggtccacagttaaaaagttaaccagggcagtatttgaatttaggtctcctcattcttccaactctttcaaaaagctggaaggtattgggcaccgtggctcacgcctgtaatcccagcactctgggaagccaaggtgggtggatcacctggggtcaggagtttgagaccagcctgggcaacatggtgaaaccccatctccaccaaaaatacaaaaattagccgggtgtggtgatgcacgcctgtagtctcagctactcagaaggctgaggcaagagaattgcttgaacccgggaggcggaggttgtagtgagctgagattgtgccactgcactccagcctgggagacagagggagactctgtctcaataaataagtaaataaataaataaataaatgaaagctgggagggataatgaacaggataaattacaaaaatcaagagtcaaaattatcttgattgacattctaggccaaaaccaataataaaagactgaaggtccatattttggttttaaataaatcaattgtgcaaagtgagactggcactcatggcattttatggcagttaatgtatggaaggttggcaaagggggttggttaaccttcagcccagagactggcagtcctgcatgactccacagatgccaacataatcttggctgcactgacagggcaagcagtccaggcatctctcacactcccacccaggccagctgcccgagcattgaaccccgccatcctctctctcttctcacacctgccgcagacctgacactacctgtggggcctccccctcccctacagaacgtggctctgctccatcctcactctgtcctctggcagccgcagcaagagtcggtgtgcagcagaattggaagacagatggcaagagggaagagaagaaggacaggagggagaggacacgggggagaagacaagaagggaagtggagaaattatggcagggcccacaatgtcactgtgagccccccaaacccagggggcaagacagtaagatgagggaagagagggaagcggggaggagggggaggaaacggatgcaaggccagcaaagggaagaggataagaaaaaggcagagcagagggaaaagactaattactcccagccctccaatattcacttacatgctatgctgcttcttcttccattcagttccttcctgctacttgcccggggcacccagcttggcccattacccacccattaatgcccctacctgggaatctctggaattcactatgctggattaaaaccctggctctactagtcactagctgggtgaatttagaccaattacttaatctcactaagccttagtttccacatctgtgaaatggggataataatatctatctcatagttttggtatgggattaagtgagacttaatttgaaatatatacacacatatatatacacatatatagatctacgtgtgtgtgtgtgtgtgtgtgtatatgtatctctctctcaacacagatgcttggcccataaaaggtgctccctggtagctagttttagttataatgtacatccctggcacgtagatagcaacttattttactatcttggacaccggcttccacttccgacaaggccaaaacttagagacgaaatggcacatgcccggcccctgtattttctactgttttctgagaacataatttctagttggagtattaattactagcttggagcattactagctgctgctatttctcagggtccccttggagaccaagcaaccgctaagatggctggctttctccatagaactcacagctagcaccagcaatgaggaaatacgcacacgcgcacacacacacacgcagtctttacatctggttagggctccaagtatttcctaagtgtctcatcacacttactaaggcctgagaatctcagagctgagacactgcagaggtgatgtagcccaagccatcccctgaggcctgagtgtcctctgcagcacccgactaggggccggggggttagcacaacctgtccccattcccaggaaaaaacccagcacacagctcacactcaatgatgtcagcttcctacaggaaggacaggtacagcatcactaattaaaaagaggtcacaaccacgaagttcattcatccaggcctcttgggaacaaatcatatcaacaaccaccaaacaaatggattcatgttaatttggaggtattcttatctgagagcaatagaatatagttcaccaaagcagaaacctgggcaagcgtcaactaaatgttggtgggtccaggaagaaatccactgattcaggctaggtgcctgtcacaacttggttagcctttctgaacctgtttccttgtctgaaagatgaaagtagcaatagttgctgtgaggcgtgattaaggcatgatgcattcagaggcatagtacagtgtctggcaaagattcaagaaactttagactctttcccctttctgcaccaataagcaaatctgaaaagatcatgaatacacagtgctgcaaaatgagaaacagaatttccccctttagacaagagagcactgtgatgcagacacagccctggcatcagcaaggaaggccctggttccccttctcatcatccctggagagatgggtgtcagaggtcaggtgagggaatctctttgtgcgtgattctccaactctgcaaacaatagctggccatttcttctgaggaataagctgaaatcaaacatacctgataggcgaactgggcttgatgcagtcccaagcactctgctgagcactgaagccacttttcctcaccacaactatgggagctagagaagggaggcgattagtggtgaagacagtggggacctgccccaggtggcattagtgaaatagacaattctctagggtcctctgcaccaacccagaactctccacataagagctgccctaggaacaccacagttctgtggcctgccctggcagatgtgccctcacatctgggtgataaggggtccccaagaggagccaaaccccctgggggcagcccggtcacagccacaactggctgcccacaggctgggagccactcaactcagaggcagagtcctatgcactgcactctccagacagatggaaggacactccccccggggcagaacagcactgtagactgaaggacagctttgaatctgtctgcccaaccggttcaaatcttgttttctgtcccctaaatgtcaccagtgtaactgtcaaggggccaaggggaatcacccaaattggacagcaccttcagggcagaagctctgtttgatttatcttttgtttccacagcacctagcctactgcctggcacagagtggatattcaggaaatttctgttcatgtgaaagatgagaaaggtcacagactccttaagatccctaaagcagctacgacagctcatttctggactgagcagagctgaccttagaggccagaagggcagggctagggatgctgactgctagggggatgagaaacctctcttaaatcagagtatggaggcactgggccaattagaggaggaccaacctttcagaatcgtaagactggaaagtgtgtgccttcacgtttcattttgcctctccccagactaaaccaactaaaccatctctggaaaagacagaggccaaggtgacaggaattgttcatttatatatgaatgaggcgttgctaagtcatcagaggctggagaaaaatggaagactctttttcccaggttgccaacctcaaagttaggtaactattggcagaggtcagactaggaagaggacaggcatgatctgcaggaggttatggaaagcagcatcccagatggggcagccctccctgctccaggccactgggctagagctcagctctggactggcttctcatcctgtcctgctgactgcatagtcacagatctgctgatagtctccagacaagactagctctgctaccctggtcatatctcaggctggtaccctctccaacctgttgcacctatttgcttaaaattaagagggctgagctgggcagtgcaagaaagaactagaaagccagtctcacctggaaactctaccaactgctatgaaggacacagggaagaggtggcaggcaggaacaatgccttaagttttccccaggttccttgaactctccatggccctctggcctcccctcacccccactacctctcataaggaagcagccctggctttctagtatgctgataataaggtcctatcaggccaactgagaaaagtctcatctagaaggaaagtactcagtgcgctatctgttctgtaggaaggctgaaggcaatgcctcctggtcacatcagcaatgctatagagaaaggaaaggtgcaagagcaggacagagactgctctggctgtgtacctggaggatgatctctgaggatctctgcaccgccaagcaccctccgggctgctgacgacacggtcagattccccagtgcgtgagcctatactacagcagtgtagactacagcagttaagagcccaacagtgcggccaggcaggtctgggctctgaagaactgtgttcacatactagaattttcttggacaactgagaagtcatttaacacctctggagtctcagtttcctcatctgcaaaatagatatattaatagcacttacctcacagggtcattaggaggactaaataagccaaaatattcaaaccacttagaacaatgcctggagcatattaagcattcaatgaacgttagtcagtatcatctttactgtcagctttttgagaatagccctttctgggatattcttcatagcacccagtacagcagagcttcattaattaaaaaagaaagaaagaaagaaagaaaaagaaagaaagacagacaaacactaagctattctattagtcagggttctctagaaggacagaaccaataggatagataaatatataaaggggagtttattaagtattaactcacatgatcacaggtcccacaataggctgtctgcaagctgagaagcaaggagagctggtccaagtcccaaaactgaagaacttcagagtctgatgttcaagggcaggaaggatccagcaagggagaaagatgtaggctgggaggcttggccagtctagtcttttcgcgtttttctgcctgctttattttctatctgcactcgcagctaattagatggtgcccacccagattaagggtgggtctgcctttcccagtgcactgactcaaatgctaatctcctttggtaacaccgtcatagacacacccagcatcaatactttgcaactggccagacacggtggcttatgcctgtaatcccaggactttggtaggcccaggcaggcggatcacaaggtcaggagatcgagaccatcctggccaacatggtgaaaccccgtctctactaaaacacaaaaaattagccaggcatggtggcatacgcttgtagtcccacctactcgggaggctgagacaggggaatcacttgaatccgggaggcggagattgcagtgagcccagatcacgccacggcactccagcctggcaacggagcaagactccgtcaaaaaaaaaaaaaaaaaaaaaaaaaaaaaaacccagaactttgcaaccttaaatccaatcaagttgacactcagtattaaccatcatcacagctattaatacgatttaatatatatgtgaggcgctttacacacattgctgagttcccacataaacccaatgccaaaagtgttttcacagaaaatagcttgcctagaatgatattagtgattggccaggctaggattgaaactcaggctctgactccagagcctgcttcttcttcccaaaggttacactgcctgcagaacaccaccttctgagcccctctacctttatcagaatgagaagggagtgggggcccaaacaaaattcaagcaagagaggaagagaacacaaaaagagatgctgggaagctcagaagaaattcaccaccttgtcaaggcctgtgtctttttctggatctgggtttgtcatcatttgcagcttttgctttgactctggatgttagattacgtagagcactacatggagcacacggtgccttcaatgagaaaccagcaagcagtcagtctgaaactgtttctatagacgtggacaagacttctcacaatgtcccagctacccaatgacactgattctaatgctaacacacctccaggcacttcaaatgcttttggcactctgaccagaagctagccacgcagggtctgtgtgagccgcagcaaggctgtctgctatataagctcagaactcctgcttttggaagaagtatcatttcaacagaacagaaagtgacaccccaacagtagaattcctacaaattctaactgtgctaacatcttcctaacaacagtcctacttaaaaacttcactttggccgggcgcggtggctcacgcctgtaatcccagcactttgggaggccgaggcaggcggatcacgaggtcagga

SEQ ID NO: 3200 - DNA, 2513 bp, Homo sapiens
gtttctctggagaaccctgactaatacagaaggagagagggaagaaaggcgggttgagtagcagaaagcttaggctgtagcacaattccgataaagtttaaggtcagctgatgaagaacactcaaaccaaagtcgcccattggaggagccccctacctcacaggaataggcctgcattattagtataccttcttcattcagttattgttattcttatggaaacaacccatgggaaatgtagccttggcatgactgtatcaatggattcagagagcagtagcggggacccccccagtcaattacgttccacagcaagagatctcagtggtgcatatccactgctggctcagtccaccccttgggctgcacagctctattcaggcctagctgccaggaagattactaggtatcattgtcaactcaggctctgtgcccagtaaacctggaaatgtctggatattcttccttgccagcatatagtcataaatctatttggggaagaacttgccatttcatcaaagtctgtacatgtatagcagggttcttcctcctagtgacctgtgacctagtaacccagccacctatgggttcttccatctgtggcttccttacctgaaaagtgcttcaggtctaggaactgagaaagggattgtgatgtgtcattggagccagtgcggttccattcgtgccttatttggttataggcgttaagcagcattcttgttagatgcccatctattttgcctataggggtgttactttcaattaattatctcctaaacaccctgtgaatcaaacccccttaactacccctccaatttcaccagttgttatagtaattatggcctcttgacttttggtaattaagcactagtcctccagagccctctattacttgagggtccattacccctgaatcatattaacaatcccagctctgtgaccacctcatttaccatcagccctggtctaaagagtaaagccactactgcacttagtgatactggtaccttctcacaggctcattcttggtggccttagtgaattgtcactatttcatgacatattcatcacagtatatccatcacatattcattcatctgacccttatgaaggtgtgatggttaatttcatcacagtacatacatgccattgtatagcaggtccttaactaatatagcaacaccaacgttctcaggcagaaccaatagaccctgttgaagggcaggcaagcccagagcaaaccatctatatgcagttcttttaacagcctgcaaggcactgtaagattagggagacgtttatcgaattatgttctgtggaaaactagttccataggatatgaactgatgtcaggagaaaaattaaattagaaatttgcttcagtgccagattctcaaagccattcgtatgtgaatgtttagtgcaactctccaaaagagatgatttgatgtgttacatgtggcagtagtatgatgtgcagcccagatcccccttcaaagaacggcttgctccccacttgctgggtgtgatgttagcaggcagcctgcagctgtcagccctcttcaggaattggcatagctgtagaaaaccacttcacctaaggtcacacttttttgtggagtggcccatagccaaggattgatcagtgtggagatacaaagttgttctcttgcccatctgaggacatctccgagggccgttttaactccagagctccctgtggggttggccaaggctgtcattggacctacattataactcattttctcccaattccgcttctctctctctttgaacaaatgtttggcaaaaggcacttcttaataaatatcctgcaattaaagtatatctcagaatctgcatcctggagaatactgtctgagacaccccactttctaattttgtttgcccatcaaagcccattccccgccccccttttttttttgacagaggcttcttctttcacctggaagggagtgcagtggtgcaatctcggctcactgcagcctctgcctcccaggctcaagcaattatcctgcctcagcctcccgagtagctgggattacaggtacccaccaccacgcctgtctaactttttgtatttttagtgtagatgggggtttcaccatgttagtgaggctagtctcaaattcctgacctcaagtgatccgcccgcctgggcttcccaagtgctgggattacaggtgtgagccactgtgcctggcctaaaaccctttttcatagagtacctaacaagagtaggccttaagaaatatattctggatgctggtaagtgcaggtgtgagaactaagtacctatgtggaaagtaaggggaggggtacccgagacttaaatctcagcttatgaattcctttgagatttgaaactagcttaattttgatgtgtaactctaatgcttaaagtactgcaggatctactatctatggaggtgctacggagaggatctaaatattatgtgacctatgcaaataaattttcttttctctgt

SEQ ID NO: 3201 - DNA, 575 bp, Homo sapiens
cgcttgttcgctcactctcagtgaaaagagttttgaaatgagttctgaatagacagcattttctttgtgcggttggtaaataacacagagcaaagttagcaagttgcagcgcctctgcgttctgattctatggaacctttttgtagggagaagggcaggatgtttttaactgaatgtgacctcaggggaatactagagaaaataataaaatttctgaatggggcagcgtggagaaatcctaagagaaatagcataagagcattttggaacacatccaggaaaagataactttcgacacacctgtagacgttcgccaggtaaaggaaatccaggcccttgagcaatgtattgatgaattggggtggaaatggaggaggatggaaacgatggcggcactggactgttttccagaaaccatttacacaggctcaccagaagagggcagcgcagagcaatgaactctccgaggagtttccaaacagatgtcttgaaacttaaagtgaaaatctctgcatgaaagtagccgtttttggacagcgtcctccaccaaaaccatatatctctaaaataataat

SEQ ID NO: 3202 - DNA, 1485 bp, Homo sapiens
gtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagg

SEQ ID NO: 3203 - DNA, 2245 bp, Homo sapiens
aaaaaaaatcttatgaatttttaagaaaagatgcatattttcattttgcaatgggccctgaaaattaagtcatcagtcctgggctttggagaagaaaaaaacaaaaaagaaaagaaagagaaagaaaaagaaaaggaatctgaatccagccctagcatgttgttgcataacattggaaaatgactgaacctctcggcctcatttccttatctgcaaaatggggatgaagatggcgtgtagtacatgctctgtgcaaggtattgtcatggtcatgccagtgggcaaagcctgttgtccctctgtgtgtttgtggattaaagcaggagggcttccccacattgccccctaggcccagtggaggaggaacagggccgccagaactgcctctttcccctccttactctgcctacatcgctctctttgcaggcgctgcacctggagggggaccagtcttggatgcctttagtggtgcgtcctggcctggcaccattgcattattctcagtgagaaatggcggcccttgttcctgcccagtggcaaagggaaagaagagaggtggccatattaaataataggaaaggacagacctgggtacaggagaaggggaggcatggtggatgggtcacaggtgtttggcttgagcaacacaggggagggggtgcccgctcttgagctggggagtgcaggaggagaggcttttagggaagggtactgagatcagccttagaggtttgggtatctgagggaccccagtggacaggtcagtacacctgcagagatggttctgaactcaggagagaggcaaggacagcacacttctctttggaagtgatcagcacagggctgttctcaaaaccatggcgggggccctggcagaggagttgggaaaaagggagcagggaatgctcctccatggaaactgacatttttgaggaagaggagccaatggcaaagggaaggaggacggaggagaaccaggagggtggccacagaggcggaagaccagcgagagggtggcaagaaggaggaagggagtgattcgcagagggggagaggtcaagccaagaaggcagacagatgctcgctgaatggagaagcagcagaggccctgagggcagcagtggcgtccccaccccagatgctgcagggcaggcacagggaggggcagtgtgggcaggtggataagggcaatggcggggctcactttgctggagagtttgcaggtggatgagggcagtggtggggctcaccttgctggaaggcttgcttgtgatgatgtttacaatggaaaggaacccagcatttaaatgctaatggcaaggaaagacagggtgttgacactggagagaggacagtgacagacaagggagaggaaagacccaggccccgccaggagaaaagaggtggggggtgcagggagctgacagtggaacaggaggggaggtcaccggcagaaagtcaggtagggggagaacagagaaggtgtggatgggacgatccccagggagacggggaggaggatccagagggccaggtgacaatagagaaggtgtgtttatagggtagtgatcctcaaggggggaattttttcccacagctctcagaggcaggagtgggaagggccaatattcattgagcacctgctgcctgcgaggagtcctggacagtgacctgtgacttcttggatggttgagtcctggcgtctgtgtgagtttcctggggccaccgtaataaactacccagcttcaacagcagaaatgcctcctctcccagttctggaggccaggactctgaagtcagggtgtgggcagggctgcattttctctgaaggctctaagggaggatccatcctggcctcttccagctcctgggaccccgggcattacttggcggggacagcatcactgcaatctctgcctcagccctcccatgccttcttcctggcgtgtgcctgcacgtctctatcttttgtgtccgcatctccccttctcagaaggaccccagtgattggatgtaaagcccaccccagtccagtctgacctgatcttagctaactgcaaagatcctatttccaaatgaggtcacattctgaggctttaggtagacatgaatttggggggacaccccagtacaacagctaagctggacaaggaggcgtgtgaagacaagggggtgagagggagacgtttcagggagcaatggctgagctgtcctaattaggcccaggaccaatgtcctctgtggg

SEQ ID NO: 3204 - DNA, 1766 bp, Homo sapiens
ggctggaaatggaagatgagaggatcctggacaacctgggggcagagggacgtcatggctctgagtgggagtggagaagatggcattttggtggatgggtggaggaagagcataggcacagatggccacgtggagtgtggtccacagataagtcacctggtggagtgcagccacagtgcctgagtcaggaggtctcagctcttgtttcaggaacacagtcatccctcagaaatggattgggtgacaagtggtctgcatgctgcacacgggcactgggtgagtgtgcttggagctgtttgtcaggacatcatcagcaatagacagaacacgagggaagtaatcagtgaaagaagacgaagttgttaagttgtttctgactttatctttggagcgggctcacagaacatttgagtgggctttttggtataagagaaagagccctacacttttgcccaattctagttctaggctccaaaacaaattttactagggttctgaactgacgggttagactgtttttgttaacttttattcttataaatatttttggccattgcagtccaatcagaagaaaagtagaaagcaggtcatttttaccttctctaagaaaagaaatccaaaatttacaggaaagcccattcttgaaagtcccttgtgctgctaggcagggcctttcgattattttcagacagatgttgaaccttcagaatttcctccgtgcatcggggtcactgactacttgtgtctaatgcaactctgcactaactagattgtgcgccgacctctattttcactttcaaacctcatattccaacgttgctcaaggttgactgtcactgactgggcttttctttacgactgtacttatgaagaacaaatgtacttgtaaatgtttggggacttcaaatttagtttacaaatgtgtagtcctcattgaagattcgatttgtattatatttaggcaagttttctggctcttaatggggtcctaatgagtcaccgatggtaaggcttcagattcagaccttcctgttaggatggggatgagctgtttgtcctcatttgccaattatttggaagagaaaaccaatgtaatgcaatcggaatccagttgtattattaagacccgcatttgaaacctagtttcttctatcagaagtaatttttctgatttttggattatgtacttctccttcatataaatgaatgttactgcttttgtggtgttaccagacctagcttatagaaataaatgacaggccacctgggggtctgcccgtgcaagcatgaactaagcagcaacaagcagtatgccctgcggtgaccagtgtgtcagcattcacataagcccgggacagtgaatgcgggcccttgtcagtcacgggcatcaggcgcatggcactgggcacagctgactgcctgttgatgctgatggctggatggctgcatttaagtacactttcacaaaactcatttgtatctcttcccgaagaaacctaaatggaattaatttgttggagggctgcaatgtaaaatttttaaatagagaacaaaatggagtatgttgctgtttcatggaagagaacacgggagaaactagcaatctgtaagctaaaaattgatggcagcccctgccacaatgaataattggcaatgccattcagcctttaaaggtatcagataatgaataagctgggcataaggcatctagttcccttccattattctccaataggttatgtaataaacatccatccctgaaagat

SEQ ID NO: 3205 - DNA, 1504 bp, Homo sapiens
gttgcagctgcctggccagcccgagagacagcggagattcattacccgccgacacaatgaccattgatggccccgtggcgttattcaaatccagtaccaattgcagccgagcccctttctccgcgccaggcccgtattgttggagcggcccactaaaagcccgccccggccccgagccgccagaggcgcctgctcgggttcagccttgcgcctcggcagcccgccggctcccagtccggctccacgggcgctgcaggtgacccggcggcgcattccagcactccccgccgcccgggccaccgccgccaccgccaccgcaggcgccccggccgcgactcagccacaggaaagcggagagcgcccgagccggtgcgtgcgcggggctgggcgggggcgggggacccacgaatccagcagcccggaccccgggctcggaaacgcgacccggcctggggctcctgccttccggattcccggagatcccaggctgggggcagggagaggggagtcggggttccccaggccagacagaggagattccccctcgacctggggcggcgctgagacccaacgcgggccactctgcggactccgggccgcgatcgaaggagccacgccaggggcgatggggatccccgcacagggtcaggatccgcgtgcttgctagtccaccttaccgccggatgggcagccgctgctgagcgcctgctaggtggtccgacgcgcagctccgagctgtcctggactggcgctttttaggagcgaaggggaaccccgcaggagaccagggccctgaactcaggggcttcgccactgattgtccaaacgcaattcttgtacgagtctgcggccaaccgagaattgtggctggacatctgtggctgagctccgggcgcaacaggggcgggggccccagggacagggctcagcgcgggcgagacctctcggggcggcggctggctggccccagcgcgaggatcgcggtcccggcccgcgcgcacagagacgccggtccctgccaccagcgccgccatccgcatcctcgtccttcttccttctctgcgggtgaccagtcccggccggcagggtccttcagtcgatcgcgtcgtttttcctcctttcaaatttcggccggaacgaagccggcacgcagcggcggggccgaatgtggtccgccctcagcccaagccgcatgaagtcgggggtgaaagaagaggccggccgaatgcgcccgctaactcgtttcgcagttgttctaacttatcaccccaatactccctacctaaacaaaacaaatcctcaaccaacccctaaatcccaaacaaaccaacccctcccgcaagcccctccggacggaccgatgggctgagcctcctccagccgctgccagggtccgacgggcaagcgtcaccaacgatgcgctccagcccggcaatctcctcggctttggaaatagaatttggaaaaacgaatccttttcattaaagaaaaatcttcggagata

SEQ ID NO: 3206 - DNA, 2148 bp, Homo sapiens
agatcaactttccgtctgtgccaacgttcgccgcgattaccgttctgctgtgtacctgttttaagaagaaacaacaaggaagtgaaaccaaagacgggcagcccggcgccaggcccgaaaccaggcctgggcctgcctggcctaaacccagtttcatgtgtgtgaagagaccaccaaacgtgtgtgaagagaccaccaaacaggctttgtgtgagcaacatggctgtttatttcacctgggtgcaggcgggctgagtccgaaaagagagtaagcaaagggtggtggattatcattagttcttacaggttttgggataggcggtgaagttaagagcaatgttttgcgggcaggggtggatctcacgaagtacattctcaagggtagggagaattacaaagaaccttcttaaggttgggggagattacaaagtaccttaagggtgggggagattacaaagtacattgatcagttagggtggggcagaaacaaatcacaatggtggaatgtcatcagttaaggctatttttacttcttttgtggatcttcagttacttcaggccatctggatgtatacgtgcaagtcacaggggatgcgatggcttggcttgggctcagaggcctcacacccagtagctaaaaatcaactcataacttagaaaccgatgttattcatagattccagacattgtatagaagaacgttgtgaaactccctgccctgttctgtttctctcttaccactggtgcatgcagcccctgtcacgtaccacctacttgctcaaatcaatcacgaccctttcatgtgaaatctttagtgctgtgaggagcccttaaaagggacagaaattgtgcattcggggagctcggattttaaggcagtagcttgccgatgctgccagctgaataaagcccttccttctacaactcggtgtctgagaggttttgtctgcggctcgtcctgctacaagactagaagagtagcatattatattcagtaactgtttgctgaatacatgagggaattgagctaagtgtttggcccaacactgcacacacaaagtggcagagctagaatttgacccaagcatagttttgaatctggaggctttaccacctcacacattgcctcacctcctgaaggtttgatttgtagtgggattagtatcattcacctcacaatggatgtgcaatacaaatgtcagaggcgtgtgaaccagagcaactccatcttaaataggagctgggtaaaatgaggctgaaacctactgggctgaattcccagacggttaaggcattctaagtcacaggatgatataggaggtcagcacaaaatacaggtcataaagaccttgctgataaaacaggttgcagtaaaggagcctgctataaaccaccaaaaccaaaatggtgacaagagtgacctctggtcgtcctcactgctacactcccagcagcgccatgacagtttacaaatgccatggtaatgtcaggaagttaccctatatggtctaaaagggggaggcatgaataatccacccctcgtttagcgtatcatcaagaaataatcataaaaatgcctaaccagcagccctcgggggctactctgtctatggagtagccattcttttattccactactttattaataaacttgctttcactttgcactgtggacttgccctaattctttcttgcgctagatccaagaaccccctcttggggtctggatcgggacccttttcctgtaacgtatttctggcaaccacagaagggactatagtgcagaaacctgacccaatggctacctttgggtaagtgttggggtccgttaacactaccaggtgttcacctgcaaagggaaggtgtaatctgccatgttaaagacactgtgcaccaacttcttcatttctttctccacgatctcctctttcacttctgctgtccttttcaccttgctgtgcacagaactgatgacaggctctttccactggtacagcttgccactcaccagagcaaagctaaatggcaggcacaggaaagcatcaatgggaggcatagcacagtggggtgggaggcaggctctgcaggccacttccgttccaatcctagctcggctgcatgacttgcttccgtgtgactcgttttccc

SEQ ID NO: 3207 - DNA, 21945 bp, Homo sapiens
agtttctaggctgccctcttttggaagctgtagctccgctggggaggagggaggagtgagaaggaaagaaaggaacaaaaatagccggagccgaggggaacaagccacggtgtccgcgtttggagctgggcgtgcgggtctcagtggcggcctcggcattcggggcggcgggaggcgcccggtgcatccccgggacggccaggagcaaagacggagaggagaggggggttagagaaaggaggacaggccaaccttgagcccggccgtcacccctgtcgcgcttttgttggcgcaggctcggccccctacaccgggctggtgcagctcccgcgatcagacggtctctctcaattcggcgttgaacccggttcttcccaaattctggtattgctggccgcttggacacgttctccccttatccctcccccagcggggaaagaaaaagccaggatcctttccttggcgcggccacccgagccactccacccgtcgcgccaaccgcctttccaggtggggaccaaagcccccactctccgctggcatctcattgaagggcacccccccgagggattgccagcttctgctgccagctgagaggccgtgtggctgggcgtcttaagcgccggtttccgcaggtcccgtgtctggcgggcgcggctaaaacccggagaggctgtgcccgggaaagccacgttcgccgtcccctcgctgcgacaggcccagccgcgatacagcgccaagtctaggtcgggccaacccagccaggagctgcccggacctgcctgaaagaccagggacgcggcgccagcgccccacaccccaccgagaccagggcgcaaggcgggcagaattcggactgatgcgccaggcccagccccgatggattccagctcctctcggccccgcctccggccctggcctcttcctccagccggggtcgggtcctccactccactgtttggctgggaaaggaccgagacgcgctcagtgcacagggggccggctgcggccataaatctccgggcgggccctccttcccgctgctcacgccggggtgctccgggccggtctcgtgtcccgggccacgccgcgcaccctgctcaccccatcacggcctggggacccggagactgcgcagggaaccacgccaggagcttctccgttcaccaaagagagggaacggcctcgttcctcggtgtcaacaccatccatctctgagggcgctggaccctgaggtggcccgagcttcacaggatcaccgccttggggtaggggcgcccgggcctggcatttcctcctaggaaggctcggtgagactgggatgggcatgcggctctccgctcgagcccaactccggtgccacctgcaccacggaggggtgaccccagggtcagggtcagagcggcttctcagaattcagcttgccacctctccgcggaccctgccttcatctcgtgcctcctcagagccctctgcgggcgcatgaagggcctttttttttttttttttttttttttttggcacaggtggaccaacggggggtgtgactgtgggcaccgtgcgcggaggcggaggctcatctggttcccaccctccgtgccgctggatgccccaggattttctccaaccggggtcccggcttggagccctccttggtgcgagctttggctcagcaatggggaaagcgggaatgggtctcgcccttgtggctgcctggtggaagcggcggttttgacacacgaatagtcgtggggagcagatccagagagggcgcatttgcaataataacgcttagtttatctctgccagaggggcgggaacaggccttcgcgctggtgtcttacatcagccaagcaaaccatgggcgcgattggagccaaccacctccagcggggttttgctccagacttaaggtgcacggaaaccggagcattcagcccttcatggatgcctcccgaaaacctcaccatgccagtgacacgactgcaaacggcgggtggcacatgccgggggcttgggatgggagggtttggaaacctcgctccaaggacgccctcagccaaggagcttcggctccttcctagaatttctagaagcacttttggagggaccgagggcttccggccgggcccagaggaatttgagcgcttgcccgggcaggcagaagcgcagcctgggagtggagaggctgctgggccacattccggcccagcttcccccgctaggccccagccctgccgcggcgccccaggaagcacctccgaaaacaaagcgctgtggtttcagcccaaggttaaagtccaccgcgagcgtgttttttcccccctccagaatctaagagcgatagcgtttctccaaataaaccgccaataaatcagctcccgggggcgcctgctgaagagctctggtgaccttgggggatggtttttctgcctgacccgtctgagcacaggctttggggaggagggggcagtgtcagccctacccctccagagagacgcggaagagggaatggccaagggcattcgtgggtgattacagcagtacgtgtgtacccagaggagatgggagaggcttggaatgggggaaaggggcgactgtggttatccgggggcctgtagtgcgcggtcaggaggcgtttgtgattgcgaggagggctgcttgctgtcggttcaacgattgctggagcgccggcggtgtcggcacaggtctaggcatggggaaagcaccactggggacagacacggccgctttggggccccgagtctttgtctgcctgggactggatgtgtttgtgtcggtgtgactaatgggatttatggatgtcagtgccagggtgactgatgaagggcttggcagcacgtgtgtttggggagaggcgctgcacctaggtggggagtgggtgccccgggagaggactgtcccttctcttagaggttccttcccccaccccctccctgccggctcccagctttgtttaggcctctgaacccctccggggcaggcctgtgcacgccgagttctgcagcaaattccacggccagcctgtccctcagaggcacctcagcacgccccacctctcccagccccacctccccagcacacgccacgcgtcccaaatccaggctgtcccacccccttcccaggcagagccttcccagtttgctcttttcccatctgaactccttatggtgtgctctgagccctgcttcaggcaggctttgacgaccgtatggtttgggtaccggcatacccatttaacagatgaaaaagttgaggtgcagaaaggagatgtgacaagcccacgcagccaggaagtagcaggcaccctgaactaaaccaggcagcttgctggggaccccactgtggaggccctttgcctctgggagcccccagcctggctgagactcgcttagagaaggtagaggcaaaggccactcccatgacacaggacacaacctgccacccttgtactgtgcgttataaccatcagtcctccctgccactcggtaagggctgtctccttccctgacctggcatgaggaaggaggggggcagtgaaggtcagaggactagtaggagagcctggtttggcctggggcagggtggggtgctgaggtcaaggtaacccaggggtcactttggagatcaggagagccgtggctggaaagcaggagctcctgtgtgattccacagaacctagcgcagactcaggttcaggacaaacctggagaatccatatcccctctcccttgggatcatctttttttttttttttttttggagagacgggggtctcactatgttacccaggctggtcttgaactcctggcctcaagcaatcctcccacctcagcctcccaaagtgctgggattacaggcccaaaccaccaagcttggcctcccttggggtctcttctttttttctttttgagacagggactcgttctgtcgcccaggctggagcacagcggcacacccgcagctcgctgcagcctcagcctctcgggctcaaaaaatccttctgcctcagcctcccaagtagctgggactgcagatgcatgccaccacgccaggctagctttttttttttttttttaatgttttatagagattggtggggggagggcgggtctcgtgatgtgcaggctggtcttgaacttctggcttcaagcagtcctccctcctcggcctctcaaagtgctgggagccactcacaggtgtgagccaccacgcccagcagagcttcgtttcccaatctagaagtctgtcatacaaaaaggcatcccggttttctctctctctctctctctcacacacagacacacacacacacacacacacagagtcacctccccccacctttttttcctttttatccttctttggcattttctttcaagcagaaaataaaaacatttcccatggctacagctttgaaagcttccctctcctatcagcctccatcccacgcccaccccaatgtcaatccatttctagagccagcgtcaagtcaaaaacaaacccacaaagatcaagcctgacaggccccctcccggctgccctccactctctcttcatgtattggtctgccttcaccccagagaggagcacgaggtaggaatcctatcatacacacacacacacacacacacagaggcacacacacatacaggcacacacacagatgcacacacacatacaggcacacacacatacaggcacacacacacaggcacacacacaggcactcacacacacacaggcactcacacaccagcttctatggccatggagactctctaaagaaccttctaagccaggcgcagtggctcacacctgtaatcccagcattttgggaggccgaggcgggcggatcacctgaggtcgggagtttgagaccagcctggccaacatgatgaaacccacgtctctactaaaaatacaagaattagctgggcttggtggcgggtgcctgtagtcccagctactcaggaggctgaggcaggagaattgcttgaactcgagaggcggaggctgcagtgaggcaagatcatgccattgcactacagcctgggcaacagagcgagactccattccaaaaaaacaaaacaagaatcttctagagctgctcctgccagaaagacctgttcacttggttccatctgctggaggggtccggttgtcccccacctgcccctgcccctgccttcctcacctggccccattcccgcagatcctcctctgttgtagattgaagaaagtcccccccaaattcatgtatttgattcctaacccccaataccttaaaatgtgaccttatttggagtgacggtcattgcagatgtaattaagatcaggtcacactggagtccggtgggccctaattccttatgatgtccttataaaaagaggacatttgggctgggtgcagtggcccatgcctgtaatcccggcattttgggaggctgaggcaggaggattgcttaagcccaggagttcgagaccagcctgggtaagaccctgcctctacagattttttttttcaattagccaggcatggtggcacatgcctgtagtcccagcgacttaggaggctgaggtgggaagatggcttgagcccaggaggtcgaggctgcagtgagctgtgatcatgccacagcacttcagcctgggcagtagagcaagatcctatcaccaataaaaggaggtgtttggaatcaaacagctatggagggaagacaaagtagaaagatgtagaggggggtggacacaccagagaggcctgggacagacccctcaagccctgccaacacctgccaccttggactagaggcttgatcttggacttcaagcctctagaatggtaagagaataaatttctgttgtttaaaccaccagttagtgacacctcactatagcagcttaaagagactcagacaccatcccaaatctaagagcctacaagggtcaagtgggaaccattgacccttgtagctcctggcagttccagccagctatctccagggtgccagatctgctgttgttcctgggaagctggcgtatcagtcagaataggccaggttatgctgcagtgacaaacatcccctacatctcaatggcttgatggaacacagaaaaacgtattctcctcttcacattgtcaacacagcctgggcactgctcccaggctgctgacctccttgtggtgtctggccagcctgagccagttagagttcatgagttgtccacctccatgtgaggtcaccatggggcatgcacagactcccatgtccctggtgctcacaccccacacgatcacacttagctgaggggtgctggagaggagagtcttgctgtgcccgggaagcggagaaaaaacaggtattggtgagtttagacaatgttggccacacttgcaaagccacatctcctgagctgctaactttggcacttcttttaaaattgtggtaaaatacacatcacatttacccatcttaatggtccccccgatccttttttttttttttttttttttgagacagagtctcactcttgtcgcccaggctggagtgcagtggcactatctcggctcactgcgagctccgcctcccaggttcccgccattctcctgcctcagcctcccgagtagctgggactacaggcgcccgccaccatgcccggctaatttttttgtatttttagtagagacggggtttcaccgtgttagccaggatggtctcgatctcctgacctcatgatccgcctgccttggcctcccaaagtgctgggattacagacatgagccaccacgctcggcccccgcccccttttttttagatggagtctttggtggtgaaatctcggctcactgcaacctctgcctcccaggttcaagtgattctcctgcctcagcctcccaagtagctgggattacaggcacccgccaccatgcccggctaattttttgtattttcagtagagatgggatttcgctatgttggccaggctggtctcaaactcctgacctcaggtgatccacccacctcggcctcccaaagtgctggggttgcaggtgtgcgccaccgcgcccggccaccaccttaaccctttttaagtgcacaggtcagtggttcaagcacattcgccttgttgtgcagccatcaccagcatccatctccagagctgttttctgtcttcccaaactgaaaccctgtcccctttaaacactcccgattcccctctcccagcccctggctattgtactttctgtctctatgaatttaattaccctaggaaccccgtatgagtggaatcatacaatatctgtcctttagtctggcttattcactcagcataatgtcctcagggtttgtccatatcacagcggctggcagaatttccttcctcttcggggctgaataatattctgatattcccaacatgcttgtcacctctacaagcctgtgaggctgtgtgagcttcccagggtccccagaataaaaactgggtggtttacacaactgaaacttaattgccttacagttctggagactggagttcgagatcaaggagtgggaagggctggttcctcctgaggcctctctccttagcttgtagatgccgtcttctccctacgtcctcacatggtcgtccctctgtgcgtgtctgtgtcctaatctcctcttcttataaggacatcaggcatattggattagggcccaacctaataacttcattttaatttaatcgtctcttttaaagaccgtatttccaaatacagtcacactcagaggaattaggggttaggacttcaacatatgaatttgcgagggacataattcagcctatatcagaggctcttcattttattgttttattttactttttgagacagggtctcacttgtcacccaggctggggtgcagtggtacaatcacagctcactgcagccccaatctcctgggctcaagcgatcctccctcctcagcctcctgggtagctgggactacaggcgtgtgccaccacacccagctaattttttattttttggagagacagggtcttactaagttgcccaggctggtctcaaactcctggcctcaagcgatcttcctgccttggccttcaaaagtgctgtgatgacaggcgtgtccctcactttattctatcactctctcccccatgcctggcccatcagacctcagtgaatgtccattcaatgaatgaatgaagtgatgtcatctcggtagggttttcaaggatgaataggagtttgctaggcagagaaggcacagagggcattccaggcttaaagaacagcctaggccaaggcctggaagcctcccagcggggctctctgtctcacaggtcacatgccagacctggggcagggaagagagctgtggcccctctcagtccgcagaggccagccaacctgctccccatgagctggagcccagccaacctccacaaggaccaggaccccagtgcctctgctcacaggagctggctcagatgattttcgctatgtcttttacccttcacgcctgggtggcttgagcgtatttatttaactttcattgtattggtgtttttgttgaaagtgcaggaattattcatagccggtttcggttctcttctggcaatgaccgcatcttcctatgcaaggtacaaattacctgtcaggccagttcaccatcagtcaggggctgtgacccagccccaagccaccgaggctcagctgctctggaagatgggtctggctggaggtggtggggcctgaataggtctttgtcccccaagttgccaaggatagggaacatggatgggaaacaaggggattggcccaggaacaaatcctccctctgcgatcctgctcagtctacctggccactcagtactcagtcttctcatctgtaaaatgggcattggagtgagtgtctggcatggcgggccatccacattgtcacccactggtgtcacccactgcctgggtgagcctgggcacatgggtgccctctgtcacctccaaggaaaggagacagagatactcatagagaagagaaactgaaaacagaagggacacagaagggcttagaggacacgtcctcagctaatctggccccctgggttgtggtggcatgagaacacagccctaaaaagttcctcctattgaaagatggggtcatctgggcacagtggttcatgcctgtaatcccagcgctttgccaggccaaggcagagggatcctttcagcccaggaatttgagatcagcctgggcaacatagcaagatcccatctatacaaaaaaaaaattagccaggtatggtggtgcactcctgtagtcctagctactcaggaggctctcttgtgcccagagttcgaggctgcagtgagccatgatcatgccactgcactccagcctaggtgacagagcaagacattatctttaaaaaaaaagaaaaagaaaaaggtgtggtcagctgggcacagtggttcacacctgtaaacccagcattctttgaggccaaggtaggaggatagcttgaggctagaagtttgagaccagccaggacaacatagcaagaccttgtctccacaaaaacaaacaaaaagaatcagctgggtgtggcagctcacacctgtagtccagctactcgggaggctaaggcaggaggaccacttgagcccaagcattggaggctgcagcaagctatgattgcaccactatactctggcctgggcaacagagtgagactctctaaaaaataaaaaaaatagctagaacacagggtttggcagaaaaggatatctaaggctatgcttcataaaactccaacaggtgcaggccaggcgtggtggctcacgcctgtaatcccagcactttgggaggctgaggcaggtggatcacctgaggtcaggaattcgagaccagcttgaccaacatggtgaaaccctgtctctactaaaaatacaaaaattagctaggcctggtggcatgtgcctgtagtcccagctactcgggaggttgagacaggagaattgcttgaacccaggagttggaggttgcagtgcagtgagccaagatcatgccactgcactgcagcctgggccacagagtgagactgtcaaaaaacaaaaaaaactccaacaggtgcagaacccggtttcacacattttccagacctgcccatgtggggaccacagcaatgagacactgatcaatgtttaacaagttctcaggtggcttcagcctgaggtggggtgggggataaggagagaacctgatgtgtagcctctgccaatgtctgtggtgtaaattctcccagcttcaagctaccaacgtgatgtcactgaactcagacttgggaagagatgtgtagtcgctcacttatgtagcatttccaccacagataactgtagcatccggcggtgctggctttcactgcatgagtaacccccaggagaaaaccacccagctgagcccatcctgactttctgacctgcaaaattgtgagcaaaataaggggatggttctagactgctacattttgtagcaatttgaagcacagcactagtcactagtggggccactgagtccagtgtgggatgatgcttaaaagggtggaggggccgaaccaggccagagcacctttcacctacgcctgactgggagaatccatgccagtctgacgtgctccagccctgctaacatcgtgagaaaaagccagtgacaaggctgacagccctctggaagggtctctcatgggcctcagtggccactgctcctgggacagaaagcccccacagggctttagcaggagccagggggatttgtgggcaagttgcccacctccgtgccatgctgactcctgccacactaaatacccgcccagccccacaccgcctcagacacagggtgaagaggccaggacagggctggccaggggccctggtttaaaatagcagcaccagtcctttgttttgtctgcaatgcagctctgccggtctagctcctgctttgatgttggtatttaagcctcttctgggaacctgaaccttccccaagcacatcagaaacccacactcgggcacatacatacatgcatgcacacacttgcatgctcacctgctcccctgagaagccagaggaggtagcctcaggctccagagctgtcccccacctctgcccaggtccccctccagatctgtgttagtgtcctgtggctgccgtaacaaacctgcactcactgggggcttcaaacaacagaaactggctggacacggtggcttacaactgcagtcccagctactcaggaggctgaggcaggaggatgtcttgagcccgggaggtcaaggctgcagtgagctgtgatcacgctactgtactccagcctgggtgacaggaagaccctatctcaaaaaaaagaaaaaaaaatcagaaatttactgtctcctggaagtcagaattctgagatcagggtgttggcagggccgtggccttccaagtctctgggtggactctctccttgtctcttcccggcttctcgtggtgccagtcatccttagcattcctctgttgtttttcttcttttttaaaaataaaggccagggccagtggctcacacctggaatcccagcactttgggaggccgaggcgggcggatcacttgaggacaggagttcgagaccagcctggccaacacggcaaaaccctgtctctaccaaagtgagctatatttgcactactatactccagcctgggtgacagagcaagaccctatcccaaaaaataaaaataacagctatgattgcagtggtgcaatcacagctcactgcagcctcaacttcccaggctcaagccatcctcccacctcagtctctcaagtatctgggactgcaggcacccatgaccacgcccagctaatttttttttttattttttttttgtagagatgggggtctcactatgttcgtctcaaactccaggcttcaagcaatcctcccacctcagcctcccaaagtgctggggttacaggcgtgagccatcatgcctggcctcttgagaccttgtctctaggagaaaaaaaaaaaaaaaaccccacacacacaaaaaacaactccatctggcagagtaagagggtgagaggccaggaatgggatgtggccacctctgacccccagagccccagcccttagtgtcttggggggacaaggcatgtctggtacaaggggcaacagccagcagggactggggtgggcactgctggttccgctctcatccctctgatagtgccctgggccctgtacccacaccccaggttgcagagaaccccccctgccccgcccccgcctggctgccgggaagtctagctgggccaggcgggttctgccgggaactgccctccctgagctgaggcccccctgcccctctccccgccatggatccagcaggtgtttgcctgtctgacccctgtgctgggagcatggcttcccctgcttgggaagtcttcactgtctccagcccctcagcccttcctggggctcctggggtccacttcctcagctgtcttcctccccccagactgagacccctttggggtaggacctgggtgctgggtgagctgggctggcgcagagctgggaacgggcaggccttcactgacccacttatgaccccacggtcatcagagccatcggggccctagggctcaagggcagggctggggccctggaattcccacaggtgcaggggatgatggctcgggggtggggaacagaggggcccaaggagtcaacagcacctgaagggccagagtgaggacgtgacaggcgtccagcagcgcgccccacccatggccctggacttagcctcaaaccagaaaggagtgtgggctgtgggtgcatggtcctgagaaggtggcaccgtcatgcttgcttcacgagaagccccgctcacccacctgtgcgggcactgccatccccaccctgcatgggttccacccctgactggcacacagtgggtgctatgcccagtaggtgcaccccaacatggtggcagaagtggcattgggcttaaaggctaagatctgatcgggagagaaccccattcacctctcaaaaccctagacaccaccccagtcacaggaacagatagggaggtgtcggagggaggctgggctgccctctacgacaaaagaacgtcctggcaataagaactgctcagtagtggcacatggggcagcccaacgtccagcaacagagggatggatcagttgtggtttattttttttttgagatggagtctctctgtcacccaagccggagtgtagtggctcgatctcggctcactgcaacctccacctcccgggttcaagcaattctcctgcctcagcctcccaagtagctgggattacaggtgtgtaccaccacacccagctaatttttgtatttttagtagagacgggatttcaccatgttggccaagctggtctcaaactcctgacctcaggtgatccacctgccttggcctctcaaagtgctgggattacaggtgtgagccaccgcgcccggcccagttgtggtattttcatacttgggaatatgattcagccttaaaaaggagcaaagtcctgatctgtgctatgccatgggtgtacctcgaaaacattccagccagacacagaaggtcacctataaaatgatcccatttatatgaaatgtccagaatgggcaaataacagaagctgactgggggttgcgaggggcctgtgggagtgagtgtttaacagatacggggttcctttgggggcaatggaaacgtcttagaactagatagaggtggtgcgtgcacagcactgtgaatgtgctacctgccactgatttgttcgctttgaaatggggaattttattttttgaggtcttgctctgtcacccaggctggagtgcggtagtggtgtgatcttggctcactgcaacctcaaactcctgggctcaagagatcctcccacctcagcctcccgcgtagctgggactacaggcgtgcaccaccatgcctggctaattttgtgtatttttttatagagacagggttttgccatgttacccaagctggtctcaaaactcctgggctcaagcgattttccctccttggcctcccaaagtgcttggattacaggcctgagccacctcaccagcctgtgaattttatgtcatgggaattttacatcaattacgaaaaaaaaaaaggcgcagccctcagcagtggtgagccctcactgttgggaacaggaaaccaaggcctggccgctggaaatggggctaagagggtctcagaggccttcctcgtacacacctgccctatcttccagaccctcccagagtgggtggtggtccccacagctccatagcggcccctctttcccccagggttgctaccaacactggccgaccctccaccaggtctccctaccccagcccagcctctccttcctctgccacccccctccctgcccccacagccaaagcttgggcagcactggtccccggcacatcccacgtcccggcctcctggaactcccttcctgccattgcctcttcctggaaaacccttcccgtcgcccaccctgacttctcttgtcatcccgaaaggcccagcatgagggacacctccccagagaagccctccctgggttgggcaggtaagaccctctcccgcgggctctgggcagctgtgctctgctgtgtgatctgtcaggcagcagctgtcataggcgactgcctgcaagtggcctggggccaacatctgcctaagggtttcccatcccagctcagcccccagcttgcagtgtgacccagagtggacccccagctcctctgaaccccatttcctccccacagacagagcgcctcccagcctgccagggaaatttgggaagacaggaaaacatgttcagcacagggtctggcttggaaaacagcagccaccatgactcggctgatgctaaaggcttgcttccttttttttctttcttttcttcctttttattattactatttttagagacagggtctccctctgtcacccaggctggagtatagtggtgcaatcatagctcactgcagcctcaacctcccgggctcaagccatcctcctgtctcatcctcctgagtagctgggactacaggcatgcaccgccacacccaactaatttttgatctttttatagagacaaggtctcgatactcctggcctcaaacaatcctccggcccaagcctcccaagcagctgggactacagacacctgctatcacaccgggctaatttttttatttttagtagagatggattttcaccatgttgaccaaactggtctcaaactcctgggctcaagatctgccagcttcagcctcccaaagtgctggattacaggcctgagccactgcacccggcctattttaccatcattttttaaatgaaaaataaaagggagggggatctttggggatctgcgtgggtactttgctccgctgccacagtgatgtccccacggccccgcagtccaactgcgtcccatgcaaagtatcactggcaaccatagcctcgtacctgagctgcctctgttccagggacacgttccggagctgacacccctcctcaccacccgccctcgagtcatgctgcgccactgcctctgccccccaggatgccccgagagggcaccttcgaccttcactcctgggtgggccacatgggtgtggaggccagactggcttcacccctgcagcgatccgtccacctggagagggcaccttgtgcggtttaatttggttgccatcatcctggaaccaggctgtccctggagacctaatcccttctggggatttaaaagaatcaaacttgccaaggaagacgtgagcttctggccccaggctctgccagcttcccattttaattgggaccatttttagccctcaccgggaggcttccgaaaaccccccaggcatctccctcggggcccacaggggtgacgtgtgcccaccctataccaggagctccctaccctcatctcggagcccccagcacccacaccagctgccccttctatgggtggggctttcagctctagaagtaaaagggagttgcccaaggcagacctgagctcagagcctgtgtccttgaggggcccttggtgggcagcaggtccccctcctcccacccagagccccccccttccatccggaagtgttgcctaccaccgaggctacaaaacccacatgccagtccctactcaatgcccctaggaccgaccgacccggcgtgcccgggaatgccccagttttctcactgaacaccttccatccaggcaccctctcatccctgggacggtgggtcacccagccacccacagataagcacggtagggggttggagggtgtcccccgaaaagacatgtccactggaacctcagataggctctcactgggaataacggactctgcagatggaattaaggtaaggctctcgagataagcgtgcctgattagagtgagccctaaatccaatgactcccgtccttaagagacacagagcgcactcccacgtaacgagtgcctgacggccgggacagagactgcagagaagcagcaacgggcccaggagcgccaagcgtggcccgcagccaccagaggctggagagaggcctgggaaggattctccgtgagagactagagaaggagccaaccctgcctgcaccttgatctgggacttctggcctccagagctgtaagacaataggtttctgctgctgaagccacccagcgtgtgggcatttgtaaccgcggcactagggaatgaacacagtaggtgggccaggcacagtgactcacacctgtaaccccagcactttgggaggccgagacaggaggatcacttgaagccaggagttcaagaccagcctaggcaacacggcgagaccccatttctacataatattgaaaaattagccaggtgtggtggtgcacacctgtagtcccagctactctggaggatgaggtgggaggagcactggagctcaggagttggagaccagcttgggcaacatagcaagaccccttctttacaaaatatttaaaaactagctgggtgtggtggcatgcacctgcaatcccagctactgaggaggctcaggcaggaggatctcttgagccttggagttcaaggctgcagtgagccttgattgtgccactgtactccagtctgggagacacagtgagaccctgtctttaaaaaaaaaaaaggccgggcacggtggctcacgcctgtaatcccagcactttgggaggccgaggcaggcagatcacaaggtcaggagatcgagaccatcctggctaacatggtgaaaccccgtctctactaaaaatacaaaaaaattagctgggcgtggtggcgggcacctatagtcccgctactcaggaggctgaggcaggagaatggcgtgaacccaggaggcggaccttgcagtgggccgagatcgcgccactgcactccaggctgggcgacagagcaagactcggtctcaaaaaagaaaaaaaaaatgctgggcacattggctcacgcctgtaattccagcactttgggaggctgaggcgggtgcatcacttgaggtcaggagtttgagacagcttggccaacatggtgaaaccctgtctctgctaaaaatacaaaaatttggctaggcacggtggctcatgctcgtaatcccagcactatggaaggccgaggcaggcagatcatttgaggtcagtagctcaagaccagcctggccaacatggtgaaaccccatctctactaaaagtaaaaaaattagctgggcatggtggtggacgcctgtaatcccagctacttgggaggctgaggcagaagaatcgcttgaactcgggaggcagcggctgcagtgagccaagatcacaccattgcactccaccctgggtgacagagcgaggttccatctcaaaaaacaaaaacaaaaattacccaggcgtgatggcagacacctttagtcccagctactcgggaggctgaggcaggagaatctcttgaacccgggagatggaggcttcagtgagccgagattgtgccattgcactccagcctgggcgacagagcaacagagggagactccttctcaaaacaaaaacaacaacaacaacaacaaatagttgcatgtcaattttcccattgcagggggttggatgatgttcccccaaaacttcctgtccacctgtgacctcagaatgtgaccttatttggaaacaggatctttgcaggtgtcattggttaagtatctcaagaggagatcatcctgggcttaggatgggccctaaatccagtgaccggtgtccttccaagaaaaggaggggcgccgggcgggctggttcacacctgtaatcccaccgctttgggaggccaaggcgggcggatcatgaggtcaggagatcgagaccatcctggctaacatggtgaaaccccgtctctactaaaaacacaaaaaattagccaggcgtggtggcgggtgcctgtagtcccagctactcgggaggctgaggcaggagaatcacttgaacctgggaggtggaggttgcagtgagctgagatcattccattgcactccagcctaggtgacagagagaaactccatctcaaaaaaaaaacaaagaaaaaagaaaagaaaaggaggggacacaggcacagagaaggccatgtgacgacggagacagatgggagcgatgcagctacaggcctgggaacaccgaggatttctggagcctcgggaagctgcagggagggctggaacggagcctccccgacggcctccagaagcagccagccctgcccacaccttgagttcggactgctggcctccagcactgtgcaagagcaaactcctgtcattagaagcaacctaggctgtggccacccgcccatctccctaggaggtctggctgctcttggatacccggagcctcctacctcagcttgctgggcactgaccttgagcgttgctccctcgacctgcagtgctccctgcagcgccccaccccatgggggacacaggaggggactctcagagccgtccccccgacaggccgaggctcctcccaggagaggaccccactgccccgccagcactggacactggacactgttttccataaacatttctttgaactgaatttcattcttctcacccaagaaatctctggaaaacaatgctgaggccagggtggagtgccggggagaggggatgttttaatggtttgtggagggttttctgttttgttttgtttgtttttttctggcattgtctctctcttctgatttccctgtaactgacagggaggaaatggattctgaaaatgggttccttcccacccctgggggctctgagatcaaagtgtggtggggccgggtggacaggacttggtgctccgaggtggggtccttcctgattccctcccaccttctccaccatgcccccctttacccaacggggcctggccaggaaggggcataccagggggctattctgggggacaggtctccagggcacctgccctgcgtgcccacccagtgaggggttcctggcccagagttgccccctcagcatatcccagggggctggtgaccctgtaggcccctccactttgctaaagaggatacagggagggttggtggcccagaactcacgaaccactgctgaccaggaatggccaagggaggcccacacagaacacccaatcccacagccacctgctctagtaccacttggggcctctccagccactggcctggctgcatttgctctccaaaactgccactttcttttagtttttaagggacaggctcttgctctgtcactgaggctggagtccagtggcacaatcatagctcactgcagcctcaaactcccgggctcaagcgattctcccacctcagcctcctgagtagctgggaccacaggcacacgctaccacattgggtgtttggatggatgagtagatgggtggatgggtgggtgggtgggtaggtggatcggtgggtgaatgagtagatgggtgagtggatggatggatggatggatgagtgtgtggatggatggatggatggatggatggagaagtggatagatgagtgaatggataggtggatgggtgggtagatggatggacaggtgggtgggtgggtgggtaggtgaacggaagagtgggtggatgggtgaatggatggatggatagatagatagatagatagatagatagataaacagacagacagataggctaatggatggatgaattcgtgctttctgtcccttgacctggtctacaagccacttccccagctagacaaagagagcttagaaccccatccctgccaggaaacagacaaaagctgtcggggtcttttttctctctctcagccttacctgggacacacagagctttacggtggggccttgttccagttgctgcaggctgccattcctgaaggtcgggggacaagctgcctcttcaaccccagctctgctgggggctcctcagcggctgggggagttgtgggtggggcaggagacctggcgagaagctcacgggtaccctcacccacctcatcccgccctgtgcccagccctgaccccagccctccctctttgtacctcaccccgtggaaggaaacacactgaaggtggggaggggtgggccagagcctcagactcctaagacaaagggagaaaaatggaccgaagagaggcagggggtagacgcaggcactgccttttttcttttgtagacagggtctcactcttgttcaggctggagtgcagggcgccatcatagctcaccacagcctccaactactgggctcaagtgatcctgcctcagcctccaaagtagctgggacgacaggcatgcatcaccatgcttggccaatttttgtattttttgtacagatggggtctcactctgttgcccaggctgatcttgaactcctggcctccagtgatcctcctcagcctcccaaatcttggggattacaggcatgagccaccacccccagccttatttcctgacatttctatggtaaaattgattgcttttataatcagaaaaaatatacagtgagacttaaagacacggtctgtaaccttgagaggccaaaacagcccgcagagggacaggcgactggccattttgatgctagggccccaggcacgaagcaggcaagtcccccctccccactttggccggcgagactttgaaaagaaagctggacgtgcaggagcaggggttgggaaggggaattccaggaaggggcctgggactggggccctggaaccatggtggccccccaggccagatccacccctggacaggtgcaaggactctgggagcggccccaaggatccaaataccttcctcagcagcccctttaatttgctttctgcagaaagtaagctaatgccggcagcggagacttcatttaggagaagagcaggcctcggcatatccctagcattggcagcattcctgggaggagaggaggggaaggctggggaggggagggagactgggctagagggagcccgcagattcacctaattccagggtggaattgctcgccagccaccgtgccctccatcattctccagaggccccacctagtttcctcattcatcagtcaccaggccttgtcctatggcccagccggggggagatgtcaaggccagggacccctctgaggctcagagaggggtgcgtagcaggagcagtaaagccaggactgggcacggtggctcacacctgtgatcccagcacttagagagacagaggcaggaggatcgcttgaagccaggagttcaagaccaacatggtgagacctctgt

SEQ ID NO: 3208 - DNA, 1433 bp, Homo sapiens
gaatcccaagcaaagatgaggagaaaagacttgagcccaaatcctctgcagactgcacatagcacacgtaacaaaactgggcaagggtctcccttagccgtgggcccatgcagctaggaacccagtccccagagattgaggcagtgaccgaaagctttggcaaccaataactgcttcatttcccaccaggttcagaatgaactatttacaggtgggaaggacagcattaagtcatgatgctagaaagccctctgctcctccagctccaagccagattggtcacactccctacctcagccacgtgcacttcatagctccgtggggtggcgacatagactggcagttacctggtacttcaacaccctctgcttgagacactcagccagctccttggccctgggctcagcaacacaggccccagagggagctggagaggatggctgtaagcaccgcccctcagaaggaagcaagagggagactcagtagccccctggggggcagagcagtcagagccaaggggaggagtgggggactgggtaggactgggtagaggtggggcagagagggcaagtacacatgcagggttatggaggttagggaggttatggaggttagggagcttatggaggttagggaggttaaggaggttagggaagttatggaggttagggaggttatggaggttagggaggttagggaggttatggaggttatggaggttagggaggttatggaggttagggaggttagggaggtgagggaggttatggaggttatggaggttatggaggttagggaggttatggaggttagggaggttatggaggttagggaagttatggaggttatggaggttagggaggttatggaggttagggaggttatggaggttagggaggttatggaggttagggaggttatggaggttagggaggttagggaagttatggaggttagggaggttatggaggttatggaggttagggaggttatggaggttagggaggttagggaggttagggaagttatggaggttagggaggttatggaggttagggaggttatggaggttagggaggttagggaggttatggaggttagggaggttagggaggttatggaggttagggaggtgagggaggttatggaggttagggaggttagggaagttatggaggttagggagattatggaggtgagggaggttatggaggttagggagattatggaggttagggaggttatggaggttagggaggttatggaggttagggaggttagggaggtgagggaggttatggaggtgagggaggttatggaggttagggaggttagggaagttatggaggttagggaggttatggaggatggcagcagagtccaagaaaagaacttaagtagtgtcctcaaaagtatccagcctggagccctgc

SEQ ID NO: 3209 - DNA, 1328 bp, Homo sapiens
gtggtgtgggcggtgtctgctgtgtggtgtgtgtggtgtctgcggtgtgtggtgtgtggtgtggagtgtgtggtgtgtggtgtggtgtgtagtgtgtgatgtttctagtgtgtagtctgtgtgcgcagtgagtggtgtgtgtgcatagcatgtagtgtgtagtgtgtgtttgtgtgtagggtgtggtatgtggtatgtactgtgtggtgtgtgtatgtagtatttgtgtgtagtgtgtagtgtggtgtatgtgtagtgtgtggtgtgtagtgtgtagtgtggtgcgtgtgtagtgtgtggtgtgtagtgtgtgtggtgtgtgtgtggtgtgtagtgtgtagtgtggtgtgtactgtgtagtgtggtatgtgtgtagtgtgtggtgtgtagtgtgtagtgtggtatgtgtgtagtgcgtggtgtgtagtatgtgtggtgggtagtgtgtagtgtgatgtgtgtgtagtgtgtggtgtggtgtgtactgtgtagtgtggtgtgtgtgtagtgtgtggtgtgtagtgtgtagtgtggtatgtgtgtagtgcgtggtgtgtagtatgtgtggtgtgtagtgtgtagtgtggtgtgtgtgtagtgtgtggtgggtagtgtgtagtgtggtgtgtagtgtgtactgttgtgtgtatgcagtgtgtggtgtgtagtgtgtagtgtggtgtgtgtgtagtgtgtggtgtgtaccgtgtgtggtgtgtagtgtgtagtgtgtggtgtgtgtagtgtgtggtgtgtaccgtgtgtggtgtgtagtgtgtgtggtgtgtgtgtagtgtggtatgtgtgtagtgtgtgtggtgtgtagtgtgtagtgtggtgtgtgtgtagtgtgtggtgtgtactgtgtagtgtggtgtgtgtgtagtgtgtggtgtgtagtgtgtagtgtcgtatgtgtttagtgtgtggtgtgtagtatgtgtggtgtgtagtgtgtagtgtggtgtgtgtgtagtgtgtggtgggtagtgtgtagtgtggtgtgcagtgtgtactgtgtggtgtgtagtgtgtgtggtgtgtactgtgtagtgtggtatgtgtatagtgtatggtgtgtagtgtggtgtgtgtgtggtgtgtagtgtgtagtgtggtgtgtatgcagtgtgtggtgtgtagtgtgtagtgtggtgtgtagtgtgtggtgtgcaccgtgtgtggtgtgtagtgtgtgtggtgtgtagtgtggtgtgtgtgtagtgtggtatgtgtgtagtgtgtggtgtgtagtgtgtagtgtggtctgtgtgtagtgtgtgtgtgcatgtgtgccgtgtgcaaccgtgcagacaggggcatcccag

SEQ ID NO: 3210 - DNA, 270 bp, Homo sapiens
caggaatttgcatttatgatattcctcctcctaccccatccctgagttgtgtgcaagtggcaagaaacaggaggtgtgattgtaaactagtaaggtcaggatcgtgtgattgtaaagtagtcaggtcaggatcgtgtgattgtaaactagtcaggtcagggtcgtgtgattgtaaactagtcaggtcagggtcgtgtgattgtaaactagtcaggtcagggtcgtgtggttgtaaactagtaaggtcaggatcgtgtgattgtaaactag

SEQ ID NO: 3211 - DNA, 1795 bp, Homo sapiens
ctcagcactctccaccccggtctgtggttgccacagtctcctaagtgctgtgagctccagcgctcacccagagatggaaagtttgcttctctttctacccagatgaggagatcgaatcccagagagaggaggtgatttatgtgagggttttgcgaggctggaagtcacgcccacagcctcttgccaggcagcagtgggggcctcagcccccaggcctctgccagagtggccccaaactgctgacttcagcatttcactggccagggcagatcagatttcttttctggcacttggccaccctgcacacccttcccccatcactattttgagctgagctcccctgtcccctcctcccagggctgtggccctcacacccaaagcctcactccaggctgaggcctttccacctcttgacccaccaccttccctccagccagggaaggctgggctggtcacggccatgtctatccaggccttgccagggacgccttcagacacagagccaggggccagctgccctgtgcaaatggcgctgctagctcaagacagccgtccagggtgctcagcactgcccaaggaggcgtcctgggactggacagagcccacgccatgatcagccctggcattgccacctcctacctgtgcgacctccaccctgccctaacttctgctgtccacctcacacctcaccctttgcaggcactgccactcctggtgtcccctccagctgccaaaggattctgagccccagcctgagcctagtgctaccatagaagtgagaggtgtggagggtgcacctgaccgcagcacacagagaggcttgtgggaaacaagatggcagtaggggaatttcgtttaaatttcgggtgaaatctctgagtttggcaagctggaggttgggtcagggcaggacatgacctagggaagatcatgtctctcgcctttcctggagctaagcgtgtggtgcaaaccacagagtcccctggaagttcagggagagggccttctccagggcaaggcggcgggtgggttcttatctccacaccagccagcctgggactcagcagtggagtgagctcctgagcagtgcattagccctctctgggccagggagaccagggtgcccctggagcttgctcttgaagggtacatggctgttcactggtgaagtgttgggtacagggaacagcaagaaaaaggcacagatgggcagcatgtcacttgcagggagtgacttttctttatttgagtgtaagtgctgtgggtggaaggtcagctggggccagaaggggaaggggcccgaatgccttgcatgtttcatctcagctctgcggtgaggcccaaacctgaagtgggccttcatttaagtatttggggagattctgcctggcccaactcaggcggtgactgcagcaggagagagaggtgcagtcggaagaaaggtcttgctgagcaaacgggacccaaagagggatgtgcaagatctggaaacaacaaatggttttcaaactcaatagtcccctccagcaatcagcaaacagcagggtggctgcagatcttccatccacccactaaggcagccagcaatccctgtctctgcagtggcggaggaaacctctgtcttttgcaatccctgtgattcggaagctttccacccctctggaccggcccctcttcccctcccgcccctccgctctgatccgtgtggtttgctaagggaggaaagccagagcaggaaacagataacttagggagtggctgttcatgtgattaaaatgtctttgctttccaaaaa

SEQ ID NO: 3212 - DNA, 2303 bp, Homo sapiens
caaattttgggtgaaatgtcccaactgccggaaggtgaaagtgttctgtgatgtaaaatttaggtcacactctataaagcttctccttattctatgtgtgaacagctagtctgtatcttcacctatgcatatttaaaaatcaaccttaagaaggctcttggccaccataatccttcctaccctgtagcaagagcccagcctcagactatgcttccttctgcctccgagtgcaatgccttcccccgaatctccaaggtaccaaaccggtcaggggcagctgagacagctctacttgtacgagtcctccccaagcccttgaaatcacaggcatctctgctgtccctgcccttcatccacatcactgaacaattaagcacacacatctgtgtagttttatttaaactgttccatgtgtgtttgtttacaattaacaacatgaatgactgcaggatggatgcagcagaaaggaatgctgagggaggactccagttggaatgagccacttttccaggactaggaatgaactttccccaataccaacaaggcagcctccagggcaagaaatggtaacagaatccatcctgttgacagtcaagatggaattacagagaattctcacctcttttttgactctcaggtggaaacccccttcccatggggtgaagcgcagtctgctccagagacccactgttagggtcggggatgtcacagaaattaacagggcagccaattcccatccagaggggcccaggatgaccccgaaccctctagctcagccccaagctcgggccagggagtgaagcctttgtccccaagcaacagagtgagggtctgtctctaacccggtgggctccagtgaaaggaaaatggcctggaggtgcccacaggagggcgccctagttctgagacaggtctacggctcccagactgtgtccccatgagtaacagagggacacgcagaggggcatactgagtgcctataggggactcacagactgcagatgcacgctgcggatccagaagccggtcaggtaatgaggtgcagaggtgtggggaagacctgggtgcctccctgggtgccaaccagcctaaccagccggggccaccaaacagaagtgcttctgacattaacgcgacacacagaaggtgtgtagggtgggtagtggaagtgaccgcagaggcctctggggattgtagttttggagctagagaggcaggcaagcagttgggttcgcccacacggtgtgcctctcacatctgcacagcgcacacaaccaagcttaggagccgactgttaagatgccccagtgacacggacaagtttctcctctgcaacccaatgagagctgctgaccacgagagcatcgcgggaccgccaaaggattctggaaaatgtggtcccgggtggccagtgtgcgctgaccttcacctgaaggtgagctgagctcaccatgcaagtctccaccctggggtgcccttccccaagcagatgccaggttggggcagaagcagttcagggagaagcgatgcgctcctgggactgccggtttgggggcaacatcggccctgtgtcccctagagtaggagggtgtaccaggatggggaaccccaaggccgttttcagggagaacaagattggcttgaggcaaactcccggaatggagatggggagagtctggtcgcatttccccaggagtttaggggatgaaggctggacttgggtgaacagcaaaagatcccctggtgatagtggtggtgaggatcagaggcttgagccagaaattcccgaggtgtttgtttgttttgttttttttgagacagagtcttgatctgtctcccaggatgtagtgcaatggcatgctcttggctcattgcaacctccgcctcccaggttcaagcgattctcctgcctcagcctcccaagtagctgagattataggcacctgccactgtgcccacctaaattttttttgtttttttgtatttttagtagagacgatgtttcaccacattgcccagcctggtctcgaactcctgacctcaagtgatccacctgcctcggcctcccaaagtgctgggattacaggcatgagcccccacacccagctcatttttatcttttaacttaaaggtttttatttttctctatttttactcttacaggtacggcttgaaggaaacttctggagggtggggtggtgttgaagagaaggcacaattgtcaccattttgttcaacatgggcgttttctttgtgcattgatttgcatttttaaaggtattccattaaaaatatgtttatct

SEQ ID NO: 3213 - DNA, 5259 bp, Homo sapiens
gccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttgataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctaacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaatagcctgcagctggtgttttg

SEQ ID NO: 3214 - DNA, 8968 bp, Homo sapiens
aaagagaactccaaataacaacacaagcttagcttttgctttagaagtttctagaatttagttgatgctattggagctatcatgaactgatacagtccccgtggggagtgactgtatgagctcgaactggacttggacatttctccagccctctgtggttccagttgagaagtaagtgctcttcattcattctcagtaaccaggaggaaaaggtaaatcagcgtgacttagaatgatcgttccctctgtctatccccacaagcagttccctgtgcgtttaaagcagtgggtttttcagaatgtaaagatctgggggtcgctccctggccagtcgcgcatattcaatatctgctcgtcctttccctccccttccagagaccaatgtcacctgtctgtccttttctggtgcctggcccttgctggggtcacccacatcccctcccgtgagctgctgtgtctcgtatccctcctgtcctgccgctctcgctcttgctcctaggccgccttctccctcatgcatccagctacttggtttgaaactctcccctggcgcctgctctgtggggaaagccgggcttcctctgattccggatggagtgtttaaatgagatgtccacacaacccccaaggaccctctgattccaacggaattggagcctacgcctgccagacccccaggcctgagcgccagcccttcactgatcagctagcctctgcctgcaagtctaaggtctgcagaatcgagggaggccagcatggcacacagcggtccagactcgcagtgacaaggtggctgcagtgcatggagggccaccggaggctggcactggtgtctcctgcacacaacgcagggagggtgaggatggggtccatgcacctgccagggtggggatggacaagacccctccagcagggccaggcaggctgggcagccctctgtccctcaaagtccacccgcccatgacagctaagattaaagtgactgctgcgttgaagaaggagggaggcagagagacagcagccagcagctccaaaggggatcccaggcaagtgatgagcagtggggaaaccctctctccagtcagcttgtcatgtcatacaggctttcctgacctcagcaatgcggatatgaggggcaggaatacactctggggtggggccgtcctgggcaccgcagggtgctgggcagcatccctggcctccacccactccatgccaggaaaccccccgacccctgtctgacagccacaaatgtctccagacatcgcccagtgtcccctgggggcaggaccacccccatggagaaccacacgtctaaggccacacctttactccacacagcatttccagattcaccaaaccactctccgtgcttgtcccctcagattacttcatgtcatgcagctgttcacatctggcttcttggccagccagcccttcttgagaaaacaaagtctggatctatgtcatctcagcagccccctcacagatccctcaccccaaccccagaccctacgtagcacattgcctgcaaagatgctcaagacgtgttttgcaatgaacaagagaatgagcagcccgcctgctccgggctgctcacctgttctagccaccttcaccatgttggcctccagctcccgtcttcagctgagcacaggggcctgtcccaggattcttggaagcggcttcctaaggcatcatgcttttgtgttctccttctcttaccagcctttctttccctctcacgtttctctccctttctgaccatgagcagggctgcagtgcagctgctgatggtcaagatgaagatggggaatgtgccagtgaaaacctggcatgcggaggcctcacctcactcaccctctcctgtcccagcttcaaaatctttcagagcgactcatgctgccagagggtggaggagtggaccttgaaatgacaagtgacagttcctcagcagtagcatctcctgctttctcagcctggtgacctgacccggcagcacgcccactgggcacctgtgcccacctggggatggggtctcgtcctgcctgtgtgacccttcctcctgacagccatctctagagacagccagtgagggcagggcaacaggcagtgcatgttctttccacatctccatgactgattctggccaggaggaggctggctttctggatcccaccaacatcacataggggaccttttcaatctacctcctacctcccctccagtcgtgatttgattctggaatttaagaagcggagaaagagcctagttcaaattcaagaatttccatctaaaaccacagcatggagaggcccctttaaaaaccacctaacccagctctttcatcaaacagatgaagaaacttacctaaagatgttaagtggtttgcccaaattgcaaagcctgatatatgggaaaatacttccatgggaaataagaaaatgataaatttaaaaaaaattttaaatgaggctctaattcctgaaaaatgacttacttaaactggggactgggcagaaaataatattgtagaaggtagaacagcatttctttgggaggatttatctttttaagtatatagtggtcttctaccactatcctacaacaggttgcaggacaaataatgtattttaatctttgggggagtctttgtgtaagtcagaccttattcattttcattccaacaacactcgcagccattggatcctaattatcacatctaataaggctgatggctaatcagcttgcctttttaagaaaaaaaggccgggcacggtggcttatgcctgtaatcccagcactttgggaggccgaggcaggtggatcatgaggtcagaagatcgagaccatcctggctaacacggtgaaaccccgtctctactacaaatacaaaaaaattagccgggtgcggtggcgggcgcctgtagtcccagctactcgggaggctgaggcggaagaatggcgtgaacccgggaggcggagcttcctgggcgacagaacgagactctgtctccaaaaaaaacacaaatgacattccattataagtttctgctgcaaaagaaagttgggaaatttgtttagatactttaaatagtcctaagattagctgaaatgccggtaacaaacgtgcaatgaacattttcttgggggcattcagcaacaaagtgaatcgtccttaaaaaaaatccatacaactaaagcgagtctcaccacgggaaccacaggagctgttttagtgaggggctggagtgtctgttacaggcggcacttttgcggctgttgctgcattagtcagattgcactcgagatgaatgaggaagaataaagtcttcaccaaaaacctgtcttggctaacagttctgaatttatagccctggcagtgggggcgggggctgggggcggggctgggaggaggggaagaaatgtgtcacccgctctgaatgaagttcaggggtggtgtttacctaagcaacaaacccttgtcaacaatcgctatctctggcttgccagcggaggaggtgggggagtgaggctgttttgatcaaaatccaacctgtggctgcaaagtgcccatcaacagggcactttgttagtgggaacgtgcgacctctcttaataaacataacatacacatcccactgagggccacgggtggacccaacttcttaacaggaacattgagcacatgaaaccagaaggtgctgggtccaatttccaccctcagccaaccctatctgtgaatgtctctacatgtgagccagccagggctcaactctttgctcttctgaaattcttaggcagcagaaatgaaggcatcgtgctgaaaagcgctccagaaattgcggatttatcagtgatgtacggtagtaggttggacaagtaatgattttctgaacaccaggaattagatcaaaaaagaaattccacttaagactaaaataagtctccagttgagagcagtctaggacatattcgaatggccagaagtttgtttcaatggggcctctgcgtttgtgcagcctgggagtcaacattacaatattggttctttcaagcagatcccgagtggatccatgtctgcctgttgtggcaaatcaaactcaaatttaatcagagaaaaatatatgcagatgttcaattaaaacctggagtccgcagtcttggcactgtttgcccggccctcattgtttgctaagtaacaacggttgccaggggcaacgcagtccactcccgtttccaagagcctgttgctgggcaaccgggagaatacttcccaaaccaaacaatgtcatcccggagcaaccccctctatctcacattaaccagatctaaaaaaaaccctctcaaatatgtaatctattattttcagaagccctaagagaaaggcaaataatctcttctctatagtaactgaggggaaaacagtttaccatatttgttctgaaataacaaaacccaaggaggaacaactctctctgaggtaagagggcatcacaggagggatttcaatccttcctagtactgggaggagaaagtgcccttttctccaagaggaaagaatctatttatcatcaaacaaacaatgtgggagagttcatagctgcacaagtgttttctgggcgaagtaaaatgaatcatggattaagctatttggaaaaaagtgtgaaaacagaggagttgataccaaattaaaacgacttttggaaatatcatgtacgtatggaacaagtgcaaagggaaccactgactcagcgtcagaaatgccttgtggggctttgccgggagggacttacagtatatctttgacatcactgcgccggctcttccctccctacccggagagaggaagacttttctaagaggaagccaggccacatcagatgcccccagatggcaggacacacaagggacacatatctccggaaagaggaggcacatggttgggcaatctcgacccatgaagggggaaaagaaaagggctaaactgaagctagtgcagcttttgttctgcctggagcagttcaggctgagcatggcttctctgaggctttgggaccaggagagggtgaagtggcaccaccacctttcaaggggaacacagagctctaagcagtgctcttgtttttggtgggcccagccaaggatcttaaaacattttgatagaatgagcaacatgtagctgcagcctcgatgggtcaacattttggatgataaaagcacacaatgctgatagatttgtgcatgaccaagcatacctttcaaggagctctcagcggaggtttgccctttgagacagacacagtcagtgcacagaaactgtttttttaagatatcatccaggagtcattcctagaataggaatggaatagacatgcctccctgagaagaaaggaagacagattctatactgttagaatttgaatctgtgttgcagggagatgaggaatttgaagccagactcttgggctgttaatgtatggctaagtggtgatgtggtgacaaccttgaatgctagtcctggaggtcaaatcaccagcagctggtgccatgggaggctttgcttaggggacacggctgggttctgcctggatgctgcatcccaagggaggcattgaggtgcggctgtgaggactccaaaccccatgtccagaaggatgagtaacagagatcctgtgtcattcattgatttcaataaaatatttattggatccatagcatgggcctggcattgaccagtcatcaaaacacaattccctgccctcatggagtttctattctagaccatgcgggaggataggagcatatggacagtaaacaaggtaagtgagaaaaatatgtcgtacgtcagatgacaccctatatcatatggtgacaagtaccagggggaaaaggaagcagacagaaggagtgctgggataggaaggggttgcaatttttaaagcgttgtcaaatgcttccctgggtgggctcattaaagagatgaggaaggtgtgggacggagctgtccagatatcctggggaagagcgttcctaatggagggaaaagccagtacaaaggccccgaggtgggacaatgcctggcttgaaactggagctgagtgaaccagaaggcaaggagaaaggcccacacaggccattgtaggggctctggcttttgcttggggtaaatggaagccatcacaaggtttgagcccaggaatggcctggtttgacttgcattttaaccaggcccctctggctgctgggttgagaataggggaagaaggaaaagggtgggagcagagagagcaatctggaggctaatgtgataatctgggcaagggaggggggcctggctgtgagccatggaggggcaaagccgtcagactctggataaacataggaggtagagtcagccagatctgctgacgggtcaagggtacctccaaggtttttggcaactaaaaggatgaggtcaggaaaattacccaagaaaaaggcctggagagcacttgggagttgagttctgaaggtgtaaagtgtgagaggctcctagacacccaggttgagatgctgagaaagcaggcagattacataagtctcaggctgaggggtgagctggagccatcagtgtatagagaatgcaggctggagccatcagtgtatagaatatatgaactagagccatcaatgtatagataacatagctggaaccatcagtgtgtaggggacatgacctagagccaccagtgtctagaggatgtgggctgaagccatcagtgtatagagaacatgggatggggccatcagtgtatagatgacatggctggagccatcagtgtatagagaacatgagctagagccaccagtgtatacaggatgtaggctggagtcatcagtgtataaatgacctagttaaaaccataagactatctgggctcaccaaggaagagcagagagaagaggcctagggctgagttctggggctgtctaccatttagagatcccaaagaagcaggagcctgaaaagaggccaaagaagtataagcaagtggtgtcctgagaaccaagtgactctggggctgagtggtgatcactggaatcagcaaagtggaggtcaccagtgattgtgacagaggagctccaggggaaaagtgtgtgcaaaagccacagaggttggagcaggttcaagagagccccaagtggagcagaactggagacaggaggaccagatggctcttttgaggaatttttgctagaaagataggaagaggaatggggaggcagctggaagaggaaactgagagcgggtttctgaaaatgaaagaaataatagcaggtaggacctaccaggagggaactgggataggagaaagaagggagacttgcaagtggatgttctttcatggatgggatgggatgggatgtggatgggatgggatgggatgtggataggatgggatgggatgggatgggatgggatgggatgggatgtggatgggatgggatgggatgtggatgggatgggatgggatgggatgggatgggatgtggatgggatgggatgggatgtggatgggatgggatgtgaatgggatgggatgggatgggatgggatgtggatgggatgggatgggatgggatgggatgggatgggatgggatgtggatgggatggaatgggatgtcctgcagaacacaggtgggcttggccagggctaggtgcatggatatgcatccaccagtacaggagagaagacagagtgtccaccctggaaggtgacaccaagtcatagtccttctggaggggggtcctggtccccagtcccattcttcatccatggaatccctgtgtttactcctcgccagcctcaatagctggctgctgggggcctccactctcagcagggtggacgggcttgaagccacacgatagggcctgggtataaagtatgatgacctaggtccacagacctcacatcagagcctccagcagaccctgggttcatagtcacatatgggctccatgtgaccaatacttgcccccaccccatggtcccacctcaatgcctgacagaagccccactcctcaggtttatgcacatgatttgcctttttcactgctttctttttcttttctagacacagggtcttgctctgtcacccaggctggagtacagtggttggatcatagctcactgcagcctcaaactcctgggccctcagcccagtgattgtcctgccttagcctcccatgtagctaggactacaggtgcacaccaccacgcctggctacttaaaacaaacaaacaaacaaattgtagtagcaaggtcctactatgttgtccaggctggtcctgaactcttggcctcaagcagtcttcccacctcagcctcccaaagtgtgggactgcaggcgtgagcccccgtgcctggccctcactgctttccttatggttactccatacctcttttcaaatttgccaaatggctaatctttccacactcgagtattattagaaatgagttttaatatacctatttttcttgctatgtcaacgtacaaacatgcatccttaaataagaaagtgttagagtcacatattaaaaatgcatttcttgctaagtcatgctcgaattatgcaagattgcaaggaaatttaatgcaagacaaatgagtgaggccaggaatcttgctgtgagagtttgggaagcagagctccctggctccagacaaggaatggactcagcctgacgggaggaggtctcgcctgtctttgggagggaaagatcctgtcggtacttttaagtgatcgtctatctttgaggcacagacatatctcaattggcccgggacagaaaatcaagccaagtcagagatcccctcagcaagacccagggatctctgaagaaatgaaaatgaagcgaagaaagacaaaattagaaatatttattccatccgtcatctctttgcttgtctcaaatgc

SEQ ID NO: 3215 - DNA, 5643 bp, Homo sapiens
ggggctgggctcggaatagcagtacttttccactttgatgccttagaactctcacttctcatctccacagaccagactcagtaaaatctcaggccactagagaatggaaggcggtgaaacaggatttaaatgcaaaaaaaacctattggaggcttttggcaccgtggctcactagagggacccagcatagtagaggtttctcttgttgcagcttctgaaaagttcaaaaaagaactccaggccgttcttccctcaaacccagtgagagtttgcagagaagtgccccctgcagggctcccgtcccagaacaccagcaccagagagggtcttcccgatgccccccgctggacttgcccaagcctctgggagcccctcatctcagatccctgtgttgaacatgacactgactgtcccttatttgttaaaatttgcaatatctctcaagtaaataatagccaacatttgttgaatgctttcatgactcccgggctaaggcctttatgagcgttgtctcaaggggccccaacagccatcccacagggagggggataacagcccccatttatagataagggagctgaccggatgctctgagaagtggcaggtgttgaaggaaggataaagcagtgatgggccagaatccccaaggttcccttttttgttcatcaggcccttcctgagatgtgatttttaatcttttaactttttttaattaatagcaatgcgtggcctcatatttctatgaaccatttagtgatactcccgcttcctgcatgccacacactgtgctgggaattgctcatgggttgtcctgtttcatcttctccgtagccctgtgagatcggcaatattagtccccctacagccaaggaaactgcccagagccacacaactcttgaggggcgaggagggcttgaacctgagtctgcccagctccagaactgagcttgcagccattagccacagctgtctcctgcatgtctgagcaaagaaaggcctttacacagcatcaccctgtgccatcccatgcaccgtgggactcagctaaaggactgtgcaaagagggggctcctgagttggatttaggcaaaaggggcagaattcgtttgatttttagagaaaatctctggagagtttcttttgattcatagaattccttttagatttctttccagcataccaactagctttagtagtgctgctacaaccagctcttataagtaagagtgaaaaagtattcttttcttctttaaaaaataagtttttcttgcttatagttaattctagaaaggcaatactaaaggtatatatttttttcaaaatgctattttttactgcacttgataattatcctgacagctctgatctctgtaatagattcactcttcagctctgggcagaaccagaggcagggttcacaccaaatttgtaaataccatatgtgggtctggtgtccaggaacttttttctttctgttaaaaaaaagaaaaaaaaaagaaaaaaaaaaagaagtagaggtggaagaaagacaagacttagaggaacaaaagaatgttttcttttgagatactcttctcaaagaaatagcaacaattgtataaacaggaaaaccagccagctttcatgataaaaggaaggcgtgtctcttgccctggtatgagattaacagaaatacagatgcatttttattttgattgaaagatggtgagaatgtagaaatgcttaggactagatttttaattttttaaaataactattatcatttattatgaaatatttgttcagttgttttgagtgggtttcttgttccttttttcatttaaaaccttctttgttgactggctccaggcttgtttgcctaaattcttaggtagtttacacaagttctagaatcttttagaactttaactccattggaagcaaacctaactaatcggagtttgagatcctggttggtttcaataggtattctggaattctggcagaacacctaaagattttttttttttttagaaggttttagatacattatcttacacaaactgtgacctaatggcaataattacctcaaatgtgggcattcatcctggttttagccttttttgaaatcatgtagccagcttgatcttggaatttaaagactatgaattctctgtgggctgaaaataatgattacttcatacccccggtcatcgttgcttaagtgaattctgaaaatagctcatctttacaacaaaaattaaaccaaggaagagattattctttgtgtgttgtactcaaatgcgatgttcaaatgcacatgttaagtatatatgtttttagctactgtaaaatgctgttagccttctaagctatcaaaacagtcacattttaaatgagtaaactaaacaattgactgtggatacttaagcatatttctggctacgttttatagttaaagtgttttatagtttacatttagactggtactttttaaagaaaagttctgtttataactgacatccgcaaaccccagtgaatgcctcttagttggaggttgtgtctcccccaaggcaagtgtgttgtcccagactcttctgtagtccagcatgcgcacttccctctggattattactttccacgtgaactcaagagaacatgaaaggcaatccagatggagggaaaaggtgtgagtccgcagcccgggccagatgcgaaggtctcatgcgtgtcgtctaaacacttgtcttcaaggccttctctctgacatcttggaagagtcattgagaacagataacctggttcattgatttttgtcttgatttgaatatttaacttattaatagatccactgatttccaggcaccaggcagtagaagagactgggattcaggtgaccatgaaggcacagctgctacttctgggccgggggtgatattttgatcagcgttttgtaggggaggaccatatacccctattcccatggtcgctggctgggttttccatatatctgctgtcatttattcgttttccccttaaaagcaaaatcaatgtaaaaggctatgtttacgttttactcattgtccagcttagactcaaagtctagttcggtgggagggggaccttagcatcctctcagagatggtcagggctgagcaggaggaggcagagacagaggggcagctcagcctggtccattgagacccactctaaacagacatcatatttggaacaagaagatgcttcgagacaggaatgggccccactgtcatgcagaaacagactgggggaatggcagtttccctgagtcttggtttcttttatgttttctcttgtgccaccaccaaactgcagaggacctgctgtgacctaaagggcattcctttagcagataagaccttgaaaactgcaaaacacctgggaccagggagcttttaaaaaatacaaaaaaataccacatttgctttttccctgtgaactgtattgacagcgtgttcttaggacagtcttttggtggaaatgttactgtaaaatagttttcatctcacccctcctaatcatactcccactttcctgtttgtgtggtggtgttgctgttttttcctttacatgaattaaccaaatgaattttgtgtcattgtttttggggcttatatttttaaaacatagaaattgccttttgttcatttgaaaagtaagtatgttgtatctgaaaaagggctctgcctctgctctccctcgcttccttgtaaccaatctccaaacgaatctctcctggcaccgcccccttccttatatagggtcactgtccccggggccacctctgcctccaccctgctgtcaccactgccctgggccaaggcacccaggactcccagaaagcgcgagagccagcaagaaggccccactcagccttgagactggtggtcacacctccctgtcagagtcgcctgctgggctgaaggggcaatggattgtcattgttgaaattgtttggctcaggttataaggaggaacttgggaagtagaaagtgacttgaccatgtgcatccttggtagcttcctgtaactaacaaatggaacagagagcacacccccgccccgccccaccccaagcagatgttcccgtcagcgctgccctgagtcagtcggtcccccgtttctgctctcctcccttttgtgttcctgctcacttcaagcttcttccatggactttccagggcacagtcatctctagcccccaaatcatctcttcatcctctgtgtgtgcatttttttaaccaaatgaaatagacaagaaagtcatactttggggcagcagaatttctaatttagtagaatcactgtatagagatagatgttgatatatatgtttgtgtatatatatcaaaccaaattggataggagaagtatagctttacagatgaggagaaggagctctttagaggtcggagtcaagactggtgtcttggacgtgcatgggctgtgtcccaggccactccgcacacatggggctgaggcgtggcgccgggcccttgtcatccacctcaccacggcagagccagcaggccctgtagggtgctgctgctgtctcactgggtcccagcttcaagcgcatcagtgggtgacgggggcaacaaatcagagtgactggaagtttccatcccgttttgctttgaccacgtgtactgagctgcagcctctgatactctgtcacgtttccaaaaatggtatccattaggatagaaagagaatggatctgcagaaatgtttacctttcaactgctcatgaattcaggacactggatagaaagactcactccccaaaatgagaacagggaagaggagacccggcgacactaagtcaccaggtccaaggaacgtggctccctccccagggtcatctcacctagatctttctctcccaggtcatctcagctcaatctcaataaccctatgaaagccctggtctgttgtgttccttcaccgtacggtttctgtaataaaaagtgttaatccatgttaatctgtgtgaaaattattgcgtgcaacagtattttctcgtgtacctctttttcctatgtgaattgtccctcttttttatttataaatgtctacttttgtttttttaaagacaaaccaatgtgttgtagacctatatgtaacctattccttagtctcatattataggtatgttataagaatggatattttacttggctttagaatgttttacaagaaaactaattcttaactgatcaagtccttgctactaaaatgcttgtgtttttcatcatgacgtcgtgtgcttctaaattaatcattttcgttgtagaaaaatggagtgaatttatattagtcttggaaactaataatagcattgtaaatttatgagatgattttaacagaaaaaatatagaagaatatagttattttaattgtaatattactaactgtagggtgagaaaaaggggggggggtcccattgtggtgaactatgttatagcttgttactcatagtttctttttgatcattttttcggtctccgaggtgaaatgacttattaattaaaatttgtaaactcacatatgcatattgtatatgtgtagaaatgtaatcacactttgtcttggaattacattaaactgtttgaaatcactgta

SEQ ID NO: 3216 - DNA, 7116 bp, Homo sapiens
agagcgagtgcgtccccaccagcctggccgccgcgggaactcggggaccgggagggcgggggttagcgggaggaaaggggcaccaagaggcaccctgagaactcagaggacccagaggctcccctcaagcaaattccctgctgaccctggacaccccttgaaggagggggcaagaggctgccacaaggctcatcttataactcccagcaaggactcccagcaaacaagttcagcttgggatctgcccaccaccaagcctggctgggaggtgggggggagcgaggggcggtggagaggcagagtccctgaacagggaaaagacaatcagttgttcccctttctggtgtcagaggcaaagaagcctgaagggctggtggtggtgctggctctgggtttattgactctgtgatcctgtccagctgtcctacagggagttccagagctctcccaaagtgcatgaggaactgcacaagtaggactggggcacaataccagaagctatttgtctcctagaacctggcaccccctccacttaccttacaggagacccacatcactcagttcccaggacacctggtgggagagtctggtgagatttggaggcagacttcctctactcacaacttgtttgaaaatggacataaagagaagaacagacactccatcgccccttcagggcctcctttgtgtcacaaaacctatcccctcctagggcacccttgacattcccctaggtgggcctacacattgttcagaacctgtcccctgtaccaaaataaatataaatgagtttgtttctttaaaagaaatattacagctttaaacttttcccagccggaatccacctaatttcatcaaggtctctcgctagcagccataacccaggccaaaagggcttgtccctagggaggcaccaaagggagaataccccaggcccatttcattccactgaggtttttgaacccctaggtgtctaaggtaataccaccaccatccccacctgttttcagttctttctttgtggcttaagattgcatttttggagggtttatgtaatgttgttcacgtcagcaagtctccctgccccaccctcaccccactgtcctatatggaattatagttggaaaccacacacacatagaaaatctttgaagatttttttctgctattcttcctgactagaagagttgacaagacatagacacattcagttgcataaaatacagtagcgtgatcagcctaaatgcatctcatttgcactgtttgtaaccaggggtgggggcttgtgtcactcattgcctccccctcctctgcccaaaccagacccgccagctggaatttcagagcaggccccaaggcagcagccatttgggaagtggaagccctagcccaccccagtccagcaggggtgcggggtggatagagaaggtgtctggaggtctggcctgagggcttggaccaactttggcagacctgggctctgggaggcttggccggtgggtgaccacagctggaagttggaggtctgcagcgatgcttctgagcttctcctgagttgagttcaagaaaggggacaccaagaagtaggggaacagtcactgactatattttacatccacgcctacccctttcccagagttgtgttctcaccacccactttgtcggcggaggagaaacactgctgcctgatgcttgcactgctgcactgttcttgcacctgctcctagccctgaactcgggccctgagctcctcactgccgcccgctctgcgctgagccccactcctgagaccgcgaggtgccagagcagcgcctctcccaccaactcctagacgcctgtaggagctgcgccggagccttcagaaccccatgggggtgtgggggtgaagttggaggtcatccggctcccggcttctcgaacgctcttctgatcgcccagcggggagacttcagggcctgcctcgtcaggccagattgcagcccgcgaccttcccggattaaccaagggcggggcctgttgcccagcaaggctgctgcctaactgagcctcccggggaacagccatgaccaaagccccgcgggcccaggcgcgggcacctacccctacccgctcaggcctgtgggagcgcaggggcagaggccgagacgctggacttccagccccacacctctgacaacccgggcacgtctgcggagcccgggggaacagtcagcgggctctgcgtcccgggagctggggacacgcctgcaaggtgtgtgatcctttaaagatccttagtactagttttgtagggagcctttgttatagctttgtcagcctgcgcgccttcagcagctccccctcccgggcccctcggttccctccgggctcgcccccagcggagagggcccggcgcaggggatctgcccaggatcaactgccctcttccagatccccttctgcgagattcttttcctttggttacaatctcccctccgtgcctggggcagataaacacggttcgccccgcctgcagtattggggcgatgctgtcctggaagaacgggctttctgaatgtgacctcgggatgctgcagcggcgcaatgctgctactgctgaatgagtagctctcctgccaccgcagggcgactgcggtgggcacagcagggcgcacagaggagggggtaatctgcccacccaggctaaggatttgagggttctgacaaaaaagagctggttgaggatgacacagttgtgaactaacctggctcctactaccccacagggcagccaggtcccagtagtcttgggtaccactgcccccaccataccaccattgtaaagtatggactcctgcttagccaacgtgcagctctaggcaggatctctgaaggatgctctggcacacagatggtgcaggtatgactttacctgcacacaagcttacatgtgccctgtcatatatggctacacgtttccccatttccccacagtcttcctatttaactggtcttcaatcctcctttctagggctttccgcctgcacacagtcatttggagaaaatcaagtgagtgcacttctccccacagaggattctgtatgttatgtaacacactcacactgggattcctcaagttaccattttgccccaactcagccagcacttggttttctggcgggggtgtcaggatgatgcaaatggaggtggaagcttcattccctgggggcttttattcccctccttgaagccccagttcaaggcccaggaacaaaggggaaaggtaactgatctctcttttggtctttctctcccctcacttccaccccttcacctgcaggccctcctctttgataaatagaggaaagcccgtgggatcaggtacatatgtaaatactgctgacctcggccgcccctcctcaccgaaaagcagaaagcccgtttcaggtgcaggctgctccgtgcctttgagtgtccaccacttctattcccccagactgcttgggactcaaggccactcacttaatacccgtctcttgttaaaaacattcaggacaactattaaatagttattggaagagttaaagaccttctttcaggagtgaaacgtttttaaagctgtgcttggcataagtctttaaggcgtacaaagtagaatcagtagacttgcctgagcgattttgaaatttgaaagatttctccccatgaaatggtaatttaaaatagtttgtagatgttgttttgttctgtgatggctttttcaccattgtcacctaaagattctcaagaccaagctactaagacatttcatttggttagtttctgggtgatactgtgctttctgattagacctatttaatttatttttaactctgcaggagagttttcaaccttggaaatgtaagtgaaacacagactcaccctccttctgagaccttgataggggcagaaaggaacaaatctggctagcccccctcacacctggaagtttccctgtctaaacctgggtacaatgagcgtggtgggttttgtcaccttttattttattgctggctcaaggaaaattctttgaaatgaacatctattctatttcagtgtgcaatgttccagccgacttaatgggcttgccttatgcggagaggcagtcctgcaggacagagctaatgtgtggtctcccaggaagctcatcagaacacctcttgtcccttttctttaaaagaaaaaaaatttaaaaagtttttgcttccatctcaatgtccattccattattttgtagctacaataaagaaacatgggcagcagtgatcattctttttgtcctatgtaatcatgtctagtgttaggaccttacaaagctccagacatacctcaggtgtattctgcacttttcatatttattcactgctcactgggtcacacagatgattcacacttgattccaccttcctctggacaactctccctcaaacaacacccctctatcaacttatagggaaaggagattcacttagagaaaacttcttgaattaaagaccagactcagtttcgccaggtaactaatcctggcataccggtgactaggaagtcatcacctaacactctacctagatataaactctcaggaaggaggcaggccggtggggacatttccacagacatttctaaaactgtggcaattgagtatattttacagatacaattttggtagattcccatccagcttaagacatttaaaatgcaattttgttcacacgcatgtgcgcgcacacagacacacacgcacgtgtcaactagggtgatattaacagtccatttccactgggcaattctgtgacagcaactacaactaacaaacttcttttctgaagagtaaaaaagaaaacaaaagcctctccatctattttaaaaggttattttatattgtttagcattctttcgaaacaggaattggctggacacttctcccttttcaaagatcaggtaaactactctcccacccacctcctccccaagaccaagccattttttaaagcaaaaattctgtttccaaaggaagaaaaatgaacaaattccattaatgaattacatacatggaatgtggcttgtctaggacatttgtatttgtaaataaatggctccctgtttattatgtatgttttactggaaaaaaaaccaactctaatgcctctgagcatgttataatacagcaaatatttccacttatggtttcagttccactgtttcttggtactcactagaaagaaatcgggttacatggagtcagttgtggggtttaagcgtccaggctgacttggggacgcggcacctctaaagttctcatgtttgccaaagtgcggggggaagggggaatggctcctaggaatcttatggggattaatctggggtttcgcctttgtcccgggatctttctaaggctcaccacggcctccgtctgcagcttcagaagcgaagccggcgtgcgatctccttggcgggcggactgggcacagtccctgccttgccctgctgccggcgcccgcacaccgcggtctcaggatctccccgcaggcctaggcctgcagtcctcgggcggagacggggcctgggggagcgaccctcaccgggccaggcacaggcagtttaccctggtgcctgtagggtgctcgagtttcccacacgcgggaagcggaggcgtgggccaagcgccgggggctgcccaagaactccaccgccccgtgcggcgcgcagggcctggcggcgcgaaacttccacaaagccgccggccgcctccggccttgcctccactccgcagtcccagctgcctagacctcggtgtcttcccagacaatgagccctgccagtgcactaggctgttccgctctgacttcttctgcccgcacatggggacccgagcgaaaggttatgggttggaacaagtcagcgcatctccttccacgcgccgcatccttcgggaagacaaacagagtacgccccccacctcaatttcgggccctggtctgtgggctgggccacagtccgggaagacccaaggggtcacgggtccagatccgtctttactttgtcctccgctccagggctccagggccctgggcagcagagaggtggatttcagagaaagcccgggtcagccaggccttgaactcagcccctctgaactccaccgtcagcagcgtgggcggcaactcaattctcctgggaggaggctgcacccccagaacggaaaatccgcaaacgtcgcgcagagacccacaggcatttctacctttccttccacaagccctgcagaaagttatcgccagaacctctggaacctgagccgactccagcctccagcaactccctcaaccttccagggaaactttcagaagtttccctttccttcgctcctcaattccttggactttctccagcccccaggtttgctcattactctgctgactgccctttagtctctagggctccacaggcctgagcgtttccagaataataataataataataataataataataataataataataataattgttattatgaggctggggaagaacaggatcagagggtaggagggactgagggagagagtggacatgtttatgaaaaggtttatttaaacctgtgtttcaaaagggttcagttgacaattatcagtaaccccgatagacaactccattaaaaaaaaaaagaatttactattgctcttgaaagccgttattttttccatcgctttttaggaagatagatgaacaaaacatcgcgtttcaagccattttgatctgtaattgaaaggcaggatcggtttgtattctcctacggcttttacagaagttgcagtgatccaaagtcgggttgctgtgtcagagtggcatttttattaatgagaatacaaaaagcttgcatattcttagccctgcttgaatttagttgctaagcaacgggtgtatggtaattcatccgcgaaatttaaatctttgagaaaggttcgtgcgttttgctgaatggtcgccacgaggaaaacaacttgtgggacccacagcagctgccacagtctggccgcccggccgtgccgggccgagcagggacccggccgccccaccgcgaccgccaccgcc

SEQ ID NO: 3217 - DNA, 260 bp, Homo sapiens
agcagcagcaggtggcaggaaggagtggagggaaaggacaccaagtcttggggagagggaaggacccttcttcggccttagaggggagaggagaaccctgaagtgggccctcccagtcccatctctgggcacagatcccaccagtctgctcaccagtctgctcagtcaaagcagagtgggtgcactggggtggacgtgtcagccctgagcacccggcctccaggctgcaggaatatgagccagtgtcttcactttgctcg

SEQ ID NO: 3218 - DNA, 2157 bp, Homo sapiens
aggaagctgccgtttgtactcgggtagcaaccggcagaagcctccccggggtccctcccaccgcccgtgaagcctacccacccaatctttagcggctgcgaagtccttccaccccactccacgacccctcccgctgcggggctccttccgccccatcgcccggccccggctcccgcctcctgtgcctgcctttctcgcggctgcccttagggcagaggcatcgcgttgggtgctttacaggggacaaggcgtccgaattccctatcgcctgtgggcgatccccgcccaacccctaggccatccagttctgttatcagaggactcccaacatgtcagctgtctgctgcacggcccctggagctcccataggcactgcatacccacacggccaacatggccaacatggaactcagtatcctccaaacagaggccttcctcttgggttccctgttcataagaggaagccactatctactcaggtgtgcccacagaagaaagttgagagtcgtcctggaccccactttctccatccctcacactcaatccttttctagatcctgaaagtgtacattgaaaggtcgctaattttctcatctccacctctgtatctcctactcatccttccaggtctaactgaaaaatagctttgccttgtgtaagagtacattcatctctgcgccgttatcatcgcttgtgaagtttttatcagtggactgaccacttcagggttggggccgtgtgtgaattatttgggtgaacccagagcccagcatggcactgggcaaaggcaagtcagccctgagttgttcttccatggttgtacctaccttggttgtcgttgtgctccagtcatacataatcttacgagctctcgaaatttgcagctgttcccgtctcatcttttggtctctagcttctctctctgcaacccatcctccacactacacacaatgtgatctttctattggacaaaattaaccctctccttctttaaatccttcagtggttctccatcaaggcatataggccttccctgtctgccttgccagactcttctctcactcctattctctccctttacattcctgacactcagctttgcagagctaactagctctttgagcactccatgctctgcactccaggccagagagcctccatgccctccagtatcccttgcttggttaactgttgttcatccttcaggactctggcaagacttagttttgtcccccaagcctgggtttgatgcctcctctgagttttcagttccactgcttctctttgatcatgtatattttgattgtttgtttacatatctgtcccttgtacttggaaggtcatctctagccatttacccagcacagcgtcttgcatgaaggagacaccagtgggaacgggagaaagactttatgagataagccctgagcccagtgatgggttgggaaacaatctcggatttagggccagacagactcaagttcaagtcctaattctgttacttacaatttatgtgttcttagaagagtcacctctttctaggcctgtttccttggtaatagactgggcatgatgaatacagttgctatgaggtttaagtgaggtaatgataaagagggttagttagtcagcaggggctaagtaaatgagaattcaaaccagaaaccaaggctcatgcctttaatcttagcactttggaaagccaatgcaggaggattgcttgagcccaggagttcaagaccagcctgggcaatatagtgagaccctgtctctatgaaaaacaaaaacaaaaccccagaaaccaataccccctggtttcaaggcctagctcagtgactttaaaaatccgacatagctgaacaactactacatgccaggccttgtgtaaagagcaagggatgggatacccagctagtctctgggttgctttccagcttcacctactaactttccttgcattctactttctaacaaaagcaaactgctagcaggtccccagatacatcattctgttacacctctatgttctctacatagtgttgtctttatatctggagtaacctttcttccttgtctgccaagtgaacttctgttccttctctgagtccgttttcagtcattacctcctgtgtgaagcttactctgattttctcctcc

SEQ ID NO: 3219 - DNA, 9271 bp, Homo sapiens
caatgacctgacacagtgttaccggatgaggagtctggtcttgctttgctttctctgccttttctgtcttgtcattggctctcccgccctcctacacgcaccccgcctgttgcttctctcattctccagttcccttccaatcccccttcacttctctttactcccctcccccaggtcagtgctcggcgtttcctccctctttctgttctcccatcctcccgggcagctgtctctgtcctgttctgtctcctgttctcccgcccctccagctccttcccttcctcctttctcctgggcccttctctgccgcaccttccacagctgctctgttcctccccatcctcgtctagtcccattcgttgtcctttctctccctgggtcacagagatggccccggggtggctgcgccctgttgaggcagggaacgtttctgctgcatggccgagttcccaacctggacccgccgggtctggcagcctgtccccgcagtagcctgggctgtgcccacgacacccccgccgcccagctacccggccctctccgtgcctcacactggctcctaacctgcttcacgttcctgcttcctgccccggtctctgggctgacgctgtcttaggggcgccccctcctcagctggaggggcatggtcctctgtcgctacttccaatcctctctcccttctttctctccatattgctcttccacactcatgcacctcttctttcctttctgctttttttctcgctcactcacccgctggagtgcagtagtgcagcctccacctcccaggctccagtgatcctcctgccttagcctctcaaagtgctgggaccacaggtgcgaggcaccatgcccggcctgttcttttctctctgcccttttttgtattttttcctttctcctttccttcttccctaatgtctgtctctctccttcccttcttaacttcccttctctctccagccctctcctaccctccttttctcttttcccctatctccagccctctcctaccctccttccctccctctttctctctccccctccgcaccgctccatctccctctcggtccagtccgctgtctgtgccccctctctgttccgttttctctcccacccttcttccctctcccatttcttctcttttcccctcttcctgttctctttttctcgctgtcctctctgtggccaccctcctttttctcacttctgctctccctgtccggctcttctctctcctctctcccttctagcagattctctggctgtttcctctcctctccctctgtgctcctccctcctcctctctcctcccagccactatcctctctcttcaccctcttctctttctgtctcatggtctcctcctagctcttttccttcccagttcctagctctctcctttctctttcctcttctctggctggagctccccgctcctccatccctccctctcccggggccccctctcccccaccctcttctcccccaacaccctctcccccacccacttctccctaggacgctccctccttcacccgtttctctgcttccctcttctccgagctcaccagccatggcacccaccctctccctctcttccttcctgtcccttttttcaccccctcgtctttctttcctcttctgttttttcttctctttccacttctgaccccctacactgtttccttctttctccctcttcctctctcccctcctgctctggccatcttttctttttttttttttttttttttttgagacggagtctcgctctgtcgcccaggctggagtgcagtggcgcaatctcggctcactgcaagctccgcctccagggttcacgccattctcctgcctcagcctcccgagtagctgggactacaggcgcctgccaccatgccctgctaattttttttttgtatttttagtagagacagggtttcaccgtgttagccaggacggtctcgatctcctcacctcgtgatctgcctgccttggcctcccaaagtgctgggattacaggcgtgagccaccgtgcccggctctttcctcctgcttttttcctacactctctcctccctcctctcctccctctttctcctgtttgatttccacctcttttctctcctctctcctctgaatctgcctcttcctcttctcacctccctcttccttccctgtctctcccccttgggtctctcttccttccctctctctggtttctctgtctctgccctgtcctttcctttccctcctctctggacctgtctcctctcctggctctctctccttcaagctctcactcccactggcctccctcccgggagccccgtctcctccgtctccaggtggcccctgcatccctgcctggtgggcctttgcctccctctcctgttcctgccttgcctgctcccaggtttccaggtcctgaccaggaggcaggagtccataccgaggcccaaacaggctagccctgagcagggcccccaagcctgaggcccaggagtggacagacctttgtgacacccattctctcttccttttccatctgtccggaactctggacactgcctggaggaatcaggcctgccgtaggcccaggaaggcggaaacaaagacgacgctcagagacaggaagcaacttgcctaaagatacacagcacaaatgagaaaattggtgcccaatgtttctgaagaccagcaactgctaagacagagacttcgagggaacccgaccttgcctgaaggaccaacagcgccccctgcaggacacttccctccattgagagaagccacaggcgccggcctgaggcattctgagtgcgtggaatcctctattaccacctcctggcaaagaacggagctgcaacccagctatatgagacaccgagaatgatctcaacaaaaaggaacagtgaccagaatgcctgggggaggaacaggggatactgggtggaaggaggggagagggagaagttgtaatattttgtaaaaatgaacatttttactcctaatcaatatacaaacatcatgctcagcaaacttcttggtatgaaacttctgaacttcacacattttcaagtcattctatgggtgggtggattggctcccatggaaatgcaactgggactgcacatgggaaacaaaggaaaatggaatttggttcacacaaacctgtttgggagattgcatttccaggaaatgggccaaattgagtttgtttcctttgtaacaacattgttgtgccttgctgactggaaggtgggtacaaataaaggaggatggactgacagctgaagaggcaccagtaattagcccctaatccttaccagggagtctctctgatgggttaaagaagcctacagaggccaggggcggtggctcacacatgtaatcccagcactttaggagactaaggtggatcgcttgaggtcaggagttcaagaccagcctggccaacatggtgaaacccggtctctactaaaaatacaaaaattggctgggtgtggtggcacacggttgtaatcccagctactcaggaggctgaggcaagagaattgcttgaacctgggaggtggaggttgcattgagccaaaattgagccactgcactccagcctgggtgacaagtgaaactccatcccacaaacacacctgccccccacccaccaaaaaaaaaggagcctatagtttccagtagacaatttggggttagtaaagaattttacaaaatactaaatgtagtcttgtatattttaggattgtttgccatgcaactatgtactgggagcacctaaatgcccacatgaaaccctaggctgggaagaggaaggctttcgcaatgccacgcagccgataacattttctggtggcaggaaatgggagggagcaacccctcctggagcatttaccttgccaggtgctctcacatcttagaccagaagtcacgaggctaggatgagggtccaggaggcagagaatgaggattgagttagggtcaggacagtggacacagagaggaggagacacagaaggatgggttgggactctatcctgggggaggtgagaggccacgcggagggctgtgagcaggggagtagtgaggtcagctctagtgtcaggaagctctccattagggggatggactgagggggggatgttgggggctgggaggccaaagaggaggctgggccgatggtccaggtggcagaggacgaggcttgagctgggaccaaggccatggagacagaggtgacgggatgaggccaggaagaactttaggggtaggtatggtggtgcataggagaacgtgattgggacagggcagtgctctggtccatgaggttgggcaggtgatggcaccactcactggaacaaagatccctggaggagcacccgatccgggcaggtgggaggcactggctcctttagtggcccctgaggcacatcctggggaaggagcccaggaggcagctggggccatgagtctggagatcaggggtgggatctgagctggagatgagttggggaatcgctggtgaagaggggctgtctggaacctccagggtgaagggatggggcagacacctggagtagcaagggggaagcatgcaccaccatcacacacacatccctctcccccagcaaggtggggccccaccgggccatgtcttccacagacacatatgtgtgcaaaatgatgcagcagaacagggggactcctgcagtgctgcttagaactactcaaatccagcaacacactcttacaccagagatggaataagatggcaccttataccagagatggaaactgccccagctatgtcaaaagaaggtgggggaaaagagcaacacttgcaaaactgttgacatgtgcatctgcttgtttctgtggagagtatctgcagcataccaggggacagaaaactcaggctgcctccagggaggggaagtgggtgctggagcccagagtgagcatacagtttctggacgtggattccactgcatcttttgtctattctggagacagggtctcactctgtcacccaggctggagtaaagtgattcaatcacagctcaggaagcatcgaactctggggctcaagcgatcctcctgtctcagcctcccaaacagctgggactacaagcatgaatcactatgcctggccaacctactctatcttttgagtttcatacttcatccctggataacccggtcaataaaataaaatagtgagtgggttccccaaggaccggccagacggggaagaaaagtttaataagaacagaacgctaggggagcctgaaggagctcaggcatttcctggaatacccaacagagtaaccctgccagcctgaaagcaaccgagacttagagggaaaggacataatcaggtttataaagatcccaatgtttaacccaggaaaaataagatgttcccccagtgccggggtagaagacatctgcagatcagacacagggaccaggactccaagttgggaacacttcccaaaaagcatcagtaggcctggcgcagtggctcatgcctgtaatcccagcactttgggaagctgaggcaggtagatcacctgaggtcaggagttcaagactagcctggccaacatggtgaaaccctgtctctactaacaatacaaaaattagccaggtgtgttggcgggcgcctgcaatccccgctatttgggaggctgatgcaggagaatcgcttaaactcaggaagcggaggttgcagtgagctgagatcgtgccattgtactccagcctggatgacagagcgagactctgcctcaaaaaaaaaaaaaaaaaaaaaaaaaaagcattagtaaatatttctggaatcctctaggaaaagaatgaagcaggattcacatggaatgaagacagaaaaagcataagctatctcctgcaggtggagaaagaaacagaagttagcaatgctaagactatcttctttattaaagttaccaaaaataggccaggcgcggtggctcacgcctgtaatcccagcactttgggaagccgaggcaggtggatcactcgagtccagcagttcacgaccagcctgggcaatatggtgaaaccccgtctctacaaaaaatacaaaaactagctgcgcgtggtggtgcacgcctacaattccagctactcaggaggctgaggtgggagaatcgctgagcctgagaggtggaggtcgcagtgagtcaaggtaccgccactgcactccagcttgggtaacagagcaagaccctgactcaaaaacaaaaagaagtgatgggagggaaggcaacctcccacggtgcaccacctcctggtcttgacagtcgactcacaaaccatcacttgtttataaacgcgtttccgatctgccatcgtaattccattttagtcatgcatcccgagatcattcaaaccacacccaagagagactggacgacagcactcactagggtgctatttataaccatacaatgcaggaggctagctgcgtgtcgatctgggggacagtttaataaactgccacacaacacagctgagctccacacagccacatgaggatggggacagccattccttgggtttctgaataacgtatcaagtgagcagtgaatttcaatcaagcttgtacatcaggaccgtcttgccaaaacaacagttgcttttggctgctggaagctgtagcttttcaaaacgttcacacatttcaatgtatcgtcgatgtttttaaatagacttacagggagggtggcacacagcaaaggcccgcaggccctcgtagcaccgcagtccaggtaggatgctgggcggcggggggtggtggagggggttctatttacagtgtctgggctttgactccactaactgttggttttgttttctttcttaaaccttttccttcaagtctggaagcctgtggagggcctgtcaccttaaaggcaaggattccttgtttgcaccaggcagacaaatgtcaaaccacgaccccaggggctgcactaggcgtcgggcccagaagcccccggccatccagccccgactctttcatgcctctgcccctgatgaggggacccagggtaccctcaaggggacacagaagggaggctgcatcctagtccagtgtcaaagtgaggggggcgctgcaggagcctggacaggaccacctagcccagccagggacaggagggtgagaccacctggaacaaaggcacagaggctggagagaaggcggcatgttcccagactgcatgggctcggggtagggggatgcgaggtcagaactggcatagtggccaggatctcgggctctactccatgggcaggggggaagcccctggggctgcatggggccatgggggaggcgggcgcaggagacaccggctgctgtgccaaaggccccagtccagctgctcctctgccagcagaaggcagaggacaaggggctggcccaggtggcctcgtgggacggggggaaaggagggaccagcaaacccttcttgggatggctgaggacacaggggactccagcagaaagggaggcccctgggtgtgcaagacgggacgctgaccagcctgggccctcaccggccactacccccaccaccacccccacccccacccccaccctggcccccggtgtctggcgctcctgacatcatgaggaacaggacgacgggaatgatgtacatccactgcagccggacggaaggatggacagacagacacagaaagagagagagaggggaaggaggtgagtgtgggcatcacccacccacggtggggaccggcatgaggggaggtcgcgtaaggggagggcgcccaggtcccctacgtcactacaggtcagggagggccagtggggcgcagggaggggcaggggtctcggtcctcactcaggcctcctgtggcggtggcgcgggccctggcgcagcaggacgcagggctgtgagcaacacggccccccccaggatgatgtgccactggggagggagggagcgcaggtcagggccagtgggctgccgtggggcctgagggccagcagggagtgggagggcgctcgagtgggcagcagggcagggcccagcaggcaagggctcagcctctgggcctcagttccctgcagcacaactgttggactatccaggcggagcgggtgaggccctcaggcagggcactcagcacagcagggctcagccatcccagcctcagcatcctcctagcctgcctcgggccacacagacctcttcgctggccttggcctgcctgggctcctgtgccacaacctaacaccagtctccacactcaatggaccagaggcctgggtggaagccacctcctccggctgtccccagcctccccaccccacgcctcagcctctaagcccccgggactcagacctgctgctggcagcacaggcccctccctcctcagctccaggaggcctcccaggcaccctgctgcccccaatgcccctccctgggccacatccctcccggacccactcctctctccttcctgtacaaccccctgaagaacctgctcgcccctcctttccaagcctccctggttcctttgaaacctccactgttcccttcctctccagcctcatggctccaacctagctcaggccgagacctcccccaggaccctgcgccctagagctggcccgacctcccctgaccacacttccataccctcttcctgcaaacaagcctcagcccaggtaccaggacacacaggaggcccggaggacaaggagcaggcccgagcaccataggggagtctgggtgggagcatggagggcctggccaggcaccgggactgtcaggaagggaataggggaggcgggggagccccactcacgtatttggcgaagaaggacttctgctcctgggggttcttggccttctgggcctgttccatctccaggcgctcaatgaaggccgccgtctcagggctggggcaaggggagaggaggagaagggtgaggcccggagtccagggacctggagaccctgaggccgccaggaagggccggggcaggtggcaagagcgccgcgaaggcagcagaggctcaccctggggctgtggtgggcggctgcagctgcaccgaggtgttgaacagctccaggtccacgtcctccacctcatggccccggcagcccccggggtgcgtcaccaccgacacgcccaccacgttgccggccacatccacgtgcagggtcagctggtccgacaggtgcgactccaccagggagca

SEQ ID NO: 3220 - DNA, 1435 bp, Homo sapiens
aggagacacagaagatggagggagggatggcagcctaccctgtggcaacgcgggagtcgcgttgccgcagggggcgcattggggtccagccgtccccagaacgcagatcagaggtagtcggacctttcccgctggcgcgcagcctcagctagggtttcctagactatccaggaattcctgccgacgtaggcaggtaccagaggcaactgaacgcgtgagacatagagcagatgagctgagaggcagcaagagaactacgcaagaatccgatcacaccctccgcttctacgacgaccaccaacaccacccagaagccaacttccgagatgccccaagccaagatcaggcaacactcagctgaatgtcatcccgtacctcttcgtcacagcggaccgcggtcacgcttaaatgtgcattgaagtggaaggtgaatgtctctttgcatggcagtgtctctgcacacgggagaggaggggcacacgtatccacctggctcaatatctagctgtattcaggtggaatagagaaccatgaaccctctggaccttttctgctttggtcctgtgcttttaacgtctcaggcctaagaggcccaccgaatccttctgccttgcttcagtacatttaaaaagaaaaaaaaagcaggacattccacctgccacctccagagggtcctctaggatccttctccactcctgaattgagcgaagcggtgccgacctccaccctttgggcacgagcccctgtgcacttgggagactcctgaacaccctcggagaagccagaaagccccgggagatggctccgtctgctgctgtaccagaccgggtcctgcaaaggatgcatcctccgagcctcctccctgaacgtccagtggggcctgccccgattctacctgagggacccactggaggagaggcacggggatgctgcctgagcagcggacccttctggcgcggagcaggctgtccccaggcagagtccgacgggtccttccttctgggtgcccccggcttcccggactccagcaggcctgggaaggccccgggcccccttagccgatgcccagagagtctccatttctcaagctttgccaccgaactcatcggtcggtgcgcctctgatcgcagggcaagggcctgcgcacccccaaagacaagcggggtccccggaaggcccccaggcagaaatgagcaccacggggaacggcccgcctccaagacaacctcggggacatggacacaacaagacagggtggcaagtctcaacaaggcgggtgcgcggcgtctgagggtggccgggccgggccgggccgggcctggccttgcgtccacctcgtcaagaaccgtctgggtacgggccccgcgggatgccccgcggcccaccttcctccctaggacgcaaggaggaacgccccggcgccggccagcagcgg

SEQ ID NO: 3221 - DNA, 14157 bp, Homo sapiens
agtgagaaacagccggcgctgggaaaggaacggtgcagcgaccgaccaactgcgcgctcggtgccaccaaagtgctactggctctacccactctgtcccccacgggcttagggaagtctgatgtctttttcttttcttttttcctctgtcgcctaggctggtgcagtggtgtcatcttggctcagtgcagcctcgacttcctgggatccagcgatcctcccgcttcagcctctagagtagccgagaccacaggtgagtgctaccacccccgtctaatttatatatatttatatatataaatatatatattaaaatatatattttatatttatatataatataaataaatatataaatataaatatatatttttatatattatataaaatatataaatatatatttatttatatattatatataatatatatattatataatatatatattatataatatatatataatatataatatatatattatatataaaatatattatatataatatatataatatattatatattatatattatatataatatatataatatattatatataatatataatatataatatattatatataatatataaaatatataaaatatagtatataatatataaaatatattatatataatatataatatataagatatataatatattatatataatatattatatataatatattttatatagtatataaaatataaaatatatattatatataaaatatatattatatataaaatatatattatatataaaatatatattatatatgaaatatatatatataaatatatatatattagtgacggcggtctcgctatgttgcccaggctggtctcgaactcctgagctcaagcgattcgcccgcctgggcctcccaaagtgctgggatcacaggcgtgggccaccgaggcccgcaggaagtctgtattgttcttgcattccacccagtgcattacgcagggggagagtagtgggcttatgcgccgagaaccaagcagatcctgttggtcccaggaacaaagtataaaccattctggtcgccaacagcttcctacgcaggaaacagccatccaccctctgtgactgggcttttccaggtcacccctcgctgccaggctctcttcccggtccagagcccacaggatcctacaggaggggccaacaactgcttgcctttgaaacttgaaactctcggtctaaggttccttaggagcgtaaaaggcacagcgttttctgatcgcagcttcaggtctcccgcccctgtcccggtacctctcctgcaggacggaactctgtgggaacgctcgttgattctgatggttaactgtcagatatccttgatattggacataggatttggaagagggcaggagagaaaaatgaactgcaagactccagcacaagaggtgggattgctggcagatgtctgctccctctccaaacctaatgaacatctcaaagtgccatccactttcctatacccttgatctgtgaaatggatcactgacgctttctctgtctttccggaaatgcaaaacaggaacagaaacaacacactcagacttgagaaactggtctggtttaaaagggttcctggccttacaggtgggtaagaaatgtcacttcctggcaggctgaggaacatcaggatatttggaggaccttgacaagggaagaattcaccgaaatctataggtattccaggcaaagtgtgatagcaagatcctggtatggtttcctagccttgagaggcttttaaaagtctaatttgagattccttattaaaagatccagaaaagccaacttaaagagaccctgtgtggtaaaacactattcctgctgcacttgtgtaaatattaggccaactttaaagacactaaatttattttgcaaacagattactcttactaatactttgatgatgtttgataaaaagggagtaagtatagagaaaaaactttcagagaaaaaaatatagtgcacctgttattagactctagctcattgtttttgaggttttttcgtctacctgaaatctagactggatcttgaattttttgtttcctgtaatatctggcaatgggctgggtgtcagagctcgcaactgcaatcccagcactttgggaggtcgaggtgggaggattgctgaagcccaagacttcgagaccagcctgggcaaaaggcgaaacaccgtctctacaaaaagttcaaaaatttgctgggcatggaggcatgcgcctgtggttgcagctgcttggaaggtggaggtggaaggattgcttgagccaaggaggttgaggctgcagtaagccttgtttgtgccactgcactccagcctcaattacaaagcaaggaccccatctcaaaaaaaaaaaaaaaaagggctggacgcattggctcatgcctgtaatcccagcactttggcaggttgaggcaggtggatcacttgaggctaggagttcgaggccagcctggccaacatggtgaaaacccatctctacaaaaaatacaaaaattagctgggtgtggtggtgtgcacctgtaattctagctactcgggaggcaggggcaggagaattgcttgaacacagaggtgaatgttgcagtgagtggagatggtgacactgtactccagcctgggcgacagagcaagacttcacctaaaaaaaaaaaaagtctagctatggctcttaaaactaatatttctgatttttcttctacccttctggctttgaactgctgaaattaaactgcacttttcctgaagtcttgtcagctgaagctggatgggttaatatagactgcagagaaatcaccaccactcatacatggactactcagaaatttcaccagaacacctcatgcaaactgcaaaccaggaaattccgtcagattgccactgcctgcccccattcaaactgaagatacttcaagcttaacatctaaaactttctgactggctgccctctggactaaaaaaactgagtttatagtcagttccaatcattaacctttgcttttctcgtttcaatgaaaatatctttttttttttttttttttgagacagagttttgctgttgttgcccaggctggagtgcaatggtacaatctcggctcattgcaacttccaccttctgggttcaagtgattctcctgcctcagcctcctgagtagctgcgattataggaatgtgccaccacacctggctaattttgtatttttagtagagacagggtttctccatgttggtcaggctggtctcaaactccctaggtgatccgcccgcctcggcctcccaaagtgctgggattataggcatgagccaccacacctggctggaaatatctcttattaaatgaatgattgcttaggcctaactttggtggatgccattctgcaatcccaccacctgactcgagacagtcctgttaactgtttaactggactgacctattctcaggactgagagactggtataatgactagataatatagtgacccagttcctgaaccgagaaactttataaggaggtttcatggtaccttggcaattgagaaaaccaaagaagcaagaaggtcagtattaccacaatcactatgcctttctgtgtggcagctggccataaaggaatgctctgacctacctcccctgaaagtagggcataaagcccttattccagaggagtacttctttacccagaggccaaaagaatctgaacagacagccatttctgggctccccagtgcccatttattagcactagataatatacttattgtccaatcatacttctacatgacttgtccatagaatccaagcctaaaaatacatacttttcattgggtctttggtcctcatttctgagggctcccttgtcatggaaaactttgttaaataattttttaatggttttctcttgttaatctgttttgttgtaagattgcaagccataaccctggcaatgggtgacaaaaaactattaacttcttgtctcctacaatagacactgttagtaactggactctaccctcccatggaatttccctcacttcttttcttgcctgattcaatcataacaaccctgctgactttcaattgtgcctacaattttcaccttaatcctatcaggtcctgaagaaatttttccagatgaattagtgatcatctcccaactatttggactttggtgtctgccattctgtatataacagaacatactataaaagcacagtctgtactggacagaatcatttactccctttcctagaccagccacgtagcttggcctgatctggaggctaaaatatggagccccattcatcatctttggaagagctgtcttgaaggcagcatgtccagagccccacatgccaccagacttaagcctaaagtaagctgggattgggcaatggacaacttcactgcactgagccaccactgccaatgtccccagttctgtgcacatatgaagtacagtgcattcaggctgccatgctgggcttacataggctagagtcatttctgaagtttaaaggggacaaaaatgttgttgagacccacactctggggccaatggctgaaaccacagaagagctacactcacttgaaaaataagtgtatgctgagatcgttcgaagatggctgaataggaacagctccagtctaaagctcccagcgtgagcaacacagaagacaggtgatttctgcatttccaactgagctttgaagagagcagttgttctcccagcatggagtttgagatctgagaacggacagactgcctccttaagtgggtccctggcccccgagtagcctaactgggagacacctcccagtaggggccaactgacacctcatacagccgggtgcccctctgagacgaagcttccagaggaaggatcaggaagcaacatttgctattctgcaatatttgctgttctgcagcctccactggtgatacccaggcaaataaggtctggagtggacctccagcaaactccaacagacctgcagctgagggttctgactgttaggaggaaaactaacaaacagaaaggaatagtatcaacaccaacaaaaaggacatccacaccaaaccccatctgtaggttaccatcatcaaagaccaaaggtagataaaaccacaaagatggggagaaaccagagcagaaaagctgaaaattctaaaatcagagcatttcttctcctccaaagaatcacagctcctcgccatcaacggaacaaagctggacagagaataactttgacgaggtgacagaagtaggcttcagaagatcggtaataacaaacttctccgagctaaaggaggatgttcaaactcatcgcaaagaagctaaaaaccttgaaaaaagattagacgaatggctaactggaataaacagcatagagaagaccttaaatgacctgatggagctgaaaaccatggcacaagtactacgtgatgcatgcacaagcttcagtagccgatttgatcaagtggaagaaagcgtatcagtgattgaagatcaaaagaatgaaatgaagtgagaagttagaggaaaaaagagtaaaaagaaatgaacaaagcctccaagaaatatgggactatgtgaaagggccaaatctacatttgattggtgtacctgaaagtgacagggagaatggaaccaagttggaaaacactcttcaggatattatccaggagaacttccccaacctagcaaggcaggtcaacattcaaatttaggaaatgcagagaatgccacaaagatactcctcaagaagagcaaccccaagacacataatcgtcagattcaccaaggttgaaatgaaggaaaaaaaggttaagggcagccagagagaggtcaggttacccacaaaaggaagcccatcagactaacggtggctctctcagcagaaactctacaagccagaagagagtgggggccaatattcaacattcttaaagaattttcaacccagaatttcatatccagccaaactaagcttcataagtgaaggaaacataaaatcctttacagacaagcaagtgctgagagattttgtcaccaccaggcctgccttacaagagctcctgaaggaagcactaaaggaacaaccggtaccagccactgcaaaacatgccaaattgtaaagaccattggtgctaggaagaaactgcatcaactaacaagcaaaataaccagctaacatcataatgacaagatcaagttcacacgtaacaatactaaccttaaatgtaaatgggctaaatgccccaattaaaagacacagactggcaaattggataaagagtcaagacccatcagtgtgctgtattcaggagacccatctcacctgcagagacacacataggctcaaaataaagagatggaggaagatctaccaagcaaatggaaaacaaaaaaagcaggggttgcaaacccactctctgataaaacagattttaaaccaacaaagatcaaaagagacaaaagagacaaagaaggccattacataatggtaaagggatcaattcaacaagaagagctaactatcttaaatatatatgcacccaatacaggagcacccagattcataaagcaagcccttagagacctacaaagagacttagactcccacacaataataatgggagactttaacactccactctcaacattagacagatcaacaagacagaaagttaacaaggatatccaggacttgaactcagctctgcaccaagtggacctaatagacatctacagaactctccaccccaaatcaacagaatatatacattcttctcagcaccacactgcacttattccaaaattgaccacatagttggaagtaaagcactcctcagcaaacgtaaaagtacagaaattataacaaactgtctctcagaccatagtgcaatcaaattagaactcaggattaagaaactcactcaaaaccgcaaaactacatggaaattgaataacctgctcctgaatgactactgggtacataactaaatgaaggcagaaataaagatgttctttgaaaccaatgagaacaaagacacaacataccagaatctctgggacacatttaaagcagtgtgtagagggaaatttatagcactaaatgcccacaagagaaagcaggaaagaactaaaactgacacgctaacatcacaattaaaagaactagagaagcaagagcaaacatattcaaaagctagcagaaggcaagaaataactaagatcagagcagaactaaaggagacagagacacaaaaaacccttcaaaacatcaatggtatccaggagctggtttttggaaaagatcaacaaaattgatagaccactagcaagactaataaagaagaaaagagagaagaatcaaatagacgcaataaaaaatgataaaggggatatcaccaccgatcccacggaaatacaaactaccatcagagaatactataaacacctctatgtaaataaactagaaaacctaaaagaaatggataaattcctggacacatccaccctcccaagactaaaccaggaagaagttgaatccctgaatagaccaataacaggctctgaaattgaggcaataattaatagcctaccaaccaaaaaaagtccaggaccagatggattcacagccaaattctgtcagcggtaggaagaggagctggtaccattccttctgaaattattccaatcagtagaaaaagatggaatcctccctaactcattttatgaggccagcatcatcctgacaccaaagcctggcagagacacaacaaaaaaagagaattttaggccaatatcactgatgaacatcgatgcaaaaatcctcaataaaatactggcaaactgaatccagcagcacatcaaaaagcttatccaccatgatcaagttggcttcatccctagggtgcaaggctcattcaacatacacaaatcaataaacctaatccatcatataaacagaaccaaagacaaaaaccacatgattatctcaatagatgcagaaaagaccttcaacaaaattcaacaacgcctcatgctaaaaactctcaataaactaggtattgatgggacttatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtatccatttaggaaaagaggaagtcaaatcctccctgtttgcagataacatgattgtatatctagaaaatcccatcgtctcagcccaaaatctccttaagctgataagcaacttcagcaaagtctcaggatacaaaatcaatgtgcaaaaatcacaagcattcctatacaacaataacaaacagagagccaaatactgagtgaactcccattcacaattgcttcaaagagaataaaatacctaggaatccaacttacaagggatgtgaaggacctcttcaaggagaactacaaaccactgctcaatgaaataaaagaggacacaaacaaatggaagaacattccatgctcatcgataggaagaatcagtattgtgaaaatgggcatactgcccaaggtaatttatagattttttttttttattttttgagacggagtctcgctctgttgcccaggctagagtgcagtggcttgatcttggctcactgcaagctccgcctcccgggttcatgccattctcctgcctcagcctcccaagtggctaggactacaggcacccaccacaatgcccggctaattttttgtatttttttagtagagacagggtttcaccatgttaaccaggatggtctggatctcctgacctcgtgatccgcccacctcagcctcccaaagtgctgggattacaggcatgagccaccgcgcccggccggtaatttatagatttaatgccatccccatcaagctaccaatgactgtcttcacagaattggaaaaagctactttaaagttcacatggaaccaaaaaagagcccacattgccaagactgtgggggaaataaagagagatcaggctgttactgtgtctatgcagaaagaagaagacataagaaactccattttgttctgtagtaagaaaaattcttctgccttgagatgctattaatctgtaacgctagccccaaccctgtggtcacagaaatatttgctgtgttgactcaaggtttaatggatatagggctgtgcaggatgtgctttgttaaaaatgtgtttgcacgcagtatgcttggtaaaagtcatcacccttctctggtctcaagtacccagggacacaatgcactgtcgaaggccacagggacctctgcccaagaacgcctgggtattgtccaaggtttctccccactgagacagcctgagacatggcctcgtgggaagggaaagaccttaccgtcccccagcccgatacccataaagggtctgtgctgaggaggattagtgaaagaggaaggcctctttgcagttgagataagaggaaggcatctgtctcctgctcgtccccgggaatggaatgtcttggtgtaaaacccgaacgtacattctatttactgagatgggagaaaactgccttatggctggaggtgagacatgctggcgacaatactgctctttactgcactgagatgtttgtgtaaagtcaaacataaatctggcctacaagcacatcgaggcacagcacctttccttaaacttatttatgacacagagtcctttgttcacatgttttcctgctgaccctctccccaccctgccacatccccctcaccaagatagtagagatagtgatcaataaatactgagggaactcagagaccagagccggtgcgggtcctccatatgctgagcgctggtcctctgggcccactgttctttctctatactttgtctctgtgtcttatttcttttctcagtctctcatcacacctgatgagaaatacccacaggtgtggaggggctggcccccttcaaagacaatcctaagcaaaaagaacaaaactggaggcatcatgctacctgacttcaaaggatactacaaggctacagtaaccaaaacagcatggtactggtaccaaaacagagagataaaccaatggaagagaacagagccctcagaaataataccatacatctacaaccatctgatctttgacaaacctgacaaaaacaagaaatggggaaaggattccctatttaataaatagtgctgggaaaactggctagccatatgtagaaagctaaaactggatcctttccttacaccttatacaaaaattaattcaagatggattaaagacttaaatattagacctaaaaaccataaaaaccctagaagaaaacctaggcaataccattcaggacacaagcatgggcaatgacttcatgactaaaacaccaaaagcaatggcaacaaaagccaaaattgacaaatgggatctaattaaactaaagagcttctgcacagcaaaagaaaccaccatcagagtgaagaggcaacctacagaatgggagaaaatttttgcaatctacccatctgacaaagggctaatatccagaatctacaaagaacttaaacaagtttacaagaaaaaatcaaacaaccccatcacaaagtgggcaaaggatatgaacagacacttctcaaaagaagacatttatgcagccaacagacacatgaagaaatgctcatcatcactggtcatcagagaaatgcaaatcaaaaccacaatgagataccatctcacaccagttagaatgacgatcattaaaaagtcatgaaacaacagatgctggagaggatgtggagaaacaggaacactcttacactgttgatgggagtgtgaattggttcaaccattgcggaagacagtgtggtgattcctcaaggatctggaactagaaataccatttgatccagccatcccattacggggtatatacccaaaggattataaatcatgttactataaagacacatgcacatgtatgtttactgcagcactatttacaatagcaaagacttgtaaccaacccaaatgtccatcaatgatagactggattaaggaaatgtggcacatatacaccatggaatactatgcagccataaaaaaggatgagttcatgtcctttgcagggacatggatgaaactggaaaccatcattctgagcaaactaccacaaggacagaaaaccaaacactacacgctctcactcataggtgggaattgaacaatgagaacacttggacacagggtagggaatatcacacacccaggcctgtcatggggtggggggagggaggagggataacattgggaggaatatctaatgtaaatgatgagttaatgggtgcagcacaccaacttggcacatgtatatgtatgtaacaaacctgcacattgtgcacatgtacactcgaacttaaaagtataataaaaaaattttaaaaagaaagtagcattttagaaaacaacttctcaataaatagcctataaacaaaaaaaaaagtaaaaagaaaaataagtgcatcctatagacaacacaacacaatgggccatgacccagccaggacatgccaacctgtgaagctggacagatagatgcctagagcagagcccaggctgcccacaagaaattgctgaaaactaaggcttaggacagactggaacccagaaaagaaaggaaccccggtcttggtcatggttcatggcaccactcctttataacaatgccctagaagaagcccatgcacctcagtgggagcactcatgctgttcttggggaaccttcataggactgtgccctgccttgagctggaagtctctgcagtagacatccttccatattttgttcttcatcttctgaacgccttcaaggtttttcaattggaaaaattctatctgcataatcaacaatgtgctaaggaactctacttttagatcttcttagaattcatagttctttgtacatgaggattaaagcattcttctgtattctccacttgtgaaatagatttgaggttggtggagtcaggattggaaacacatacaggtgggcaggggcatgaaagggactgggacccagatcagagctggaggctgaactccagggagcctttgaatagctatggatatcaccagggtgggaagggacagtgctccactgtcctgggattctcttgaaactgagcttggcctccctgctgagagcagagaacaaccatcaataaatattccttcaatggtctgaagtttacgtttacagggtggaggtggaaattaaatttagggagccatgaggaagacccccagccctgtgccttttgaattgacaaccatggcatttcagggcatcagctccaggtcaggcattctcaggcagttgcataattctgccaatgtggggcccgcccacctcaaaaatccacatggattggatccagcaaaaccaaatattcagcaaaacttcaagatctagcaacactgaaggctcaagtacatcaccggtgcatacttggcccaaggaggctattctctcacaatctctacccagctccgggcctgcagcatctgagactcactccttcaagctgcaggtatcccaggaaaaagatttatgcatcctcatagcttcaacatgcagtgtgtcaggcacagaaaaatggttgtcttcagaaagtgataaaaaaaacatgcagtagcaatcaccctttggactttgaaacttttctgtcaccttagatgtcagaaactaaaacccagaaacttggtgttggcattaatttggtctagctatgaagactttttttttttttttttcacacagtgacagttctgaatttgaatataaaggagcttaggtgctataatctgaatggaacgtgggaataaaactgtctttgccttgtacttcttgttagattaattaaataccaattatcagtataagaaaatggcaataaattgtcaaagtggaattggaaagtgtttttaggatttggatatgaagcaggcttcccatgtgaccattctcacttcttattctgaagtctaacactctgcttttctttctctccctctcttcattgattcttctagtggctggtgtttgggtattgtgggaactgagctttcatctcctatgttagccatagagatgagggctttgagggcaccatggaatccgattgctggaaataaatcaatcttaaaggaaaggaaaatttaaaaatcaggtgcaacaaaagcaaaatgagaaaactgctaaactctacaattctataaagaagaattgcataaaaaggaaataacaggaaaagaaagaaaagcccctataaatgtggctcctaaatatccagccctcgaggttgttcctttgcaggagtctgttccttttggccggctgctgaacctagggaggcagcgtgggatggagttggcaaacatcctgcaagtccacgacccatgaagagccgctatggtaccactagcagtgctaggacccagaaactagcgaaactgtttaggagaagctgcgggctggacccaccagcggtgctgccacggaggtcaatcctgctttgacaagtgagcggtgctgcaactgagaaagttacagtctgaggaaccaggggtactgggacacaggaaaaggagtcagccagcttgctttaggcacacagtaagggaagggtccccagagaacctccggaataaaagaacttgcacaggcgcctggcctaaatgtgcccttgctgactaagggcccgcatatgcactggggcaatgggggtggagccaccaggaatttgcgccttatacaaacagggaacctagccccatcagcttttaaataaaagcccttgtatttaaatattaagggggcaaccagaaacctgttctcaggacccctctttttgctgtgagctttccttttcgcttagtaaattctactgcactcactcttcgatatctgcgtgcccatttcttcatgatggtgaaacaaa

SEQ ID NO: 3222 - DNA, 5808 bp, Homo sapiens
agatgctcccaggctctcccgcagtttaaagacttaactcagcggctttcagggcctgtggttgagggactccgaaagaactgttgctggtggaccggttcagggtcttgacttcgccacacaaaagaacttgagagcacgtccaaagtaaagctaagacctctagtacagtgttcaatggaactggtgagaaaagacgtccttgctgtgttcctgatatgaagaggaaagcagtccttctccattaaatgctgacaacatgagcctcccgtggtcggaacgggcttgtgaaggcggtgctggggtgcaccagggcagcagctacagaccctctggtgctgggcaccaatgagaagctcatctggccccgggatcctggcaggacactgggagcactatttccatgggcagcagggttgttcctggagacatcactgacccaggacacctagcacaatggcactcgatgtgaaagtggcttcgtacaaatctgccactcaagcctaaataagtgcattccagaagagccgcagcccctctaacagctcctgaggtgagggaaaccctagggatgggaagttggagcagaaagagatggtggcctgaagtcaactgcagtgaaaatctctccccatcagcaagttttgcaaagctatggccacagggacacatgactggggcccctcctagtcttggaaggagcccccatggaaatgagggcctcacagtgaatccacctctgatcctacttcacctgcagtcaaatgagaagagatttcaatcagctaaagacaccctatcccctctccccgacccctgcgaccccaggagctcctgccttgtcactgtgtccccaaacgaaccgcatctgaatcaagcccctttctctccctagtggtcaacatctgggctgtgatgggcagctcccactcttgccttagaatatgactggagaggtgacttctcatcacatggagaatatgttcaccccatggtgctttccacccaagctgaccatggcttgactttttggtgtagttgctagctctgtgccatccttggcaatgtgaccctggagcagctgtccccagtgtgcatttgggggatttcatgtaattatgaataggatgcaaattttatagccccagtgaagggaaacacccctggcgaggcttcccggggccagagagaggactccactgagggagatggtggcagggccattctttgtgtcctgcttttttttttttttttttttttaacatcctctttatgtcctgagagccatgtgcagatgaggaaaaatgacatgcaatgcatttttgcctgccacaatgactttgcaatcataacaagcaaaatgttctaaacagtaagtgaatcgaggaagatatactgccaagtcaggaagaaaaaatccacctgttcagtgatttcaggaactgctgaagaaaatcaccagtgagtatcagtttctgcaagagaatctaatgcaggctttgcttctcatcggaatcccccagctggtgtcttggttgactgagagtctgggggagagggcagagaatggatttattctctgctaggtttttaacagtcaagaagggctgtggtcctaaggggcactggtcaaaccttagtgtgcatcagaattatctggataaggctaggcacagtggctcacgcctgtaatcacagcactttgggaggctgaggcgcgtggatcacctgaggtcagaagttcaagaccagcctggctcttttagtagagaaaccctatgtctattaaaaagtacaaaatttagccaggtgtggtggtgagtgcctgtaatcccagctacttgggaggctgaggcaggacagtcacttgaatctaggaggcagaggttgcagtgaactgagatcgtgccattgtgctccagcctgggcaacaagagtgaaactctatctcaaaaaaaaaaaaaaaaaatacctggagagcctgtgaacatgcatagtgctggaccccatgccaaagatactgattcagcctgtctggggtgggccagagattctgcattctgtctaaggagctcccaggtgaggcacatttgcagaccacagtctggaggtttgaggacttggaagaccatggctgacatatcttgagtctctgccttggtatcctttgccaagcagagaaatgcactgtttatgtttttcaggagctcaggaagcagaatgcaacccatgcagatgtaggggctggattctctctatgactgagtgggagtctcagccccaagaaatgccccgggttggccctgaaatccacaatggcttgctgggctggaggccaccagctgatgggacccaagagaggaatgaattatttatctggactcctcacagagaacaatgccctgcaaatgtcccccgcaccatgctgggtggaattcatagtcaacctaacaaccagcttagcatcttctctcccggaccttgcccctccaaccgtatcgaactttgaggagcaattagggaattgcttgacatcttccctgcgagctcttgggtcacaaaagctaattaaccttcctcttgccttccaaactaagtaacaacctccagagccaagtcttctggaacaaaacaggaaggaagaaagaaactaagaaagaagcactgtctctgattttttttttttaatgaaggttaacatataatttttaaaatgaactccatggaaaggaggttgtggggttcacaacccctgggagcagttccagcagtgccaggacggtctcagtggcagccctctgctcatctttgaggtctactttgcccagcagctaactcttgtaggtggaaacatggtggcttcttgttctctgggaagttctggatgggaacttgatgtgggaagttgtgaggtgccctgaacttggaggtggggctcattggcaccacagtgatggtcccatctgtgccatgtagacttgaccaagcaactcaaggtgtccttaatgtcccagactgagagagaatttgccggcctccaccttggaatattgttgactttcagtgcacgacgcaagtcctctccttcaacactcctctctaagaagatacacagtcaaacacttaaggacttgggcttgcggagggtgtagatctgggctcagattcccattctgacacttactggctacgtgacctacactgtgattcccaaatgcctgcatatccacataccactgtgtcccactgcactagctacccggagctgccataacacattgccactaactaggtggcttaaaaccagaggaattcattctcttatagttctgggggtcagaaaacttttttttatttgtttgagatggagattcgctcttgttgtccaggctggagtgcaacggcatgatctcggctcaccgcaacctctgcctcctgggttcaagcaattctcttgcctcagcctcccgagtagctgggattacaggcatgtgccaccacgcccagctaattttgtatttttagcagagacaggtttctccattttggtcaggctggtctcaaactcccgacctcaggtgatctgcccccccttggcctccctaagtgctgggattacaggcgtaagccaccacacctggccctgggggtcatatatcttaaatcaaggtatcaacaggaccaagctccccaaaagctccaggaaaggatacttcttggcctctcttctggcttctggtggctgcagcaatccttggggttccttggcttatggatgcatcactccgtactctgcttccgtcctcacttgaccttctcacctaccttcctttacgtcatcttccttctgagatgctctgtgtccaaattttattctttgtaaaaggatgccagtcattggatcagagaccaccttaatccaggatgacttcatcttaactaaattacatctgcaaagattctatttctaaataaacccacattctgaggttctgggtgggcatgctatttggcaggacaaagtcaacacaggacactcattttcaggattgatcgcatggtttgaggaagctgatggtgacatctcttcttaaatctgttttcaggaaaatcatactggtagccttcaagtggccatggtgggagcattgacccagggaaatccacatttcccaacacatgctggatacctgaggactccagagctactatctgctcatatctgctcaacattaaaaaaaaaaaaaaaacctcacattgttaagtgaaaaggtttattggcagatttgcttaactcaatttgcaaagataccttagaccaggggtcggcaaactacattccacagaacgaagctgcccattacttgtcttttgtttgtttgtttgttttgttttgttttgttttgagatgaagtctcgctcttgttgcccgggctggagtgcaatggtgtgatctcagctcactgcaacctcaacctccctggttcaagcaattcccctgcctgagcctcccaagtagctgggattacaggcacatgccaccatgcccaactgatgtttttgtatttttagtagagatggggtttcaccatgttggccagactggtctcgaactcctgacctcaggtgatccactgcctcagcctcccaaagtgctgggattacaggcgtgatcctaagtacagttttataggacaaccatgctcattcatttccgtatcgtccacggctgctctacagcagcagagtttagtggtcaggacagaaccggcacaacctgcacaacctgcacaactttcaaaggctgaatatttactctccggctctttagagaaagtttgcaactcctactttagactgatgcttctccaatgctaacgcgccagtcaccaaatcaccggcatctggtcccagcctccaaccataaaccacagctgaatggaaacttggtagcgcttgccttcaatagcagatgctgtaagaggaaagcaaggtgaccaagaaaacattgcaaaactctgggcagaatctggggcctgaagactctgagtcagaggcctctttttttgctctaaacacatattagcaagagtccaagaggcatcaaagatgagttagcagcaaaatgaggctttgtccttcatgtagaaaggattaaatgatagttgaaaatgcaataactttcaccctgtgggattcagtgatgttcagtgctgtgattatgtccaacttcaaatcttgctgtcccaactgggacagcccaaacatagggagccactgcactaagatgttatgatttattaagataataaagctagcgggatgacaaatgtttcatttttcccccatgtgtttcccccaaaggaccgtctgcttttgcatgtgatttgactatgcgctgaggacctagcgtggtatatcagcaaagtggaaaagtgactgaagtgactgtttatcatcttgtaccaagttacaccactttaagctttaactccacagctcttgcattattttaaaaccgtctggcagatctctaaaactaatggtacaaaccactctgtgatacattaaaatacatcccactctgtcatactgcaaacaagtagctgctccccagtctttgaaaaagtactttcaagataaaatatgtactcatgggttctgcaggtttttaaaaagtcttgaatcttcacagatttactgggggggaaggggcgtttcatgtaaaatgtgtttttccttgacatttagaggtcttgcaaagtggtttattatagatcttgtggacatctcgctatttaattaaat

SEQ ID NO: 3223 - DNA, 15781 bp, Homo sapiens
gttgccttacacactatgcaagctttgctgtttgcagtaaaactggctgctgcttgctctttgggtccacactgactttatgagctgtagcactcaccatgaaggtttgtagctttactcttgaagccagtgagattaaaaacccaccgggaggaacaaacaactccagtacgcgccgccttaggagctgtaacactcacggcgaaggtctgcagcttcactcctgagccagccgcaccacgaacctatcagaaggaagaaactccgaacacatccgaacgtcaggaacaaactccggccacgccgcctttaagaactgtagaactcgctacagcactcaccgtgaaggtctgcgatttcattcttgaagtcagtgagaccaagaacccaccaagtccggacacaatgggacctgtatgcagtctatggggcagttcagaccaaagggctgggcgtggcaccacagctgccccgagcccttggcctctctgagcttttctctctcacctgagaaatgggatttcaaggaaaatgagtagcggtaacttacccaccttactccacggttactgtgaagcgcccagaagagaagccatggatgtgggcgacgcattcgagagcacagcgctgggctccagccctgatgcagaggtacaaagctcgtctgggcagattgttatgcaaatcaaaagaggaagcagagctaggggagccgaggagctcctgctgggctctgccagggaagaagccgcagtaggagcccctacgtaggccctgcaagaggcctggcgttcaggaaagggcccgctgaccatccagtgcagggaaaggagtccagctctggcctctgcccctcagctccacctcctgcattcctaggagttctccagaggatctgatgggagctcagaaccggtcccaacagctccctccacccttcatgaacgggggctggaaaatgtggtctgctctgataaggatttgcgtcaggctactggctactcagcagccgagaagagcaagcctccaggcctctgcacgcgtgccttctgcccggtgagcctctcactatcgtccttctaaaagacacttcaaaaagaggcaaaatcatgccttccatacatatattaaaaaaagaatatgtgtcaaatattttattctactcctaaaccaatttaaggaaaccaggcagatgttacaactggttcaaatgaaatcctaagaacagacacatttaataatcaggaatatggaaaagaacatgcaaatgggagctgggcacagcggctcatgcctgtaattccagcactttgggaggccgaggtgggtggatcacctgaggtcaggagttcgagaccagcctggccaacatggtaaaaccccgtctccaccaaaaaaaaaaaaaaaaaaaaaaaaattagctgggcatggtggcacatgcctgtaatcccagctactcagtaggctgaggcaggagaatcgcttgagcctgggaggtggaggttgcagtgagccaagattgcactattgcattccagcctaggcaacaaaagcaaaactccatctcaaaaaacaacaacaacaacaacaaaaacacgcaaatgggggcaaagctagggaggggagagtcaactggtctcctactggagtttggaatctgcaggtctgtagagaagcaaaattttgcattgctatcactaacctacaagttaaagagttgtaagtagtcttcatagaatggagtcagataatccaagggaggtcctggagagtctagataatgcacagtttttcaaagatgtacaactgttttcaaagatgtacaaatatgtacaactctgaccactgatgtccttcacctggccaacttaacccacacctcctccaggaagccatccctgatgcccaagactgggttaagtgccagcccctgggctccctcagtgccttgaatttctgatcacactgttccgtctccctcatcagatctatgagattttttttttttttaagacagagtctcactgtgtcacccaggctggagtgcagtggcacagtcatagctcactacagcctcaaactcctgggctcaagggatctttagcctccccagtagctgggactacaagtgtatgccaccatgcccagctaatttttaagttgtcaagacaaggtcttgctttgttacccaggctggtctcgaactcctgggctcaagcaatttgcctgcctcggcctcccaaagtgctgggattacaggtgtgagccactgtgcctggcctgatctatgagatccttaaaacagaagctgtgtcttacccacctctcactgtgcctttgagaatcaagggacacgtggttgaatgaatgaatgaatgaatgagagaaaaaatgaacaatacagggtcctaagccaaagtggtccacagggcccccataaacccgtaaaagactgacgagacagctgttgaaggtctgcatgtgtacctgtgaacacagacaggcttcaatctcaatcttaataagggctcctcagaaatgaagctcaggaagcaaacaaacatgggaaatgatggctaaacacaaacaggtgggttttgcttttatttccttttaaccataggactcctgagtccttgtaatatatagtaaagagtcttgctctgttgcccaggctggagtgcagtggcacaatcacagctcactgcagcctcgaactcctgggctcgagccatcctcctgcttcaggctcctgagtagctgcgactacaggtgtgcaccaccacacccagctaatttttaaaaaattcttttaagagacaagatctcactatgttgcccaagctggtctcaaactcctgggcacaagcaatcctcccacctcagcctcccgagtagctgggaccacagacacacgccaccatgcctggctaatttttgtattttttgttgagacagggtctctctatgttgcacaggctagtctcgaactcctgggttcaagcgatcctcctgcctcatcctcccaaagtgccgggattacaggcgtgagccactgtgcccaggctaacagcctttaatatattaaagtaccccaggagggagaatgcaatgtttccatgttttccttatctgactataaaacaatttttttaatggaccagagacgatggattcatggagttactgtgaggaagacactcagcatcgtgcctggtatcgtgtgtgcttcataaacgccagccatagcatgattctttataaaggcaccagctgcatttatggagtaaatgcctttcttgtgtcatctcgcttgactggcaaagccataaggccaggtgaggaagatgaggcaggggatgaagaggatataacacgtaggaggtgaagtcactaacccaaatccttgcagccggcaagtggtcagaattcttggaccaggtgtgaggccttaagagaacaagctagcccagggcttggcatgaagtaggtgcttaataaagattggttttagccaggcgcagtggctcatgcctgtaatctcagcactttgggaggctgaagcaggaggatcacttgagcccaggagttccagaccagcctgggcaacacggctaatccctgtctctactaaaaatacaaaaagattagtcgggtgtggtggcgcgtgcctgtaatcccagctactcgggaggctgaggcaggagaatagcttgaacctgggaggtagactttgcaatgagccaagatcgcaccactgcactccagccggggcaacagagcaagactgtctcaaaaaaaaaaaaaaaaaaaaaaaaaaaaagactggtttctaccatgcctccctcctccctccttcccattcagcccagaggttctggcagggcagacagagctccaggccaaggacccccaggtggatgtacagagcagacccaggctgagcccaatctttccaccctgcagttcagctcctccctcccctttctcttcccagtcttcctgaacctgcacctggcctctctgcacacccccgcgttatttggggatgtaagaactcagggttccctcccttattacttctccttgtccatcctggtgatagtgcttgactctcaacacacaaaaggggctttaaaatgatcctttgaaaaaataatttttttgctgggcacagtggctcacgcctgtaatcccagctctttgggaggccaagacaggcggatcacctgaggttgggagttcaagaccagcctgatcaacatggagaaaccccgtctctactaaaaatacaaaattagctgagcgtggtggtgcagctcttcgggaggctgaggcaggagaatcgcttgaacccaggaggcggaggttgcagtgagccgagatcatgccattgtactccagcctgggcaacaagagtgaaactctgtctcaaaaaaaaaaaaaaaaaagaaagaaaaaaaagaaaaaataattctttaaaactcttttttagagacagggtctcactccatcacccaggctggatgtcatcatagttcactgtaaccttgaacttctgggctcaagcaattctccagcctcagactcctgagtagctgggaccacaggcgcataccaccacgcctggctaaaactggttccttttttttttttttgagacagtgccttgtcctgtcccccgggctgcagtgcaatggcacaaacactgcccactgcagccttgacctcctgggctcaagcgatcttcccctacagcctcctgagtagctggcaccacaggcacgtgccaccatgcctggccaaattttttttttttttttgtagggatggagtctcactatgttgcccaagctggtctcaatctcctgggctcaagccatcctcctgccttggcctcccaaagtgctgggattaaaggcatgagccaccgtgcccagcctaaaaatggtcttgattcaatgagtgagtaaatgaagcctgtgcccagggcctgccaggccccctggggctgcccacagggtaaacacagacccacacggagccccactccaggcctggtcgaaaaaaatgctgctccagctgaaggctttctcagagaaatgactcagcctgagcactcagatgcaacttccacgttttatggactgaaggtgctttcataacagctggtgatgatgagccagaggcgggctataaacagagcggtgatctggtcctgaacactcaggtctcagcccccacccacaagcagggcctctgaggctgtggcttctccacactggtgctgctttgtgctggcaaatagcacaggcccccaaaatgacctggaggctccttaactgaggaggcagatgagtgacagggccagacctgcagcctcaagggcctggctgtgccctccctagctcccttgggcctgggagccttccatgaacctgtggcctgggaccaagagcatggggggcctagtgatgtgcctggtggggagcggggagtgctgccagcaatgacagtcccgctggggggacgtggtacagactcactgagacacagaaccctgtgagcaaggggggttcacttaatcctccctgaggactcagacaggtgggctgcaggcagtggggtagccttgcctctcactcatgcccacccacccatttgctcattcattcagacaagcgtggattgagtattttctttttttttcttttaaagacagggttttgctctgtcgctcaggctgaagtgcagtggcatgatctcagctcactacagcctcatcctcccaggctcaaccgatcctcctgcctcggcctctcaaagtattgggattacaggcgtggcccacgcctggtgaattgagcactttctttctttttcttttttttttttttttttttgagatggagtctcactctgtcatccaggctggagtgcagtggcatgacctcggctcactgcaacttctgcctcccgggttcaagtgattctcctgcctcagtctcccaagtagctgggattacaggcacccaccaccacgcccggctagttttgtatttttagtagagatggggttttaccatgttggccaggctgttcttgaactcctgacctcaggtgatccatccgcctcggcctcccaaagtgttaggattacaggcgtgggccactgcgcctggcaaattgagcactttctttttttttttttgagaccgggtcttgctctgtcaccaggctggagtgcagtggcccaatctcagctcactgcaacctccacctcccaggttcaagcgattatcctgcctcagcctccaagtagctgggattacaggcacgcgccatcacgcccggctaattttttgtattttagtagagacagggtttcaccgtgttagccaagatggtctcgatctcctaacctcatgatccacccaccttggcctcccaaagtgctgggattacagatgtgagccaccgtgccctgccaaatcgagcactttctaagtgcccacctgtcagcgtcaccccaggctttcccatctcagcccgtggctccactctcctctagctactttggccaaaaaccacagagtcatcttggatcccaatttttgcttcacccccacatccaatctttcggcgagtcccgtctgctttacctcggcacatcatcagtgcgctcagtgcacttcccagccacctcccacgctgggctgctaaccttctgccaggtcaccatagctaccaccagctcctcctgaccctttggccttggtctctaaaacccattctcctctcatcagagtgacctcatcccagcatcattctgaccatttctcatcttaaagtcctcaaaagggtcctatcagatattaacaatttttaaagaaattaagacagaatggctttggcatctggctattaaaaaaaaagggtagggggggccgagtgcggtggctcatgcttgtaaacccagaactttgggaggccaaggtgggagggtcccttgagcccaggagttcgagaccagcctgggcaacacagagagaccctgtctttacaaaaacaaaattagctgggtgtggcggcacatgcctgtagtcctagctacttgggagactgaggtggcaggatcacttgagcctgggaggttgaggccgcggtgagctgagatcatgccactgcactccggcctgggtgacagagtgagagcccatttaaaaatgaaaaataaagggaaaaaaaaggacagaacaggagtcccggagacagaaccttgcataaatgagaatttgccgtatgacagagaagcatcaccaaccagtggggaaaagatagactcttttataaatggcgttgggacaagtggtgatccatatgggaaagtaaaattagatccccacctaacaccacacacacaactccaggtggattcaggacttacatgtgaataacaaaattttaacacatttagaagaaaatatagaagaatatttttatgacctcagggtaaggaacaatttcttttttaaataaactttttgtttgattacaacatgcatagtgtacaagtcataagggtgccgcttgatgaaatttcacagtgaccccagctgtgtagccagcatccagatcaacaagcgggatgtaaggccaggcacggtggctcactcctgtaatcccaacactttgggaggccgaggagggcggatcagaaggtcaggagtttgagaccagcctggccaatatggtgaaaccccgtctcaactaaaaatacaaaaattagcccggcatggtggcacacacctgtagtcccagctacttgggaggctgtggcagaagaatcgcttgaaccctggaggcggagtttgcagtaacccgagatcgtgccactgcactccagcctggcgaaagggcgagaatccgtctaaaaaaaataaaaataaaaaacacaacaacaaatgggacatagccagtgccttccaaagcccccacgtgcctctttttttctttcttttttttttttgtttgagacggagtcttgctctgttgcccaggctggagtgcagtggcatgatctcggctcactgaaacctccgcctcctggattcaagcaactctcctgcctcagcctcctgagtagctgggactacaggcacacaccaccattcctggctaattctttttttatttttagtagagacggggtttcaccagttggccaggatggtctcgatctcctgacctcatgatccacccgcctcagcctcccaaaatgctgggattgcaggtgtgagccaccacactcagccttctttttttttttttttttttttttttgagacggagttttgctcttgttgcccaggttggagtgcaatggcacggtctcggctcaccgcagcctccccttcctgggttcaagtgattctcctgcctcagcctccccagtagctgggattacaggcatccgccaccacactcggctaattttttttttttttctttagtagagacagggtttctccatgttggtcaggctggtctcaaactcccgatgccaggtgatcctcccgcctcagcctcccatagtgttgggattacaggcgtgagccaccgtgcccagccttttttttcttttcttttcttttttttgagatggagtctcactctgttgcccaggctggagtgcaatgcaatggcgtgatctcagctcactacaacctctacctcccggattcaagcgattctcctgtctcagtctcccaagtagctgggattacaggtgtgttctaccacgcccagataatttttgtatttttagtagagacagggtttcaccatgttggccaggctggtcttgaactcctgacatcaagtgatccacctgcctcagcctcccagagtgctgagattacaggtgtgagccacggcacccagctcctcatgccttttgacaggaaagagtatcttaggcacaaaaggtatcagctacaatggaaaaaaattgatgagtctgatgatattgacatttaaatcttaagttcaacaaaaaaaaatgccacaagattaaaggatacgtacagctgagcaccatgactcgtatctgtaatcccagcattttgggagactgaggcaggcagattacttgagctgaggagtttgagaccagcctgggcaacatggcaaaactctgtctctacaaaaaatacaaaaattagccaggtgtggtggcgtatgcctgtagtcccagttacttggaaggctgaggtgggagaatcactggaacctgggaggcagaggttgcagtgagctgagactgggccactgcactccagcctgagtgacagagcaagaccctgtctcaaaaataaataaataaataaataaataaataaataaataacagatatgcacaatatggaggaaatatctgcaatataatcagcaaattggtatccagaatatgtaaaggtcttctgcaaatcaagaagagagacaaccaacccaacagaaaatttggcacaggttatgaaccttataggaaaaaaaagcctagatggccaataatcatatgaaaaagaggctctgggctgggcatggtggttcatgtcaataatcccagcaatttgggaggccaaggtgggaggatcacttgagtccaggagctggagaacagactgggcagcaaagtgagacctcgtctctacagaaaacaaaataattagccgggcatgatggtgcatgcctgtagtcccagctactctggaggctaaagcagggggatggattgaatccagcagatggaggctacagtgacctatgatcatgccactgcattccagcttgggcagcagagtgagaccctgcctcaaaaacagaaaaagtctctgtctcaatagtatcagagacatgtaaatttttttttgagatagtctcaccctgttgcccaggctggagtgtactggtgcagtctcagctcactgcaacctccacctcctgggttcaagcaattctcctgcctcagcctcccaagtagctgggattacaggtgtgcaccaccacgcctggctaatttttgtatttttagtagagacgaggttttgccatgttggccaggctggtctcgaactcctgacctcaagtgatccacccacattagcctcccaaagtgctgggattacaggcgtgagccactgcgcctggctgagaaaggtaaattaaaacaacaaggagatattatgtctcacccatcagataatttaaaatggaagaaaacataaaagctgatattattaaatgtagacccaaatgagactccttaaaaacaccagctctgggctgggcgcggcggctcatgcctgtaatcccaacactttgggaggccgatatgggtggatcacgaggtcaggagatggagaccatcctggctaacaccgtgaaaccacatctctcctaaaactacaaaaaattagcccagcatggtggcacgcacctgtagtcccagctactcgggaggctgaggcaggagaatcacttaaaccgcagaggcagaggttgcagtgagccaaaatcacatcattgcactccaggctgggcaaaagagcaagacttcgtctcaaacaaacagacaaacaaataaaaacccaccagctctggagaagattggtaaagccacttggaagtgacacaaaatggcagcttgaaggtcaggtcaagatcagggtgaaggtgagaacatctgtgagcattcctcttccaggcagagactctacagaagctctatgagcatcccaggaggaagaaattggaaacgtcatcaaggagatacacaaggtatgatacactcatacaatggaaaatggccggacaaatgaaagaaacaacatcaaagtgaattatcataagatacaccaagcagggccagggtggggccaggtccacctctcctgttgcccaatcttgaaggtggcagaggacctttgaggcaccttgctggcccactgaggagctgtggccgaggcacacgcccatcagggctgactccttgctgggaactgggtcaggtggatggacgtggtgacgagcaacagtgaggtttcccccacatcctttcacctgccctgctgcgtctgctgctgagtcaggatccatctggggagccaccgtgggacactctcccctatgggagagtggtaaggttctggagtaacacatgggactggaaatgtttctgtggccatttttatttttatttatttttttaagacagagtcttgctctgttgctcaggctggagtgcagtactgtgatctcagctcactgcaacctctgcctgtgggagttcaagcaattcttctgtctcagcctcccaagtagctgggattacaagcacccaccaccacgcctggctaatttgtgtatttttagtagagatggggtttcaccatgttggctagtctggtgtcaaactcccgacctcaggtgatctgcccatctgagactcccaaagtgctgggattacagagctgagtgacagagtgagactctgtcaaaaaaaaaaaaaaaaaaaaagaaaggaaggaagagaaatagaaagaaagaaagaaaaagaaagaaagaaagaaaagaaagaaagaaaagctggaatgagtcagggcagaatcatagaatgtctgggtgtgaatcctggcttccctcctttccagtgaagcaaccttgggcgagtggcttgaccactctgtgcctgtttcctcacctgtagcagttaggaatgcatttggctgcaggtaactgcagagctccaacctcccgcaaaacagcagctttgttcatttcatcttgaaaagctcagccatgtgcggttgctggttttggttcaggaggtcagagagaggattcatcatctttgtcttttttcttagaaaaacctgtttacctgaagacttcccctcaatgtcactgccaaagggaagccttgcaaccaggctgccggttgcacggatccaacatttgctctgtgggtctcagcctgggtcaaactcacacctctaagggatgtttggaaatgtgtggagtcattttgggttgtcacaatgatttagctgcaatgcatagaacagtcttatatgaagaattgtcctgccctagaagaaaaaaaaatgtcccacccaaatgccaaaatgtctgtgccccactgaaaagctccagcctccgtaagtggaggcagtgagtagggaagggctgagacagatgcaggtcaggcaccagccctcactcctgccacatccagcttgtagggctgtgccagggagcatggggatgtgcccaggccagcgcctggcatgagcacatgttggggtccccaaggcgtgcctaaggggcgctttggccagagcactgtggcaaggtctgagactggcaaagaatgaccccggggactgagcagtggatgcaggtggaaacagagtgcctctgattttcctctgaccttcttgcctctcttcaaagcctgcctggccctcggaggctgcccagtgcatcatagtacatcccacggtggctccccagatggattctgactcagcagcagacgcagcagggcaggcaaaaggatgtgggggaaacctcactgtggctcatcaccacgtccatctgcctcaccaagttcccagcaaggagtcggccctgatgggtgtattcctcagccacagctcctcagtgggccagcaaggtgactcgaagggcctctgccacctctaagattggggaacaggaaagatggacctggccccaccccagcctgcgggtcaccacccatggcgggacaagtgagaaaagttggccttgctcaccgctggagcccaaaccacaggtttcatttccccttgataaagacaatgtttgctattgttgcatctgatggtaaaagcaagtcatattcactatcaaaaagtttgaaaggcggccgggcacggtggctcacacttgtattcccagcattttgggaggccgaggcaggcggatcacaaggtcaagagatcgagaccatcctgtccaacatggtgaaaccccatctctactaaaaatacaaaaattagatgggcatggtggcgtgcacctgtagttccaactacttgggaggctgaggcaagagaatcgcttgaacccgggaggcagaggttgctgtgagccccaagattgcaccactacactctagcctggcaacagagcgagactccgtctcaaaaaacaaaaaaaaaaaggaaaataagaatccagcctcaagcctgtcacccaggaacaatcactctagttggctggtgtatttccctccagtctttttttcagtgtatgtatataaactttatttatatatattattttatagccagctgctttttttcttttaattctaaatgatgggctgttttttgttttaaaacactgtagaccagccaagtgtggtggctcaaaccggtaatcccagcacttttggaggctgaggtgggcagatcacttgagcccaggaattcaagaccagcctgggcaacatggcaaaaccatgtctctaccaaaaataaaaaaattagccaggcatggttccatgcacctgtagtccctgcaacttgggaggctgagatgggaggatcacctgagcccagagaggtcgaggctacagtgagccatgatcatgccatcacactccagcctgggtgacaagagtgagaccctgtctcaaaaacaaacaaacaaacaaacaaaaaaaaacacaggctgggcacagtggctcatgcctgtaatcccagcacttcggcaggccaaggtaggtggatcacctgaggtcaggagctcaagaccagcctggccaacatggcgaaaccctgtctctactaaaaatacaaaaattagccgggtgtggtggcacacgcctgtaatcccagctacttgggaggctgaggcatgagaatcgcttgaacccgggaggtggagcttgcagcgagctgagattgtgccactgcactccagcctgggcgacagagcaagactgcatctcaaaagaacaaacaaaaacaaaaaccactgtagaccaagcaaactcaactcttcctcctcccatgcagtgctccctctgcctgtttccccacatcacctgtgtgatggggagtgggggggcacacagcgaggctgaggactcatggaatgacccttgggaagccagaatgggcacgggtacacatttccaagcaggagactcactgatctacccaccccgggtccccaaccacactgggaatcccctccatgaacgggaggagcctctatcacacacacacacacacacacacacacacacacacacacacacggagaccacagagagaacatgggcaccgtgggcaactgtttgaaaatttctgagctgcttctcagataaagagagcactctcatcttccttgtccttctccagaatcagcagaaatcaagtttctcaccttccaagctcagccaagaaatttcaattccagtgacgacagagctggtgtggggtggatggttcccatgggaaggtgtgggtcacaggctgggctcttagtactgggaaagtccctaggccaagtcagaatcccaggtgtcctccctgagcacctgctgtgtgcaggatgccatgccaaacattttatgaattagttcatcccattcttgtgacacctcagcaggggaggtatcagtacccccatttaatggatgaagaaatggaggccctgcaaaattaagccacaggccaacttcctcatggatggatcaagcatctgaagccaagagagtggacatggcctgtccagactggggaccagcgcaaggcaaggtttatcctgctgggccaggcccggctgcctctctcagagggcactggggagtttgccctggacacaggctaggggcaaaggctcacatggacatgtcgagtcagctgccagatcctgggctctaggcctccccaacatcttcccaatgcacccagctgactcctggagtccagaaagtccaaactgtagaaggtcaccccaagcgccctgggacttcgcactctgcgctggctgacatgtggggctggaatggcttcttccactgggcgtgtatgtgggcgtgggaatggacacatgtgctctgtctcccggcccaactgtccagtcacaggcgacagcatctgggtctgtggcaagttcagagctccagacctgccttccccactgatgccctgtgtgacctggacccggtctcactccctccctgagtcccagttgttcttctcttctgtggaatcctaaccctgtgattcctgaaggggagggacagtaaagacacatttctttcttttctttttctttttaagagagaagatctggcggccgggcgtggtggctcatgcctataatcccagcacttggggaggctgaagcaggtgggtcacctgaggtcaggagtttgagaccagcctgaccaacatggtgaaactgtgtctctactaaaaatacaaaaatcagccaggtgtggtggcaggcacctgtagtcccagctacttgagagattgagacaggagaatcactagaacccgggagacggaggttgcagtgagccgagatcgtgccactgtactccagcctgggtgacaaagagagactctctcaaaagaaaaaaaaaaggagaatctggctatgttgcacaggctggagtacagtggctattcacagcaccatcccactactgatcaat

SEQ ID NO: 3224 - DNA, 916 bp, Homo sapiens
tccttgttttagctcatttccttcttcttattcaagcagatcgaggctgtgtgcttctcatcttagggaagaatatagcaagatggcagcagaaaaaaatcagactccaaaatctaagtcttcagtccagggatatatcctgagcttcaagtttcacatagccaccttcctaccacaaaattctcatttgaaggctctactcattatcttttctctgtaaaattgctcttatgttccttatctcaacgtatcacatgtccatccatccagtattcgaggtcataacttaagaaaacatctttatccaaacaatcaccgtgtcccaaacacccctgaatccattcatctctgcacctccattgccaccttcatctttcgtctcagttaatgtgacggcctctgatcctatcttttgccttcagtctttcttctccaatttattctgaagtgtaaaccagattgtgtggtttttttttaaacttaaatcctttagcttatttcccacaattctcaaggataaaatcacttccaaaatcactcaagtcatcacgccagcctgcctttcaagcctcatcctcacagtctatacctgcccttctttcccaaatggcatgctttctctcactaagcatttacacatcttgtctgaaattcctatctgcatatgctaaatgcgtgccaatttttctaatgggttgttttgacgtgaactgattaccagagtgagtgcaagttcaagagcttgacaggggcacacctctgtgcaactcaggctcaaggtgagtggctttgacaggacagttctcattctaagacagagcattctaaattatcctttcaaagatagttcctctccctatcttccaccatccattttattttcctttaatttctatgtcatgccattgtttccttc

SEQ ID NO: 3225 - DNA, 4370 bp, Homo sapiens
ttactgttgattgtgacgaaatgccagctgaggcacatgccttgggagctaagtggttgctgcccttgaccactgtgaagactggtgtgggaagggtcgctttggatgcacttgagcaggggtccccaacccctgagccatggagccgcaaggagccacacagcaggaggtgggaccatccagttgcaggaaaacaagcttaacacgcccactaattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagttagactctctagtcccaactgctgcctcctggtggcctatgaaggcccaaaatctcctcaagttgacctgtccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatcaacaggcccagctttgacttgagaacagcctctgcaggccctgctcttgcctcccaggggctttttccaggcccagctcttgcctcatggcagctgccccaggccaaatttctgcctgcctgccagcagcctcaacaggcacagctcctccctcacagtggcccatttaggcccaactcatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggcgaagctcctgcctttcggcagcctctccaggcccagctcctcctgcctcccagtggcctctttcggcccagcccagctcatgcctcccggcggccttcccaagccccgcttttgactttcggtggcctctgcaggcctcgacaaggcccagcctcctgcctcccgaaggcctgcacaggcccagcctctgcctcacagcggactctccacgcccagctagctgttgcttcactgcggcctcccgagtccaaagctcctgcctctcggccgcttcggcaggcccagctcccgcctgccagtggcctcttcaggcccatggggctcattcctgacaacggcctttccaggcccagtttttcccttccggcggcctctccgggcccagaacctcctcaagtcggcctctccagacccacttgcaccctccgggcgttctctccgggcccagctcttcttcctggttgggtctccaggcccgattcctgcctctcaacaacctctttggactcagtgcctacccatctcctggcggccttggtcggcccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgaccgccgcaggcccaagttgtcctgaagtcgggctctcccggccctgcctcccagcaagtaagcaagctcttttggctcaactcctgcccagctcccaaccgcctttgtaggccccgaactttctccagccaagctctgagggcccacctcctgcctcctggtggcctgtacagttctagcactggttggagaacagcctctgcaggcccctcccttgcctcccaggggcctctccaggcccagctcttgcccccacggcggcctcccggggccaagtccctgcctgcctcccagcagcccgcgtgcggcccagctcctccctcacggtggcctgttgatgcccaactcatgcctctggcaccctgcccagaggcgtgagcccctgcctcacactggctcctcccacgctgagagaggtcagtgtgagcccttgcctcacaccggcccctcccacgcggacagaggtcagcgtgagccccttgcctcacaccggcccctcccacgctgagagaggtcagtgtgagcccttgcctcaccccggcccctcccacgtggacagaggtcagcgtgagccccttgtctcacaccggcccctcccacgctgagagaggtcagtgtgagcccttgcctcacaccggcccctcccacgcggacagaggtcagcgtgaccccctgcctcaacaggccaccgtgagggaggaacaggatcgcactcgggctgctgggaggtaggcagggacttgggcctgggaggtcgcggtggggcgagagctgggcctggagactcccctgggaggcaacagcggggtctgcagacgcccttctccagccggagctgggactgttcagtcactgggagaagggatgtgggtctgaagagcttggttgcagaaacttcggggtctacaaacgcaggcgggagctgagccaaaagagcttgtttgctgggaggtgggagatgcagccaggaggaacagctgggcaatgcgggaggcagaggccaggcctccttaagttggcctctcagacccacttgcagcctcccggcgccccctccgggcccagctcttcctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcttagctccagcctcccggcggcctctgcaggcccaagtcgtcctcaagtcggcctggaagtgggcctggaagagcagcaagtcggcctccctgggcccagctccgtcctctcgacggcctctccaggtgcaaaacttcctcgagtcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcccggcctcggcctcggcctcacagcagactctccacgcccagctagctctcgcctcactgcggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatgtaaatattttgataggtaatttatttggagtgagtttctgcgccaagcccgaattttttattttattttccttattatttggtgttaaacaggtttaatgacggtcatggcaactttttggcacaatgaaaaatatcgcccacga

SEQ ID NO: 3226 - DNA, 4223 bp, Homo sapiens
gagacagcatctggctctgtcacccaggctggagtgcagtagcgcaatctcggttcactgcaacctctgccttccaggttcaagtgattctcctgcctcagcctcccaaatagctgggattacaggcatgtgccaccatacccagctaatttttgtattttcagcagagacggggtttcaccatgttggccagactggtctcgaacttctgacctcaaatgatctgcccatctaggcctccaaaagtgctgggattataggtgtgagccactgcgcctggcccttggtaaacacttcaaatgcacccaacattaaagtaaaaaatatcaatgaaatcttaaaaaatgcagcctgggcaacacagcaagaccccatctctccaaaaataaaaatagaaaaaattagtcaggcatgacaacgtgcttctatagtcccagctactggagaggctgaagcaggaggatcgcttgagcacaggaagtcaaggctgcagtgagttacgatctcatcactgcacaccagcctgggcgactgagttagcactctgtctctaaaataataatttaataataataataataataattcacacgtttttctgtagtattcgcttgtcaaatgaagttaaatgtgatgtatgttacaatgtattgtgtggcatgtgtgatattatctcattggattagaattatttattctccatttgcttttctgtttaagaataagctccttcagggcagggacagctcttatttcctctgtgtctcctagggcctggcacaatgtctaacacaaggaatgctgagcaaattatttagtgcatgaatatttgctccaggaagatgaggcctaataccatgcagatggttattacatgtcaaaataagaataatcccatttttatattctctttccctcttcctctgatctttctcctctcaaatattttcaggctggaattcagggattggttctggagttatctttatggttgtagaacccctagagctgagaacacacagtggtgccatttagagaactgactgccccagtagactcccagaatacactgggactcccagaacactggatcatgcggcagccttagccaggagcctcataaagtgtgtgtgtgtgtgtttcagtggtgtgaagtcagctggggaatgccaggtgcccactccccaacttggaattgcagatctctagcctgctgcgtggctgtagctcccttcctcctccttctttttctcccaacattgagaaagcagtatgctgcctatttcaaagagtataatagctccacatttttatgcttctttttggagcaattagagtgcagaggagggtcagcagagggtaagagcggagaaaacagctgattcctgagcactaagaggtcccaagccacccagcccccctctcctgcaccaaccaagcctgcacttgtcacaaagtcagccctgacaagtgctctgccgccgccgctgtgcttgggtggagtagaaacggaggggagagagggagggaacttcattctttcctggcttaaaaagtcaaaggctctgtaaggcatgcaaaaggaagaaagaaattgtcctgcttggccgcattgctttcctttcttgaccagttctgcccacacccaataaccccatgcttctctgcccagccttcctccacctgggcccgggaagggaaatgggacgcctgctcctcctctgctcacccatccccagcctttctgccagcctgggtgtcccacagctgaccggcctgcaaacaggactctatctgcagaatccaccccctccccctcaactctagcattaacctttctctttctttcaacaaaagccaaactctttcaaagccaacctgattgaaattcaaaaactttccagggcctctgcaccactctctactcctccccatactgacagccgctggtcacccccccacacccttcccactccccacccccagcaatgtagaaaatagcgggacaaagggctctccccaccccctcccccaagcacaagactctccctttgtgtcactgtgtcactcgggctggtggaaagggagagctggctctgggctctcctattgtctcccgatacccccacccccacccccacccccacagccttctgcagcctggaggccttgtgctgggtcccgctcagttggccaaatcgaggggcctctatggggcccccaggcccactctctgacaggacagaagagccaagggcccgtctatgcccgaagggtgcttcgcccctggctcccgagccccacgttgtggactccagggtggacctggagccgcagaccaaagctggctcccttattttcctggacaccagatggagctcctccctccctcctctctctttagagactccctccctcagcagcagcggcaattagaatggtctggcaggctctggggagggggatgcccaggtggtggccaggaggctattagagaatggagacaggcagcctgggacacctccttgtacagagctgcagccgctggggaggaaaggtctaaacacgcttccattaattaattaattcaacaagtactcattgagcacctatcatacacgctcattggggaaacagcagtgaacagaacaaagttctccttgcagcgcttacattccagtgggtgagacagacaatcagcaaatcaatacatatttcagacacaagtccacccagaaaaagagagcaagacaaggagccagagagtgccaggtggggagtatgtgagatgcgggtggcagcgggggtgtgttagggaagtctccagatacaggcagaatttagacataggaaggagcgtctgagaaaagagacttccagcccaagggaactgcaagagcaaaggctctaagctgttaattaaggaactaaaaggctaaggtggagacccaagggcagcgtgtgtagcctgtgagcccagagggcagggaggccagagagggtaggtctctcatgcctgtagagaggtttggatcttactttgaacgaatggcaagccagaggagtcacagaatttgatttatgtattaaaagggccggaacaagggtagaagcaggaaaacctaaggactctgttgaaattgtctaggtgagagatagtagtagtggcttggtccagggtcatgtggtagagatggagagaagctgtcagatttgggaaccaacaggatttgctgataggcagtatgaatggtgtgggagaccagagtccaggataacttcaatgttttggcctgatccaactggaagactggagtggctattgacgggcagggtagagataaaggacataatcatttgatcctgtgcagttagaataaggagttcagttttggacttaacatttgagctgcctgttagacatccaattggagatgtccagtaagcagtggagttggtgaatttgtagttcaggggagaggtctaggctagagatataaatttgggagtcaccatggagctggtatgaagccctggagggatcacctgggaaggtagtgcggataaaggagaagggaaatctgaggactaagtcaagggtactccaaagtttagcatcactgaaaggaggaggaaccagcaagaggaacaagcagtgaggaagaaggagaaccaacagagggtgtgtcctagaagcggagtgaggaaagtgtttctagaagacgggagtgacagattgagtatgatatgcactgaggactggctgttggatttggcaatagggaggtcactagtgacctggacaaaagccatttcacaggaaggatagggaaaaatctgactagtgagggttcacctgagaatgaaaggagagggggtgacctaaaggggaacagagaaatggagaggtagctacagggggaaatggaaggcttttaaaatagatggtaaatatttttgcacgtttgtgtgcatcagagcttccagcagaaagggaagctctgatggtgagattcagggagacaattactagaagataatctaagctacattaggaaagaagttaggtgagatggggtgggggacatgaaaggcaggcagggtcaatagggtgcagtccttcccattggagttggaattgggtcactaccaggagtaaattggcagttggagagcaggatgtttaagttggttattaggaaggggtataattactggtaatg

SEQ ID NO: 3227 - DNA, 16894 bp, Homo sapiens
gtgctccaggcctgcttggtgtggacatggtggtgagccgtggcaaggaccagaatggatcacagatgatcgttggccaacaggtggcagaagaggaattcctgccttcctcaagaggaacacctaccccttggctaatgctggggtcggattttgatttatatttatcttttggatgtcagtcatacagtctgattttgtggtttgctagtgtttgaatttaagtcttaagtgactattatagaaatgtattaagaggctttatttgtagaattcactttaattacatttaatgagtttttgttttgagttccttaaaattccttaaagtttttagcttctcattacaaattccttaacctttttttggcagtagatagtcaaagtcaaatcatttctaatgttttaaaaatgtgctggtcattttctttgaaattgacttaactattttcctttgaagagtctgtagcacagaaacagtaaaaaatttaacttcatgacctaatgtaaaaaagagtgtttgaaggtttacacaggtccaggccttgctttgttcccatccttgatgctgcactaattgactaatcacctacttatcagacaggaaacttgaattgctgtggtctggtgtcctctattcagacttattatattggagtatttcaatttttcgttgtatcctgcctgcctagcatccagttcctccccagccctgctcccagcaaacccctagtctagccccagccctactcccaccccgccccagccctgccccagccccagtcccctaaccccccagccctagccccagtcccagtcctagttcctcagtcccgcccagcttctctcgaaagtcactctaattttcattgattcagtgctcaaaataagttgtccattgcttatcctattatactgggatattccgtttacccttggcattgctgatcttcagtactgactccttgaccattttcagttaatgcatacaatcccatttgtctgtgatctcaggacaaagaatttccttactcggtacgttgaagttagggaatgtcaattgagagctttctatcagagcattattgcccacaatttgagttacttatcattttctcgatcccctgcccttaaaggagaaaccatttctctgtcattgcttctgtagtcacagtcccaattttgagtagtgatcttttcttgtgtactgtgttggccacctaaaactctttgcattgagtaaaattctaattgccaataatcctacccattggattagacagcactctgaaccccatttgcattcagcagggggtcgcagacaacccgtcttttgttggacagttaaaatgctcagtcccaattgtcatagctttgcctattaaacaaaggcaccctactgcgctttttgctgtgcttctggagaatcctgctgttcttggacaattaaagaacaaagtagtaattgctaattgtctcacccattaatcatgaagactaccagtcgcccttgcatttgccttgaggcagcgctgactacctgagatttaagagtttcttaaattattgagtaaaatcccaattatccatagttctgttagttacactatggcctttgcaaacatctttgcataacagcagtgggactgactcattcttagagccccttcccttggaatattaatggatacaatagtaattattcatggttctgcgtaacagagaagacccacttatgtgtatgcctttatcattgctcctagatagtgtgaactacctaccaccttgcattaatatgtaaaacactaattgcccatagtcccactcattagtctaggatgtcctctttgccattgctgctgagttctgactacccaagtttccttctcttaaacagttgatatgcataattgcatatattcatggttctgtgcaataaaaatggattctcaccccatcccaccttctgtgggatgttgctaacgagtgcagattattcaataacagctcttgaacagttaatttgcacagttgcaattgtccagagtcctgtccattagaaagggactctgtatcctatttgcacgctacaatgtgggctgatcacccaaggactcttcttgtgcattgatgttcataattgtatttgtccacgatcttgtgcactaacccttccactccctttgtattccagcaggggacccttactactcaagacctctgtactaggacagtttatgtgcacaatcctaattgattagaactgagtcttttatatcaaggtccctgcatcatctttgctttacatcaagagggtgctggttacctaatgcccctcctccagaaattattgatgtgcaaaatgcaatttccctatctgctgttagtctggggtctcatcccctcatattccttttgtcttacagcagggggtacttgggactgttaatgcgcataattgcaattatggtcttttccattaaattaagatcccaactgctcacaccctcttagcattacagtagagggtgctaatcacaaggacatttcttttgtactgttaatgtgctacttgcatttgtccctcttcctgtgcactaaagaccccactcacttccctagtgttcagcagtggatgacctctagtcaagacctttgcactaggatagttaatgtgaaccatggcaactgatcacaacaatgtctttcagatcagatccattttatcctccttgttttacagcaagggatattaattacctatgttacctttccctgggactatgaatgtgcaaaattccaatgttcatggtctctccctttaaacctatattctaccccttttacattatagaaagggatgctggaaacccagagtccttctcttgggactcttaatgtgtatttctaattatccatgactcttaatgtgcatattttcaattgcctaattgatttcaattgtctaagacatttcaaatgtctaattgattagaactgagtcttttatatcaagctaatatctagcttttatatcaagctaatatcttgacttctcagcatcatagaagggggtactgatttcctaaagtctttcttgaatttctattatgcaaaattgccctgaggccgggtgtggtggctcacacctgtaatcccagcactttgggaggctgaggtgggaagatcccttactgccaggagtttgagaccagcctggccaacattaaaaaaaaaaaaaagtaagacaattgccctggaatcccatccccctcacacctccttggcaaagcagcaggagtgctaactagctagtgcttcttctcttatactgcttaaatgcgcataattagcagtagttgatgtgcccctatgttagagtagaatcccgcttccttgctccatttgcattactgcaggagcttctaactagcctgaattcactctcttggactgttaatgtgcatacttatatttgctgctgtacttttttaccatgtaaggaccccacccactgtatttacatcccagctggaagtacctactacttaagacccttagactagtaaagttagcgtgcataatcttaggtgttatatacacattttcagttgcatacagttgtgccttttatcaggactcctgtacttatcaaagcagagagtgctaatcaatattaagcccttctcttcgaactgtagatggcatgtaattgcagttgtcaatggtccttcaattagacttgggtttctgacctatcacaccctctttgctttattgcatggggtactattcacttaaggcccctttctcaaactgttaatgtgcctaatgacaattacatcagtatccttccttttgaaggacagcatggttggtgacacctaaggccccatttcttggcctcccaatatgtgtgattgtatttgtcgaggttgctatgcactagagaaggaaagtgctcccctcatccccacttttcccttccagcaggaagtgcccaccccataagacccttttatttggagagtctaggtgcacaattgtaagtgaccacaagcatgcatcttggacatttatgtgcgtaatcgcacactgctcattccatgtgaataaggtcctactctccgaccccttttgcaatacagaagggttgctgataacgcagtccccttttcttggcatgttgtgtgtgattataatcgtctgggatcctatgcactagaaaaggagggtcctctccacatacctcagtctcacctttcccttccagcagggagtgcccactccataagactctcacatttggacagtcaaggtgcgtaattgttaagtgaacacaaccatgcaccttagacatggatttgcataactacacacagctcaacctatctgaataaaatcctactctcagaccccttttgcagtacagcaggggtgctgatcaccaaggccctttttcctggcctggtatgcgtgtgattatgtttgtcccggttcctgtgtattagacatggaagcctcccctgccacactccacccccaatcttcctttcccttccggcagggagtgccctctccataagacgcttacgtttggacaatcaaggtgcacagttgtaagtgaccacaggcatacaccttggacattaatgtgcataaccactttgcccattccatctgaataaggtcctactctcagaccccttttgcagtacagcaggggtgctgatcaccaaggccccttttcttggcctgttatgtgcgtgattatatttgtctgggttcctgtgtattagacaaggaagccttccccccgcccccacccccactcccagtcttcctttcccttccagcagggagtgccccctccataagatcattacatttggacaatcaaggtgcacaattataagtgaccacagccatgcaccttggacattattggacattaatgtgcgtaactgcacatggcccatcccatctgaataaggtcctactctcagatgccctttgcagtacagcaggggtactgaatcaccaaggccctttttcttggcctgttatgtgtgtgattatatttatcccagtttctgtgtaatagacatgaaagcctcccctgccacaccccacctccaatcttcctttcccttccaccagggagtgtccactccatatacccttacatttggacaatcaaggtgcacaattgtaagtgagcataggcactcaccttggacatgaatgtgcataactgcacatggcccatcccatctgaataaggtcctactctcagaccctttttgcagtacagcaggggtgctgatcaccaaggccccttttcctggcctgttatgtgtgtgattatatttgttccagttcctgtgtaatagacatggaagcctcccctgccacactccacccccaatcttcctttcccttctggcaggaagtacccgctccataagacccttacatttggacagtcaaggtgcacaattgtatgtgaccacaaccatgcaccttggacataaatgtgtgtaactgcacatggcccatcccatctgaataaggtcctactctcagaccccttttgcagtacagtaggtgtgctgataaccaaggcccctcttcctggcctgttaacgtatgtgattatatttgtctgggttccagtgtataagacatggaagcctcccctgccccaccccaccctcaatcttcctttcccttctggcagggagtgccagctccataagaaccttacatttggacagtcaaggtgcacaattctaagtgaccgcagccatgcaccttggtcaataatgtgtgtaactgcacacggcctatctcatctgaataaggccttactctcagaccccttttgcagtacagcaggggtgctgataaccaaggcccattttcctggcctgttatgtgtgtgattatatttgtccaggtttctgtgtactagacaaggaagcctcctctgccccatcccatctacgcataatctttcttttcctcccagcagggagtgctcactccataagacccttacatttggacaatcaaggtgcacaattgtaagtgaccacaaccatgcatcttggaaatttatgtgcataactgcacatggcttatcctatttgaataaagtcctactctcagaccccctttgcagtatagctggggtgctgatcactgaggcctctttgcttggcttgtctatattcttgtgtactagataagggcaccttctcatggactccctttgcttttcaacaaggagtacccactactttttaagattcttatatttgtccaaagtacatggttttaattgaccacaacaatgtcccttggacattaatgtatgtaatcaccacatggttcatcctaattaaacaaagttctaccttctcaccctccatttgcagtataccagggttgctgaccccctaagtccccttttcttggcttgttgacatgcataattgcatttatgttggttcttgtgccctagacaaggatgccccacctcttttcaatagtgggtgcccactccttatgatctttacatttgaacagttaatgtgaataattgcagttgtccacaaccctatcacttctaggaccattatacctcttttgcattactgtggggtatactgtttccctccaaggccccttctggtggactatcaacatataattgaaattttcttttgtctttgtcagtagattaaggtcataccccatcacctttcctttgtagtacaacagggtgtcctgatcaaccaaagtcctgttgttttggactgttaatatgtgcaattacatttgctcctgatctgtgcactagataaggatcctacctactttcttagtgtttttagcaggtagtgcccactactcaagactgtcacttggaatgttcatgtgcacaaactcaattctctaagcatgttcctgtaccacctttgctttagagcagggggatgatattcactaagtgccccttcttttggacttaatatgcattaatgcaattgtccacctcttcttttagactaagagttgatctccacatattccccttgcatcaggggcatgttaattatgaatgaacccttttcttttaatattaatgtcataattgtatttgtggacctgtgtaggagaaaaagaccctatgttcctcccattaccctttggattgctgctgagaagtgttaactactcataatctcagctcttggacaattaatagcattaataacaattatcaagggcactgatcattagataagactcctgcttcctcgttgcttacatcgggggtactgacccactaaggccccttgtactgttaatgtgaatatttgcaattatatatgtctccttctggtagagtgggatattatgccctagtatcccctttgcattactgcaggggctgctgactactcaaaacttctcctgggactgttaataggcacaatggcagttatcaatggttttctccctccctgaccttgttaagcaagcgccccaccccacccttagtttcccatggcataataaagtataagcattggagtattccatgcacttgtctatcaaacagtggtccatactcccaacccttttgcattgcgccagtgtgtaaaatcacaggtagccatggtgtcatgctttatatacgaagtcttccctctctctgccccttgtgtgcccttggcccctttttacagactattgctcacaatctcaggtgtccatatttgcagctattaggtaagattgtgctgtctccctcttcccttccctctgccctgccccttttgcctctttgctgggtaatgttgaccagacaaggccctttctcttggacttaaacaattctcagttgcactttccttggtcccacccattatacatgaacccctctacttcctttcgcattgcttctgagtatgctgactacccaaagccccttctgtgttattaataaacacagtactgattgtcccatttttcagcccatcagtccaagatctccctaccactttggtgtgttggtgcagtgttgactatgaaaagcaggcctgaactaggtggataagccttcactcattttctttcatttattaatgatcctagtttcaattattgtcagattctggggacaagaaccattcttgcccacctgtgttactgctttactgtgcaaaatactgaaggcaagtcagacccagggagctggattgccatcctttattttgtgtttccagtgtacactataaaattgtctccccaggaaggaaggttggcactttctctgcattcttctttccagagcagattgcctggttaagaatctcttgttgtcccctttgtatattgttattgtaaagtgccaaatgccaggatacagccagaaaaattgcttattattattaaaaaaatttttttaagaaagacatctggattgtagggtggactcgataacctggtcattatttttttgaagccaaaatatccatttatactatgtacctggtgaccagtgtctctcattttaactgagggtggtgggtctgtggatagaacactgactcttgctattttaatatcaaagatattctagagtggaactcttaagaccagtatctttgtgtgggctttaccagcattcacttttagaaaaactacctaaattttataatcctttaatttcttcatctggagcacctgcccctacttatttcaagaagattgcagtaaaacgattaaatgagggaacatatgcagaggtgcttttaaaaagcatatgccaccttttttattaattattatataaaatgaagcatttaattatagtaataatttgaagtagtttgaagtaccacactgaggtgaggacttaaaaatgataagacgagttccctattttataagaaaaataagccaaaattaaatattcttttggatataaatttcaacagtgagatagctgcctagtggaaatgaataatatcccagccactagtgtacagggtgttttgtggcacaggattatgtaatatggaactgctcaagcaaataactagtcatcacaacagcagttctttgtaataactgaaaaagaatattgtttctcggagaaggatgtcaaaagatcggcccagctcagggagcagtttgccctactagctcctcggacagctgtaaagaagagtctctggctctttagaatactgatcccattgaagataccacgctgcatgtgtccttagtagtcatgtctccttaggctcctcttgatcttcctcagaagaataggcttgttgttttacagtgttagtgatccattccctttgacgatccctaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaaagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaa

SEQ ID NO: 3228 - DNA, 712 bp, Homo sapiens
tcggccacccagccgtctcctgtgaaggccatatttgataaacaggaacttgaggaaagaatgtccagatgttgtttttggagaagaagaactacaaagttagagcaaatactcttatttataagaagaatgaactcagtgtgtgagaaggagaatacaaatgcaacagcctcaaattagcagtggatgcctactgggcttctgcaaccgctttccacggcaaactctcaaagcttgagctgttgctcaggttttccctagggaagtgttgatggtgtcctggggacactgcactgcagtcatggccagcaagccttgtaaatacaaagcatggtacaggatatgcatgataaaatcaccttgctcaaataaatgcagcaggaaaaatggatttcatcttctgattcctttaggttccaccagatggctagctggtaatgacccagacacctctgagtaaactcccagaaagcctgacaaatatgttgcaaacttagccatatgtagagtggctacaccacatttgcaacgctctcttaacagcatgaccttctttaatagtgatcacttccatttttaggccctttatgcattacttttgtcattttatattgcttctttttttctgatccttgcaaaaaccctgccaagaaagcaagaaaatatgtttccccctcaggacctggacaacatcagatagaatgtgtcacat

SEQ ID NO: 3229 - DNA, 202 bp, Homo sapiens
cgggagacccgaggccgcccagagccctccccgggagacccgaggccgcccagggccctccccgggagacccgaggccgcccagggcccttcccggggagacccgaggccgcccagggccctcccgggagacccgaggccgcccagggccctcccgggagacccgaggccgtccagaatcttggattccaaagatccgctaa

SEQ ID NO: 3230 - DNA, 4885 bp, Homo sapiens
agaccccgatgtatcaaatccgaggtcaggcagtggtcctgaagctgagcaaatgtatgtggaagcaggctcaggcctagcggcacttcgcctccttcacacagacccccgccggacaccgcgccctgccgcgactcacttagcaagtctcgcggattaggtttgatcgcattcggccctttcccggatagctcgtcgcggatacttctcacagcgaagcagcagctcccagaagccgtaaagctatcccagagcgaggcaccatacgtaaatcttccgcgtcgctacgtgacgtcagtgcgagcgaccccgggccggctgcgtggagctggcgctgcctctcctgaagccgaggcgctaacttgagtgaagaggtctataggctttttcacttttggttatctgctcaggcgctccttggggtcgcgcatggtctcggacagggtttgcaaggacttcggagctaaccagtttggagccataaccctttcgtacttgccaaaaaactctgggcaagactcttgaattttgagccgcagtattctcgttcataaggtgcctgatgtcctccattacagagaccccgttttactcctgagcaataaaaaaaggcttcagaataaggcgggggccgggggtggcataaaggatataacactctcctaaatgaacttccagtccttttaggtaccctcttcacttctacttcctgaagccagtttcttagttttttagggggttctgtgatacaaatagaattgcttgttggttttgctcactgggggtttagaattcaggtttttcaagtcaactgagccctttgctattgattccagaatttcatttccattattccttttctttaatccttaagggtgtatgactttaaaaatcctgttactgtcattttcagggagtcttagggagcaaatgtagaacactatgtttaagacagcatttttacctgataatccaaggtgatcattctaaaacatataccagatcagtcatagcattcttctatgagaataagaagcttcaatgatccctcgttgcctgcataacattcagactcttcagcaaggtaaacaagagagttcattttctttccaacctgatatctcacagcaggccactgctcccccacccatcttccacattccccacacctgatactgtaaactctagtcataatgaaaggctagtaagagttctgagaatacaaagtccttatcatgtttccacacctgttttggctgggctcaggctgaaatacccttctttctccatgcctgcttgatgaaaatacagcttaaacatgacttcctcagtgatgcctttcttcaagccctaaagaataatttatccagactcctccaaactccatcccacgaacccatcatactcttgggaggggtcatttgtcatgggacctgcaaattctgggtttgccaagaatgtaaggtcctaactgctctttacctagatcatttttcagggttgtttgggatgatcagtttcatagctgaagtattcttcccaaagagtaggcttgcttccacttaactacaaaagtatggaatcccccaaactcagtattcctctcctataatgtaacccactgactgcatgtgcagacatccatggaagcccatcttcaccatcctggtgggacttgggggacatggaaaatgcataaacatgaagttctggcttctgcttttgccataaattacaaagttctttgtcacccaggaatccaagtttactgccataaaacagttaacaggctatcttactaactttaaaataggtttcaataccagacccttcccagacagcgacatatatttcttacagcatcagttgttactgttgctgcattatttccaaatctgacctcctatactaaatagcacccttatagcagggattcatgtcttaggcgcttgtttcccaaactatttttttttttactcagctccatccacttacactgttccagttgcagggaaatatcaaatgcccaccctgtaccctgctgatattttgtaccttgactggcacactctacttattttaaggcttatctctcagttgtcaatgtcattgtttccttaaaaagttcaaaaataatttggaaaatccttgaccctacctgaaacaaggttaggtcctcctgttatgtgctgttgtaccacatatcacagttgggataataaggcattgtgtgagttactctaagtgttcagctgctcaggagaaggcagagagcaaattagtggttgagtttttcaggcttggtgttttgacaggtgtattagtctgttctcacattgctttaagtaaatatctgagactgggtaatttataaagaaaagaggtttaattgactcggttccacatggctggggagccctcaggaaacttaaaatcatggtggaaggcacctcttcacagggcacgaggaaagaatatgtaactatggaagtacactggaaggccaggagtggtggtggctcacacctgtaatcccagcactttgggaggccgaggcaggtggatcacgaggtcaagaaatcaagaccatcctggccaatacagtgaaaccgtctctttgaaaaatataaaaattaatttggcatggtgacacacgcctgtagtcccagctactctggaggctgaggcaggagaatcacttgaacccaggaggtggaggttgcagtgaaccgagattgcgccactgcactccagcctggtgacgaagtgagactccatctcaaaaaataaataaataaataaaaataaacctcactgtttgttttaacaataacaagcgtggtaagggtggtgtcagtccataagttagataggcagttgctaggcagatgtcgttgcagaagtatgtgtgtgtgtgtgtgtgttgtgtttaaggttgtggtggcctttgtgcaggttgtaaatttttgtagtcttttgatagttcttgttatcaaccatatgtacatgagaacccttccccttcatggcgtttcctggctccgtttgccagggttttaatacgagtgactccattttgaatctgacaactttcacatttccccttttgatcaaggtctttctcaaaagcatcactgatcaatcatcctgtatttaggttttgatatctcttggtgccagtctgccctcatgttgaagggagtcactggtaactaggaattagcatcaaaaccctttagccacatttgaacaacaaaagaggtttggagggagtggatctcaggctaagtctacctggagtccactgttaagttcaattctgtctgttccataggcactgtctatcatctcaaagtgctgggagagcattattctcttaggagttgcatttctatgcaaatttgacaagaaacaggtataaagttcttaaaaaaaaaaaaaagaaaatacaaagtaacaatctcagcataatagttttcagccgtgaacctaggcttaaagacaaccagttgaataaatcaaatgatcatgaagaattaggtgagacttattataccatgtgggctattttcttattttgtgtatataaattccccaaaggaatgtatccaggtacagcatgtagtatgagcaaaagcacagacatctctttgtttagctggtacacagcaatcctattacttagcattccatgactggcttgaattaaagcagagagagctaactctgttttaaaaaagaccattagtacaatttgaacaaaaagtttactgaggatgttgccagtattaccccctgggtggactaaaggatttatgaagtcagattctgtcaagtcacccacaatatctaccgattgtgaaattatcctgccaaatcaaagaggtaggcataaacaaggaagaattaagaggggcaagagtgtcattaggatggggagttatgttccatcatcttgggaaaagctgcccacagtatggagatgttagcttttcattctggtttacagttttaatgtctctggttatagcattgggcagttttgtgaacctttgggcatgagatttctcccttaaaattcagttaagtttgagcttgggctttaagaacatagcaagtctcgtttttagtaattctatggaagaaagttggattggaggaacctagaagaattaaagatccagtccagcgaccaaggtttacctagttgcacagaaattttcttaacactggcaggtgccctactagtaatctttcttgtctgtgaccagtttatccttaacatgggagactttttctttggataccttcaatattttcagagtggtattttcagagtggtgcctttcacttagttaatatgcatttatgttccttctgtcatttaatggcttgattgctcatttcttttaagcactgaataatattctattgtctgaatgtactacagtttatctattcatttacctacccaccctgacactttgaatctaatcctgctcttccatgacactccctctttccccatagtgcttcctaggaacttgccacgatgtagtgcttacttagtactgcttttctaattacttaatttgtccctcatagtcaaccagcagttttgcctggttcataagagatggcctatttattgaaatgcctggatcagagaaataagatatgactagctggtgccaagaatggagcctggaagttgtctccatgctgtttaccataaagcactaactaaagtcactatttaaaaaaaaaaaaaaaaggacacacatatttaaacatacttattacacatatttatcaacaaggcatcacaaataagtcacaaaaagtaggcttagtttagttcacaatataaatcccgtgaaaacac

SEQ ID NO: 3231 - DNA, 1943 bp, Homo sapiens
aaagccagctgggctcctgagttcggtgggtacttggagaacttactacgtctagctggaggattgtaaatgcaccaatcagcatgctgtgtctagctcaagaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacaggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccaggatccacctctgatgttcagtgaagaggaccggaaaagtctgctagagcagtaccatctgggtctggatcaaaaacgcagaaaatacgtggttggagagctcatctggaattttgccgatttcatgactaaccagtccaaggatgaaggaaaaactggacctcattatggatttacttttgggatacactcattattccagaggagggtaaaaggctgagaagcttaaggtgtcagtttcttggtcgggaatgaaaatagtgccaacctgtgataccttcactctaattttactttctgaggaagttttctgtaatagttatttggtgataattattaatactggtgagaaaatcaatgtaaaagaggagaaataacccacacaaccacatacaactaggaaatgatagatggatctgaaaaaaaggatatgcactcttaacaagttcaacacccaagtactattgcaagtaccagctgtatttcatggaaaaaaaaaaaagaataactcaaaaggcagaacgaagagcctagaggtcagagatgagaggcatgaataattattcacaggcgttgaatataatcaaatgacttgcaacatttaccactgggattttaaaatgtggtggaccaatcattcttttagtctgtgcattttcccatttttttcaacaggaatgtctagagacattattcctgttttgccactgtatttttggtgaatgtgtagtaagtaactggcctctttagtatcacaaagctggatgaagaaaatgtggtacatatacaccatgaaatactatgccgccacaaaaaggaaatgagatcatgtcctctgcagggacatggatgaagctggaagccattatccttagcaaagtaacgcaggaacagaaaaccaaacaccacatgttgtctcttagaagtgggagctgaacggtaagaacacatggacacagggtggagaacaatacacactggggcttgatggggggtggaggggagggatggggagcattagaaaaaataactaatgcatgctgggcttaatacctatgtgatgggttgataggtgcagcaaaccaccctggcacatgtttatcaatgtaacaaacctgcacatcctgcacaggtactccaaaactaaaagtaaaaaaatctaaaagaaaaaaaaaaaagaattaaacccaaaatcacttcccca

SEQ ID NO: 3232 - DNA, 612 bp, Homo sapiens
tgaaactacaatttgttgagcactgaccatgcaggaaacccgtttttccccgttttctcttttgtgctcacagcacctcctggagtaggtgttcctatcatcctctctttatagctcaggagccaaagctcagccagcccgaaggagccaggattagagcctgcatggatgcaacagtcacgcttctctctattacgtgtcttgcaacttggagtcacatgatctcagcatctgatccaccctgggctcagaacctcccagaacctcccagaatcgaggctcacggcagaggttctgcactcaccaaggacgcggggggaccatgtctgtgctcatgtggatccccgctgctgggcagagcacaccacacatccagactcaacaaaatacatggagtcaaaggtcaggtgactgaatcaatgagtatgttacacaccaagaaagacccctcctctctgcaccccggggagcagccccagaagcctggtctcctccaggatgaaaatgcaaacgcaggtgcctgggggctcccagagcctttggcttcacggttccctcccggccctgcctggagcttcatgtgcctccccttttgcttaatgagagccgctg

SEQ ID NO: 3233 - DNA, 16923 bp, Homo sapiens
ccgtggcaaggaccagaatggatcacagatgatcgttggccaacaggtggcagaagaggaattcctgccttcctcaagaggaacacctaccccttggctaatgctggggtcggattttgatttatatttatcttttggatgtcagtcatacagtctgattttgtggtttgctagtgtttgaatttaagtcttaagtgactattatagaaatgtattaagaggctttatttgtagaattcactttaattacatttaatgagtttttgttttgagttccttaaaattccttaaagtttttagcttctcattacaaattccttaacctttttttggcagtagatagtcaaagtcaaatcatttctaatgttttaaaaatgtgctggtcattttctttgaaattgacttaactattttcctttgaagagtctgtagcacagaaacagtaaaaaatttaacttcatgacctaatgtaaaaaagagtgtttgaaggtttacacaggtccaggccttgctttgttcccatccttgatgctgcactaattgactaatcacctacttatcagacaggaaacttgaattgctgtggtctggtgtcctctattcagacttattatattggagtatttcaatttttcgttgtatcctgcctgcctagcatccagttcctccccagccctgctcccagcaaacccctagtctagccccagccctactcccaccccgccccagccctgccccagccccagtcccctaaccccccagccctagccccagtcccagtcctagttcctcagtcccgcccagcttctctcgaaagtcactctaattttcattgattcagtgctcaaaataagttgtccattgcttatcctattatactgggatattccgtttacccttggcattgctgatcttcagtactgactccttgaccattttcagttaatgcatacaatcccatttgtctgtgatctcaggacaaagaatttccttactcggtacgttgaagttagggaatgtcaattgagagctttctatcagagcattattgcccacaatttgagttacttatcattttctcgatcccctgcccttaaaggagaaaccatttctctgtcattgcttctgtagtcacagtcccaattttgagtagtgatcttttcttgtgtactgtgttggccacctaaaactctttgcattgagtaaaattctaattgccaataatcctacccattggattagacagcactctgaaccccatttgcattcagcagggggtcgcagacaacccgtcttttgttggacagttaaaatgctcagtcccaattgtcatagctttgcctattaaacaaaggcaccctactgcgctttttgctgtgcttctggagaatcctgctgttcttggacaattaaagaacaaagtagtaattgctaattgtctcacccattaatcatgaagactaccagtcgcccttgcatttgccttgaggcagcgctgactacctgagatttaagagtttcttaaattattgagtaaaatcccaattatccatagttctgttagttacactatggcctttgcaaacatctttgcataacagcagtgggactgactcattcttagagccccttcccttggaatattaatggatacaatagtaattattcatggttctgcgtaacagagaagacccacttatgtgtatgcctttatcattgctcctagatagtgtgaactacctaccaccttgcattaatatgtaaaacactaattgcccatagtcccactcattagtctaggatgtcctctttgccattgctgctgagttctgactacccaagtttccttctcttaaacagttgatatgcataattgcatatattcatggttctgtgcaataaaaatggattctcaccccatcccaccttctgtgggatgttgctaacgagtgcagattattcaataacagctcttgaacagttaatttgcacagttgcaattgtccagagtcctgtccattagaaagggactctgtatcctatttgcacgctacaatgtgggctgatcacccaaggactcttcttgtgcattgatgttcataattgtatttgtccacgatcttgtgcactaacccttccactccctttgtattccagcaggggacccttactactcaagacctctgtactaggacagtttatgtgcacaatcctaattgattagaactgagtcttttatatcaaggtccctgcatcatctttgctttacatcaagagggtgctggttacctaatgcccctcctccagaaattattgatgtgcaaaatgcaatttccctatctgctgttagtctggggtctcatcccctcatattccttttgtcttacagcagggggtacttgggactgttaatgcgcataattgcaattatggtcttttccattaaattaagatcccaactgctcacaccctcttagcattacagtagagggtgctaatcacaaggacatttcttttgtactgttaatgtgctacttgcatttgtccctcttcctgtgcactaaagaccccactcacttccctagtgttcagcagtggatgacctctagtcaagacctttgcactaggatagttaatgtgaaccatggcaactgatcacaacaatgtctttcagatcagatccattttatcctccttgttttacagcaagggatattaattacctatgttacctttccctgggactatgaatgtgcaaaattccaatgttcatggtctctccctttaaacctatattctaccccttttacattatagaaagggatgctggaaacccagagtccttctcttgggactcttaatgtgtatttctaattatccatgactcttaatgtgcatattttcaattgcctaattgatttcaattgtctaagacatttcaaatgtctaattgattagaactgagtcttttatatcaagctaatatctagcttttatatcaagctaatatcttgacttctcagcatcatagaagggggtactgatttcctaaagtctttcttgaatttctattatgcaaaattgccctgaggccgggtgtggtggctcacacctgtaatcccagcactttgggaggctgaggtgggaagatcccttactgccaggagtttgagaccagcctggccaacattaaaaaaaaaaaaaagtaagacaattgccctggaatcccatccccctcacacctccttggcaaagcagcaggagtgctaactagctagtgcttcttctcttatactgcttaaatgcgcataattagcagtagttgatgtgcccctatgttagagtagaatcccgcttccttgctccatttgcattactgcaggagcttctaactagcctgaattcactctcttggactgttaatgtgcatacttatatttgctgctgtacttttttaccatgtaaggaccccacccactgtatttacatcccagctggaagtacctactacttaagacccttagactagtaaagttagcgtgcataatcttaggtgttatatacacattttcagttgcatacagttgtgccttttatcaggactcctgtacttatcaaagcagagagtgctaatcaatattaagcccttctcttcgaactgtagatggcatgtaattgcagttgtcaatggtccttcaattagacttgggtttctgacctatcacaccctctttgctttattgcatggggtactattcacttaaggcccctttctcaaactgttaatgtgcctaatgacaattacatcagtatccttccttttgaaggacagcatggttggtgacacctaaggccccatttcttggcctcccaatatgtgtgattgtatttgtcgaggttgctatgcactagagaaggaaagtgctcccctcatccccacttttcccttccagcaggaagtgcccaccccataagacccttttatttggagagtctaggtgcacaattgtaagtgaccacaagcatgcatcttggacatttatgtgcgtaatcgcacactgctcattccatgtgaataaggtcctactctccgaccccttttgcaatacagaagggttgctgataacgcagtccccttttcttggcatgttgtgtgtgattataatcgtctgggatcctatgcactagaaaaggagggtcctctccacatacctcagtctcacctttcccttccagcagggagtgcccactccataagactctcacatttggacagtcaaggtgcgtaattgttaagtgaacacaaccatgcaccttagacatggatttgcataactacacacagctcaacctatctgaataaaatcctactctcagaccccttttgcagtacagcaggggtgctgatcaccaaggccctttttcctggcctggtatgcgtgtgattatgtttgtcccggttcctgtgtattagacatggaagcctcccctgccacactccacccccaatcttcctttcccttccggcagggagtgccctctccataagacgcttacgtttggacaatcaaggtgcacagttgtaagtgaccacaggcatacaccttggacattaatgtgcataaccactttgcccattccatctgaataaggtcctactctcagaccccttttgcagtacagcaggggtgctgatcaccaaggccccttttcttggcctgttatgtgcgtgattatatttgtctgggttcctgtgtattagacaaggaagccttccccccgcccccacccccactcccagtcttcctttcccttccagcagggagtgccccctccataagatcattacatttggacaatcaaggtgcacaattataagtgaccacagccatgcaccttggacattattggacattaatgtgcgtaactgcacatggcccatcccatctgaataaggtcctactctcagatgccctttgcagtacagcaggggtactgaatcaccaaggccctttttcttggcctgttatgtgtgtgattatatttatcccagtttctgtgtaatagacatgaaagcctcccctgccacaccccacctccaatcttcctttcccttccaccagggagtgtccactccatatacccttacatttggacaatcaaggtgcacaattgtaagtgagcataggcactcaccttggacatgaatgtgcataactgcacatggcccatcccatctgaataaggtcctactctcagaccctttttgcagtacagcaggggtgctgatcaccaaggccccttttcctggcctgttatgtgtgtgattatatttgttccagttcctgtgtaatagacatggaagcctcccctgccacactccacccccaatcttcctttcccttctggcaggaagtacccgctccataagacccttacatttggacagtcaaggtgcacaattgtatgtgaccacaaccatgcaccttggacataaatgtgtgtaactgcacatggcccatcccatctgaataaggtcctactctcagaccccttttgcagtacagtaggtgtgctgataaccaaggcccctcttcctggcctgttaacgtatgtgattatatttgtctgggttccagtgtataagacatggaagcctcccctgccccaccccaccctcaatcttcctttcccttctggcagggagtgccagctccataagaaccttacatttggacagtcaaggtgcacaattctaagtgaccgcagccatgcaccttggtcaataatgtgtgtaactgcacacggcctatctcatctgaataaggccttactctcagaccccttttgcagtacagcaggggtgctgataaccaaggcccattttcctggcctgttatgtgtgtgattatatttgtccaggtttctgtgtactagacaaggaagcctcctctgccccatcccatctacgcataatctttcttttcctcccagcagggagtgctcactccataagacccttacatttggacaatcaaggtgcacaattgtaagtgaccacaaccatgcatcttggaaatttatgtgcataactgcacatggcttatcctatttgaataaagtcctactctcagaccccctttgcagtatagctggggtgctgatcactgaggcctctttgcttggcttgtctatattcttgtgtactagataagggcaccttctcatggactccctttgcttttcaacaaggagtacccactactttttaagattcttatatttgtccaaagtacatggttttaattgaccacaacaatgtcccttggacattaatgtatgtaatcaccacatggttcatcctaattaaacaaagttctaccttctcaccctccatttgcagtataccagggttgctgaccccctaagtccccttttcttggcttgttgacatgcataattgcatttatgttggttcttgtgccctagacaaggatgccccacctcttttcaatagtgggtgcccactccttatgatctttacatttgaacagttaatgtgaataattgcagttgtccacaaccctatcacttctaggaccattatacctcttttgcattactgtggggtatactgtttccctccaaggccccttctggtggactatcaacatataattgaaattttcttttgtctttgtcagtagattaaggtcataccccatcacctttcctttgtagtacaacagggtgtcctgatcaaccaaagtcctgttgttttggactgttaatatgtgcaattacatttgctcctgatctgtgcactagataaggatcctacctactttcttagtgtttttagcaggtagtgcccactactcaagactgtcacttggaatgttcatgtgcacaaactcaattctctaagcatgttcctgtaccacctttgctttagagcagggggatgatattcactaagtgccccttcttttggacttaatatgcattaatgcaattgtccacctcttcttttagactaagagttgatctccacatattccccttgcatcaggggcatgttaattatgaatgaacccttttcttttaatattaatgtcataattgtatttgtggacctgtgtaggagaaaaagaccctatgttcctcccattaccctttggattgctgctgagaagtgttaactactcataatctcagctcttggacaattaatagcattaataacaattatcaagggcactgatcattagataagactcctgcttcctcgttgcttacatcgggggtactgacccactaaggccccttgtactgttaatgtgaatatttgcaattatatatgtctccttctggtagagtgggatattatgccctagtatcccctttgcattactgcaggggctgctgactactcaaaacttctcctgggactgttaataggcacaatggcagttatcaatggttttctccctccctgaccttgttaagcaagcgccccaccccacccttagtttcccatggcataataaagtataagcattggagtattccatgcacttgtctatcaaacagtggtccatactcccaacccttttgcattgcgccagtgtgtaaaatcacaggtagccatggtgtcatgctttatatacgaagtcttccctctctctgccccttgtgtgcccttggcccctttttacagactattgctcacaatctcaggtgtccatatttgcagctattaggtaagattgtgctgtctccctcttcccttccctctgccctgccccttttgcctctttgctgggtaatgttgaccagacaaggccctttctcttggacttaaacaattctcagttgcactttccttggtcccacccattatacatgaacccctctacttcctttcgcattgcttctgagtatgctgactacccaaagccccttctgtgttattaataaacacagtactgattgtcccatttttcagcccatcagtccaagatctccctaccactttggtgtgttggtgcagtgttgactatgaaaagcaggcctgaactaggtggataagccttcactcattttctttcatttattaatgatcctagtttcaattattgtcagattctggggacaagaaccattcttgcccacctgtgttactgctttactgtgcaaaatactgaaggcaagtcagacccagggagctggattgccatcctttattttgtgtttccagtgtacactataaaattgtctccccaggaaggaaggttggcactttctctgcattcttctttccagagcagattgcctggttaagaatctcttgttgtcccctttgtatattgttattgtaaagtgccaaatgccaggatacagccagaaaaattgcttattattattaaaaaaatttttttaagaaagacatctggattgtagggtggactcgataacctggtcattatttttttgaagccaaaatatccatttatactatgtacctggtgaccagtgtctctcattttaactgagggtggtgggtctgtggatagaacactgactcttgctattttaatatcaaagatattctagagtggaactcttaagaccagtatctttgtgtgggctttaccagcattcacttttagaaaaactacctaaattttataatcctttaatttcttcatctggagcacctgcccctacttatttcaagaagattgcagtaaaacgattaaatgagggaacatatgcagaggtgcttttaaaaagcatatgccaccttttttattaattattatataaaatgaagcatttaattatagtaataatttgaagtagtttgaagtaccacactgaggtgaggacttaaaaatgataagacgagttccctattttataagaaaaataagccaaaattaaatattcttttggatataaatttcaacagtgagatagctgcctagtggaaatgaataatatcccagccactagtgtacagggtgttttgtggcacaggattatgtaatatggaactgctcaagcaaataactagtcatcacaacagcagttctttgtaataactgaaaaagaatattgtttctcggagaaggatgtcaaaagatcggcccagctcagggagcagtttgccctactagctcctcggacagctgtaaagaagagtctctggctctttagaatactgatcccattgaagataccacgctgcatgtgtccttagtagtcatgtctccttaggctcctcttgatcttcctcagaagaataggcttgttgttttacagtgttagtgatccattccctttgacgatccctaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaat

SEQ ID NO: 3234 - DNA, 37027 bp, Homo sapiens
taaaaatgtaaaagatcagctgggtgtggtggctcacacctgtaatcccagcactttgggaggctgaggtgggtggatcacgagatcaggaattcaagaccagcgtggccaacatggtgaaaccctgtctctactaaaaatacaaaaattagctgagcatgatggtgcacactgtaatcccagctactcagcaggctgtggcaggagaatcacttgaacccaggaggtagaggttgcagtgagccgagatcgcgccagtgcactccatcctgggcaacagaacaagactccaactcgaaaaaaaaatcaataaaaatgtaaaagatcattcttagcttggaggctataaaaaaggatgcagcatgtcagatttggcccattagctgcagtttcctgacctctatctacctcaattggttctttacttacattacatggaaagtgcaaacttggatggcttcaatgtctggcttcttttatttatttatttatttatttatttatttatttatttattttttgagacggggtctcgctgtggcccgggctggagtgcagtggcacgatctctgctcactgcaagctccacctcctgggttcacaccattctcctgcctcagcctcccgaatagctggaactacaggtgcacgccaccacgcttggctaattttttatatttttagtagagacggggtttcactgtgttagttagccaggatggtctcgatctcctgacctcatgatccgcccatctcggcctcccaaagtgctgggattacaggtgtgagccaccgtgcccggctggctggcttctttttacccttcacatctggctttaaatactaccttttcacagatttcttctctaatcactctttctaaagtaaatatgctgtttttcattattagtcattgcatcctatttctttccctttaattttcttatcacaatgtataattatatgtttttttttttttttggttattgcctgtctccctcaatagatcataagttccatttgataaggtacaatgtctgttggtttattagccagtgcctaacactaccatttaatatgtattcaatgaatatttgttaaatgtattgattgaatttaaagtgactactcagcctacttctgccccttggagcttggattgtttcttcaaaggtattgatccttttgactattttaattatgaattcactaaagacatctggaaggcttattgtgtcaagcagtgccaaatccatggcttgatgaacctagatccatccccttcccctttccatatcacagatgacaacttgatggttggcctatgacttgtaaaagttgtcatatttgaattctgaaatttctctaattttcttgggaagcagaaaggaaaaattagtagttggcctcaaagggacagttgaatttcacatataatgagcaaagtagtgtgaggaagagaggagggccttttcttttgaggtcataactaaaagttaggtgagcaaatgccataagcatgaaaatagcaaaccaagcttcttggtttctatccaaaggctttgttgggaaaagtatcaaagtgtgttcatttgttatgtaatatataaggtagagaacccaatttgaaggaggtggaataactttccaaaatacttatggctaaattctcagttgatcttggaataagattcaagaatccaaatgcacccttctttgttatcttgctagaaaacatgctgggcatggtggctcatgcctgtaatcccaacacgttgagaggccgaggtgggcagatcacgagatcaggagttggagaccagcctgatcaacatggtgaagccccgtctctactaaaaatacaaaaattagccagacatagtggcacgcacctataatccgtgctactcaggaggtaggcaggagaattgctggaacccgggaggtggagtttgcagtgagccaagatcacaccactgcaatccagcctgggtgacagagcgagactctgtctcaaaaaaaaaagaaaagaaaaaagaaaagaaagaaaaaagggaagggaaggaaaggggggaggggagggaagggaagggaagggaaggtaagggaagggaagggaagggaagggaaaagggaaaacaatgtgcttttacccacagctgataagcttttctaattgtctacctttgggttaaactttatcattgagtgtttttatcccattatgaaagaattaaggtttgaaggactgaggtaagggtggatatttactcttaattgagtagcttaaccaagtcaagccacagattagctgaagccaaaaagcactggcagcatttgaaataactgagaacatattatacttaacactttattatctaagagaggcacttgaagttgagacctagaaatttgattctgggttctttgtttctaaggggcagggtgaacccagctatagcattcacagatgctatagaattatatatattctatatataattatatatattacattcatattaatatatgttaatatattctatattattcatatagaattcacagataatccaagtgcttttttaatacattgataccaaatctctcctgctctcaaaaaaaaaagcccaaggcaaaaatttttgattagcctgtatccgcaaattcatagtgcatggcatgatgggtactctacatccctcctcctattgcactcactgtgcccagatgaacctaaagtcaccagtaatagtgctaatgtagtaatgggcccaagcttcaaaagaaggaaaattagtattcagtatttaaatgtgggaaagaggaagaatatggaaattatcaattttataatacctatacatattcttacctgcattaatgtgaatagacatcaatgataaacagaataatgccccataaagatgtctacactgtaatctccaaaacttataactatactatatcacatggcaagagggaattaaggttactaatcagctgaccttgagatgggagattctcctggtttgtatgggtgggcccaatgtaatcacagggtccttataaatggaaaaggcagacaggagattcagtgtcagactgatacaatgagggaaagactaccagcagttgatggctttgaagatagaagaagggggccatgagccaagaaatgtgagtagcctctagaagctgaaaaaggcaagaaaacggattcttccctagaatctccagaaatgcagccctgccaacatggtgattttaactcaatgagatgcattttagacttctgacatctagaattgtgttattttcagccctcaagtttgtggtaatttgttacagcagcattaagaaaatgtacaatgaccatgtgcagtgcctcatgcttgtaatcccagcactttgggaggccaaggtgggtggatcgcttgagtccaagagttcgagaccagcctgggaaacatggtgaaaccttgtctctacaaaaacacaaaaattagcctggtgtggttgtgtggacctgtagtcccagctactctggaggctgaggtgggaggatggcttaaacccataaggtggagattacaatgagccaagatcatgccactgcactccagcctggacagtagagccagaacttctctcaaaaaaataaaaaagaaagaaactatacaatgctcctgtgattctagtgctatgtacatatatcctttatagggaattaaggaggttatagacacaaccagaagaggaggcatggaatagactaatgtataatggataggaaagtgtatcttttacaacttctctgtaaaaacaccttcacctactttatgagtttgcctcagctgccataacaaaatatcagaccaagtggcttaaataacaatttattttctcacagttctggaggctagaagtctaagatgaaagtgccagcaagtttgatttctggtgaagtctctcttccttgcttgccaatggccgctttctcactgtgtcttcaaatgtccttcctctgagtatgtgaggagagagaggtttgatgcctcttcaccttcttataaggacaccagtcctactggattagggctccacccttatgacctcatttaaccttaattacctccttaaaggttctatctccaaatacagtcacatttggagtcagacctacaacatatgaattttgagaggacacaattcagtctataacacctagatggaaggcaatttcatataaagatgatatgcagtctatgacagcaaagtagctagtggaaatcacaacccctaattctatttttatgtcattccctaagtccaggtcccatgtggatatagcattgttcagggctatctctttgctgttctttttttttttttagactcacacaagcaatgtggagaaggaacatgaaaacatctttgagatagagcttaatacagatgtcaatctctttgtaaataagcaattaaaagtggaaccactgtccaccatgtgagaagagtgactggctatggctggatatttttaaatacacataaaatgtggtataaatggtagaatgccagggatagaaggagtatcttataagttacctagtcaacgttctggcttctgggcagaaaactatctaaactcagccagataatcagtttcaactaaatcaggaaaacatggaatcatctttatctaggtagtgttatagttacattgcctcatttatctacacatcaataaattctttctcattgctaatatttatcattcttatcatagtataagcaaatgttttaattctattatggtaaagataaagcttctgtaattaaaacactttaatctggaaagacagcagtaaacccttcaagcaaaagcccaagtaggttcaaaaataatagccagagaggttaaaggtaaaccaatagagtgatatgttacagcaactaagggagagaggcaggagttttttaaaagagagaagaggaattataacaacagaaacaggttagccagctgccagtttagatgagcataatgagtcccttagatagatcattggtgatttttatcaaaacactatcggtggagttgtgggagtggtaggctgactatagtggattggggaattaaatagtgatgaacccaaaacagaaagtctgaagaaattccctttgagccaaaaaaaaaaaaggccgggtgcagtggctcacacccataatcccagcactttgggaggccgaggtgggaggatcacctgaggtcaggagttcaagacaagcctggccaacatggtgactctactaaacattgtctctactaaaagatacaaaaattagccggaagtggtggcaggcaacttaatcccagctacttgggaggcagaggcaggagaattgtttgaacccgggaggtggaggttgcactgagctgagatcgagccattgcactcaaacctgggggacaagagggagacttctctaaaaaaaaaaaattccctttgagcatctctactgtagagatgaaataagagagaagtggattctttagtatagagatggaaaggtatggagctagaacatgtgggttgtgaacagtggctaactaaaccaggaccagtaacctagatatcacattgggcttaattgctgggttattcattcattcaggcaacatgtatttgttgagagcctgaatgtgccaggtaatagaaacacaaaggtggttaaaatagaccttggcctctgtcttcaggaagcttccagtctgaagagggatgaagacatatattaatcaaacaatcccacaaatgcaggtataatctgcataaactgacaaatatatctactttggagtcaagaaattaagagaaatcactgatgtgatcagtgaacaagtaagatttattaggaagatggaaggatgacattacttcaaatatattacaggaaaccccaaccatggtaacaacatcaggcctatctttacatatgtttaataatgcttaacttcacttttgctcctatcctccccaaagcaatcttcaagttcttctgtatctttgttttattttctttgttcttttttgtctcatttcctatactgtttttattccatactttgacagttcagtgaactcctttgatagatcccaagtcctcctttttcaatatttacacttataatcatttttgatcactccaaaactgagaactttgagtgtagattttctaggcttcttattttatttttagacattatatagaaaaattagagggaagggaaaagaaggatggcaacatggtaactgggacagtgttcaaaaggtctaagtcctacttctcactccatacaaattatctgcaatttttttatttttgagacaggctcttatctctcacctgggctagagtgcagtggcacaatcatagctcactataaccttgaactccagggctcaagggatccttccatttcggcctcccgagtagttaggactacaggtgtgtgccactacacacagctagtttttaatttttttttattttcatagacacagggtctcactatgttgctcaaactggtcttgaactcctggccccaagcaatcctcctgccttggcctcccaaagttctagaattgttacaggaaagaggtcccaatccaggcccaaagagattttatttatgtactagtgtggagcctagcctaggacacatcaagcagaagtgcagataaggtctgactctttccagtacagctagggtgcctggctctccacatgtccccagaccttatctagaatctaatgtctccaaggtaggtacattgaataattttcaaaagtcaaggaagcagtttatgaccttaaagtagttagcaaacttaatatctgacctgactaatttagaccaaatgtttacatttttgaagatatttttattttatcagtaatctttaaaactattttctattttccaaagattacttaagtcaaatgaactaaaaggcattatacattttagttttctgatgaaatatctgatttaagcacttattatttttgaaccaattaaagcttttttatatcacacacacaacacatataaatacacagacaggctgggtgcagtggctcacacttgtaatcccagcactttgggtggccaaggcaggcggatcacgtgaggtcaggagtttgagagcagcctggtcaatgtggtaaaaccccatctccactaaaaatacaaaaattagctgggcatggtggaggatgcctgtaatcccagctactcaggaggctgaggcaggaggatagcttgaacccaggaggtagaggttgcagtgagccaagattgtgccactgcactccaggctgggtgacagagggagaccctgtctcaaaaaattaataaataaatacacagaagaagataaaggacttatcccctaaggcaggaatcaaaccctgaacacaggccaccattgtgaaaagaaaaagcacagccacatggttacaaggtcaagctcccaaggacatacaaaacaagaaggaaacctcatccagttttttcagggacctgcagcaaagtttgtacctgataaatttactgggccatcttgaacagcaggtttacaggtgtcctaagctcatgttctatcctaagatacccctctttatgacagaacaatacagaaagacacacaacagatttgctacaacttaagactagcctcataaatccattttttcactaatcaaaactttacagaggaaatgaacagtgatttttgccatccattcaaccagttttatagagagagagagaggaaagcattgcctgaggcagggtggggaaggcccggcactccgagtgccagagaaagccccacccattgcagcaacactgaaaagttcatgcagctgcttgtcagtcatgaacggattttttccagcagtcccatcagctctcatttccctttttaggagggaaaagctccccatgttctacaatcctctacatgcctaattctgtcaaccatagccatcagcaaagagtgcaaggcagatcaatccaaagagaatagcggttaacatcctataatgccaaacctgttcttagccgaaagggactttaaggagagggactttactgagagggacctctaaccccctaaatcttaaaagggactctaatcctcctaagttgggcctctaacccagtgtcagtcaagcatccttgccttttattgagaggaagctttaaccctctcttacgagagactctaactcccctaagttgagctataaccaatcccatcctttgcctgagtaccccaccacttacccaaagttgtccaattagtaatgctgcagtctatttcctttgtgctgggggtctcctcagtatcatcccttcgagtttcaccagaaagatgttatcaggccccaccacttacccaaagttagcctttggattgggggtttctgcattatagtcacttcagtggttgccaaaaagatgttataggacccccaacacttacccaaaattaacctttgggtcaggtatttctgcactatagtcccttctgtgataatcagaaagatgttataggaaaaggatcctgatccaggcccccaggagagggttcttggatcttgtgcaagaaagaattcagggcgagtccgcagtgcaaagcaaaaccaagtttattaggaaagtaaaggagtaacagaatggctactccatagacagagtaaccccaagggctgctggttgcccatttttgtgtttttttcttgatgatatactaaacaaggggtggattgttcatgccttcccattttagaccatatagggtaacttcctgacattgccatggcatttgtaaactgtcatggtgctgatgggaatgtagcagtgaggatggccacactaatgtgttttaagccttttcctcagccaaactacaaaaaagcaaaaattactttgtttcaatattacccctactggctaacacactagcaggtcatcagaatatttgccattcctacaaaattccaagattctgtgatgatcctttgagtataagaatcacagagatacacacaattgttacatgctctatttaagttttctatgttatattttctctttataccccccaccccatttcctgactctttctttttaaagggtctttgggatcatgaaagcaaaatgcagcatcctcagtgtcacacacgtccatgtgaagagaccaccaaacaggctttgtgtgagcaataaagctttttaataacctgggtgcgggcaggctgagtctgaaaagagagtcagcaaagggagataggggtggggcagttttataggatttgggtaggtagtggaaaattactgtcaaagggggttgttctctggcgggcaggggtggaggacacaaggtgctcagtgggggagcttctgagccaggagaatgaatttcacaaatgtcatcagctaaggcaggaaccagccattttcacttattttgtgattcttcagttgcttcaggccatctggatgtatacatgcaggcttgggctcagaggcctgacattcctgtctttttatattaataagaaaaataaaacaaaatagtgttgaagtgttggggcggtgaaaaattttttggggggtggtatggagagttactgggtgatgtttcttagggttgctttgagtgggattaggggtggcgtgggaacctagagtgggagagataaagctgaaggaagattttgtggtaaggggtgatattgtggatttgttagaaggaatatttgtcacatagaatgattggtgatggcctggatacagttttgtatgaattgagaaactaaacagaagacacaaggtcccaataacagaaggagaaaaacaggtattaaaggactaagaattgggaggactcaggacatccaatcagagtgcctaagggggttcagcgtgattattttcttggttgatgagtttttgggctctatccttgagtttttttatgttgtcatataccaagccagattgatttaggtaaaaacaacacttttcatttaaaaatacacacagtcccctttttttgagcagtaagtcaaggcctcagtgattttggaggaaagagaaatgcaaagccagcaatcattttttaaagaaggattagaaacagctaggagagagtgaatgagattgatagtgtggtggagatagctggggagaggtagagggtcgcataagaacaggaatgagaataagagtgaatataaaggtaaagaataggactttattagggtgaaagtattggagtgtaccttgtcactgaagatcttctatccacttcaagagagacttaaggaaggtggtttgaggtaaaaccaggagatatgagttatgatggtttggaggaaaagtgtaaactggcagtgtaaacaagggcagggcatttacgagtagttgagaatggtgaataggagtatgactagacagaagatagtagggatgacaagttttggggttgcagtccaagtagtgggggtgactgcataaagccttgttgcaataagtagggtaataaacttaatagaatgaaaggatgttttaggctcataagggttactactgttcttcagaaatgtgagtgagtttaagggaagtagggttgagtacttgcaacttctaggaggaagaggagagattaggctggctgtccaatggacacagctttattctggaatggtgagcctaatagggagggtcttacaggcggatggcagttggggtattatagatgactaagtagggtccggtctatcaaggttatagagtttgaggggtcagattcttaacaagaactgatcgtccatctagggtgtctttatatggctgggaatatggagtaggcaagaaaagattagcagcttggcaaatttcctgtcttgcctgctggaggaccagcagatagattcctagaggactggtgtctgagacgaggttggggccaagcaagaaagtgtgtctatataaaagtttaaatggactgtaccctctagcatctcaaggacaggctctaattctgagaaaggcaagaggtaaaagtactgtccaatcttttttaagttggaggctgagcttggtgagatgtgtctttaaaagaccattagtccattctacctctcctgaagattgagaatggtaaggggtatgaaggttccactgaataccaagagcctgagaaactgcttgggtgatttgactaataaaggccggtccattatcagactgtatagaggtgggaaggccaagcctaggaattatgtctgaaagaagggaagaaatgactatggtggccttctcagaccctgtgggaaagtcctctacccatccaatgaaagtgtctacccagaccaagaggtattttagtttcctgactcggggcatgtgagtaaagtcaatttgccagtcctgggcagggcaaattctcgagcttgatgtgtagggaagggagggggcctgaggaattcctgagtagtagtagtatagcagatgggacagagaagtgatttttttaggatagatttttacaaaggaaaggaaatgagaggttttaagaggcaggatagcagcttgcaacttacatggaaggggttacaaaatgacaacagaatagaataggcctgtgaggctggaaggagatattttccttgttccaagaaccatttgccttgtgtggaaagagattgataggtggaagtttcagtgggagagtaggtgggagtgacagatgagaaggagaaaaactggccatgagggacagaagttgggacactagctgcttctttagctaccttatcagcataagcactgtcctgagtgatgggatctgatgccttttgatggcccttggagtgaatgactccagcttcctttggaagtaaagtggccttgagaagagtttttattaaagaggcattaatgatggaggacacttgcatagcgaggaaacctcttttagcctacataacagcatggtggtgcaggatatggaaggcatatttagagtcagtataaatattgatgtgtagtccctttgcaagagtgagagcctgagttaaggcaatgagtttggcttgctgacaggtagtggaggtggacagagtggtaacatcaaggatagatgtggaagatactatagcatagcctgcctttgctaatgagtgacaattaggcctgatggaactgccatcaataaaccaagtgtgatcagggtgaggaacaggaaagaatgaaatatgggtaaatggagtgaatgtcaggtagatcagaaagatacagtcatgggggtcaggtgtggtatcaggaataatgtgggagccagcctaaaacagtaagatcaagttgcttggacagaaaggctacaggtcatggtcctggctcttgtgtaagaattctgaccgcacagccctgcacttcagctgtgtgtaatgaaaaagggttcagatgagttagggagagctagtgtgggagcagcttccagggctgttttaagaaatggaaaaaggagtggggaaaggatttaggatctatggggtcagctaggttttcttttgtgagtttatataatggtttagtcaggacagtaaagctaggtatttaaaggcaaaagtactgaaccatgctcaggaaagaaaggagttgttgctttgtcaagggggttggggtttgggagattagccagacacgatcagcagggagagcatgtgtgtttttatgaagaattatgtcaagatatataacggatgaggaagaaatttgggctttggaggcagatgtgcaatgtccttttgagaatagattgttggagcagcaggagggtgtcctgttgggaagatttgtaggaggggctataaagtagaaggtcatcaaaatatttaataaggtgagatgtagatggatggaaagagagtaaatcatgagaaagggcctgactgaagtaataggagctgtccctgaagccttgcagcagtacagcccaggtaagttgctgagactgatgggtgtcagggtcagtccaggtaaaagtaaagagggccttggaggaagggtgcaaaggaatagtaaagaaagcatatttgagatccagaacataataatgggttgtggaggggttgtgaagggaggtattaagaataagagagtatatgggtttggcaccatggggtggataggcaaacaatttggttgataaggtgcagatcctgaactaacctgtaagacttgtccggtttttggacaggtaaaatgggagaattgtaaggagagtttataggcttcagaagctcatgctgcagcaggcgagtgataacaggctttaacctttttaaagcatgttgtgggatgggatattggcattgagcggggtaagggtgattgtgttttaatgggatgctaaggggtgcatgatcggtccccaaggagggagtaaaggtgtcctatacttgtggattaaggtggggagatacaaggggaggatgcgaaggaggctttgaactggggaaaaggcggcaatgaggtgtggctgtagtccaggaatagccagggaagtagataatttggttaaaatgtcttggcctaataagagaactgggcaggtgggaataactgaaaaagagtgcataaaagaatgttgtccaagttggcaccagagtgggagagttttaaggggttttgaagcttggccgtcaatacccacaaccgttatgggggcaagggaaacaggcccttgaaaggaaggtaatgtggagtgggtagcctccatattgattaagaaggggatggacttaccttccactgtaagagttacctaaagtgtctgtgatggtccaggaggcttctgaggtgatcaggcagcgtcagtctccagctgctaagccaagcagatctgggaaagtgtcagtcagagagccttggaccagagctttaggggctgtaggagtagctgccaggtgagttggacaatcctatttccagtggggtcctgcatagatgggacatggcttacgaggaatcccaggctgcagcattccttggcccagtggccagatttccagcgtgtgaagcaagatcctgggggaggaggtctggaaggaatgcctgactgctgtggcttaggtgctatgaagttcttgtgtgctggagatgtggctggggtttctctcacagtggaggcaagtaattgcaactcttctctattattgtacaccttgcaggtgaggttgattaattcctgttgtggggtttgagggctggagtctaatttttggagctttttctaatgtcaggagctgactgggtgataaaatgcatattgagaatgagacggccttctgacccttctgggtctagctagggtggtaaagtgtctaagggttgttgccaaatgggccatgaactgggctgggtttttatatatgatgaaaaagagcctaaacactaactgatttgggagaggtcagctaaagaaaaaggagcattaaccttgactatgccttcagcttcagccacctctgtaagaggaaactgttgggtagatgggggagggctagccacagaacgcaactgtaagctggaccaggtgtgaggaggggaggtgatagaaggattatagggtgggagagcagaggctgaggaaaaattgggacctggctcagcctggtgaggagcagcctggggaggaggggagaggtcagatgggtctgtagaaaaggaggattcaaaggactcagagcttggggtggagactgaaggaagagacaggagagaaagaagaaagatttgggatgagtcacattgggagcagagattaggaaaagacttgttgcaggaagtcagggaccccaaatggagggaccggctgaagccatggcagaagaatgtggattgtgaagattttatggacatttattagttccccaaattaatacttttgtaatttcttatgcctgtctttattgcaatctctaaacataaattgtaaagatttcatggacacttatcacttccccaatcaatacccttgtgatttcctatgcctgtctttaatttaatctcaatcttgtcagttgaggaggatgtatattgtctcaggaccctgtaataattgcattaactacacaaattgtacagcatgtgtgtttgagcaatatgaaatgtgggcaccctgaaaaatgaacaggataacagcaattgttcagggaataagacagataaccttaaactctgactgccggtgagctgggcagaacagagccatacttctcttctttcaaaagcaaatgggagaaatatcgctgaattctttttctcagcatgggatatccctgagaaagagaatgcgcacctaggggtaggtctctgaactggcccccctggggcgtacctgtctcttatggttgagactgcaggggtgaaataaactccagtctcccatagcgctcccaggcttattagaaaaaggaaattcccacctaataaattttggtcagaccggttgatctcaaaaccctgtctcctgataagatattatcaatgacagtggtgccctaaacttcgttagcaattttaatttcaccttggtcctgtggtcctgtgatctcaccctgcctccacttgccttgtgatattctattaccctgttaagtacttgatgtctgtcacccacacctattcgcacactccctccccttctgaaaatccctaataaaaacttgctggtttttgtggcttgtggggcatcacagatcctaccgatgtgtgatgtctcccccagatgcccagctttaaaatttatctcttttgtactctgtccttttatttctcaagccagtcaatgcttagggaaatagaaaagaacctacgtgattatcagggcaggtcccccgatagggactgatgtgcaaaagaattcctggatatcaggcacctcagaccatttgcccattttacgacaagaattatctagatcttgtaggatggagaaatcgaaagtgctgttttctggctatttggaaccattgtcaagtttgtattggggtcaagtggtattgcagaagaaaataagatgtttaggttttaggtcaggtgtgagttgaagaggttttaagttattgagaacacagtctaagggtgaagatggaggaatggagggtggaagtttgcctatagtgaaggaggcaagccctgagaaaagagagggtagagacacggagagaaggggtggggggtacttgcctcccggggaggtggtgcttgccaccaaggtgaaggatcaaggcaggcatccccatggtgatcagacacctctgaaatgtgggtgaataatcaggcaggcatccccgcagtgattaaacactgagggaagactgtcttcccgagaccatgaccatcgtcagagttttgggttcacacataaaacatgtctcctctgtctctaccagaaaaggaaaggcactgaaattaagggaagggagagattgaagggtagcacagaaattgaaaggagaaagaggttgagggatagtgaaagaagttggagaagagagcaaaaagaggctgcttaccagatttaaaattggtgagatgttccttgggctggttggtctgaggaccagaggtcataggtggatctttctcacggagcaaagaacaggaggacaggggattgatctcccaagggaagtcccctgatctgagttatggcaccaaatgtcacgtgcatccgtgggaagagaccaccaaacaggctttgtgtgagcaataaagctttttaatcacctgggtgcaggcgggctgagtctgaaaagaaagtcagcaaagggagatagggatggggcagttttataggatttgggtaggtagtggaaaattacaatcaaagggagttgttctctggcaggcaggggtagtggtcacaaggtgctcagtgggggagcttctgagccaggagaaggaatttcacaaggtaatgtcatcagttaaggcaggaatcggccattttcacttcttttgtgattcttcagttgcttcaggccatctggatgtatatgtgcaggcttgggctcagaggcctgacactcagcagctactaccaccattggcaccactggcaccactgccaccaccccactgcaccccagttgcttcactctccatcacagaagccttttcagcaacagccaacatttgtaccctcaccaagccctctgattttcccaatcacaaggccttcactacaatattttcttcattcacaagtgtcacctattctccatccccaaggtaagtcaattctaattttcttgcaagggttgacagaggtaaaacctgtccagataccccaaaggtgtttcatcttggcaattcttgactctttcaaggaaataagaatagtcaaatataactaagtaaaataaataagaatatataaggtctgtaaaccaaaaatgaaattctaagccccccaaccaactgaatggacccctcctctcagccaagggcattctaaagttaacctgaaagactaattcaggccatgatggaagtgggtggtcaggcatgcctcattatatcctcctccctttggaatttagacacaaatgaccaacattaacattaaaacagagaccttaagattgacaaagtagactctttgtagcaataagatatgaacacaacagatagcaggccccaaaatatatttattcaacatatttttaaatggccctgcaaagctgtctcttgtggggaaacctacattctgtagagaatgcccttccctttccagatcttttcgcttatccaggagagaattaactaagagtctggtacctttttaagtctgataagaaacatttacaatctattctctctgaagcctcctacctggaggcttcatctgcataagagccttagtctcagaagccccttatgttaatgcagatactcccttctattgatttcaagactttaatcagaaaacctctgagtcttcctatgacctggaagcccccacttagagttgtcccacattttcagacccaaccaatgtacatcttacatgcattgattgatgtcttatgtttccctaaaatgtataaaaccaagctgtagcctgactactttgggtacatgttctcaggtctcttggagctgtgtcatgagctattggtcactcatatttacttggctcagaataaatctcttcaaatattttatagagtttgactctctgttgacaagtcctagttttaaaacagtttttatttcatttatttattttgagatggggtcttccctctgtcacccatgttggagtgcagtggcacaatctcagctcactgtaacctctgcctcccaggctcaggtcatcctgccacctcagtctcccaagtagttagaaccacatacgtgtgccaccatgtccagctaattttttgtatttttgatagagatggggtttctccattttgcccaggctggtctcaaactctctaagctcaggcaatccacctgcctcagcctcccaaaatgctgggactacaggcatgacccacagcgcccaaccaaaatgacttgtttttagacaagaggttagaaattttttttcctcaaagggccagacaataagtagattaggccagggtttctcaacctcaacagtattcacattttgggccagataattctttgttgtggagtgctttccttttcactgtagggtatttaactgcatccctgacttctactccctaggtgccaataacatcttattctcagttgtgacaataaaaacattttccagacatttctagatgtcccataggaggtaaaattgccctgaggtgagaataactggtatagactttgcattccatatgctatctgtcacaactactcagcagtgccattatagcacaaaagcagccatagacaatatgaaaatgaatggacatggtactttcccaataagtactatggaaactgaaatttaaatttcatataattttcacatgtaataaaatattcctttaaaaatttaagcatttagagatggaaaacccattgttagcttgtgggacaaacaaaaacaggtggtaagccatagctttccaactcctatttgttttatttttgaaagtttaataatatatgtaatttaaactactgtatccaaataatattattttaacatgtggtaattataaaaatcaattcataaattcagtatgtattttacatttataatacatctcaatttgtactagccacattttaagtactcaatagtcatatatggctagtagctaccatattgggccatgatgccctagagtatttgcttttaattattaggcatacttcctctcaagaggccctagtcattgggaacatgaggtcactttctctttgaaggtaaaagcctctaagtcctgttattgatctaaactcacacaaaaaaaaaaaaaactgaaagtaaggtttaaaagaccaccatgacaatatttatccaatttgtgactgtatttctgattggcaattcaaaattttgtttggcttagtaatttttcttgctatcttgaatagaattaatcccagaaggtctggtagacaatgagtgttttggtgtaactgggtttctttatgtacaaagctacagaattccccttgaagacactggccttgacatccctgaaatagcaaaatagacttttttgtttactccacgtgtagtatatgacagttagtgcattgtagatagggccatctattgaaatctacatgtgattatactctatcgaacatctactttaaaacagcaaacatgagagcctacaattgacatctcactgtttaaaaaaaacaatttcacatatatattcacaaacatactaaagtggtcaatattcaaagtaaagactcagatattcctcactttgcaccatggtttagttaaataatacaagtaccccaacaacacagtttaaatttcagttaccatggtatattgactgtgatattaaataaagtacaaatttcactgctaggttttcagtatgtaaattactatataactaacagatgtgcatcatgatcaattatgaatcacatcacttctttcacagtctttggtgactggtcacttatcagctattcagtacatgtgcagagaacaaaccatgtgtttgtgttgcctctttgtctgccagtgataaacccaagtgacatttaacaaaaacatataatgaaagagggaattggccaataaaaatgaaagctcaagaaagaaactaaagtcacaatgctggaaatgaaattcaaatcaaaggtaaatgaagttatagaggaaacagctgactgtgggaatgttgacactttcactggttggaaaggctatatagatatgaagccaaaggaacttagttaaagcagacattgacataaatgaggaatttggttgtgacaagcaatgcctattttagaccaatggcttgtatcctcattagggactgtcagtataccaaaagaatgggtgttaagtctaggaaaattataatcatcattaagttgacttttagttcccaagatttcctataattactgttttcagtatttagatattactgctaatggtaaaatggcctatgagtagaaaatatgaaatttacatttctctttatccaaatttcctagtggaaccctgcccctaacaatgtttaccacttcttactgtccattttcacagatatgggggacatgattacatgccctcaacccatatgttttctaggtaactctaccacagaataaagcggtactcaaattactctcagcttgcttaatatccactttaggacactgaaaaacaaacacaaagggactaaacaagatgaacagtacgtatcccatttcttttaagtccactatcttgatatcatgaggccccctcactggttttatgtagatgggctactggaatgcataagctagtgccaattcttattttccaaagatgttaaaagattaacataggatgggaggagagtgaggatcaaaaaatctacctatcaggtactatgctcactaccagtgtaatgaaatcatttgtacatcaaagcccatgacacacaatttacccatggaaatttacccattggcttttgctgcaaaagtaccccttgaacctaaaataaaagttggaagaaaaaaacttaacatagcaaattcttagacattgttctgacttgtttgcaagacctatgctttcttcctaagctggtgctggatagttcttttgacttttttcattattgatcttctctctccctagcattgccaccaagggaaactatttcatgtaagacattcttttccatccagccatctggttggccctaatttctctgagcacatctttcccacctgtattgtgaaccatagagcaggcctaagggaaggttataaagaaggtaaggttggtctgtattgtctcagtctcttttaatatctattcccttctgtatggtactccttcttctcagagactcctgttctctagcttcttcataatcggctttcaaaataggatctgctgtcagcgatttatccctttagtgctaggatggtaaataaattttatcttgcatgccaactctaaattattagtagcagccacctgaaatgctacgtgaaggattctggggatgcatccagttgaattagttatgagaagaaaaattggctactataggaaagagaatcaacaattcaatggattaaacaaaaagagtgttaattatttcttacatgacagtatcaatgtaaaaagttcaaatcagagagggaattctgtttcttagtcattcagggacttgatttccttccaagtcattgtactttcatctcatagggaatcactcccatctgtatactgaaactgggtagccattacatctgagttgcagctggtgggagaaagtatggaaaggagagcataccctatgtcttaggacccaggcatggaaatggcatacatcacttctactcacattttattgatcataacaatcatttggctgcacagaactgcaaaagaagctgaaaaatgtaccctagctgggcagccacacatcaagcaagaatgggagaatgtattttggtgggcaacgagcatttttgtcccttactaggcttaacaggaatcaatgctatgattaattaatgaaattttccacgagttggaaaaaaactgtggcatccacccatattatggtattagctgatcttgccttaagtgtgaaatggaagtcttgttttctttcctagagggtcctgaagtttaaatataattccaaaaaatttgacaggcattttccactatgagaaaggtacttttgttaggtacaaaaataaacttgtccctgctttatcacttaatgtagaatcaaagattcgtctccagataacagaatttcagacatcagctaccaaggagggaaaatataggcttgggaaagaaggccttcttgtatgaaatcacaccacacaggcactagacagctctacttatataaagtttagctctataaaaatgagattggggtgtttcagagattttattaggaaatgtacagagaaaacagttgatggggcaaaagctataaacactaaggtgagaaggaatcagaatataggcaagagttatagaagcatctaaatggcatttgtatctgtttaatcagcctatcaggtaaatctgcccacttttctccctaccagtgaacatctgttttgaacctctaggatatgggacctcttgcttgataccagtctttctgtgcctacctattctaaagcctgatgtcatcttctgtgccttcccttataggcttacttccttcaacgctgaccattcctccagcatttcttattctaaagaggaacaggtaagaaacttcgttggagggaaaattaagcaaggattggcattagagagggagctgtgcacagtccctgtctcaacaaaaatagcttaagatgagacaagtactttacttagcataatcttgctactgaaggggctattctaaatgtccccccgcccaacaccattatgtaaacattctctaatattcgctacttaatttagattatccacccttccttctggccattgcattccttatctagcaatgcaggaaaagggcaagaaatcaaagggaaggaataaagggacttctgtttccagactgtattttaaagggaagtcatggttggttagcgattttctttagcttttgctttgcgtttgcagaatagctaatattattgttttacctatgggaactggtatccaatctagtgcccaatggggctgttgttactagagctattttctgtgaacctcatagcagactctcttctgctgaaaatgagatttactattcattctgggttctctcaaaagccagcctgccatctacaattagcggtcacatccatttggctatagttcaggtaagtccaattcttcatgtcctgcttctcagctctctgctgctcagagccaaaaaccttatcttagaaccccaaaatacatgtctagttgctgtatcaaagaccaggtagcagcctttacagaaagtcccttttctcagaatctagttgagccaatactatgcagtgtccactatattcttcttggttcattctctttcttttggaggcaacagcttactatggtgaggacaactggaatccatctctacctattcaccactttttaagtagtaaaattggtagctcaaaagtaactttattccctgctaagtcttgctctttccaattattattcaaacatgagaggtgacagtgagaagattggtttggcattataggatggtaccatgcaaggtactctaacaaccggccttctgtctcatggtctatctccctgcagattcaggttgcatcagctgtcctcctatgtccacaatccaaatgctatgggatactatggcagacaagttttccagttcttcaggaagtagcaactgtgagtattctagctcacaatgggaggagcacaacgactggactccagccatgagcaaatacaagtaaaggtttaactgagactgtctgctccccagttctccaacccctgcctaccccaagcccctttttgtcttgatttatagtagaaaagtaatagtcggtcgggcgcgggggctcacacctgtaatcccaccactttggaaggacgaggcaggtggatcacccgaggtcaggaattctagaccagcctggccaacatggtgaaaccccatctctactaaaaatacaagaaaaaaattagctgggtgtggtggcaggctcctgtattcccagctactcagggggccaaggcaggagaatcatttgaacccaggaggcagaggttgcagtgagctgagattgcgccatcacactccagcctgggcaacaagggcgagacgtcatttcaaaaaaaaagaaaaagaaaagtaatagtcacaaaatggatataaaaagagaggtaacaatgggaaactacaggggggcaaattaatacttttatagtttcagcagacctgtagtaacagaagaaaaactgattttcacttggttcagactatctccctgggctagaaagtatagggccaaggtagaggaatcggaggtagatgaattatcttcctgtgtcttcctttaagtagttcacattgctcccatttaggtaccagttaatagtcataattactataatccctctctttggatattctctaagactttatttcctcgtgagcataaagacataaaatagtacactggaggttagctatgattaggaagagccattctaactgtaaattactcataatccaagctctttcctgatgagcatgtatccgttataaaagaggctatgataatatacagtgagaaaagaatttgtttagaaattaagtgaatttggatctagggtcacctcagctattttgcgctgcgacattgatcaagttattttctctgggtttcagatgcctcatctttattttgtgcatttagatacacaattctaattggcccaatgggaattacacagctaacaccatcatgcagcaaaacaaaataaaatacagtggaactgaagtgagggagtaaaaccaccacactatgcagatgagactatctgcctagtaacaagacatttcttggactctggtacttcagccaaatgtcctctgggagtggagaggcggggagacaatatagtccactgccagaaagaacccacatctgttccaccactctcattgtcattgcgtttcctgggatactttcagaataattcattagtaacaacaacaacaacaacaaaaaaaaaaaacagcaaggaaaaggctacaaggggaagggtttttctaggtctttgggatatatctaatcatttcttcacggaatattataaagtagggtccactcaaagctcatccctcacaagccactcaacctttgacattcttcttctatttaatgtgagtcagaattcctaagattttttgaaatcctgcctgcaaagtctgcttatgaatttttttccttaccacggagttcccataaagtgacaggttctgcctaagtagttagctacctgcaaggctgctcgaatccaactttctttcccactctactttgcattctgctctccctttgctctcctctccttaggccctcaagtgatgccagcttttgttctagcactctagaaaggagttactattttgatccagagtacacagagaagagaaactggagtgggtaaaaggaagctcgtcactgagaatgctggtactgggagcaagactgtggcaaacccaggaaatactaacaataagaacccctcaaaagttcacctttaccaagccaatggaaacaatatagctgagtggggtttgaattttgagaactaatgactcctcagctaccatgtaattgccttggtgctccatttgctataattcatgggaaaggtactaaggtccttcaactggttttccttgctacctccacctttttcagaagttggacctatgattagcacacttcctgcctatccattcacagtgaatagaatggctggctaaattttaaaccccatttaaattattccacttcgaaatttgaatgatagatgcttgcctaagtctactggcctcagtaacattaccttttctcatgaccaagggtaaaagagtaaattgataggaggcacaagtttttgtggatgtgggttgggctggcaccaaatccaactacaagcatacagtgaccacttcatacacaccacataaaaaatacaaaaactgaaaaatactatcaaatgctttgacattttctaaatatttctgctgcccctataaaattgccttgtctgacctttcctcactaaccaggagatacggtgtttttcatttcctctcccttcaaattttacaagagaatcaaggaatttgaggaccaaagcaccacaaacacaagagtaagcacagcaaatatgacaaggggactgaagtaagcccctatgggaataggatctgctgaaggaatcaagagggatggacaaaggaacagaagacactcaagaataacttcaggaagtctccttaccgcctcacctgctttccctctgtcctacacatccagccttgcaaagaaataagagtaaagagaaaagtccatgtagcaccatcccagttcagaagcaacccccaagatatgggtcaactttatcacctcaaactctactcatttataatgacaaaattcaactgttaacacataggtaagagttcttcaggcatcggttttaaaggtccatgtactgggacgggtgcggcggctcacacctgtaatcctagcaccttgggaggccaaggctggtggatcacctgaggtcaggagttcaagactagcctggccaacatggtgaaacccagtctctactaaaatacaaaagttagccgggcatgatggcgggtgcctgtaatgccagctgttctggaggctgggacgggagaatcacttgaacctgggagacagtggctgcagtgagccgagatcacaccactgcactccagcctgggtggctgagcaagacactgtctaaaaaaaaaaaaaaaaaagttcatatactgaataaccatctgggcccataacagcttaagactttctggagaaaaaaaaaaaaaccagtttccagtttaatttccaacaaagcagtaggaactcttgcctatagaatactgtgctgggggctgggcacggcgacttatgcccgtaatcccagcactttgggaggccgaggcgggtggatcatttgaggtcaggagttaagagactagcctggccaaaatggtgaaaccctctctctactaaattaaatacaaaaattagcctgctgtcgtactacacgcctttaatcccagctattcgggaggctgaggcacaattgcttgaacctgggtggcagaggttgcagtgagccgatcacaccaccgcactccagcctggagacagagcgagactctgtctcaaaaaaaaaaaaaatactgtgctggttcatttgcctataaagtcaccaatctaatgtttgggtatttgatcattcagaattctagaaacactgaagatcccttcacctactcagggtctgggcctctttcatgaatgcttaattcccacagccttacagtttatacccttctcctctcccacttttgatcctcaagttttttgcttctcacattttttactgggtttgtgcttctcagtatccttgaccaaagcaactgatgctgtaagaaatgagacttcaaaccatttacccacactgggtgattaaggtagtttaaaaaaagaaatgaggccaggcacggtggctcccgcctgtaatcccagaactttgggaggccgaggcaggtgtttcactttaagtcaggagttcgtgaccagcctggccaacatggcaaaaccccgtctctactaaaaatacaaccattagccaggcatggtggctcatgactgtaatcccagctactggtgaggctgaggcaggagaatcgcttgaacccaggaggcagaggttacagtgagccaagatggcaccactgcactccagcctgggcaacaaagcgagactccatctccaaaaaataaattaatttattaatttaaaaagaaaaagaaaaaagaaatgaagaacttacggtaattagtgtggttagggacagtgagttagaaattgtcacatcaaaatacaaagttttcaaaacagtatattttattttacaatagcaaccaactccccagtttgtttcaattgtgacatctagatggcttaagattactttctggtggtcacccatgctgaacaatatttttcaatcttccaaacagcaaagactcaaaagagattctgcatttcacatcagttcacaagttcaagagtcttccatttatcttagcttttggaataaattatctttgaggtagaaggacaatgacgaagccacttaattccttgtgtctgcataaaagcagatttattcatcacaacttcatttatgtgaataaagcagatgatgataaaatgttctcttattcttgtttaatcagtagtggtagtgatgccagaaactgtgaaaggaaggcttttagttactttcttctttccattttccaataatccattccccatccccagctgaagaaaggggtgttactgagtccagctgataccacacattgaaaggtaaacattaatatttcaaatctgatgtctaactaaaaatgtacagaatgaaaactagaaaatttcaaccccagattatcttcaaccttgctccctccaccaatcatactttgacatttatctatttccttctccacttatggatgtaattggcttgctatagaaactacagttcagatgctttgaatgtatgaactacaatgaacaataaagtcctcttcttttgaagcatattttggcttcagctttaagataatcttatgacaagaagggtcacactgattcacttaataaattccattcttacctaacacaaggtttagttgataagcacttggacaaaaataatacttttcaaaaatgtaaagcaaactagtgaggacaaaggattttgtcctcatctcaacaatgatcagctattggaactgcatgaaactgaacaatttaaacctggagctggtaatgttcttaagaccaattcagaacaaaggcaggttgcccttaaaacaggtttgaccttttccttcactcttcctcctgtcccaccctctgtgagtgatttaaaaacggaaaaggtcaaagcccagccaggcctacatttagagaaattttaaaaaaatttttcctttcaattttggccaattatttccaatttttattttattcttaaaacttaagcatggtaaaatgttaagctgttttcatccactgatattattctactataaaaagcccttcttgagcagatttgatgataaaaaggagaacatttctaaggtataattagagaagctgttgcatgagaaatcatgtctccatctccattttgctatgcgttatctgaggattgtttctgaaagagatctatttaggcagtgtatgtatgtgtcagcatgtaaaaagtaaagaactgaaaatagacaaaccttgtaaatgcacttcaaaaccaattgtggctcaagtgtaggtggttccccaaggctggtaccaatgagactggggtttgggaattagttggtcatcatccctcctgctgcccagcagtggtcagtcatttttcatgagggatggactaggaaaatgaagtgtctattataaggagagttcctgtaacttaaggagcaagctcactacaaaacccagctacctgcttatcgtagtggccagagtggtagaagagatacggagtaggaattaaaccacacaatgttatttagggactaagccatgcccctaacaagaaaacaagccaaaaggaaagtattaggcattctctgggaaggcatgcatttttttcccatgtctctggggccaaaaaccttataccaagtacctattggcacccgaatatatttgtagaatgaatgaatacatgaaaaaaaataaacagtaacctttctcctatattctactttccaagccaattaataagcaagtgtcttttcgtcatgattttttttgttttctgtttaggatttaacaaaatggttgagataacagtcacttctgtttgatgaagagtatcacttcattccatttttgtgtttttgttgcatctccaagtcagaataaatgccttttggagcagatatatttcatttagcatttagtatcatcttcatcaatactcgtatgaacgaaaaaataaaaagccctctcttattcccactctacaacgcatgtcaaaggtgatctgtttagtttttccttagtatcgaacatatcacagctactcaatgaagtttcttctcaactaaagaaacacagtctcttagagaatttgttcctgtgtttccaccataagataaatgagataaagtgcactttggtttacgtctttcaagcacttaagaacagcactttattcagttttaataaatttttactaaattggtaaatgcaaaagaatcttttttttattgctcatatgtcttcctgtctctaagccagaccaatgagcaaatacctttaaaactagttgttacatcttgaaccatttaactgtaataaaagcagaatgtttagttaatgaattaaagaacaaaccctgagcccttttatcagtctcctggctttaaactaagccaatgaggaagtgatttgggggattcctgaaactaggaaaaatgtctctttattttgaaagaaacttgcatttttctttctttttttttttttttttaatctcaaaggcaattgagtgggtcttctgggccagacctatttaatttacgaaacatagtaccttgcagagaataggcattgaaatattatttaaacaatcaaaccaaagatgttcttctatcttcagctgtcagtgatctaatgccctcatctctcttatcctcaggacccagaatggtatattccacataaaagatgctttgtttatcaaatgaatcaaaaagcacgcctgaggcatttatttttactcctttacttctgtaggccaggtcaaggtgggtctaattcacttttatcatcagcacttaagaaactggatggaagaccacaacaccttgttttttgcaaaaattttccatctcctcaatcaggccaggaagcatgtatcttctggacaggactttatctctctactcagcttagtacactgccttatattagtccatttgtcccatgttttcatcactgaataaacttgttaaatgacttttggtctggatctcacacctatattacttcatttccttctgtgagcactctataatgataacatcatttttatatcctagggcatgtagttccgagccccacagaaagtaatcaccattcagtaagccaatagttcattcctatctgtatagaactgtaggctttgtaaatctacacatagatctctgttgtaggttcaataatgataataaatgtttgtgcccccagttgttatctctaaggataagagtaatcaatgatcattcagcagatatagcttatatatgggtggcagtttacaaattataaattgattttacacatattttcttctgctacccaagacacaataaagatggtttatctttgcatccccaatgcctagcaatgagattggcacacaatagataactactatagtggcattcttcagacaaccaatcccttgcgtatgcgtattcaaaagataatcattgttattcaaattttcctactttatttgcacaatataataactatcatacaattttataaacctagtacccagcaccaagtgagaaaatcaacagttacatttatatggtgccttagagttcacaaaatgctaacataggtattgccttatttttggctgtggctaaatgaaatatgataaattttcagtgcctttaacagtgagttcacatagtaggcaatcaaaattgatctatttaacaggtatttaaacccttggtttgtataactacttatagaacccttctcactgtggtttaactatacaatgagaattttgtagagacaatacctagcttacagaaagttttattcatacagaaagcatcaaatttttcatttacaagtgctttataatttagaaagcacattcgcaagctgaattaagtgactttcggtctggatctcacatctattacttcatttcctcatactagctctttcctggttacctggaaaaatgtatcagtaataatttaacttaacctcaccagtaaagtcttgattgtttaaaattaagcaatatatcattccttacatctgaatagtatagaggataaactttcctcttattacataggagaattaatcttgtattttacagtacccaaaatagctggtatgtaagaggcacttaatattcattcatccattcattcattcataaatatgtagcccattgacatttgtatcatgctttagtttacaaagcactttaatatgcacctttctgaaattttttgttctatgagaatacttttccccctttggtagctctagcacccagcatggtatctggcacattataggtgaccacaacaagcttagtcccttatgttttcagtatattttaaagtttaaaagcagtttccatgtgttttcgtttctgatacctggaatactgcatttttactcaaaattaccagagcagcaaacacaaattggcctcaaatatacatataatttattcatttatcaaacaattccttgtgtctgcatagtactatatccttttgaaagagcacttttttatgcttgctcctttctttgtatccacaacgcttatcacagtagaatacaagtgctttacagtttacaaagcacattcactattttttttcaggtcacctagatatcaataatcattgcatttttagtgcctagcacagggacaggcacagaaaaggaaactagtagtattcagaaattttctctgaataacaaataatacatcagggggtggtaagctatgaacagcaggccaaatccaattggctcaaaaactaagaatgattttgaccttataaaaacgttgtttaaaaaacaaatatgtaacagaaaccatatggcccacagtctaaagtatttatgatttgaccccttacagaaaaactgtggacccctgatttacataatgcttcacaatttacactgcactttcaaatgttaactgcatgattgccaatacactaattggtttttctcttatgttttacagtgctttcatacacattatcagtcatttaaatcaacttcccacataaacaggaagaaaaaaatcaaggaaagtattaaacatgctcaacagtcccaggttctctcatctttaagcctagagatgggtattaaacccaggagtagcgttggcacagtccaccaaattatttggccactactatgagcagggagttcaggctgtccccttgggacctcgctttgtcccaggcacagtcaccctttccataaccatcactagaaatcccaaaccccagaatcctgctcacctaagctcaaagaaggaagctgttgctggcaggtgcttctcagaagtctggcacatctgtgtatttcttgtctaattcttctcattggcctggagcatctcttcacatttttctctagagagcctggcacttttttttccccaacaacctgaccattttatcttctcagtctagggcttctggggtcaaaagaaaggactgaaatacagtatcacctatatgaatgtctgctcctgagggaagttaacaaaagccagattagatactgactggattttggtgtctctctcaagtggagaagatgtgaatagaaacagaagtttacaaaacactatagcctaacaaataggtaaaagctgtgatttaaagctggctcaagactggcccaggcataatactgtcaatctaaaggtaaccggcaacatcaaaaagtacatctcaaaagaatcaggcttaaagataaacaggagaactggaaatatctaagagtaagaagtgtaaacaatagaaaagaggtagggtttagggttctcatcttgggatttccccaggtcttcaagcttctatccttcctgggttctgggtcatgggcctccagattccggccgttagtcttgagatacctttttcgcttgggtcctctatccatctaggtaggctttgtgacaggggccttccatccttgggttgtaggtcttccagctacaaccctgggctaatcttaggtcgttggccttgtgtcacaagtctcagttcttaggccttccatgtgtcctgtcccaggtcttaagacttctaactcaagccttgagacttccatccaactcaggccttcggtccaattcaggccaccctctgttttcttggctcttgaggcttttgttggtttcaggcctgaggcttctatctatcttggaacatgggctttccatcttagtcctcgggtctcaagtctcaaaccatctgtcttatactttgggccttctatccatatgagccttccaccttctgccctacttgagttctgggttttactgcagtctagggccttgttttggtcttggatcatctcacatggcagcctggcataaggaaccgctccacaatgcttgctctgatagccgacgttctgcacctatcaggcaggggttaggaagcccctctgccacacatgacacacacacacgtacacttgcccacatatgcaaagaaatatttaaggagagattacatgaaatcaaagagagggagatagattcatgaagaggctgaaatactcaaaggtgagtagaaagggaagaagcagagaacaaatacaagccaacagagattaatactgaaatagaaaatcacaaacagcaagagatgctgaggcacgcaggggaggagagagagaatagcccaagagaggcagaaaggaaatgcagaaatgagaaatgtgagataaaaagtagaaacagcagaaaggaggccagactcagaaaaaaggtgaaatttaaaacgaacgagaaggggaaggggtaacaaataatcacagttcacaaagagaaaagagaggtaggcagagaaaggagaggtagacagaacaagaaaaggacaaaaagcacacagcatgtgacccaaaaaggagacatgaaataaagcgtgaaagaagagccacatctaggagagcaaagagaaatagcaacaaaatgaaaaatgagagatatgtctaagacaagacacagaccactcttgtgaacaaaaagagaaaatgaggcaaaggcacacacgaaagaaattagcaagagaaacatggaaatgggtaagacacactttagatagagaacaaagagcaaagacaagaaagaaagagacaaagaaatacacacttgagtgcaagagataagcaaaggcagacattcagaggaagtaagtagtagaagaggcaagatacagtgaggggcacaagaggcatgaaaagcatcacagaaagataaaaaaaatcaaaaagtgtcattagtaattataataaactattgttactacgaatactacttatagtactacaataataacaaccaccaataccaacacagatgctcttctatttataaacttttaccttagggatttcttacatagaaccaaagcatgccaactctgcctgctacctgatagtgctagtggtcacttatattgtgggaaatgaacttatgagtcttcttgggttaccttttacttgacatgtgccaggcactgcaataggtgagcactttacatacatgatttcatttaaccctcacaaacagagaagtctagagactttaagttgtcaaaggtcatatacctaatgagtagcagaggatttaaaacacacaatgtatgcctcttaacatcctgttacaactatttactaggatttctggaagagccaaatgggatgtcacagatgactaagtattttcataaaaggctctttgataggacttgctcaatcccctcctttagcatcacctttccccaactctttagaaaactgacttcattctcacacttttataatggctacttcagagtttagttttctttttacactaatcttaactgacgacagagtctctcacaaacggagatgagaaagggttaccctttcagcagaaagcagaaatggtgttttaagcttctcaacgtttaaggctctaagaatgacagagggcctatacagtgaagacatagaacacacaagcaaaggctaaattcttctgtgatacaactggtaagaagaccataatgtctttgagttgcttcagtgaacccagtcagtaatatggaagactggtcatctttccatctcacatttagccccacttcacattagaccaacacaccccatccaacaccagctcccaaaaaacagctgttataacagttctgaagtgatcctcacaggactgcaacatcaacaacttacttcattcagctatcctcaagtgctagagtgccaggcatgttgatcttcaggtgggaaggctgacttccttcagtgtgttcaaatttcttggacctgctgaagactcagctctctgcactgcttgtaggaagtataatgatttggcagataggaacaatgaagag

SEQ ID NO: 3235 - DNA, 5206 bp, Homo sapiens
gccacccctgagacagcaagaccaacaaccccttctcttcctcttcagcctactcagtgtgaagatgataaaatgaaacagttggtgatgtttcagagaacccaactcaaactgacttgaacaagagaaatcagtgtttactgcagagaacacagaagccagcaagcagcagggaagggaggcgaaccaatgcagcagcccaccgggaccgaggaggacacacgcagagcaagtcacaggaagcgcagctgaaaacaaatggacgcttatcccaaatgcacaggacacttaccaagaactgatggtccgtcaaagtaaagctcaacagctttggctggcaggacagtcaaacttttggacgacagaaagtaacagtgggaaatgggacaacatctgccagcaacgcgagaggccaagaccatggctgctacaggaggggtcagcgtcacagtacacgcatggcggcggttgcacatgcatgcctggggaatgtgagtgttcagacatgccaggagtccagcctcaccaggaaacaggcacacggggacagaggcgcaaacactgaaaactctcgctgaatccactcggctgagcggtggtcacgagagcacggccctgcgctccccacaaaactgcacctgggccccagggcgagacaggcgtggaaggtgcaggggtgtgtgtgggggcaggggctcctggctcagagccgtatccaggaaccccccttcaggctggagccctgccctgagccccctgtggagagactgtggagagccccctgtggagagggtgactgtgggagagcagcatcaggcctagtctcggctgtgaagtaccccccacctccacgcaggatcccggggattctgtcaaggtgggggccgcctgctcagcccaggctccctgaacgtgtggctagctgagtttgcggaagaaaccaggagagtgccaacaccaggcttgcaagcaagaggctccctgactgcctgatcctggagcgcaccccatcctccctgtgttccctgggcctcagctgttccccagtgaccttggagacaccctgccccaccctggctccacaggagccctgcccatcaccgcctcagctctgagtctcccctggggacacaaccttcctcctggtgcagaggcgcaggatgctgcccctaaggcccatcttcctctgcagcatgttttgatgtcagctcattcacaggaaagaaacaatcacatctcagtgcccagaatggggaccaataggagaggtcactgggaataaagcccacacgcaccccagggtccatgggctccccagaaatgcaggtggcctccgccagagccaacaagcctaagttgctgatcagcccctccctgcttccctgtgtggaagaggaaacagaggcccagactagtagggctctgccgtggtggccggctgcgtccccagacctctggtcccagggctggctgggagtgcccctccctgtgctcacttcctgctctcctgggaaatggctcagggatggggcgtgtggggacagatgctggcatagctcacaaaatgcttgcacaagggacactccatggcaggtccctgcaggagagcaaagtcacaacattcagagattccctgcactctgaggcccgcagagcctggccgaccaagcgaggctgggaggatgttgcctgctggtcagggcagccctctgatcagggcggccgagtgaggctgggaggatggtgcccgctggtcagggcagctgagcgtggctgggaggatggtgcctgctggtcagggcagccctctggtcagggtggccaagcgaggcagggagggaggtacccaccggtcagggcagccgaacaaagctggaaagatggtgcctgctggtcagggcggctgaatgaggctgggaggatggtgtctgctggtcagggcagctcaggaggtgctgcccaggaggtgctgtccaggcagagcctagggctggtgtgggtgtgccatgctcctgagaagtttctgggttgtggctttaatgttctcctgcagtgagaacgctgacacttggccaaagggtcctcacctctcccctagtacacttctgagatgccaggaaggttctgaacatcagattgattcctgggactcccctccagggtggccttactggagtcaggagcccctgccccactaggatggctctgcagtggcctgaggacagtgagcactgactggtcactggtgcaaagttgcccactgtgatggttttgaccgttgatgggaaccaagtgaaagccctgcagctatttctaggcatttcagagggtgcttccctgcatgtactctgctgcagaccatcctccctgggccaggagcccgctacacagtaggagattctttttcttctcttttgagcacttttattctctttttcttaatctctgctcctcctttgaactgagaaatgtgcaaatcttttttgttagttttgaggttgcttcttatgcatatttcatctggaactttcccctttgggggtgatctgttctatcagcctgcccgctgctagagaggccgaggtggtccggccagccgtgcgctgctgctggtgtctctgtgggcatgacctggtgagatatcattctgcatctgggggtccatcctatcagccctgtgttctagattccccagtgactgacatttagccagtctcctctgtcactctccagtgacatgtacacactgttggcacgaactgcagatgtcacgttctgtggctgagagcctcagtgtgcatctgtagtaggaggatgtcagtgaggactgtcctgtcgctgctgagctggcaccgactgtgcctggtctacactccaggtctgccaaacgacccagcaaggtccttcacaactcttctgatccaggatcacacatcacttgtgctttgatgcctgcttctgaacaattttacctcctgagatgtccatttttgggagtgtgagccctcctctcctggtgacagctggctgaggccgtccagcctcaggacacacagggaacggctgcataaggagatctggggcagggggcccaccaggatgttctgccctgtggggggcaacaccggctgtggtctgccggcggcatccagggacagtctgtctaggtgaggctgaggccgcccccactcgctccctcacccccatgctgacagcagtgagctgaccacagactgggggagccccacagggagactggcctccccagcacatgccccgcagtgccagacgcggtcatcacagaggcaggtacacgacaccacggacgtgccacgtacccgccatcgggaccaaggaccactgagaaaccatgaaggccatgcagcgactgtggtggcaggaccgtcaggaggccataggtgccacggctcccctctggtggttcacctgcccacctgtagctggggtggcccctccagtgcgctccccagagcagaacaccccccaggcaacacgtctgatgaaggccaacagcgtcagtcctctggtgtttggtgacatcaaagctgtgccgaaaggccttccctcactgctaacacttgaagggcttctgtccggtgtggaccctctgatggcgaatgtggtctgtcttatgcttaaagatccacctccattaactgcactcttagggtttcttcctctgaaaaggaatgaacacgggaaccccctcaaaggcatttttaaatgaagcgtggaaggcatcaaagatgtgctcttcttcaggactcaggcttctccatcattctctgttccttggaagcgtgagggctaaggagctgctgacttctctctcttggccccacttcaagaaaggcttgcttcccacacacctctccacgctcccagtgcgggactgacactctgcaccgggaggccaagggccaccatcgtcttgctgattatatgtcaagttctgtgtgaaatgagagaccatggggattcattattgctggagttgacgctttgagattttatggaacaatgtagactcatgcccagtaacagatctggagaggagaaacaggctaaaagccaatatgtttcacaagagcaactgaaaccaatatttcaaatgaagaactgactcgtacacaggtactgtaagaatcctgggaagtggaaagagattccaatctcacctcatcagggagcatcgaatgctctcttaagctcaataggaagaagtgaggctactttcagatttctctatcccaatggcttcaattgtactaaggtaaaaactatttgacagagtgtaatttttctgcagttgtgacatgaacagtccagtttgtgtcaaaagaatacttccctcaatgagaatgtggttttgattagagatatttctagtattaaacataacataatagctaacatttaatgagctcttactatttgacatggaactaagtgttttccaaggattattattattataatgaatcctcacaaatattatgacattggattttcaatagcctcatctaatagacactcaactaaggtaagggacagagctgggatttaaacctggggcatgctctgttttttctggtgctgtgtctcaagttacagaggcttgaggtcttttctaagtaatacctatagctccttgtctcccagaagagacctattatttagggaatccttaaagcttttgtcttgcctgcttgcgactacttctattgcttgcagcatattcctcagcaacttcatggttttctgggcagagtgttggaaattatgtggtaggatggatttaagagttgaagggttgtttactgatatgatttggctctgtgtccccatccaaatctcatcttgaattgtaatccccaggtgttgagggagggaccagctgggaggtgattggatcatgggggtggtttcccccacactgttctcgtgatagtgagtgagttctcaagagatctcatggttttataagggggtgggggcggctcttcccctttcacttactcactccctcttgccatcttgtgaagaaggtgtctgcttccccttcgccttccactatgattgtaagtttcctgtaagaggcctccccagccatgcagaactgtgagtcaattaaacctccttcctttataaattacccagtctcagacggtattctacagcagtg

SEQ ID NO: 3236 - DNA, 1634 bp, Homo sapiens
tgcatttaacattttattgagattctcaacagctgccatttggtttgtatagcaaattttttacaaagtaacttttttccatttttgatatttttatgaaaattattttcttcagttttaaagccctgtccctcccccaaagaaggattaataactaccaagtaatgattaaaaagcaaaaacagctttataaacacttgtgaaacaggggtaagtgtccgaagtcaagaccttctgggcccagtggaggtgctgggctgctccgggacaccatcaccacttcaccatccacaacatcctcaagagctgagcagccctgcacagaccctggggggcttcctgttccacaagctccactccctttttcctctccatctttgctgttgggcctcccctccaaatctgcctaacaaaggcagcacgatctttaatgcctgtgcagctttgtaagtggagccaggttactctgttttgaaagctgagattccctgtccagtctgggggaggaaaaattatccaatgtagcatggatggtttcactttcttgtccactcagacacatgctcatacttattaaatggatttattggatgcttcaaaagtcctgatgtgtagtagcacaaaagttccttgtaaaaaaagaagttgcaaaattataaaaatttctgcagcagttctggctctggatgacaaagctcattctgattagtagtttttttgacatgcacagcagcttcccctataagtcctacgttcggagggttccgtttagacaacaggaagttggaatccaagtttaaaaggctctctgctgacaaaatgtggtacatccatcaacagaattctactcagcaataaaaggaacaaactaccaagacgttatctgtcatggacaaacctcaaaaacattagctaagtaaaaaagccagacccaagggaccacatattgtatgattccattgatttgaactgtccagaaagggcaaatttatagagaaagtagattagtggttgccgggggtaagaacaggattaactgtaaaagagcatgaaggatcttattgggagggataaaaatgttctaaaactgagtaatagttacagctacaccactgagggaagttactaaaatcactgaaatgtacacttgaaatgggtgttttatgatatgtaacatatgcctcattaaagttgttttaagaaaaggattccctgcctcccaaaccatccttcaagcattaaacatttttggaggctcataatcaacaggacagaataactacttagtgatgatttacagagtgaaatattttactgttttgtagtaagcacattttagtaactgtacactagtacaatgtttttaagattttatctcatttttgtcatattagcctaaaatgtttatttttatttaaaaagtagccaataggaaggtaagattggggagaaagctcagtaaatgtcacaaaagagactcctagtaacacaatctgagggagctttttcttttgaaataaagatggtgcatctgtccctttacagatttctctcctgtcccctgggactggggaaggtgaatctcctgcctgacaccttgtagagattagtgtatccagctattctattgccac

SEQ ID NO: 3237 - DNA, 1896 bp, Homo sapiens
gcccctgctggggagagggggagttctgggaggaagacccccagaggagcccggcaatcagaccctaaccagagacggaagccccctcccacctctgaaggggctcctaggccggctcacacacgccaggtcagggccgggagccgagatgcagggaggtcagggaacagggttccattctgcctgcaggctcagggaatgtctttggggaagtggtcgctgaggctggccttgaacctgaatgggagcagagtcagcaaagcacagcagagctcagcccatggggtgaccagcggtgagcttgaccctcgcgattctgactcccaggggccatccgtcccttctccacggctgccatggctcctgcggcctcagcctgctctgcggaccccctgctggacccacagtccagctgcttggtgtgggccccacaggcacctgtgcggggtcaggccctcccagtggggctccagggcccttgagcccttctcctggtgatggggctggactgtggccctggagttccatgctgcagggtagattgtgtctggacccagaggtcaggctgggaaggggtacccggatgtggggttgcccctgcctgggaagtgttcctgggctgaggctgctggctgggcacaggggaaaagttcaccctacacggaaagcacaacaaattcacacagatttccaaaccacttctgcgcaagcctagaggctgatgatccggggatatgcagccttctccaaagtgtgtgcatgtgcgtgcgcgtgcacacacacacaaagacacacagacacacacacataccctaaacctttccttcttctcccagttccgcccagttgagctaggatggcccggtcctcccctcactgtgagggccccttcctgcttggcctcgcctggtactgccccttcaggcctgtctggcccagacccctaccctgatttttcatttcctttgccaaaaggcacaggggctcgcagaggaaggtgggggaggctgcagagtgggggcgcctactctccccagggcctctgcaagctgctcgtgtctgggctcagagctccggggaggtcggctggggctcacagccatgcttcaccactccttcccagggtccggtttcccacacctgattttgtttgggaagcgggaggagtaaaggcacaggataagggggaggggagcttgtggggctggggctggtgtgctgggttcctgggagccatctgaagtttgggctagtgtatcccctgccgggtattactggaggctgggcccagccccctgtcccagccccctgtcccagccccaccgtctgcatccgaggcccacctagaacagtctggccgacagccagcacttcctgtctggggacacctccaaccggcacccctgcctgctgggccctgggggaagggtggcatggcctgggaaggcacggggtgggggggtggggggagcacgctgagcttcccaacatttcagccccagatctgcccagagtgagaaagcaacacgcagtccacgcttggtacatacccaaaaatacatcatcatttcggaaccgcggctccacagcaggctcccggggaggaggggaggagacccaatcagggaagcggccgctggcggcaggttggtgggggtaggggcttggtcccccaacgctggcactcagtttagctgtcacttgcagctgtcttaggaagtgcggctctcctctctgcctcccgctcgctcctgctcactccaggtcctctctccctctccctgtgtctctgcctctcgctttatttccccaggttgctcagctccgtgcctgctctccgctcgcccatcgatggggtcctgcccggcactgccctgtcgcagtcactcctgctgc

SEQ ID NO: 3238 - DNA, 2372 bp, Homo sapiens
agaactgggctgagggagcaaagcctttacgataccacacaggatggcacatttcactgacctgacactcactacgtgtgcctaatacaatttctccaaggatacagactcaggattgacagtagtgacctaggagaagtaaggggaagaggcaaggggactttctttttttcttttttttttttttttacatctgaatttttccacattctactctctggctgatacaacaaattctctagacccgggtttctcagccttggcatgactggcacttggggctggagagtcctttgtagttgtgatgcctcgtgccctgtgtgttgcaggatgttaagtagcatccctggcctctacccactagatacccacgtggcaaatgtgctaaatgccacctggagggcaacattgccctcggttaagagttactgccccagccaatgtgttggccttattaaatgtaatttattccatgatataagcacaagccactgtgactgcccaggccacctgggccatactgcctttccctagttcagggaaacatgtatgagaatccactttgagttgttaaaatcccctgggtttgagtcccaactgtctcccatatgatgttctgacattccctatgcatctggggacccaccaggagtttctttgtgcaactacctcatattcaagaacaatgtttgttattgttgttttgggagtgggtttcactcctattgcccaggctggagtgcaatggcacgatcttggctcactgcagcctctgcctcccaggctcgagcaattctcctgccttagcctctcaactagctgagattacaggcgcatgccaccatgcctggctaatttttggttttcttttgttttttgacagagacagggtttctccatgttgtccagactggtctcaaactcctgagctcaagtgatccgcctgcctccgcctcccaaagtgctgggattataggtgtgagatatcgcatctggctcaaggacaattttagaaaagtaaatcatttctttctgataaatacacacacataatctttagagtctctttctttctaccgactactttaaaagtcagaagtacaactatctgagctcctcattcgtgataacacactggccttgtgattttttttaaggaaattacatcttaaatgttcatgttttcatgctcccaaattcattcttcatgtcctgaaaacttcttacactctatctggttttgttggtttgtttcctttcttgttttattttggtttttgtcttttgctatgtgaatcttacaatagcttctgatctaaaagagtaacctagggcacagtggctcacgcctgtaatcccagcactttgggaggctgaggtgggtggatcacaaggtcaggagatcgagaccatcctggctaacatggtgaaaccccgtctctactaaaaatacaaaaaattagccgggtgtggtggcgtgcacctgtagtcccagctactcgggaggctgaggcaggagaatggcatgaacccgggaggcggaggttgtagtgagccaagaccacacctttgcagtccagcctaggtgacagagcaagactccgtctcaggaaaaaaaaaaaaaaaaagaactttgaaaaactaggtgccccatcactcatttgtaagttgacatttaaaacatttttgtctccagtttaaatagttgcagaagatatcattttaggcatgtaaatatgcagacagatagatcagatatagatagataggtaggtaggtaagtaaggaggtaggtaggtagctaggtagatagatttgtttaaataaaactgtttcattagtcttttgtttgtttgttttttgttgtttttttttttgagacggtctcactctgttgcccaggctggagtgcaatggcgcaatctcggctcactgcaacctccaccttccgggttcaagcgattctcctgtttcagcctcccaagtagctaggattacaggtgcccgccaccatgcctggctaatttttgttttttgtcttttttttaatagagacggggtttcgccatgttggccaggctggtgttcagctcctgacctcaggtgatccacttgcctcagcctcccaaagtgctgggattagcaggtgtgagccaccatgcccggcctatctcatcagtcttttaagtgaatccagtaggtcctaaatagaatagagattttattcccatcattatccacttaaaaacagaatacataaacaagcctatgtttctttgtttgatgcacttttgtttgcatgttacattttacacacacacacacacaaatgcaccataagcaaactctttttcaaaagccaaaaaatttac

SEQ ID NO: 3239 - DNA, 3303 bp, Homo sapiens
agagagtagctgtggtctcctgcgtgctcaccctctgctcccttggtcctgctccatgctttggtcctgcacttaaattttacaagcatactctctttctcttaaggtaagcaaccattttaaatctcagcggtaaacaaaacaaaaaatcaccaggaaactatatgaaatcaggtttttttgtttgtttttggtttttggttttggttttgtttttttggtggtattttttttgtttttttgttttttgtttttttgagatggagtcttgctgtgtcacccaggatggagtgcagtggagccatcttggctcactgcaacttccgcctcccaggttcaagcaattctcctctctcagcctcctgagtagctgggattacaggcacccaccaccatgcctggctaatttttgtatgtttagtagagatggggtttcaccatgttggccaagctggcctcaaactcctgacctcaagtgatctgcctgcctcagcctcccaagtgctgggattataggtgtaagtcaccacgcctggcatcaaagcaggttttaaccagcctttttgtccactgataacataaaggaggtcagcagcagctaagtcctgtgccagaagagctttcttgtcctttcacactgcaagagaaataatcacttagctaagaggccaattttaccttttttaaaaaaaaatttaaaaatgagggcgggtgcagtggctcactcctgtaatcccagcactttgggaggccaagacgggcagatcacttgaggtcaggagttcgagactagcctggccaacatggtgaaaccccgtgtctactaaaaatacaaaaaaattagccaggtgtggtggcgggcgcctgtaatcccagctacttgggagactgaggcaggagattcccttgaacccaggagatggaggctgcagtgagccaagagcacaccactgtactccagcctgggcaacagagctggactccgtctcaaaaaaaaaaaaaaatttttttaaatgagagctatatcttatcaacaaaattaactatgttcgtttttggagttttatttttgtagcatttacagaaatctgttaagagcttcttaattataaaaatgagttaataacatatttctcaaattgacttatcaattcgttgtcattgtggacgaaattactttataatcaattaccataaagaaacctgatttgatttcagctcaccctcaatattcaaggcacttggattgttggtctccacccatttattatgtggtctactaaaaatagaccacatcctaggagttagcattccaagaacagtttccacttattactcacttcttgatatttatggaactgctcatttcgcaaatatttcagctctactctccaatctttagaagaaaaaagaaaataacaataacaacaatagaatttcattctctccagagagttagcaaggaaatgagagcggaaagaaagcaaatgggaagttagaattggggaaaatgtaaagcaaagccaaatgtgaataggaatagcagttgacaagaggggaaaagagggtgcagaggacaaatataccaatagaaaacatgtaaactcaatagcatgcaaccttttaaaaaataaatgatttaagttcattttgatagtggataggacaagaatattggcacattatgaaaagaaacatgacaaggtcttgaataaattttaatgaaaatatataaatggattaccctctattacaacaccagaggccacaaaactacaggaagcaaattcttcactataagatattcttcacagcctcttttaatcatgtatacatcctcattctacattaactttcatacacaaaaacaaattagaatgaaattcatttttgtacttacaacctgacatccttagaaatgtgaatcttatgccaacttagagcaaaaatcaaaattggaagactatagtataagaaaagaccatggcctgtaatcccagcactttgggaggtaaggcaggcaaatcatgaggtcaggagtttgtgaccagcctgggcaacatggtgaaaccccatctctagtaaaatacaaaaaaaaaaataagccaagtgtggcggtgtgcgcctgtagtcccagctactcgggaggctgaggcaggagaattgcttgaacccaggaggcggaggttgcagtgagccaagatcgcgccactgcagtccagcctgggcaacagagtgagactccatctcaaaaaagaaaagaaaagagaagaccatgagggggaagatcaaatagagttgtagagacttctggtgtggatatgcagacatgatttaatccatagtctatggtaatcaccatctgtaagtggagaccccagcctacttgacttggtggtagaaattcttttcactggcagcggctttcatttctttttcctggaaattttatctttcttttctgttatagagtaaaatggaagcctgctagcagaacacatctatccacatgactctgacatagtagcctgcatttcccaccttataccaccttcctttatgggagttatttttcattgcattctgaagacaaaagacctttggtgataatcagtaaagatcctaacttggtggtagacagttttctacggaacatgcagttctgactccaataagccacaaggcagttcaaacaaaacacttggctgccctttgggagggacctggtgggcacatctttctcttttccttcacatctcattgcctgttgtcactcatggaatatgtgcatggcaggatcaagacaccaccgtctggtgttcctgccggcagggaaaatgttggattttgagcctagattcccaatttatgttattttatacccctctaccattatctttgttttattgcctgggggaaagcagtgttcactaaggaggaggtggttattgcaactatttgaatgtaatctggggccattaggaattcatccatctgtcaagcctgtggaaggaaggaatatgaatggagtactagttctgatagtgaagtgtgccttagaacagatgtttgaattgacaagtcttctcagtggtgtaacatataccagggtagcactggtaccaagtgagaatggggctttgtctttgtagccttttttcccttgtggtttgttgcagtggtttgaatggcatggttttttatttatttatttatttattttaaagagaatttagcaatttatgcaatttttctagaattgaatattttgtactttgataatagctcatttatggagggaaa

SEQ ID NO: 3240 - DNA, 8251 bp, Homo sapiens
gcatccgctgctctgttaagtgatcaccacattcattgttctcgtttctattatttctgaaaaaaatcttcaggattctgcttgtgggagtggatgacatttttacagtgtttacagctttatctattccagaatgtcatatagctggtataagaaagaacactaatcattcctaaggaagaaaattaacaacgccgtgagttataatatctggctgaaactgaaggagctctgtgtaattaaaagtcctttctgccctgcctggccatggttctgtatgcattgatgtcttacaaactgaaaaaaaaaaaagttattttctcatctccattccctagcatagacatattacatgatgtggaattgaaacaagaaaattgcattttaatcttccactcagaacatagaagaatgaaacaaacaaacaaaaaatactctgttgtcttagtctaccacaagcaaaatctggcagtctctttgctttggtaatggcataaattccttgattagcctataggatagcccattgttctgctcttttagtggaatagctagcaattgctttgtcattttttccccatggttcctaccattagtgttgggaggtttcttctttgtttttttgagaaagaggaaaaagttgttatattttcataaaaacttaaatttcatccaaaatacttgattttcatgaagaaagtaaatatctctgcccctagtatacatgtgtggaaactttcagaaccctgaagataaatacatttcaaacaagtgagtttgaaaatatcaatagcaaaataggaagtaagctaattagagaggtaagaactagatggcttagcattccaataataatatataaccttctttaagagtaaaatcttggtcaaaagacagatgaaaactccaataaaatttcacaactcatggaaaagtctatcttcgtaattctttatgaagcaaactatatatatataaaacatatatatatatatatttgagacagagtttcgctcttgttgcccaggctggagtgcagtggtgcgatcttggctcatggcagcctctgtctcccgggttcaagtgattctcctgacacagccttgtaagtggttgggattacaggtgtgtgctatcatgcccggctaattctgtattttgagtagagacgggggtttctccacgttggtcagggtggtctcgaactcccgacctcaggtgataccctcgcctcgacctctcagaatgctgggattagaggcttgagccaccacgcctagctgcaaacatatttcttatattttccaacatcacaaaattttactgagctatgatatgtactaaaagctgataaagatggtgttgttatatttaacagtactctgaattttgttgccatttctaaaattgtattcagaggaaattatgcccatgtttctatagagagaattttaaaaaatacatgagcatagaaatttgagcaacattgattaaggttccataaaattgaagcaggaaatagtatagaatatacttttgctcactctattaaaataagtctctcataagtatgcttcagttaagttcgaagggtaggaaaattaacctggaacggggcattcagatataagtaagtttattttggagaaatttctatgtcagctgagattattttctataaaaacagaagaaagatgaatatcactaatgatagcacaaaccactaattagaaggcagtatgtagaatttttctggaaaaataaaactataaatgacaaattaattttagcagaaattgtaagaaaatgcaatgagggtaataggaatgttatctttgaatacaatggacagcaaattgtaaactgaatgtattcactaacacaaaagagaaaattacttttaatgattgcctattgtttctctctacataaagtttgagtttcatgtctgatgaccttatggctttttaaatagacacttcatgtgacatcattaaattactttatacagtattactacatttctatggtaaaatttaagcaagagattaattttgaaagactttcagagaaagacttgtaaatacagacatgagacataaatctgatgtgggcctttgctttgttttgcttattttcttttagtttttgtttaataaaaaattggggtttgtaaaagtttagaatactcgcaggaatgttgtctagcaacatttttggttatattagtaacataactacatggaataacagcaagaaattttcttccatgaaaaattaattttccatttctattgcaaggggagagaaacaactaagtgctgcatatatcccccaaattatatttaattatttcatacttaaattttctttgttaccacagcgtaaagggttgtcacagtgcaatggtggcacctattggcatatgggatatatgacattaaactgtctgaattttccccaaattttctctattcagtgcatataagttctagaattgaagaacgcatggctaaaatcagcactttcaattttaaatgaacaagtttaaaagccaacactaaatgcaatgtgtaaggtggcattagtcatggaggttttctgaccatgggacattaaaaataatgagaagagaaaacaatgtcaatatttatttcacaataatgcttttgtgaaacagtgaaataatgaaaaatcagaaatatagatagatagatagatagatagatagatagatagatgcagatatacaccataaagacatacactaatcagggagctattcactggagagaaaagattaaactaatcaggttaataattatgtatatatagaaaagtgaatcatataccatatttatagactcaccgtgatggatcagttttctctatataacatccaagcataaaacgtggagaaatcagctaatgaggagttcagtcagatctacaaaacaatgataattgattccttctatataatttttcttcttaggcctggatatattgtatataacataatatttaatttgtactatttatgatatataatgtgcaatatataatgtaaaatcataagattaattttggaacacgctcttacgttattgaaacacagattaataatgtatatattatatattactcatatatatcattactgtatatatattactcatgctttcagtcacatgaagagagcttctaagtattaatgtatgacatactaaaatgaatgagcgttctccacaaaacatactttcatcacccaatgaatatttatattatgttgccaattacagagtaggaagtattggatataaatactgttctcatggagcttacagtgttaatgcatttgtcttttatatctaatacttattatattatttccgttattataatataagggaaatgtatgttatagtaatgacaaggataataacaatgatgcaatgaaagaggtgatcaaggacaagggttagaatgacaaaaagagaaaaataaggtagtgttaaattatatgaagacaaagtaagcaagaggagttggtagatggattgtgggtgggggtgcacaatgttaaacaggtgattcatgtagtctccagtgatatgacattcaagccaaacctgtattaggttaatcaatgctgaatccattttttctaatgtggagtgaatagtgatagcacaatttctagaggaaaatttaggtttggggtagaaatttagaagtcatcaaaatatgtattttatttatgcacaaaagactggatgaaagtactaaaagagggtaaatgtttacagagaaaagaagagttccaagcgttcagtcctgaagtactccagcatttgtgagattgattaaaacagaaagaactagaatgagtgacttaaaaaaagagaatgtggttgttggagaaaacacagaagaatgtggtatcttccccaagaagaaagaataaataagaatttgtgctaatgattgctgatagacctaatatgaggaaaactgagtgattactattgagttatcaatatatgtacaccactggtgacctagagaagtttggtgagtgccagaggcaaactccagattgagcagattcaagaggaaatggaaacaagtgaatagaagaagtgaacagagctataagagtacagacagctttatgtatgatctctgctctaaagaagagcaaggagattgggaggccgaggtgggtggatcaccaggtcaggagatcgagaccatctgggttaacacggtgaaaccccgtctctattaaaaatacaaaaaattagccgggcgtggtggcggacgcctgtagtcccagctactcgggaggctgaggcaggagaatggcgtggacccaggaggcgaagctcagtgagctgagatcgcgccacttgcactctcagcctgggcgacagtgcgagactccatctaaaaaaaaaaaaaaaaaaaagaaagaaaagaagagcaaggagaattaacaaaccatctgtgtttttttttatggtttgttatacaagtgggtagagactcagcaacactctatgtctattagcagagtttctaaagtacaatatagtaagtggactaagggatagttcaacttggtcagattaagaggcaaacatcataattacagctatgctaagtgggcagtcagcatacaataagcacttttctaagtgctttacatacattgtcataattaatccccatcaaaaaacatagaatatcattatctcatttttatagaaagaaaccaagccatagacaagtaagggagtcctacggccataccaccctgactgtgcctgatctcttcagacaagtaaggggcttgccagttttcaaaggtacataatcagagaacaaaagcccaaatagtacattcctcttaccaaaatgaatacattttccactatcaaaactctttctttgtgagtagaaggaaaacaacaaggaaatcatgcttgagcagatgatatagaacatagaatggcttgcaaagagcttgcaaagaggttgtgggaggttttaaagcttatgagtgtgactgtggcttagaatcatttttatttcaagaatgaaaatgaaattagtttgggtaaaaaatgatgggactgtcttagaacgtagaatataatatggacaaataaatatttaatatatgagaatggaacacaggagaggaattctagtcgtaagtaccactttggatgtcatctgcatagcattgatatccattagttaatgaattctatagtatttgatcacctagtctctgagtactgagctacatgttacaagtacaggagtgaaatagatagacttctgctgtcagcaattttactgaaaaatagacaatattgataaagaagcataattaaaatacattgtggtgattgcttaaacatcaacatattatatcagcatatgtaagcatctctaatctgtatttggaggatgagtgttagagaaggctttcagagtagatgaaattgttatttttttaagagaaaacatgcaaagaaaaaactaacccagatctttcgaaaatatctgaaaataagaccaagagagtcaaagaaggaacaattttctagtagaagatgaataaatctatagacttttctgcaaagcaatgtgaaatactgattataaaaggaaacatttaacaaataccacctaaagctttttttgatataaaattagaaaagtacatatgacttgctactgagtagtttcctctctgacagagggaaggcagctctctgaacatgttaaattaaagaataagtgcctggttaggaagcacaggcaggaaataagggctaaagctttcaaaaagaagaaaggtaagtacaatactgagggaaaaatgtaaaggcattgccatgaaggcagagaaatcacttacacagatcagaatccaagaacagaccaacataaagtcagtctctagaccctgagcactgaatgcccccgagtgaacaaaaagaaggcttcataagcagtgagcatcaaacattagaaggaatttcaaatgtgtgtgatctctttatcctgatggatcttcaattgcataattttccattagattggacaaagattgttgacctccctctggtggacaggagtcacctaaataaatgatctgtggtacatatactgccaccttctccctttccccatacctatatgcacagcttctgagactaaaacaaatgctgatttatgctgccaacaatcttccaatagtcatagaccttacttccagaacaacatactctcaagtagacagagtgaaaagattgatcaatccataagagatctcaagtctactttcaaatgtcattttgcttatgattgaaatgttttaagatagcctcattgaactcagcattatttcatgctggacagctctctacagtctataccattctagtacactacagaatgacatcttattcaaagatggatactaaagttagcagaaaagacagatgtcacataattgaaatcacagttgggaagaatttgggaagacatcatgcacatattcagtgagcaactaatatagtttttatttgctaatttttattttatttttatttgaaaaataacaatgataagagtacagtgtgattcttgatatatgtatacattatgcaatgattcaattaggcttattaacatatccatcacctgacatacttatttttttgtttggtgagagcatttaaaatctactctgttagtaattgtgaaatatacattacattactattaactatagtcactatgctctgtgatagatctcaaaaacttactattcctgtctaactgaaaatttgtatccttttacaaatatctccacactttcaccccacccccacctccacggcacagctcttggcaacctccattctactctcctattctatgacttttttagattccacatgtaagcgagatgatgtagtgctttgtctttctgtacctgactcatgtcatttagcatggtgtctgatagttttattcatgttgttgcaaatgataggatttccatctttttaaaggcaaaatggtgatctaatgtgtatacataccacattttctttattcatccatctgttgatggacacttagattgattccacatctttattattctgaatagagctgtgataaacatggaagtgcatatacctcttaaacatactgatttcagttcctttgcatatacaccgagaagggggattgctatgcactttttatttttcatacaaaattggaaaccaatactgcatttttgattgaggtcttatttgtaaaaggggctatgttgaaccttgactaggatctttctgtctctgaacacattcaagttgtcagaaaattctctcacctacatctgcccatctctcctcacctccagcacttcatcttgagaccaaactggaaaagtcttttattagaattttcccccaattgactccaatcagcttttccttctcctaccccattgttccctttaattctcagcacagtaggcagggatcctgttaaataaaaaatataaaatgtcagccttccactcaaaccttcctaatggcttcccatcttgaggcaggagaatcacttgaccaagagatcaagaccagcctagacaacatagtgagatccctgtctctacaaaaattacaaataataaccataatgaggcgtggtggtgcatgcctgaggtctcagctactcaggagactgaggtgggaggattgcttgagatcaagtctgcagtgagctatgatcataccactgcactccagcctgggcgacagagaaagaccccatctcaaaaaaataaataagaaataaaagtaaagtaaaataaaataaaagtgaaaattttgattaataccaggtaaacttctgcatgaggaaaaccccaccccctcctttatctttctaaacagattcaagcaggtctcacctcagagcctttggacttgctgttcccaatgacagatgtgctctcaaccaaatttcattgtgttaagttcctttacctccattggtatgttgcctacatttcgtcttcccagtgttgtggccaacacacaggcacatacatgcacgtggacacacacacacacacacacacacgtcttttagctttgattggcttattgcactaatcacatcaaatgtatcacttatttagccttttttt

SEQ ID NO: 3241 - DNA, 2236 bp, Homo sapiens
attcattaagataataggatcatgatttttcattaactcatttgattgatattatctccatgcattttttatttcttttagaaatgtaattatttgctctagcaatcattgctaacctctagtttgtagaaaatcaacactttataaatacataattatgatattatttttcattgtatcactgttctaaaaataccatatgattatagctgccactccatcaggagcaaattcttctgttaaaagctaactgatcaaccttgaccacttttttgacatgtgagatcaaagtgtcaagttggctgaggttttttggaaagctttagaactaataagctgctggtggcagctttgtaacgtatgattatctaagctgattttgatgctaaattatcttagtgatctaaggggcagtttagtgaagatggaatcttgtatttaaaatagccttttaaaatttgttttgtggtgatgtattttgacaacttccatctttaggagttatataatcaccttgattttagtttcctgatgtttggactatttataatcaaggacaccaagcaagcataagcatatctatatttctgactggtgtctctttgagaaggatgggaagtagaaaaaaaaaaaagaaagaaaggaaaggaagagaggagagaagaaggcagggatctccactatgtatgttttcactttagaactgttgagcccatgcttaattttaatctagaagtctttaaatggtgagacagtgactggagcatgccaatcagagagcatttgtcttcagaaaaaaaaaaaatctgagtttgagactagcctggccaacatgttgaaaccccatatctactaaaaatacaaaaattagcctggtgtggtggcgcacgcctgtagtcccagctactctggagcctgaggaacgtgaatcgcttgaacccagaagacagaggttgcagtgagctgagatggcactattgcactccagcctgggtgacacagcaagactctgtctcaaaaaaaaaaaaaaaaaaaaggaaaaaaaagaaagaaagaaagtcccagcacacctagataatttaccgagctcttcagcaaaaaccatgttacatacagcatattccaaagaaatgaactcttctgcaatttaaattataagtaatatgttattttggatcctagagaaaccattttctctacatttcatgagcatggttagaaaagagtttacaagaattaggaagagggaacaattttaatggtcagaaaagaataaaatttattctagttcaagaagtgcacacaaagaatatgcattaatctaacaactatgagattaaatctttcaaaaaggtcaaaggaggattgagaagtttacagagatgtccacggcattttatatcaatctcaaaggtaaggtctgcatttttataaaccaacttaaacttctgttgagataggatattttgttttcaagccaaaattaccattaatcaaatatgttttaattatctgatttagatgatctactttttatgcctggcttactgtaagttttttattctgatacacagttcaaacatcattgcaacaaagaagtgcctgtatttagatcaaaggcaagactttctatgtgtttgttttgcataataatatgaatataatttaagtctatcaatagtcaaaacataaacaaaagctaattaactggcactgttgtcacctgagactaagtggatgttgttggctgacatacaggctcagccagcagagaaagaattctgaattccccttgctgaactgaactattctgttacatatggttgacaaatctgtgtgttatttcttttctacctaccatatttaaatttatgagtatcaaccgaggacatagtcaaaccttcgatgatgaacattcctgattttttgcctgattattctctgttgagctctacttgtggtcattcaagattttatgatgttgaaaggaaaagtgaatatgacctttaaaaattgtattttgggtgatgatagtctcaccactataaaactgtcaattattgcctaatgttaaagatatccatcattgtgattaattaaacctataatgagtattcttaatggagaattcttaatggatggattatcccctgatcttttctttaaaatttctctgcacacacaggacttctcattttccaataaatgggtgtactctgccccaatttctagggaa

SEQ ID NO: 3242 - DNA, 923 bp, Homo sapiens
ccaatgttcagggcctccagaaatatcaatgtccagagtaaccaatgtcttcaaaatccaaggcttgcaatgtctccaatatcctgtgcttacaatgtttccaatgtccagggtttccgatggcacctgtgtcaaggtcttccaacaactccgggtcttccagcgacttcaagtcttccaataatctcaaggtcttccagataatcctgagcttccagaaaatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaaatccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccaggtattctaa

SEQ ID NO: 3243 - DNA, 8480 bp, Homo sapiens
gcatccgctgctctgttaagtgatcaccacattcattgttctcgtttctattatttctgaaaaaaatcttcaggattctgcttgtgggagtggatgacatttttacagtgtttacagacacaaaatgaacaagatgtctgtggcaaccctcagaccattgacgccttctctcctatgtatcaaatcacacatttggacgttgactgaaccctcacatgtcagatgctcaatattgaggtatagtaaaagggagcatgaacttgagaaaatacgctttcaacacaaagctgtaataatataaggtcaaataagattctgcattggagatagaaaactctgaaggaagctttatctattccagaatgtcatatagctggtataagaaagaacactaatcattcctaaggaagaaaattaacaacgccgtgagttataatatctggctgaaactgaaggagctctgtgtaattaaaagtcctttctgccctgcctggccatggttctgtatgcattgatgtcttacaaactgaaaaaaaaaaaagttattttctcatctccattccctagcatagacatattacatgatgtggaattgaaacaagaaaattgcattttaatcttccactcagaacatagaagaatgaaacaaacaaacaaaaaatactctgttgtcttagtctaccacaagcaaaatctggcagtctctttgctttggtaatggcataaattccttgattagcctataggatagcccattgttctgctcttttagtggaatagctagcaattgctttgtcattttttccccatggttcctaccattagtgttgggaggtttcttctttgtttttttgagaaagaggaaaaagttgttatattttcataaaaacttaaatttcatccaaaatacttgattttcatgaagaaagtaaatatctctgcccctagtatacatgtgtggaaactttcagaaccctgaagataaatacatttcaaacaagtgagtttgaaaatatcaatagcaaaataggaagtaagctaattagagaggtaagaactagatggcttagcattccaataataatatataaccttctttaagagtaaaatcttggtcaaaagacagatgaaaactccaataaaatttcacaactcatggaaaagtctatcttcgtaattctttatgaagcaaactatatatatataaaacatatatatatatatatttgagacagagtttcgctcttgttgcccaggctggagtgcagtggtgcgatcttggctcatggcagcctctgtctcccgggttcaagtgattctcctgacacagccttgtaagtggttgggattacaggtgtgtgctatcatgcccggctaattctgtattttgagtagagacgggggtttctccacgttggtcagggtggtctcgaactcccgacctcaggtgataccctcgcctcgacctctcagaatgctgggattagaggcttgagccaccacgcctagctgcaaacatatttcttatattttccaacatcacaaaattttactgagctatgatatgtactaaaagctgataaagatggtgttgttatatttaacagtactctgaattttgttgccatttctaaaattgtattcagaggaaattatgcccatgtttctatagagagaattttaaaaaatacatgagcatagaaatttgagcaacattgattaaggttccataaaattgaagcaggaaatagtatagaatatacttttgctcactctattaaaataagtctctcataagtatgcttcagttaagttcgaagggtaggaaaattaacctggaacggggcattcagatataagtaagtttattttggagaaatttctatgtcagctgagattattttctataaaaacagaagaaagatgaatatcactaatgatagcacaaaccactaattagaaggcagtatgtagaatttttctggaaaaataaaactataaatgacaaattaattttagcagaaattgtaagaaaatgcaatgagggtaataggaatgttatctttgaatacaatggacagcaaattgtaaactgaatgtattcactaacacaaaagagaaaattacttttaatgattgcctattgtttctctctacataaagtttgagtttcatgtctgatgaccttatggctttttaaatagacacttcatgtgacatcattaaattactttatacagtattactacatttctatggtaaaatttaagcaagagattaattttgaaagactttcagagaaagacttgtaaatacagacatgagacataaatctgatgtgggcctttgctttgttttgcttattttcttttagtttttgtttaataaaaaattggggtttgtaaaagtttagaatactcgcaggaatgttgtctagcaacatttttggttatattagtaacataactacatggaataacagcaagaaattttcttccatgaaaaattaattttccatttctattgcaaggggagagaaacaactaagtgctgcatatatcccccaaattatatttaattatttcatacttaaattttctttgttaccacagcgtaaagggttgtcacagtgcaatggtggcacctattggcatatgggatatatgacattaaactgtctgaattttccccaaattttctctattcagtgcatataagttctagaattgaagaacgcatggctaaaatcagcactttcaattttaaatgaacaagtttaaaagccaacactaaatgcaatgtgtaaggtggcattagtcatggaggttttctgaccatgggacattaaaaataatgagaagagaaaacaatgtcaatatttatttcacaataatgcttttgtgaaacagtgaaataatgaaaaatcagaaatatagatagatagatagatagatagatagatagatagatgcagatatacaccataaagacatacactaatcagggagctattcactggagagaaaagattaaactaatcaggttaataattatgtatatatagaaaagtgaatcatataccatatttatagactcaccgtgatggatcagttttctctatataacatccaagcataaaacgtggagaaatcagctaatgaggagttcagtcagatctacaaaacaatgataattgattccttctatataatttttcttcttaggcctggatatattgtatataacataatatttaatttgtactatttatgatatataatgtgcaatatataatgtaaaatcataagattaattttggaacacgctcttacgttattgaaacacagattaataatgtatatattatatattactcatatatatcattactgtatatatattactcatgctttcagtcacatgaagagagcttctaagtattaatgtatgacatactaaaatgaatgagcgttctccacaaaacatactttcatcacccaatgaatatttatattatgttgccaattacagagtaggaagtattggatataaatactgttctcatggagcttacagtgttaatgcatttgtcttttatatctaatacttattatattatttccgttattataatataagggaaatgtatgttatagtaatgacaaggataataacaatgatgcaatgaaagaggtgatcaaggacaagggttagaatgacaaaaagagaaaaataaggtagtgttaaattatatgaagacaaagtaagcaagaggagttggtagatggattgtgggtgggggtgcacaatgttaaacaggtgattcatgtagtctccagtgatatgacattcaagccaaacctgtattaggttaatcaatgctgaatccattttttctaatgtggagtgaatagtgatagcacaatttctagaggaaaatttaggtttggggtagaaatttagaagtcatcaaaatatgtattttatttatgcacaaaagactggatgaaagtactaaaagagggtaaatgtttacagagaaaagaagagttccaagcgttcagtcctgaagtactccagcatttgtgagattgattaaaacagaaagaactagaatgagtgacttaaaaaaagagaatgtggttgttggagaaaacacagaagaatgtggtatcttccccaagaagaaagaataaataagaatttgtgctaatgattgctgatagacctaatatgaggaaaactgagtgattactattgagttatcaatatatgtacaccactggtgacctagagaagtttggtgagtgccagaggcaaactccagattgagcagattcaagaggaaatggaaacaagtgaatagaagaagtgaacagagctataagagtacagacagctttatgtatgatctctgctctaaagaagagcaaggagattgggaggccgaggtgggtggatcaccaggtcaggagatcgagaccatctgggttaacacggtgaaaccccgtctctattaaaaatacaaaaaattagccgggcgtggtggcggacgcctgtagtcccagctactcgggaggctgaggcaggagaatggcgtggacccaggaggcgaagctcagtgagctgagatcgcgccacttgcactctcagcctgggcgacagtgcgagactccatctaaaaaaaaaaaaaaaaaaaagaaagaaaagaagagcaaggagaattaacaaaccatctgtgtttttttttatggtttgttatacaagtgggtagagactcagcaacactctatgtctattagcagagtttctaaagtacaatatagtaagtggactaagggatagttcaacttggtcagattaagaggcaaacatcataattacagctatgctaagtgggcagtcagcatacaataagcacttttctaagtgctttacatacattgtcataattaatccccatcaaaaaacatagaatatcattatctcatttttatagaaagaaaccaagccatagacaagtaagggagtcctacggccataccaccctgactgtgcctgatctcttcagacaagtaaggggcttgccagttttcaaaggtacataatcagagaacaaaagcccaaatagtacattcctcttaccaaaatgaatacattttccactatcaaaactctttctttgtgagtagaaggaaaacaacaaggaaatcatgcttgagcagatgatatagaacatagaatggcttgcaaagagcttgcaaagaggttgtgggaggttttaaagcttatgagtgtgactgtggcttagaatcatttttatttcaagaatgaaaatgaaattagtttgggtaaaaaatgatgggactgtcttagaacgtagaatataatatggacaaataaatatttaatatatgagaatggaacacaggagaggaattctagtcgtaagtaccactttggatgtcatctgcatagcattgatatccattagttaatgaattctatagtatttgatcacctagtctctgagtactgagctacatgttacaagtacaggagtgaaatagatagacttctgctgtcagcaattttactgaaaaatagacaatattgataaagaagcataattaaaatacattgtggtgattgcttaaacatcaacatattatatcagcatatgtaagcatctctaatctgtatttggaggatgagtgttagagaaggctttcagagtagatgaaattgttatttttttaagagaaaacatgcaaagaaaaaactaacccagatctttcgaaaatatctgaaaataagaccaagagagtcaaagaaggaacaattttctagtagaagatgaataaatctatagacttttctgcaaagcaatgtgaaatactgattataaaaggaaacatttaacaaataccacctaaagctttttttgatataaaattagaaaagtacatatgacttgctactgagtagtttcctctctgacagagggaaggcagctctctgaacatgttaaattaaagaataagtgcctggttaggaagcacaggcaggaaataagggctaaagctttcaaaaagaagaaaggtaagtacaatactgagggaaaaatgtaaaggcattgccatgaaggcagagaaatcacttacacagatcagaatccaagaacagaccaacataaagtcagtctctagaccctgagcactgaatgcccccgagtgaacaaaaagaaggcttcataagcagtgagcatcaaacattagaaggaatttcaaatgtgtgtgatctctttatcctgatggatcttcaattgcataattttccattagattggacaaagattgttgacctccctctggtggacaggagtcacctaaataaatgatctgtggtacatatactgccaccttctccctttccccatacctatatgcacagcttctgagactaaaacaaatgctgatttatgctgccaacaatcttccaatagtcatagaccttacttccagaacaacatactctcaagtagacagagtgaaaagattgatcaatccataagagatctcaagtctactttcaaatgtcattttgcttatgattgaaatgttttaagatagcctcattgaactcagcattatttcatgctggacagctctctacagtctataccattctagtacactacagaatgacatcttattcaaagatggatactaaagttagcagaaaagacagatgtcacataattgaaatcacagttgggaagaatttgggaagacatcatgcacatattcagtgagcaactaatatagtttttatttgctaatttttattttatttttatttgaaaaataacaatgataagagtacagtgtgattcttgatatatgtatacattatgcaatgattcaattaggcttattaacatatccatcacctgacatacttatttttttgtttggtgagagcatttaaaatctactctgttagtaattgtgaaatatacattacattactattaactatagtcactatgctctgtgatagatctcaaaaacttactattcctgtctaactgaaaatttgtatccttttacaaatatctccacactttcaccccacccccacctccacggcacagctcttggcaacctccattctactctcctattctatgacttttttagattccacatgtaagcgagatgatgtagtgctttgtctttctgtacctgactcatgtcatttagcatggtgtctgatagttttattcatgttgttgcaaatgataggatttccatctttttaaaggcaaaatggtgatctaatgtgtatacataccacattttctttattcatccatctgttgatggacacttagattgattccacatctttattattctgaatagagctgtgataaacatggaagtgcatatacctcttaaacatactgatttcagttcctttgcatatacaccgagaagggggattgctatgcactttttatttttcatacaaaattggaaaccaatactgcatttttgattgaggtcttatttgtaaaaggggctatgttgaaccttgactaggatctttctgtctctgaacacattcaagttgtcagaaaattctctcacctacatctgcccatctctcctcacctccagcacttcatcttgagaccaaactggaaaagtcttttattagaattttcccccaattgactccaatcagcttttccttctcctaccccattgttccctttaattctcagcacagtaggcagggatcctgttaaataaaaaatataaaatgtcagccttccactcaaaccttcctaatggcttcccatcttgaggcaggagaatcacttgaccaagagatcaagaccagcctagacaacatagtgagatccctgtctctacaaaaattacaaataataaccataatgaggcgtggtggtgcatgcctgaggtctcagctactcaggagactgaggtgggaggattgcttgagatcaagtctgcagtgagctatgatcataccactgcactccagcctgggcgacagagaaagaccccatctcaaaaaaataaataagaaataaaagtaaagtaaaataaaataaaagtgaaaattttgattaataccaggtaaacttctgcatgaggaaaaccccaccccctcctttatctttctaaacagattcaagcaggtctcacctcagagcctttggacttgctgttcccaatgacagatgtgctctcaaccaaatttcattgtgttaagttcctttacctccattggtatgttgcctacatttcgtcttcccagtgttgtggccaacacacaggcacatacatgcacgtggacacacacacacacacacacacacgtcttttagctttgattggcttattgcactaatcacatcaaatgtatcacttatttagccttttttt

SEQ ID NO: 3244 - DNA, 2702 bp, Homo sapiens
gtcgaaggggcccgaggccccgagaagggcaggatgcgatgctgggtgtgtgacctcagccatggaagggccacctgccaccggggggctgggccgtcgggcctttggttgtggagggaaaagagtggccacttgctggagctgggaacgtgcagtgatgagcactaggacaagaggaccgtgacaaacagacatagaaggtaaaactgcccgagtacaggctgatccacagacctgtgtccagggagaggcctcaggatggatttggaaatgcaggacaggttcatgaaatcctcacacacctgccacatactcaaggagggtgctgtttacttgattgattgtgctggtcctgaacatctgacatgatttgtggttataaatgggtgtttgccgttaactataagtatcttggagtaatttaacaaacaacaataggtattggggcaggtcagcgcgtctccacctgaaagacaaaggaaagccgtgaacgcaggaccagcagttgtggctcacggtgagaggtgacagcgtggtagcatcccttgctggctctgggcgcgtcctcggcctcggcgtccgctctggccgcgctcaaggagctcttcagcccgccgctgcgctatgagggcctctctctggggctggcggaggccggagcctgctccctctgctggcggggaggtgtgaagagaaaggcactggctggagccggcgctgcgcgcggcgctcgcggcccagcgcttgggttccaggtgagctccggctctgcaagccccgcactcggcgtggccggccggcgcctgctgggcttgatcggagactgaatccctgcgtggaccaccgttccctcttcgcgggattgttggccaccatagccgatctccgtctctttctctcttcccctcttttcctcttgattgtctggaactagctccctctgggctgccggattacccggcccgccaagttccgcagcgagagccagtgagagatgatgccggctgggcttctgggacggttggggacttggagaacttttgtgtctaactaaaggattgtaaacgcaccaatcagcactctgtgtctagctaaaggtttgtaaatgcaccaatcagctctctgtcaaaacggaccaatcagctctctgtaaaatggaccaatcagctgcctgtaaagcggaccaatcagcaggatgtgggtggggccaaataagggactaaaagcaggccaccagagcaggccgctgcagcttgctcgggttctctctctgctctgtggaaacgttgttgtttagctctttgcagtgaatctggctgctgcttattgtttgggactgtgccacctttttttttttttttttttttttgagacagattcttgttctgtctcttaggctggagtgcagtggcgtggtctcggctaactgcaagctccgcctcccaggttcacgccgttctcctatttcagtctttccggtagctgggactacaggcgcccaccacaatgcctggctaatttgcgccatctttaagagctgtaacactcaccgctaaggtctgcagcttcactcctgaagccagccagactacgaacccttactacgaacccatcagctggaaggaacaattccagacaattccacacaggaggaagcaacaactctggatgtgccacctttaggaactgtaccactcacgggaaggtctgcagcttcactcctgaagtgagcaagactacgaacctaccgggaggaaggaacaaattacggacacaccattctttaagaactgtaacaaacccgcgagggtccgcagcttcattcttgaagtcagcgagaccaagaacccactaattccatacgcaatgggttcatttcttttttttttttttttacaaaagtcttctctgtgctgacttaaggggacactttgtgtcacttccagggaaggatgcgctggggtcccgacattctgtcagggtccaaacaccctcgttcctcatccagggcatggagcacctgagtaggatggaacatttgggaaaaaccccacctcagtcccaggcccggcagcctgaggagatctaaggctggctgggcattcgagctgtaagagcagggagtgtttactgcacccaggagaggtgatcaggacacaatttcactatttctggttgttttagaatcaggttcctttgtctccttattttacctcagttacattttccaagatcctaggactcacagaaggatgcagtcggtgggggcagagtgctgtaccagggcctccagacatggtttctagacactggctcatgtgatggcaccagggcccccagccatggtttctagacatttggtcataccatggccttggttgatgaccccatccatcggatttcatcctcctcaaaacgaaacagaaggtttagcccagcagatctctggagtctgtgattttcagatgagagcccaattgatggtgaagcataacaagagtacggttgatttcattccttcagcattcacttattccatgtgtgtgtaaagcctgatctgtgttggagagctcagcatgcagacatgacgtgatggagctgtggctctacagttacccctcaccatagtaaacagatgcacaattacttttgattatgttcgtgtaataaaggtagttaaagttcaacatttatcagaaaaa

SEQ ID NO: 3245 - DNA, 4739 bp, Homo sapiens
actcggcgccagccccacggccatcaccggaccgctggagatgtgactgggctcgggacatgagcccgcttgttcgctcactctcagtgaaaagagttttgaaatgagttctgaatagacagcattttctttgtgcggttggtaaataacacagagcaaagttagcaagttgcagcgcctctgcgttctgattctatggaacctttttgtagggagaagggcaggatgtttttaactgaatgtgacctcaggggaatactagaggtaaggagagaaaaataattgaggtaactgtgggtgttttacatctcggaaaccatggcttttaataaggccacatgaagagagaagctggcatcatcccacgcaaaaaccagtgcctggcagagttgtggaagaaaataataaaatttctgaatggggcagcgtggagaaatcctaagagaaatagcataagagcattttggaacacatccaggaaaagataactttcgacacacctgtagacgttcgccaggtaaaggaaatccaggcccttgagcaatgtattgatgaattggggtggaaatggaggaggatggaaacgatggcggcactggactgttttccagaaaccatttacacaggctcaccagaagagggcagcgcagagcaatgaactctccgaggagtttccaaacagatgtcttgaaacttaaagtgaaaatctctgcatgaaagtagccgtttttggacagcgtcctccaccaaaaccatatatctctaaaataataataaaactccccaaacatgctaatctcgaaatgggtccctcaacatggaaggattgagttgcaagggacaaaattttacttccctgtcagagatgttttcacttcgattatccttttgatttattttattataaaagactatgtgaagtctagtattagtcatgtgcacaaatattcattatgcagctttttggggtgatttttttgataaaaatattgaaaaaatcacaaattcagattcgtggaagattccctacgcaacacagcgtttgaagcaaaatgcagcttaaggaagtttcccattaaatccatatttccttgatgcaaaatgatatcacattgttttacttgttaatttttttcttctcagaattaccacagaaaatattttttgttttataataaaacacgtgatactctacattggacatacattttacacttgaaatctggaaagaaaaacctactagactggaacagaattccaaagaacgtgaggggacaaatctatggagacatttatattttgttttagggttattataaaactctagtttcatcgtctatgcataaatgtttaggggatctaaatatcttcactaaattttattctgtaatcggaaagttggcatttaagatgatcattcttataggctaattaggatgataaaatcctttcctcttttcaaaagttcacgaacgcataacaaattggaactacttttacaagccgagtgtccctcttatgccattagctttcttggatttaccttctagatgactttggctcctgttaacttcagatctttgacatatcaagtatggttgttttcaaaggtttcccaggcaactgcaacaattcatctggttctagtcaaaagtgcccttgaactctcagctcacttcccttccctgtatgagtaatgtgtgtagcaaaaggaaaaacaccaaagacttcatgtaatggctaatgtgaatgatttggtgaagagaggaatggatttcacaaaaggatccacttggatgttaagacctcagctggctgcctgcgggttccctttgtcaagctctcatttgcatttagggggaaggccacaacccacatcatgtgttcggggttctgtttaactcttcctcacagttcctagggccccaaactcttaccctaggtggccccaaggactccttcaaggccagatcgctggcccgccagggagtgactgcccccaaatctctgagagatgcctcaggactccagctgactcacacacacgctgacctgtgagaatcattctgtgcttcttgtttctcacataacccactgggaagcaatggttggagtcttgttgcattttacttacaggaagagttttataattacctcccaagaagttcctgaagaacagaggagggagtaattggaatctctgatcctgttgtttgtgaaaggttcctctgctttacattaattacattctgtgttgcgtttaaaagaaaagatttcacctcatctaggcagacagtgcagttagaccatcaccttttttcccctttattttgactcttgtcttcacagctaatttactagtgactaaaatgatggcaaataaggcaatataatatggacagcctgcaaatcccactcatggagctctgtaagtgggagcagattgctgtctgagtacagggcttctgcagaagtctccctatcaactccacgtcgaactcaaagtctagagagcttcaacaattaatgatatgtcatctggatccagtcataaaagcatgatgaccaccccttcccccacccctcaccattcctttctccttggatttgttatatttcattctgttcaatataattactgagatgtaaacattccattgaaatgtgtctaagtaggcagatttttaagaatctacttttatgggtctataacaaattttaggaaggctatttcattgatatgtgaaagtgtataatagttgctttagctactagcccttccaacagctacatttaccactgtgattgtcactttgaataatccttgtgttattaaaattaatacagataaatataattttatagtaggaaatgtagttgtcaggatgtgaaacaatagtaatcaatttgaataaatatttgctatttgttttcataaaagttttaatcctcaaaagagaactctgaccaaaataggaatatagcaggatcaatgaaacaggtggcatgagtcatctcactggcttttaattaaaaaggatgctgtggttgttggcgtggactggactgcgcataggcagttttagaatttcttaagctgaaatccagctggagagttcttaatcagaatggacttattttgataatttataatctgtgtattcagagcattgatgttatagttttgatacctaaatcaccgttttaaaaattcaaagagatatatgaatcctgagtctcggacagttattcctgagccaaaggatttctgtgcaatgctaatatgtataatagagaatcagtctttcactgtacagttttgtcatcatgtttcaataactgaatgaatattctgaattaataagcataacgtttgtataagctaaagactaatctaagctctgcattcattgatgggaaccttaagcaaatgtttcttttcatcagcttgttcaaaaggcataaacataattacagttctgaggcgataacatatcgactggttaaatagtaagtgggtctggacaaggtaacttaaagttatgggctgcacgttgttttgagtacttggaagcatctggaaaaaataatttttttaaaaagatatttttactgtttatcttatagaaaaacagtatgagcattaaacccccactagaattttggaggttttctttttctaaagcgttggttaaaattcagataagttgatacttacagcttgagagaaaagatggggaagtggtagaaatatcaaatcatgagttagttttaaatttctcagaatgctcagggggcagtgagggaaagagggacttgctggccatgtccccacacctccgctttgcaccttttgctgaagttagttcccgaaaacagtgctgggtgtttgggttacatctggttcagccttcttttcctccttccttctttatccgtcacatggcctgccctctatctcttaaatcttaggtctgttgtgagactggggaaggagtgatgtgaacatgtgctcctgggcctggaaatgcccctctgccccgactccttctgtctcagcagtgcttgtcattaattctcccaacaaatacctgagcccttctctgtgcaggatgggtctcagtgctttgaatgtgctgtctcgtttaattctctcaaaagccctttattgacaatgctcttataatattttatacagaaagaatggaaagctaatccaatctttttctaatgtggttaatcaaatttatttatttttaattaatggtggcttagaaagctttctttcagcattactatcctttatgagattgtcataaatgtttactatttttcattgttcatggcaaggcggcaatagatcttattcagaattgataatcagtgtgatttatctggtagccaaaccaaaaatcaaactattatgctgtttagatataatggtagccactagaagatttacatcaaatgttagaccagaagccctttccatcagtgaccaggtttggtatctgctaggagggaaaagcctggtaactgatcaccagtgtttctgttctttttactttatagtttgtaatttaccaaggcatgattaattttgctgatgtttaagttacttacaatcatattaagagttagagaggagtgatatcagcaagatggctgactaaaagtgcccaacacccatttcctggactacccccacaaaaaatgaataaacaatgaataaacaacta

SEQ ID NO: 3246 - DNA, 812 bp, Homo sapiens
ctgacaggtgcagggccctgcccctcgagggccagcctctccctcgggagcgtgggtttttcctgtttgatcctggcttaacttgaacatctctggcattggagctgccctctggagtagcccagaagttggcactcacctcaccttttgctgcatttccaagagatcagcctttggacttcctggaaagtggtagaaccactgtcctatgaaacaaagtgcttctgtgctgaaatggagtaagttccctgcagcctctggcaaggtaacctaccgagcacctcctggagtaggtgttcctatcatcctctctttatagctcaggagccaaagctcagccagcccgaaggagccaggattagagcctgcatggatgcaacagtcacgcttctctctattacgtgtcttgcaacttggagtcacatgatctcagcatctgatccaccctgggctcagaacctcccagaacctcccagaatcgaggctcacggcagaggttctgcactcaccaaggacgcggggggaccatgtctgtgctcatgtggatccccgctgctgggcagagcacaccacacatccagactcaacaaaatacatggagtcaaaggtcaggtgactgaatcaatgagtatgttacacaccaagaaagacccctcctctctgcaccccggggagcagccccagaagcctggtctcctccaggatgaaaatgcaaacgcaggtgcctgggggctcccagagcctttggcttcacggttccctcccggccctgcctggagcttcatgtgcctccccttttgcttaatgagagc

SEQ ID NO: 3247 - DNA, 236 bp, Homo sapiens
caatgctgtgtagccagagcctagacaaaagttacagcacctgggagatcagtgcagagatatgtcacaatgtccccagtaggcagagaccaggcaagagttggatcacctcgggatcagtgcagagatatgtctcaatccccctgtgggcacagcctagacaagagttacatcacctcggttaacagtgcagagatatgtcaaaatgcccctgtaggcagagcctacacaagtgt

SEQ ID NO: 3248 - DNA, 10707 bp, Homo sapiens
ccagccctagccccagtcccagtcctagttcctcagtcccgcccagcttctctcgaaagtcactctaattttcattgattcagtgctcaaaataagttgtccattgcttatcctattatactgggatattccgtttacccttggcattgctgatcttcagtactgactccttgaccattttcagttaatgcatacaatcccatttgtctgtgatctcaggacaaagaatttccttactcggtacgttgaagttagggaatgtcaattgagagctttctatcagagcattattgcccacaatttgagttacttatcattttctcgatcccctgcccttaaaggagaaaccatttctctgtcattgcttctgtagtcacagtcccaattttgagtagtgatcttttcttgtgtactgtgttggccacctaaaactctttgcattgagtaaaattctaattgccaataatcctacccattggattagacagcactctgaaccccatttgcattcagcagggggtcgcagacaacccgtcttttgttggacagttaaaatgctcagtcccaattgtcatagctttgcctattaaacaaaggcaccctactgcgctttttgctgtgcttctggagaatcctgctgttcttggacaattaaagaacaaagtagtaattgctaattgtctcacccattaatcatgaagactaccagtcgcccttgcatttgccttgaggcagcgctgactacctgagatttaagagtttcttaaattattgagtaaaatcccaattatccatagttctgttagttacactatggcctttgcaaacatctttgcataacagcagtgggactgactcattcttagagccccttcccttggaatattaatggatacaatagtaattattcatggttctgcgtaacagagaagacccacttatgtgtatgcctttatcattgctcctagatagtgtgaactacctaccaccttgcattaatatgtaaaacactaattgcccatagtcccactcattagtctaggatgtcctctttgccattgctgctgagttctgactacccaagtttccttctcttaaacagttgatatgcataattgcatatattcatggttctgtgcaataaaaatggattctcaccccatcccaccttctgtgggatgttgctaacgagtgcagattattcaataacagctcttgaacagttaatttgcacagttgcaattgtccagagtcctgtccattagaaagggactctgtatcctatttgcacgctacaatgtgggctgatcacccaaggactcttcttgtgcattgatgttcataattgtatttgtccacgatcttgtgcactaacccttccactccctttgtattccagcaggggacccttactactcaagacctctgtactaggacagtttatgtgcacaatcctaattgattagaactgagtcttttatatcaaggtccctgcatcatctttgctttacatcaagagggtgctggttacctaatgcccctcctccagaaattattgatgtgcaaaatgcaatttccctatctgctgttagtctggggtctcatcccctcatattccttttgtcttacagcagggggtacttgggactgttaatgcgcataattgcaattatggtcttttccattaaattaagatcccaactgctcacaccctcttagcattacagtagagggtgctaatcacaaggacatttcttttgtactgttaatgtgctacttgcatttgtccctcttcctgtgcactaaagaccccactcacttccctagtgttcagcagtggatgacctctagtcaagacctttgcactaggatagttaatgtgaaccatggcaactgatcacaacaatgtctttcagatcagatccattttatcctccttgttttacagcaagggatattaattacctatgttacctttccctgggactatgaatgtgcaaaattccaatgttcatggtctctccctttaaacctatattctaccccttttacattatagaaagggatgctggaaacccagagtccttctcttgggactcttaatgtgtatttctaattatccatgactcttaatgtgcatattttcaattgcctaattgatttcaattgtctaagacatttcaaatgtctaattgattagaactgagtcttttatatcaagctaatatctagcttttatatcaagctaatatcttgacttctcagcatcatagaagggggtactgatttcctaaagtctttcttgaatttctattatgcaaaattgccctgaggccgggtgtggtggctcacacctgtaatcccagcactttgggaggctgaggtgggaagatcccttactgccaggagtttgagaccagcctggccaacattaaaaaaaaaaaaaagtaagacaattgccctggaatcccatccccctcacacctccttggcaaagcagcaggagtgctaactagctagtgcttcttctcttatactgcttaaatgcgcataattagcagtagttgatgtgcccctatgttagagtagaatcccgcttccttgctccatttgcattactgcaggagcttctaactagcctgaattcactctcttggactgttaatgtgcatacttatatttgctgctgtacttttttaccatgtaaggaccccacccactgtatttacatcccagctggaagtacctactacttaagacccttagactagtaaagttagcgtgcataatcttaggtgttatatacacattttcagttgcatacagttgtgccttttatcaggactcctgtacttatcaaagcagagagtgctaatcaatattaagcccttctcttcgaactgtagatggcatgtaattgcagttgtcaatggtccttcaattagacttgggtttctgacctatcacaccctctttgctttattgcatggggtactattcacttaaggcccctttctcaaactgttaatgtgcctaatgacaattacatcagtatccttccttttgaaggacagcatggttggtgacacctaaggccccatttcttggcctcccaatatgtgtgattgtatttgtcgaggttgctatgcactagagaaggaaagtgctcccctcatccccacttttcccttccagcaggaagtgcccaccccataagacccttttatttggagagtctaggtgcacaattgtaagtgaccacaagcatgcatcttggacatttatgtgcgtaatcgcacactgctcattccatgtgaataaggtcctactctccgaccccttttgcaatacagaagggttgctgataacgcagtccccttttcttggcatgttgtgtgtgattataatcgtctgggatcctatgcactagaaaaggagggtcctctccacatacctcagtctcacctttcccttccagcagggagtgcccactccataagactctcacatttggacagtcaaggtgcgtaattgttaagtgaacacaaccatgcaccttagacatggatttgcataactacacacagctcaacctatctgaataaaatcctactctcagaccccttttgcagtacagcaggggtgctgatcaccaaggccctttttcctggcctggtatgcgtgtgattatgtttgtcccggttcctgtgtattagacatggaagcctcccctgccacactccacccccaatcttcctttcccttccggcagggagtgccctctccataagacgcttacgtttggacaatcaaggtgcacagttgtaagtgaccacaggcatacaccttggacattaatgtgcataaccactttgcccattccatctgaataaggtcctactctcagaccccttttgcagtacagcaggggtgctgatcaccaaggccccttttcttggcctgttatgtgcgtgattatatttgtctgggttcctgtgtattagacaaggaagccttccccccgcccccacccccactcccagtcttcctttcccttccagcagggagtgccccctccataagatcattacatttggacaatcaaggtgcacaattataagtgaccacagccatgcaccttggacattattggacattaatgtgcgtaactgcacatggcccatcccatctgaataaggtcctactctcagatgccctttgcagtacagcaggggtactgaatcaccaaggccctttttcttggcctgttatgtgtgtgattatatttatcccagtttctgtgtaatagacatgaaagcctcccctgccacaccccacctccaatcttcctttcccttccaccagggagtgtccactccatatacccttacatttggacaatcaaggtgcacaattgtaagtgagcataggcactcaccttggacatgaatgtgcataactgcacatggcccatcccatctgaataaggtcctactctcagaccctttttgcagtacagcaggggtgctgatcaccaaggccccttttcctggcctgttatgtgtgtgattatatttgttccagttcctgtgtaatagacatggaagcctcccctgccacactccacccccaatcttcctttcccttctggcaggaagtacccgctccataagacccttacatttggacagtcaaggtgcacaattgtatgtgaccacaaccatgcaccttggacataaatgtgtgtaactgcacatggcccatcccatctgaataaggtcctactctcagaccccttttgcagtacagtaggtgtgctgataaccaaggcccctcttcctggcctgttaacgtatgtgattatatttgtctgggttccagtgtataagacatggaagcctcccctgccccaccccaccctcaatcttcctttcccttctggcagggagtgccagctccataagaaccttacatttggacagtcaaggtgcacaattctaagtgaccgcagccatgcaccttggtcaataatgtgtgtaactgcacacggcctatctcatctgaataaggccttactctcagaccccttttgcagtacagcaggggtgctgataaccaaggcccattttcctggcctgttatgtgtgtgattatatttgtccaggtttctgtgtactagacaaggaagcctcctctgccccatcccatctacgcataatctttcttttcctcccagcagggagtgctcactccataagacccttacatttggacaatcaaggtgcacaattgtaagtgaccacaaccatgcatcttggaaatttatgtgcataactgcacatggcttatcctatttgaataaagtcctactctcagaccccctttgcagtatagctggggtgctgatcactgaggcctctttgcttggcttgtctatattcttgtgtactagataagggcaccttctcatggactccctttgcttttcaacaaggagtacccactactttttaagattcttatatttgtccaaagtacatggttttaattgaccacaacaatgtcccttggacattaatgtatgtaatcaccacatggttcatcctaattaaacaaagttctaccttctcaccctccatttgcagtataccagggttgctgaccccctaagtccccttttcttggcttgttgacatgcataattgcatttatgttggttcttgtgccctagacaaggatgccccacctcttttcaatagtgggtgcccactccttatgatctttacatttgaacagttaatgtgaataattgcagttgtccacaaccctatcacttctaggaccattatacctcttttgcattactgtggggtatactgtttccctccaaggccccttctggtggactatcaacatataattgaaattttcttttgtctttgtcagtagattaaggtcataccccatcacctttcctttgtagtacaacagggtgtcctgatcaaccaaagtcctgttgttttggactgttaatatgtgcaattacatttgctcctgatctgtgcactagataaggatcctacctactttcttagtgtttttagcaggtagtgcccactactcaagactgtcacttggaatgttcatgtgcacaaactcaattctctaagcatgttcctgtaccacctttgctttagagcagggggatgatattcactaagtgccccttcttttggacttaatatgcattaatgcaattgtccacctcttcttttagactaagagttgatctccacatattccccttgcatcaggggcatgttaattatgaatgaacccttttcttttaatattaatgtcataattgtatttgtggacctgtgtaggagaaaaagaccctatgttcctcccattaccctttggattgctgctgagaagtgttaactactcataatctcagctcttggacaattaatagcattaataacaattatcaagggcactgatcattagataagactcctgcttcctcgttgcttacatcgggggtactgacccactaaggccccttgtactgttaatgtgaatatttgcaattatatatgtctccttctggtagagtgggatattatgccctagtatcccctttgcattactgcaggggctgctgactactcaaaacttctcctgggactgttaataggcacaatggcagttatcaatggttttctccctccctgaccttgttaagcaagcgccccaccccacccttagtttcccatggcataataaagtataagcattggagtattccatgcacttgtctatcaaacagtggtccatactcccaacccttttgcattgcgccagtgtgtaaaatcacaggtagccatggtgtcatgctttatatacgaagtcttccctctctctgccccttgtgtgcccttggcccctttttacagactattgctcacaatctcaggtgtccatatttgcagctattaggtaagattgtgctgtctccctcttcccttccctctgccctgccccttttgcctctttgctgggtaatgttgaccagacaaggccctttctcttggacttaaacaattctcagttgcactttccttggtcccacccattatacatgaacccctctacttcctttcgcattgcttctgagtatgctgactacccaaagccccttctgtgttattaataaacacagtactgattgtcccatttttcagcccatcagtccaagatctccctaccactttggtgtgttggtgcagtgttgactatgaaaagcaggcctgaactaggtggataagccttcactcattttctttcatttattaatgatcctagtttcaattattgtcagattctggggacaagaaccattcttgcccacctgtgttactgctttactgtgcaaaatactgaaggcaagtcagacccagggagctggattgccatcctttattttgtgtttccagtgtacactataaaattgtctccccaggaaggaaggttggcactttctctgcattcttctttccagagcagattgcctggttaagaatctcttgttgtcccctttgtatattgttattgtaaagtgccaaatgccaggatacagccagaaaaattgcttattattattaaaaaaatttttttaagaaagacatctggattgtagggtggactcgataacctggtcattatttttttgaagccaaaatatccatttatactatgtacctggtgaccagtgtctctcattttaactgagggtggtgggtctgtggatagaacactgactcttgctattttaatatcaaagatattctagagtggaactcttaagaccagtatctttgtgtgggctttaccagcattcacttttagaaaaactacctaaattttataatcctttaatttcttcatctggagcacctgcccctacttatttcaagaagattgcagtaaaacgattaaatgagggaacatatgcagaggtgcttttaaaaagcatatgccaccttttttattaattattatataaaatgaagcatttaattatagtaataatttgaagtagtttgaagtaccacactgaggtgaggacttaaaaatgataagacgagttccctattttataagaaaaataagccaaaattaaatattcttttggatataaatttcaacagtgagatagctgcctagtggaaatgaataatatcccagccactagtgtacagggtgttttgtggcacaggattatgtaatatggaactgctcaagcaaataactagtcatcacaacagcagttctttgtaataactgaaaaagaatattgtttctcggagaaggatgtcaaaagatcggcccagctcagggagcagtttgccctactagctcctcggacagctgtaaagaagagtctctggctctttagaatactgatcccattgaagataccacgctgcatgtgtccttagtagtcatgtctccttaggctcctcttggacattctgagcatgtgagacctgaggactgcaaacagctataagaggctccaaattaatcatatctttccctttgagaatctggccaagctccagctaatctacttggatgggttgccagctatctggagaaaaagatcttcctcagaagaataggcttgttgttttacagtgttagtgatccattccctttgacgatccctaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaactttgtattttgatgtgacaatttctaactcactgtccctaa

SEQ ID NO: 3249 - DNA, 5758 bp, Homo sapiens
cttcctccgccccaagcagccggggcggtgcaccaccggcccccgcttccttctcggggttgggaggcaccgagggcctcgaggggctgcgggactcgggcttggtgtggagggcaagagcgctgcgacgtgcggactggagagtcagcctttgggctggagacacgggagcgggtggctacagtggtttacgttgttgcacggggcgagtagaactgtccaggaagaggcccagaacatacatattcagcaccagaaaagactggcacgcaatttttcttgacaaactgggtcttgctctttgaagggtgggtgggaatgtgctgtttttatgagaatgtcaaagaacttctcagaatcacattaagcatgctaattaccaaatattaaatgctaattgttccacacgcagttcgaatgccaaggaaggaagatgaaactagtataagctactcttgacattatgtcagggatggttttgacacgttttgcagcctccacctggaggtggggaacgtttcctgtgtcgtccccagagcagagtaacagcgttgtttatgggtgagagcaagcctcaagcctaggcaacaatgtgccttgcttgcttttaagctccttctaaaggggaggtaaaccaagaccgctaaagaattgctaggtgcctgggcgtgatggttcaccccggtaatcccagcactgtgggaggcggaggcggaggcgggcggatcacgaggtcaagagatcaagacgatcctggccaacatggtgaaaccccgtctgtactaaaaatacaaaaattagctgggcatggtagtgcgcgcctgcagtcccagctactcgggaggctgaggcaggagaatcgcttgaacccgggagttggaggttgcagtgagctgagattgcgccactgcactctagcctgggcaacgatagtgaaactccgtctcaaaaaaaaaaaaaaaaaattgctaggcagctgggcacaggggctcaggctgataatactagaattttgggaggccgaggcaggaggaccgcttgagcccaggagttcgagaccagcctgggcaacatagcaagactgtctctaaaaaataaaaaacattgctaggcaacagcttccatggacttgttccaggaacgaagattattcttgaaatgtccacgtagtggataagacagagtcaatcagtgtgtccagtgctacaggcttgattgggttcaatcctgtacttgggtcaaggtgtttgcctacattgcctgtacttcctccaagacatttctgcctctgggttgtaactgcccgtgtacttgtctgtgttccctaagccagatcataagctctgaagctgaggatggtggctgtagatggcagtacttgtctgtgttccctgagccagatcataagctctgaagctgaggatggtggccgtagatgacaggcctggatgcagccaggtgccttgtggatcagcttgcttttaggtggtgaaggactgaccatagacagtggccctggcattccaggacactgcatgggggaaagtggagggccaggtccatcccatcccctctataagctggacaaagctgctccagcatgtgggtcctcacatgaaaaaggccacattgacatcctttgtcctcctgtagagggagtgaaactgagaggcctcagcctcaagcaggcacagaacttgagacctctcggccagagtgtacagacattgcacaaaccttccaagttcagagaagacaaaagccctgagtaaattacagacaaaaaagcccccaaatatacagcactgtgaatccagaaatgccacctgacttcaggtcacaaggaagaaaaactgattttgccagaagtagccattattgcacagcccagttataatcacaactgacgttaaagtcaggccagatgaccacagaagtctacagaaaaaaaccaggattggccacgcgtggtggctcacgcttgtaatcccagcagttcgggaggccaaagcgggtggatcacctgaggtcaggagttcaagaccagcctggccaaggtggtgaaattccatctctactaaaaatacaaaaactagctgccattgtggcgtgcacctgtaatcccagctacttgggaggctgaggcatgagaattgcttcaacccaggaggcggaggttgcagtgagccacagtcgcaccactgcactccagcctaggtgacagagcgagaccctgtctccaagaaaggaaaaaaaaaaaaacaaaaaaaaacacccccaacaccaaaaaacaaaacaaaacaaaacaaaaaaacaaccaaacaaccaggactgagaaaatcaggctttagcatgaaatgttttcccctaaattcagaccaatgtacctcaaaaacccagttgtaaagcttaagtgtctagtgggttaactatcccacccaacctcctaaaaagtgttattataaaaggaaaaaggggagaaagggtagaggagagaaaggtgggccaatggctactgttcaaggaaatggtttaaatggggctgccacgtggttatgtgtctgtcacgagaggcttgttaagcagttagcacttgagtcatttttctacacttccattcagccaggcagacagctgtggttatgagtgggaacaattttggccattatgtggtgtggcttggttgaaaatgcttatggcaagctgcctaaggcaccgcaaacagcagcatgcctccttgagcacacagtccttctgctcataaattctctctctacctccaacctggccagccctgccagatccctttcccttcctcttggagcacaggcccagccatggcctccactactcagtcactgcacagttcctgacccacacatacccctctatgtgctcaccatcctccttagtcctgtcccaggtgctccccaagtgacctgacattgagctccagctgttgttctttgaacacccaagaccctcatctccaccccatggctgaggagttctggatttggggtttgatggaccagtaaacctctgcagacaccatctagggactgacactgggttgcgaactttttattttgcaagattgaatatttgaaaacaactcaaactcctgtctaaggttcctgtcttttaaaaaacaaacagaaggccaggcacagtggctcacgcctgtaatcccagcactttgggaggccaaggtgggtggattacctgaggtcaggagttcaggaccagcctggccaacgtggtgaaactccatctctactaaaagtacaaaaattagccaggcgtggtggtgggcacctctaatcccagctacttgggaggctgaggcaggagaatttcttgaacccaggagatggagattgcagtgagcgaagatcatgccattgcactccagcctgaacgccagagggagactctgcctcaaaaaacaaacaaaccaacaaacaaacaaacagaaaaacattgtcacacagacaaaaccaatatggaaaacttccaaagaaagggtgcggcatcactttaacgggtgagcacagcggccctggcagcctccaggctctaggtggcactggattctttctgacaagtcctcatctgggctgtcagagacctccgctttgagctgcgctgccatagagctctctggaagtcccttgctcctcagggtccagtccgaatgcgcctttcacgaggcctctcaggccatcctcaggagaaaataatttctcactttggccaggcgtcgtggctcacgccttgcaatcccagcactttggaaggctgaggtgggcggatcacttgaggtcaggagttcaagaccagtctggccaacatggtacaaccccgtctccactaattagctgggtgtggtggtgggcgcctgtaatcccagctacgtgggaggctgaggcaggagaattgcttgaacccgagaggcagaggttgcagtgagctgagatcgtaccactgcactccagcctgggtgacaagagcgagactgtctcaaaaaaaaaaaaaaaaaaaaaattccacctgtgaggccgggcacagtggctcacgcctgtaatcccagcactttgggaggctgaggtgagtggatcacctgaggtcaggagttcgagaccagcctgaccaacatggtgaaaccttgtctgtacttaaaaatacaaaaataagccgggcgtgatggcaggcgcctgtaatcccaactccttgggaggctgaggcaggacaactgcttgaatccaggaggtggaggttgcagtgagccgagattgtgccgtgccattgcacttcagcctgggcaacaagagcgaaactccgtctcaggaaaaaaaaaaaaaaaaaattccgcttgtcaattttttatagcagagactgccatttttaggcagtgactgttctttgtccttcgatgtctgttcttcccaaattctatagtagaaccctgggcttttagttggacacacggatgactgaaataatgatatttcctagtaccccttgctgtggtcttgtgactaagttctgaccaatgggaagttgaaatgggcagtatcctattcaaagagattgggtgctgttctttcctccttccagcagactggaatgagaatgtaatggctggagcaagggcagtcaccctgcaccatgaggcggcagccttgtgtttgagctgaggatggtaaaacaagataggagcctgtgtctgatgatcatgagcatcacactagctctgggccaactatgtttacaaaagaggaggaaaatcatctctcttgttaaaagtcactatagtttggcttttctgtcattttcaaccagtctagtcctagctaaaacaaactccagcctatcttaggacagggctgttctctgctgttcaagagtgggagctctctgacggcagtgatgtgtgatttggcttggtaccccccaaaggttatcatatacagttggcaatctcaatactttgtgggatgaatttcaaagaaaaaaggtttctaggttaagtatttgtaaaaaccaaagtaatggcattttgtgctttcctgatttattagcccatctcaggattaaaataaaatgaagttctaaagaaattatcagagactgggtcacaaatttatataaaagtttagtgagtgctgcattattaagaatagtaccaaaaatgaaaacctaagcgtttaacaatgggggttggcgaaaataaattttagattgagaaaagtgtcataacacaaactttcaaggtgacaaatgatagaaacctgaacccaagatatattttaaaaatatatctatatacacatagcgaaagcttataaggaaatacagcaaaatgttaatctcagctgggtgtggtggctcatgcctgaaatcccaacactggcaggacaagacaggaggattgcttgaggccaggagttcaagaccagcctgggcaacacagcaagaccccatctctataaaacataagaaaaattacccaggtgtggtggcatgtgcctgggaggtcaaggctgcagtgagctaggatcacactactgcactccagaatgggcaacagagtgagaccctgtctcaaaaaaaggaaaaaagcatctttgtgtgacaggactacaaatgattaaaattttctctttgcatttgcctttttttttgagacagagtcttgctctactgcccaggctcaaatgaggtggcgtgatctcggctcactgcaacctccgcc

SEQ ID NO: 3250 - DNA, 8371 bp, Homo sapiens
gcatccgctgctctgttaagtgatcaccacattcattgttctcgtttctattatttctgaaaaaaatcttcaggattctgcttgtgggagtggatgacatttttacagtgtttacagacacaaaatgaacaagatgtctgtggcaaccctcagaccattgacgccttctctcctatgtatcaaatcacacatttggacgttgactgaaccctcacatgtcagatgctcaatattgagctttatctattccagaatgtcatatagctggtataagaaagaacactaatcattcctaaggaagaaaattaacaacgccgtgagttataatatctggctgaaactgaaggagctctgtgtaattaaaagtcctttctgccctgcctggccatggttctgtatgcattgatgtcttacaaactgaaaaaaaaaaaagttattttctcatctccattccctagcatagacatattacatgatgtggaattgaaacaagaaaattgcattttaatcttccactcagaacatagaagaatgaaacaaacaaacaaaaaatactctgttgtcttagtctaccacaagcaaaatctggcagtctctttgctttggtaatggcataaattccttgattagcctataggatagcccattgttctgctcttttagtggaatagctagcaattgctttgtcattttttccccatggttcctaccattagtgttgggaggtttcttctttgtttttttgagaaagaggaaaaagttgttatattttcataaaaacttaaatttcatccaaaatacttgattttcatgaagaaagtaaatatctctgcccctagtatacatgtgtggaaactttcagaaccctgaagataaatacatttcaaacaagtgagtttgaaaatatcaatagcaaaataggaagtaagctaattagagaggtaagaactagatggcttagcattccaataataatatataaccttctttaagagtaaaatcttggtcaaaagacagatgaaaactccaataaaatttcacaactcatggaaaagtctatcttcgtaattctttatgaagcaaactatatatatataaaacatatatatatatatatttgagacagagtttcgctcttgttgcccaggctggagtgcagtggtgcgatcttggctcatggcagcctctgtctcccgggttcaagtgattctcctgacacagccttgtaagtggttgggattacaggtgtgtgctatcatgcccggctaattctgtattttgagtagagacgggggtttctccacgttggtcagggtggtctcgaactcccgacctcaggtgataccctcgcctcgacctctcagaatgctgggattagaggcttgagccaccacgcctagctgcaaacatatttcttatattttccaacatcacaaaattttactgagctatgatatgtactaaaagctgataaagatggtgttgttatatttaacagtactctgaattttgttgccatttctaaaattgtattcagaggaaattatgcccatgtttctatagagagaattttaaaaaatacatgagcatagaaatttgagcaacattgattaaggttccataaaattgaagcaggaaatagtatagaatatacttttgctcactctattaaaataagtctctcataagtatgcttcagttaagttcgaagggtaggaaaattaacctggaacggggcattcagatataagtaagtttattttggagaaatttctatgtcagctgagattattttctataaaaacagaagaaagatgaatatcactaatgatagcacaaaccactaattagaaggcagtatgtagaatttttctggaaaaataaaactataaatgacaaattaattttagcagaaattgtaagaaaatgcaatgagggtaataggaatgttatctttgaatacaatggacagcaaattgtaaactgaatgtattcactaacacaaaagagaaaattacttttaatgattgcctattgtttctctctacataaagtttgagtttcatgtctgatgaccttatggctttttaaatagacacttcatgtgacatcattaaattactttatacagtattactacatttctatggtaaaatttaagcaagagattaattttgaaagactttcagagaaagacttgtaaatacagacatgagacataaatctgatgtgggcctttgctttgttttgcttattttcttttagtttttgtttaataaaaaattggggtttgtaaaagtttagaatactcgcaggaatgttgtctagcaacatttttggttatattagtaacataactacatggaataacagcaagaaattttcttccatgaaaaattaattttccatttctattgcaaggggagagaaacaactaagtgctgcatatatcccccaaattatatttaattatttcatacttaaattttctttgttaccacagcgtaaagggttgtcacagtgcaatggtggcacctattggcatatgggatatatgacattaaactgtctgaattttccccaaattttctctattcagtgcatataagttctagaattgaagaacgcatggctaaaatcagcactttcaattttaaatgaacaagtttaaaagccaacactaaatgcaatgtgtaaggtggcattagtcatggaggttttctgaccatgggacattaaaaataatgagaagagaaaacaatgtcaatatttatttcacaataatgcttttgtgaaacagtgaaataatgaaaaatcagaaatatagatagatagatagatagatagatagatagatagatgcagatatacaccataaagacatacactaatcagggagctattcactggagagaaaagattaaactaatcaggttaataattatgtatatatagaaaagtgaatcatataccatatttatagactcaccgtgatggatcagttttctctatataacatccaagcataaaacgtggagaaatcagctaatgaggagttcagtcagatctacaaaacaatgataattgattccttctatataatttttcttcttaggcctggatatattgtatataacataatatttaatttgtactatttatgatatataatgtgcaatatataatgtaaaatcataagattaattttggaacacgctcttacgttattgaaacacagattaataatgtatatattatatattactcatatatatcattactgtatatatattactcatgctttcagtcacatgaagagagcttctaagtattaatgtatgacatactaaaatgaatgagcgttctccacaaaacatactttcatcacccaatgaatatttatattatgttgccaattacagagtaggaagtattggatataaatactgttctcatggagcttacagtgttaatgcatttgtcttttatatctaatacttattatattatttccgttattataatataagggaaatgtatgttatagtaatgacaaggataataacaatgatgcaatgaaagaggtgatcaaggacaagggttagaatgacaaaaagagaaaaataaggtagtgttaaattatatgaagacaaagtaagcaagaggagttggtagatggattgtgggtgggggtgcacaatgttaaacaggtgattcatgtagtctccagtgatatgacattcaagccaaacctgtattaggttaatcaatgctgaatccattttttctaatgtggagtgaatagtgatagcacaatttctagaggaaaatttaggtttggggtagaaatttagaagtcatcaaaatatgtattttatttatgcacaaaagactggatgaaagtactaaaagagggtaaatgtttacagagaaaagaagagttccaagcgttcagtcctgaagtactccagcatttgtgagattgattaaaacagaaagaactagaatgagtgacttaaaaaaagagaatgtggttgttggagaaaacacagaagaatgtggtatcttccccaagaagaaagaataaataagaatttgtgctaatgattgctgatagacctaatatgaggaaaactgagtgattactattgagttatcaatatatgtacaccactggtgacctagagaagtttggtgagtgccagaggcaaactccagattgagcagattcaagaggaaatggaaacaagtgaatagaagaagtgaacagagctataagagtacagacagctttatgtatgatctctgctctaaagaagagcaaggagattgggaggccgaggtgggtggatcaccaggtcaggagatcgagaccatctgggttaacacggtgaaaccccgtctctattaaaaatacaaaaaattagccgggcgtggtggcggacgcctgtagtcccagctactcgggaggctgaggcaggagaatggcgtggacccaggaggcgaagctcagtgagctgagatcgcgccacttgcactctcagcctgggcgacagtgcgagactccatctaaaaaaaaaaaaaaaaaaaagaaagaaaagaagagcaaggagaattaacaaaccatctgtgtttttttttatggtttgttatacaagtgggtagagactcagcaacactctatgtctattagcagagtttctaaagtacaatatagtaagtggactaagggatagttcaacttggtcagattaagaggcaaacatcataattacagctatgctaagtgggcagtcagcatacaataagcacttttctaagtgctttacatacattgtcataattaatccccatcaaaaaacatagaatatcattatctcatttttatagaaagaaaccaagccatagacaagtaagggagtcctacggccataccaccctgactgtgcctgatctcttcagacaagtaaggggcttgccagttttcaaaggtacataatcagagaacaaaagcccaaatagtacattcctcttaccaaaatgaatacattttccactatcaaaactctttctttgtgagtagaaggaaaacaacaaggaaatcatgcttgagcagatgatatagaacatagaatggcttgcaaagagcttgcaaagaggttgtgggaggttttaaagcttatgagtgtgactgtggcttagaatcatttttatttcaagaatgaaaatgaaattagtttgggtaaaaaatgatgggactgtcttagaacgtagaatataatatggacaaataaatatttaatatatgagaatggaacacaggagaggaattctagtcgtaagtaccactttggatgtcatctgcatagcattgatatccattagttaatgaattctatagtatttgatcacctagtctctgagtactgagctacatgttacaagtacaggagtgaaatagatagacttctgctgtcagcaattttactgaaaaatagacaatattgataaagaagcataattaaaatacattgtggtgattgcttaaacatcaacatattatatcagcatatgtaagcatctctaatctgtatttggaggatgagtgttagagaaggctttcagagtagatgaaattgttatttttttaagagaaaacatgcaaagaaaaaactaacccagatctttcgaaaatatctgaaaataagaccaagagagtcaaagaaggaacaattttctagtagaagatgaataaatctatagacttttctgcaaagcaatgtgaaatactgattataaaaggaaacatttaacaaataccacctaaagctttttttgatataaaattagaaaagtacatatgacttgctactgagtagtttcctctctgacagagggaaggcagctctctgaacatgttaaattaaagaataagtgcctggttaggaagcacaggcaggaaataagggctaaagctttcaaaaagaagaaaggtaagtacaatactgagggaaaaatgtaaaggcattgccatgaaggcagagaaatcacttacacagatcagaatccaagaacagaccaacataaagtcagtctctagaccctgagcactgaatgcccccgagtgaacaaaaagaaggcttcataagcagtgagcatcaaacattagaaggaatttcaaatgtgtgtgatctctttatcctgatggatcttcaattgcataattttccattagattggacaaagattgttgacctccctctggtggacaggagtcacctaaataaatgatctgtggtacatatactgccaccttctccctttccccatacctatatgcacagcttctgagactaaaacaaatgctgatttatgctgccaacaatcttccaatagtcatagaccttacttccagaacaacatactctcaagtagacagagtgaaaagattgatcaatccataagagatctcaagtctactttcaaatgtcattttgcttatgattgaaatgttttaagatagcctcattgaactcagcattatttcatgctggacagctctctacagtctataccattctagtacactacagaatgacatcttattcaaagatggatactaaagttagcagaaaagacagatgtcacataattgaaatcacagttgggaagaatttgggaagacatcatgcacatattcagtgagcaactaatatagtttttatttgctaatttttattttatttttatttgaaaaataacaatgataagagtacagtgtgattcttgatatatgtatacattatgcaatgattcaattaggcttattaacatatccatcacctgacatacttatttttttgtttggtgagagcatttaaaatctactctgttagtaattgtgaaatatacattacattactattaactatagtcactatgctctgtgatagatctcaaaaacttactattcctgtctaactgaaaatttgtatccttttacaaatatctccacactttcaccccacccccacctccacggcacagctcttggcaacctccattctactctcctattctatgacttttttagattccacatgtaagcgagatgatgtagtgctttgtctttctgtacctgactcatgtcatttagcatggtgtctgatagttttattcatgttgttgcaaatgataggatttccatctttttaaaggcaaaatggtgatctaatgtgtatacataccacattttctttattcatccatctgttgatggacacttagattgattccacatctttattattctgaatagagctgtgataaacatggaagtgcatatacctcttaaacatactgatttcagttcctttgcatatacaccgagaagggggattgctatgcactttttatttttcatacaaaattggaaaccaatactgcatttttgattgaggtcttatttgtaaaaggggctatgttgaaccttgactaggatctttctgtctctgaacacattcaagttgtcagaaaattctctcacctacatctgcccatctctcctcacctccagcacttcatcttgagaccaaactggaaaagtcttttattagaattttcccccaattgactccaatcagcttttccttctcctaccccattgttccctttaattctcagcacagtaggcagggatcctgttaaataaaaaatataaaatgtcagccttccactcaaaccttcctaatggcttcccatcttgaggcaggagaatcacttgaccaagagatcaagaccagcctagacaacatagtgagatccctgtctctacaaaaattacaaataataaccataatgaggcgtggtggtgcatgcctgaggtctcagctactcaggagactgaggtgggaggattgcttgagatcaagtctgcagtgagctatgatcataccactgcactccagcctgggcgacagagaaagaccccatctcaaaaaaataaataagaaataaaagtaaagtaaaataaaataaaagtgaaaattttgattaataccaggtaaacttctgcatgaggaaaaccccaccccctcctttatctttctaaacagattcaagcaggtctcacctcagagcctttggacttgctgttcccaatgacagatgtgctctcaaccaaatttcattgtgttaagttcctttacctccattggtatgttgcctacatttcgtcttcccagtgttgtggccaacacacaggcacatacatgcacgtggacacacacacacacacacacacacgtcttttagctttgattggcttattgcactaatcacatcaaatgtatcacttatttagccttttttt

SEQ ID NO: 3251 - DNA, 7874 bp, Homo sapiens
ggcaacctgctcgggtcccctgccacactatggaagctttgttcttttgctctttgcaataaatcttgctactgcttactctttgggtccacactgccttcatgagctgtaacactcaccgggaaggtctgcaacttcactcctgagccagcgagaccacgagcccactggaaggaacaaactcccgcacgccgcctttaagaactgtaacactcacagagagggcccgcggcttcattcccgaagtcagtgagaccaagaaccaaccaattccgggcacgggatcaattgggattagaattttatcctactgctaaaacataaagcaaaaaggccaaaagtgatctcaccttttcagagaaacgcacttaaatagcagcagcaggtgcctctcttttctgagcttcccttcacctgaatgtggttctggtacttaaagtttctttttctgcatccgctgctctgttaagtgatcaccacattcattgttctcgtttctattatttctgaaaaaaatcttcaggattctgcttgtgggagtggatgacatttttacagtgtttacaggctgaaaatttttcgagcttttatgctctgcttccgttataaggaggaggcctcacaatcctggtggaaggcaaggaggagcaagtcacatcttatgtggatggcagcaggcaaagaaagcttatgcagacacaaaatgaacaagatgtctgtggcaaccctcagaccattgacgccttctctcctatgtatcaaatcacacatttggacgttgactgaaccctcacatgtcagatgctcaatattgaggtatagtaaaagggagcatgaacttgagaaaatacgctttcaacacaaagctgtaataatataaggtcaaataagattctgcattggagatagaaaactctgaaggaagctttatctattccagaatgtcatatagctggtataaggttcagggggcccatgtacaggtttgttacatgggtgtatctcatgttgctgaggtttggtgtataaatgatcccatcacccaggtaggaagcaaggtacccagtaggtagtttttcaacgcatactccttcccactttcccctatctagtagtagtccccagtgtctattgttgccatctttatgaccacatgtacccaatatttagctcctgcctataagtgagaacatgagacatttgattttctactcctgtgttaattttcttaggataatgccctccagttgtgtccatgttgcttaaaaggaaatgctttcattctttttttatggctgcatggtattcttttgggaaccagctcattgcttggtacagaaccctgataaagactaattgtttaataatggggcaccaattactctataatctctgttgcaatgaggatccatcaaatcatagtgctaatcacatgcagcaggaacccattatgaaatgaaagatatatgtacatgtgtaagtgtatatgaaattaggcttgaatagattgccacaaatgagtaagttgtgtgagcggggggctcagattctcaggacacatccacttgctgcatcaccattccactgtccacacatgcatgtggcctaataaggagtttcctaaccccagattaaaagagggaaaaaatgagcttgttttacacagtatgctgtcactgttggaactggactgctggcatagttcaactactgtctagagtggcactgatggacagaaaagtgaaatcctccaagtgggaagaactttggaaaatacatttgaatgaccattttgcctcacaggaaggaaacagtgatggaataatgcctcttctgaaaggtggtcccattctaatcttaggaacctgcaaatatgttaccttatagtgcataagggccttttcagatgtgattgaattaaagatctggagacagaagaattattctggattttctgggagaggacaacataatcacaacataagcacattttttttctctctctgatgtcctgcctccttcttataaggataatcacataattggatcatgataagaaggaggcaagaggtcagagaaagaagaaatgtgctacaaagttggatatgaagatggagggatgggtcacgaacagtctctagaagctgaaaatgtcagaggaaagaattctcccctagagcctccagaaggaaaatagccctataaacactttgactttagccctgtaaggcacattgcagacttctgacctccagaaccgtactatagtaaaataaacctaggttgctttaagccactcagcttagttatttgttacagcagcaataggaaactaatacagataaatatattccaaatccttgacaatcgctaattgtttgtttagttggtcaggtattaaaaaaaaatttaaaaacctgttttctgctgtaatgtcatcactattatttcaggcctgattctatcgtttaaattttctcattttggactatgttttccttcttatttgaatgcttgggatttttaaaaattgtaatcttggcattggcatttttaacttgccgggtgctggatgatttttatatacctatacatgttctcgaactttgttctgaggtgcagttacttgacagcagtttgatccttttgagccatgcttttaaggattttatgtagaaccagtacagtttctaacttacagctaatgttgacatactactgagggaatatccttctgagaactattcatttgtccctgggattatgaggtgatttactctggatagtgaaatagaaaccattccagaaccaaggatggcactaggtgttgttccctctatttttggggggaaatattgtctctgcttcaagtagtttcatcacatgcgttagcagatcaatatttaagtgaagaattgaggggtaccctctgcatatcttcttagctctctcagtacaactctctcttccctggtattacgccctgcaaaatcaatctgccttagtctcataaacactcagattggtctctttaacccacagagatagtcaggctcccccctgattaccctcctttcctgtggcctggaactctttccaggcaatgagctggaacaaacatttgccttaaataatttgcttaccctatctcatggattattacccaggactgctcaatgtctggtgtcagaaaactgatatttcacagtttatccatttttagatattttagtgggtgggaaggtttagttacttattattccatctcaataaacaacagaaataattcacttgtgagtttgaataattatattgcagtattttttactttattctaacaattaccgcatttcttacactcaatctgagcacaagcactacaaccctatcaatattccacacctgaaataaactaacatgactaacacctataattccattaattttattatccctaggaggtttacccccattaatgggatttctccctaaatgagttaccatccaagaacttacaaaaaacaacagtcttattaccccaaccattatagatattataaccctactcaacctatacttttacacacgcttaatttactctacctcagtgacaatattccccacatctaataacataaaaataaaatgacggttcaaaaacacaaagtccatattacccctccccccacttataatctctaccctcctcttacctatttctccattaacactatctatgatctagaaatttaggttaaataagaccaatggccttcaaagcctttagcaagtaaattatacttaatttctgcaacaaacctaaggactgcaagactccactctgcatcaattgaacgcaaatcaactactttaattaagctaagccctctctagattggtggaattaaacccacgaaaatttagttaacagctaaacaccctaatcaagtggcttcaatctacttctcccgccgctgggaaaaaaggcgggagaagccctggcaggagtgaagctgctcctttgaacttagtctgaattttcatgttgaattcaacatgaaaatcacctcgggactggtaaaaagaggccttaacctccatcttcagatttgcagtctaatgtttactcagccattttacctttttcactccacttatgttcatcaaccgttgattgttttcaagcaaccacaaagacatgggaacattatagttactattctgtgcatgagcagggatagcaggcacagccttaagcctccttattcaagcagaactgggccaaccaggtactctgctagaagatgatcaaatttacaaagttattgttacctcccacgcatttatcataattttctttatagttataccaatcataatcggaggttttggcaactgattagttcctctcataattggctctcctgatatggcatttccccgaataaataacgtgagtttctgacttctccctccccccctttcctactgttatttgcattctcaatggtagaggctggcagtgggacccgctggacagtttatcctcccttaacaggaatcttaacatgcaggatcctctgtggacctgaccatcttctcacttaatttagcaggcatcttttctattctagaagctattaattttactaccacaatcattaacatgaatcccctggccatatccctacatcacacacccctcttcgtctgatcagccccagttacagcagttcttctacttctttctcttccagacctagccgccggcattactatgctattaactgactgtaatctcaacactacattgtctgacccagctgtcagaggtgaccctgtcctgcattaacacttatctgattttttggccactctgaagtctatgtccttatcttacaaggcttctggataatctcccacatcgtaacacactattctggaaaaaaggaaccatttgtgtgcatgggcatagtatgagccatagtatcagttggtttcttaggattatcatatgggctcaccacatacttacagtaggaatagatgtagatataggagcatacttcacctctgccactataattattgccctccccgctggcatcaaagtctttagttggttagcttcactacatggcagcaacatcaaatgatcccccacaattctttgagccctgggatttatatccccttttacattaggaggtctgaccggcattgtactagctaactcatcactagacattgtcttgcatgacacatattatgttgtagctcatttccattacatcttatcagtaggagccgtatttgctattataggaggctttgtccactgatttcccctattctcaggttatatacttagtcagacctatgctaaaattcacttttccatcatgtttataggtgttaatttgacttttttcccacagcatttcctgaacagggaaaagttgaaagcattcccactgagaaatggaacaagacaaggaggcccactcttaccacttctgttcgacataatactagaagtcctagacagagctatcagaaaagagaaagaaataaatggcattcaaatcggtaaagaggaagtcaaactgttgctatttgctggtgatatgatcatatatcagaaaactctaaagactcctctaaaaagttcctcaactggtaaaggaattcaggagagtttcaggatacaaaattaatgtacacaaatccattgctctgctatacaccaatagcaaccaagctgagaatcaaatcaagaactcaacccctttcacaatagctgcaaaaagtaaaataaaatacttaggaatacatctaactaaggacatgaagggcctgtacaaggaaaattaaaaaacaccactaaaagaaataataaatgatacaaacaaatggaaacacatcctatgctcatggatggatcaaatcaatattgtgaaaatggtcatagtgccacaaacaatctacaaatttaatgaaattcccatcaaaataccaccatcatttttcacacttcttgattcatggaaggaggtcaaaacaagagcttggaagtagttgatttcaaccctcatggatgactttgagggtttcaaaacttcagtcacggaagtaactgaagctttggtggaaatagcgagagaagtagaattagaagtggagcctgaagatgtgaatgaattagtgcaatctcatgacaaaacttgaatggatgaggaattgtttcttatggatgaggaaagaaactggtttcttgagatggaatcaactcccgatgaagacacggcaaacgttgttgaaatggcaagaaaagacttggaatattacataaacttagttgaaaaagcattagcagggtttgagagaattggctcaaattttgaaagaatttctactataaataaaatgctatcaaacagcatcacatgttacagataaatctttcattgaaggaaaagaaaataaatgccacaaatttcatctttgtcttatatttgaaattatcacagtcatcccaaccttcagcaatcaccaacctgatcaacagccatcaacattgaagcaagacttttcatcagcaaaaatattattactcactaaaggctcagataatcattagcatgttttatcaataaagtattttttaattaaggtatttctattggcttttttggccctgccaagtcttatgttgaaacttgatctccagtgtaggaggtgtttggattgtggaggaacatccctcatgaatgacttggtgtcattcttgcagagtgagttttcttgttcccatgagaactggttgttccaaaagactgttacctcctcctctttcttttttgcttcctctcttgccatgtgatctctgcagacaagctccccttccaccatgagtaaaagcagcttgagaccctcaccagatacagatgaaaaagccatgcttcttctacagcctgcagaactgtgaaccaaataaatattttttgttatgaattaccctacctcaggtatatctttgtaacaacactagtggaataagatagatatgtacttttttaggcatagtgctactgcgcacttcatagactacagtatagtataaacataacttttaaatgcactgggaaaccacacaatttatgtcacttgctttacagcagtatttactttgttgctgtggtctgaaattgaacctgcaatatctagaggtgtgcctgtacctatagccatgggagaggccctcagcgcttgcaagcactgagactggtatagggagttgcctggaatccacctgatggcattgttccgaagagagagaggtcctgctgggccccacacaactcccaagagccaagcacctgaagcatgctgccattttagagcccagactccaccagactgcaccgtgccctggggcctaacagcccctgcatctccacatcccaagatccctgctgacatctcaccacatccactccaagagctgcagcatcacaatgccagctcaactgagcactgcagctgcgttacatactaagcagagatccatgaaaaatctttctaccaaattcattgatacaattgcaattcatgccatgtttgagttacctatatatacaaatgcatttccttccttcttgttttctttcttccttcctttctctattcattccttccttccctttcttccttctgtttctttttcttccttctttccctcctctctctctatattatttccttccttccttcccattctctctctacttccttccctttctttactttcttccttcctttcttttccttccttctttcttttttctctttctttcattctaccttcctttctc

SEQ ID NO: 3252 - DNA, 547 bp, Homo sapiens
ggctgaggagaacctcgagagcagcaacactggaggacagggagggggtgcaggcgacatgaggaaagccgcaaggattgggaagagagcacccaactcctctgagagatggtgaggttgaggacactcagcacacccaggatgaggatacgcggtcacgagctaggcggaggcctgggtctccctcctgtacatctggacgggtgaagactgagctccctggcatcccgtgggctgcctgtttctgtttcccttctccacacgtgccgacctcagagacgtgacagcaccttcgccctggagaatctgttgtgtccgtcacgctctccctggctcagccctgacagcccccgcagtacgcgtgcaccccacactgccttcatccactgcccagcccacgcctgggcaaggcccaccccttccctatgacccctcccagccagaggaagtgccatgggagcggccagttgcacccctatgtaaggtggtggagcctggactgggagatgcactcaggaactgcttaggataagcacgctcgtgcaga

SEQ ID NO: 3253 - DNA, 25780 bp, Homo sapiens
ggaggcgctggggctgtcctgggtcgtcacatgcgagaaatcgtctcaccccagccagtgtgacggagtgagagcaaaagaaagttttgatagcagcgtacgatttatattcagctgtatgctgggcaggtccaacttggcatttcttggctgtatctctgaaggaaagtcatcttaatctctatgagcctccatttcctcagctgtaaaatgggaagatcttcctcacactgctgtggtgtctcgactccccaaagcgacagatgctgttcatctcttggcctctgtgtcatcattcatccttgattgttcggggaagcccactccacctctgtgacagacccacagatgcagatttacacagggaatcctagacagacacaatgaagaaactcccatctgatcagagccaagtcccagtaataacatcaatgaatcattgacttcagtgagtcacaatattgagctggaagaggcctccaagacctttttagtccaaccctttacctgctagttattcacaagtgaatagaaactgagtgaggtccaaagagggaaaatgacttgaccaagatcacaaagcttggtaatgccaaaggtgagactggaagccccgagccctgagccccaggcccatgcactttccacacacccctctgcctgccacaaactagctggcacagagagcaggagggagggcataggcccctcatgacttagccaagggcagctcagtgtctccatgcaggtggactccgtgtgtcagcttcagccctcccttgggaagggaagggcctggggccgtcctcacaccccaggcgccaggccacggagctataggaggcagcttcctgcttggcccttatccaaggccatttcacaatggggggaaaagcgctgagctgagagtcccgggttgctgctcactccacccccactccagcccctttcagaccccccagggacaacgagccaggcccggcctgaggcttggggtgaagagagctgcaagaatggagacaggctgaacagccccttttgggagtgttctatgagctgtgtccctggaactggacgagggcaccaccttgcatattaccagcactatcccccttcccttgccgtccacctgcaagcattcaggctggggaagtcccttctgggacaggagtggtcgcttccagtcagccccatagcactctcatgattagtcagaggggaacctggaggcaagaaggcccacaagctgggagacggcaaggcctgggtcacttcctgcagtgaggcaacgtgactaccaggcagaggagcccaaatgtctcctcccaagatgctacagggtctggggtgaactgtggctcagctgactgaaattcaggcaggaaccaagacagagacactgagacgggacattcagccaggatttattatgcccttacacacagggtcggctctgagctcagctctgtaagggatctcgtttgaagtaggaggcagtggttaaggacccaaatcatcctgtcttcaagtcttgaagaggagacaaaacaaacctaggtgaaatgtcaaaccacaagacaaggcagtgtgaaatgagggcccacactctcatgctggacagtccagtatggccagtgaagcgggggtggggagggagtcactgcagacaaagcttcggggaagagatggaaccgagaatgatggggagaacttgactctgcagacaggatgggaaagatctttcagacagggaaaggaagacaaggcagaaatcaacctgcatacgtgaggacaggaccctgtttgcaccaggggtggtcagccacgaggctggaaatgtgcctggccacagggcacttcctcactctgagctcttgctacttgaacacagccttccttggtatccgtgggaagttgctggcctactgaggcaggataccacacggagaactaggcaggggcgtggaggtgtcaaggaactcagccccttggtggaggagccctctgacaacaggaagcagctgcaacgggctccagggctgtactggtatctgcaactctccccctaccctggctgcaccctgcagaacaaactgttcttcaagaagttctggggacagagggcccacacctgctcccaggtcggggtggataaacccccatcagccaggctgggagcccagcagagacatcacacagctcagcagccctcctcaccccctggccccctgcctcctcctaccccagaccaggttgcagttgactagggcaatataacacaaaacaagagctttatattattattattattattattattttatagagactggggtctcaccatgttgcccaggctggtctcaaactcctggtctcaagtgaccctcctgtctcagcctcccaaagtgctgagattacagacatgagccatgttacccagccaagagctttggagagggaaatgagaactgaatcttcataaatacctcatcctggaacttccaacaatgtctccaaaaatagtacctaaactccaggcctcaaactctaaattgagtggggatgtgaagtggttgtggccttacagaaacagcactggagtggcagccgaagtgctgagttctaatctgaattctgccactcattggcgtgggaccttggacaagtcactttttgccggacttgagtttcttcctctgtaacttggggagttgggattgagctgtaaagtcccttccagttttaaatgtgagactccaatgctgtcaggtaactttgggattgctgtaatgactgtttgggggctagtatagctgggaaagaaattaggatgagaatccaattgagggcaagataaaatggaattgtattctattcagaacttgaaataggatgggattttgttttccccagatcctcaccataaagagatttgggagaaaatcttgggagatttggactcagaatatcttaagaggtagtattctagaagattgcccaacacttggtggggaagagcaagaattcttccagattgcttgacaagcagaacatggggagtgggtcacagtaataccaggaaagacacatcccatcctcccaaccctcttttccactgaagctgctccttacaattcctgtaactggggaccaggcctttcattccagttacagctaaaacttaacatggccatttaaatttccctgagggtataaatggctaatattctctccttctaagacccagcatatgctgagagaggccttcagaggaggtgggggctggaagaaggagtgaaggtggaggcccaaagatcacgcaggagccatgctttttctgaagccagatctaggcctagcaactcagagcagttccccgtgggcagtgatgtggaagaaggccctgggcttcctaagtgcctctaggtcactttgtgaaacctctcacatgggcctgcctgggaggaggagcccagtgtagcccccacctgtctgctgcctgctcatcttccagggtgttgaggggatgggtagcatggctgtctgcccccaccaattacccacatggcttgggtcaaccagactctgtcagagctgttgaaggagacataaacctaggcttttggaggcagcttcagggaaaggtggagtgtgtgaggtggaaggtgggtgagaaagtgtgcaagggggaacacactgttctctactggccctttgccaaacagcaagggagagaggagtaacaaggccagactatggccatgtttagtggttttcaactgcggcccaaaatgaggcagacataggctaggcatggtctagcccttgtgtgtgtgtgtgtgtgtgtgtgtgtgtgtgtgtgtgtgtagggggagtgtgaggaagttgtgagggtgtgtggtgtgtgggggagtggtgtgtgtggggggtgtggtgtgtgtgaggagtgtgtggtgtgtgggggattgtggtgtgcgggggcggtggtgtgtgtggtgtggggtgtggtgtgtgcgtctgtgtggttgtgtgtggtgtgtggggaggtgtcatgtggcatgtgtggggggttgtgtgtgtgtgaggagtgtgtagtgtggggggggtttgtgtgtgcatggtgtgtgtgcgcgtgtgagggggtgtggtatgcatgggcagtggtgtatgtggtgtgtggggggtgtggtgtgtgggggtgtgtggtgcggtgtgggtgtgtgtgtgtaaggaggtagtgtgtgtggatgtgtgtagggggtgtggggtgatggtgcgtgtgtggtatggggggtgtggtgtgtgtgtctggagtggggagtgtgtggtgtgtggggagggtggggatgtgtgtgtggagtgtgggggtgtgtggtgtgtgtgtggagtgtggtgtgtggggagggggcgggtgttggcctgggtgagccctggcaatcgcagcagagaagatgccaaaattttgtatttactgtcagggcaatgatgctggaactgcagatccagcgccccgaaacccggcccatcccaagacactgcttctcacagccaacagaggaaggagggagggggagaggcctgaagccgaggcttcttcttgaggaatgctcgccaggccagcagccttcctcacttcaatgcagccttccccttctatccaccgatgagcatttagcgggcaactcctttgtccagggcaagccttccccaggtctctctcttcaaaagcagatgctacctagtgggaggtgcggagttatacatgcaagaaagggctacaggacagcatcactagtaccaagctgtgaaggaggtggactttgaagggaagaaagaatttagaaaaacagactagtggactagttactgcggggagcagagtgccatttcaggcaggagaaggagtgtgatgtgaatcttagggaagagtcctctttgtatgttctgacaactattctctgacaccaacggggcatcctgcaattggattcagtgtcaattctgacactgactacctgcagttagtgcctgtgatattgtgaaacaggtattaattaggtcttcattcctgacatacaactcctaaaatccttggaatctcctaagttttaagtgtctttttgcacgctaagcacctaggtagcttcaagatgggagctggccgccagaaagatcaagacagggttagaggattgggactttcagccccacccttcaacctccagggagggaaaaggggctgaagtttaagttgatcaccagtggccaatggtttagtcaatcaggcttatgtaatgaagcgtccataaaaacccaaaagggcagggttcagaggatttcttgatagctgaacacgtggggattcctggagggtggagcacccatggaggttaaagaagctccacccctcctccatagctcaccctatgcatcttttcatgtatatcttgtggactatccttataataagctaacacatgtaagtaagttgtccctgagttctgtgagctgctttagtgaaccccaattagctggtcagacagagcagcggcgaaacaacccagggcttgcacttggcatcagaagtgaggagaggggactgagttctcaacctgtgtgatctgacactgtcggcaggtagagtcagagttgaactggaggatgccccactagtgtctgctgcggaaatgatagcttgcttggtggcggggagagacccctgcccccccatgtggtgtcaggaacgtgttgagagagcatagtaggaaaaaccgagtttggtttttttacagtgtcagactccacaagttaaatgtcaaagtccccaagactacccttacttcagaactcaggcgcacgcagggtccacaggctactggcacttctgtctgacttgactacacatttgagttctcaccacccaaacttagggttcagtagttggctagaatggctcacagaactcactgagcatgctatacctacaattagttttattatcatatagactcagaacagccaaagggaagagctatgtagggcaaggtgttgggtgggggcggtgtgtgtgcagagcttccatgccctctccttgtggaatgtggtatgtccctctcccagcacattggtgtgttcaccaaccaggaagctcctcgcagtttcagtgtcgagttttatatggggctttactccacaggcaccattgatgaaatcattaaccacatgacgaactcaatctctagtccttccctctcgccccagaggttggcggtgcagtagggatgggagtagggatgaaatttccacactctgatcacatgcttggtctttctggcatggccagtctctcccttaaaattaagggcccaccttgagttgccttcttatcataacctgaggtatgatggaaatgctcattacaaatgacaaaaggcgttcctgtcactcaggagatcccaaaggtttttaaagctctgagccaggaaagggggacaaagaccgaatgggctttttaaaaagtcatagcagagattgtaatgggcagttcctagggaaaggaagtgggagctgaggatggaaaggcagggtggggcagatgtataaggtcagaagttgatgggtacggggaggagaaatcagccctgccctcctaaggaagtgcaggcagaggagaagcagtagacaccactccctcacttgagtgtcttgggggaatctttcactcttccagtaagtttaattttcccctgggtagttcgtccaggaggaggcagccttcagtttctgctttggcaccaacgtccccacaactcaggtccaggttccctcgtgcagcctcctgacattccccacagttcaaataccacctccttctagaaggcttccctgattacccaagtgggaaaagaccctgccctgaattctgaaagccctttgaaaccgtcccctactgccccgcggggacgtcaagacaacttactgtgactcattcctatctccccagtttgatcctgagcactttgccttacccctttctgcttcgttccaaacagccggcactgtgtgcttcatagaacatttgtgagctctgcagacattctgtcatcatcggcccctcctctgcccctaaccaacttgctaccttcccttgcagagccctgcctctgaatagagtgtgaatgtctgccctgccagcctgtgagctcctccagggaaagaatgtgtgtctaccttccaagcctgacaagcagtgggtgcccatgtgtgcggagtgaactcagtcacttttctcctagacggcgtcacctttctcacatttagggaaaatcaagtgtaagggaatgagttacttattctcgtagaagaatgggaagagtgagaagaaagttgggggtgaagcaggactcacacaaaggcaaggctggcctcttcccgcaggggctgggtccccctgggcctcttgccaggacactgttctcggtgggtgctccaccaagacgcaggtaactggcaagatgagagatcagaccaacctggacctgtgacaggcaggcacatgggcagcatgaacatcccactagcctctggggacagcatggcagaaaggagccattctgggaaactgtgaaactttccccttgaatggcttccagcccctttaacaaccccagagcagcgtcccagccttggtgagctggggtttactcactcacactcacggttaccacgcagaggcccaggctgagggggaaggaaccgcctgctcagcccccactgaggccggcccggtgctcctcttggcatcactctgagggtcctcagtgggcagaccccaggtggggtgagttgcacagcccaagaatgaagctcccttctgcctcccctgggcaggtcccatgacttggaggaaattgctccagagagtggcaactagacatgaagtgggacacggtgcccagggtttctcagtggcctctgaagccacccagagtcagtgagagtatcttggcctctctctgtgggcttcagggcctctcaggcaggtgtttgtctctgggatccctggatcacgagccctgtgactcttccacggccagcttcccaccccacacccctgctgagcatgttaccccgcatcctgggggagccaccatttgggaatagattggatggagaaggcctgctcccaagaaacagttaatcctctccccttcccccaggccccttgcacctgcaggctgtggtgtgtggtttcccacagctgcagctggctctgcagagcccctcccttcgagggaacctgagaggctcagggcctgaggcgccaggagaggctcctcgccctctgtccagctgctggggatggcatgagagggccttgctgccctctgacctggacataccacaagagtgctctggttgagtgacccatatgtgattcctggcttgcaagccaaaggcagagattccagtttgggaggtcagagaggtttctgagaagggaaatcagccatgaggccccccagtcctgggcttgctccagctctgctgccttctggaagaagctgactggcctgggtgtgggctgggcattcccctggggtaggatgcagggctccagaaagagagggtgagtggagggtaagaggtgactgggaaggaccgggaggaacaggaggaagtgagatgtggcagggccaggcctctgctggtcaagacagccttgaagccacggtgctacaactctggcagggtcagccctctggctatcccagaagagggcaggttgccacagagcctgggcaaatacccagctgccctctgaaccaggtgttccagggacacctccgaatactgcttacactgagacaatgagacaaaaagtgccagcagcttcctggctgggacacaccttcaggagcattagcctggagcagaggctgaacccatcctaacagcttgcccatgtccccagccccgggctaccgggcaagtgctcacatcccctggggacaggtggatggcacacagggtcatggcggagggctgctcactgggtccagagccagggtctgggaagagggagggagatgcaggaatctgacaggcttgagcctcacagggcccagggctctggcttctctcagatccagctctgggcaatgtttcagttcaacactctccctgggaggctgtgtagcctggggctcagggctttggtggcgtcctgtctgcagaaaagccccactccccactaagagacaactccccataccagagcaggaagagagagggcgattgagcaaaggaggcctgaggggaaacagagacacccatctacaggagcccctgagtcaggtgtgggaggagggagaggcagggcccagcagaagccaccgtttgcgccacactcctctacctcaggcggagaccagctgcagggtggcagccagggtttggaggaggtgagggagcgtgccggcccggcacccaacaggcttcagtcttggctcccacacagcttgatgctcctttcggggtataactgatgccaaccacccagggccactgccaggagtccactgtgtactcagactgtgcttggcccattcgcagcagtgccacagggccacaggcgcagagctctggctgggagtcactgccaatttacagtttgccctcaggtgtgtggaggcaaagccctatgaaagattagctttgcgctccggaggagagggcgcatggcaggtgatctgcccaccatggcttatttgtggcttcatcactgtgatgacactatgtttggcatttactcattattgttatccagaccccacgttatcaagaaaagtacaggaaatctgccgttgggagagcggcagcacccatgtggagtgccactttctgatctgggacttaaacaacattgctgttttcctccttgctccaagtcatccattttgacaattttatatcagcatggacccttcaccaagactgaaataactctgttattgagtgttgggaacacggagatgaataaaacaaggcccctgtcctgggagagccgagaggccacctgtcagctgacatcttagggaggacaccatctacatccaaccctgactactgaacacttccagtttcttggaagaaagattttaaaatcttcagaaatgagaactcctccaaataggattttcatttgtttcatatattttaaaattttatattttaatatgtaacagtcatatggtttaaatataaaaatgacatcagtggctcagtaagaagttttcctcctaatttttccctaacagttcccaatttctgatataaaaaatgttatatccttgcaggatttacttaggtaaatacatgttcttagttttcctcttcattattccaaaggttgtttactgcaagcatggtttttcttgctcatacatcctggagattgtcccatatccacacagagaaggttccccatttttttcttacagccgcaaagtgttccttgttctaaaccaggtttctattgatagtactgggtggctggtcctcaatcttttgctctcagactgtgccatgtatgtcctttcagaggggggcaggtacatctgtaggatgggttcaagggtttgtaattgagagagagattgcaaattgtcctccacagaggttgcactgctttcatccccaccagcaatgtatgaaaaggcctgtttcctgttttccctatcaggctgatatttatttatttatttgtttatttacttatttattagagccaaggtctcactctgtcacccacgctggagtgcaatggcgtgatcatagctctctgcagcctcaaactcctgggctcaagtgatcctcctgcctcagcctcctgattagctgagactacagatatgtgctaccacacccgactaatttttcactttttgtgaagacagtgtctcgctatgttgccccggggtgtggggggagttctctaactcccggcctcaagcaatcctcctgcctctacctcccaaagtattgggataagctaatatttttaaagagaaaggaaggaggcaatatgaggcctctaaagaagagaggtaggaagaaggtgaagcccagatgcctggagcacacagagctgcagccactgcctgcagctttgcttatgagggggattgagtttcttcaggccatgatgtttgatttgtgtttggagcagtaagccttacagctgataaatggtttttttctcctgggggagcacgagactctaggaagataatctattaggagaacctgagggaagagagtttagttggtgcatgtgggtgtgaggttgtttctcggtcccttcaggctgctattgcagaataccatagactgtgtggcttagaaacaacagaactttatttcttacagttctggagggtgggaaatccaagattgaggtgccatcagattcggtgtctggtgagagcctgtttcctggctcatagacagcacctctcactgtcctcacctggtggaagggtgtcgctggggactgagtgtcttcatttttatcagtgcttcttttgtaagggcactaatgcccttgtgcgggctccacccccatgacctaatcacctcccaaacagcatcacctcagggatgaagatttcaacatgtgaattgtgggggacacaagcattcagaacatagcaggtggcatatgaaagtgcagaccaccatatccagcaaatacatatgcatttccaatagtcaggggaagagacagagggagaggtggaggagggtggagaagaggacaatcttctctgaggaggtaacgtttgggcagaatccaattcatagatctgggaagaaaagttccagcaaagggacaagcaagggtcaagatcctcaggggaaggagaggagaggggcctgctcaagacagtgagtgaccttggaggaattgggacagggaaggcagtcagcaaagctgggagtcgggggggtgctggaccatggggagcctggaaggccatggcagggagtttggggtttatcttaagaataatgagaaaaagaaactggtcagaaaaaccacatattgcatttttccatttctacaaaatatccaaaatagacaaacccagagagacagaaagcagattcgtggttggctggggctggggagattgggaggaaatggggagtgactaataatgggtgctgggtttcttctgaaggatgattacaatgttctaaaattgattgtggtgatggttgcacaaccctgcaaatatacaaaaaaaaaaaaaagcccattgaattgtatactttcagtgggtgaattatatgatatgtgaattacatctcaataaagctgatttatttatttattcatttatttattttgagacaggatcttgttctgtcgcctaggctggagtgcagtgacgtgacacaatcacagctcactgcagcctcgacctcccaggctcaagtgatcctcctacctcagcctcctaagtaactgggactataggtgcatgcaccaccatacccagctaatttttaaggtgttttttttttttttgtagagacaggggtctcactatattgtccaagctagcctcaaactcctaggcttgagtgatcctcctgccttggcctctcaaagtgctaggattataagcgtgagccactatgcccagccttgttattttttaaaaaaggattttaaaaaattataaaaaggataataggaagctgttagagggtgatttaatcagcagtaacattctcactcaggctgttgtgggagaacaaactgtagggaggggagagtgggggcaggagatggttgggaagctagtgcagtcggccaggcaaggagcaatagtgacttggcctgggtgggtcactttgtgatgaggattaatgaaaaggccagactggggtattttttgaagctagagtttgataattggttgtgaggggtgggagagagagatgaatcctggccatttaactgcagtgaaaagactggaggaatagttggacaagcggagggacggggcatacgagttctgttttgaacatgacaggcctccgaggtgtccactaggcagacgggatgtcagggcagggttaccaccatgtagatggtcactgctaagagctgggcactcctccaaacacatacattaaatcatttagtcttctcagtaacctatgaggcgagagctgtagctatccctgtccatagggggcgtatcctgtgtgccatttcagatgcccgcggcctcacctcttgttccagccattgccccagtgaccagttttgcacaggtcttgaccagtgccgtgtaaatgtcgcctggcagggcctctccacatgcctctcgcccaacaccatgatggggggacacccatggaacctgcttggcattaacacatgagccgcccagaagtgaaggggagctaacattccatgggatgactcgagaggagccaatggataactgtcccccttcttccagtgagttctgaagtacgtttcataaagcttcacagaaagactgagtggtgttcactcagagagatgttaacacactcccatattgactcccccctttctctgtttcattcctcctccccctcacccctgctccctgggatcatgttcccaaataaactactcatgcttaagcctttgtctcaggccccatgtaagatctgatcttacatggagaatttaacagcaacaacatcacaccaggggcatgctcaccaggggcagagcaggggttcacaccccggcaagcttctctactcgcttccatgttgcctctcaaagatcccaacctctagaggacatttaaaggcacaggcctagatggaatctaaccatctaaccgggagagactgtaaataagaaaaaagtccccacaccatgctcacatttagagatcaagaagaggaggagccagcgaaggagccagagaaagagctgccatccgggtaggaggaagccagaccagtgtggagtcctggactccaaagaaagacagcgttgcaaggaggagcgagtgccctactgtgcaaacgctgctgagaaattgaggaggtgagaccaggagacagaccttttggatgcgccagtaggaggtcactggtgacttggacaagggcagtttcaatggagtgacagaaacaaaaacttggctggtgtaggctaagagggaatggaggtgaagattcggagaagtagccagcagggacaaccacttcaaggaggggtgcgtaaaagggaggaggaagtggagcagaagctgaagagggtgtagggtcaaggaagagtttgttttgaaagtgagagagatcatagcgcagttatgtgccgaagggaatggtctggcagagagaaggagctggatagtgcaggagggagaaaggtgatttcaggcagtcttgagtaagtgaagggatatggtgcacaaaatgaagggattggccagggatgcaagaggaggccatccctccatctgtccatccatctatccatctgtccatctgtctgtccatccatccgtctgtccgtccgtccgtctgtccacccatccatccatccatccatctgtccgtctgtccatctatccttccgtccatccatccatccatccatctatccatgcatgcatccattgtgaggaagaaaggtagcagcgggcatagatgcaggcaccttgggagatctgatggtgagaggcacgtacgttccagcagatgacatttagtttctcagcaaaataagaagcaagatctttaactaacagcgagaaactaagggaaggtgttgagggttggagaagatgtgaaacacttatctggagagtggcgcagtgaatttagtagagaaatatagtaagattactgggcaagctgagcgcccacttgaagtttgtggtcagaagcgtcaagtgcggctattcagtatgactgtgagtttccccggcaatgctcagctactcagtgcaggtgcagggtgttgggtttaagcagggtggaggctgtgtcaggagattccaaatgaagggaaaagagcaagaaaggagagggcttccacaaatgggtgattcttgtcaaggcctacagaattgagctggagaagggggttgaaggcagtgaaaaaggacaagttcaaaggcagggagttcccaaaggggacacatcattgaatggaggtaatagagtagataagctgagagccgaggaaggggtggtcagggagcagggggttcagaagtgctgaggcaaaaccctggccatgggagtgggaggcccaggcagcagaacgagaggtggagagtgaggaggccaaagaccaagagtgggaggtgctgggtggacatctacatggatgaccttccttgtccaccatctcttaaacagctccccatcctgccactaccccttcatctgccttttcctttcatagcccctctgtctaacattattttacgtaggactggttcattggttaattatccttgctgccatcagaatgtaagcatctgagggcagggacattttctctctggtctacacttataaactcttttctaagaacatacctggcacagattaggtgctcagaaacatgtgctggacaaaagaatgaattaatgttaaggtctaggaaaagcatggaggagtggtggtggagaggaagaccgtgggccaggtactaaaatctgtgaatgagcaggagtggcctagagtatggtaaatactagaagggatggtggatggtctggtctgatggcatagctgcaaaggagatgcagacttaggctgaggaggaagggggagaaacctacaggtggccatgaaagcagggaggacaactcgctgcctccaggcatactgatgtggaagaagaaaacagagccaagacaggaggtggctgcaaggaagctgtgtgtgggggtcaggcaggtttgcagtagaacaggatggtgaaaggaatgttcaaagggaaagtcgagtggatggggagattttgctgatgacaaaccataagttcccgagagcagagtgaaaggatctgggggattgtgtcagattaggggaatagagctacatgggggtgaaagtcttgggggtgaaggatgaacaacagtgtcaggcttctggaggtgtctagggacacaaggccacagggcatgatgggctctcctgaaggtctctcttgggcaagtgggtacccctgctcacgccagctcctcctccagccagggcccacgggccatggaccacagtgaggcagtgatattggcgttggaggggccttgccagacactgagtgttcggggtgggaggagagggcagctttgggtattggaaggaaagtcgagcaggcactccggagactagattctcatccaaatctttcctacaaaccatgacgtaacattgggcaaaatggtcatgattttccttatctataaaatagagaggagaggaggtctctcttagctgtgcaaatcctggcctctgtctccttctttccctgacttcttctagctcctgtctcctcagccctcccgacttgtagctaagccctggctttgtattaaccaccctcctgctgtcagcatcgctgagaggcatagccaaggcctgccctcttcctcctccctggctccaaaatgctccatgcactgtcccatgccactctgatcctgagcagccaagtgggcagaatgacactcctttgggcgtggaagtgaacatcagccatgagtagggagaggaaactgcccacagagagggcagactccatcaggggcaagtgacaaagccacagactggcatgaagaggcttcccaggccctctggaaggcagtgaagccagcagcctggctcctgggatgggctgtcccctattcagcagctccatgggcctggaagtgggcccagggagccagccagaaggaggctgtggccagaggcttgatttgcagcccaggactaggacgcagggttctcatccaggcttcacccacagcaaatgtgcgactctccctggccctctgggtggggattataataactaccttgcttaccccagttgctggaggccaatattcactgaacattcatcatgagtcaggcattcagtaatcctcacaatggccctagaaattggcctgtactattttcaacccttagggaggaggtgacagacacatagaacatctaagtaacttgcctgacactccacagcttgtaagtggcagggccaggctcttagccctaaaccatacattagagatttattatcatttaggtccctcaacaatcttgtgatgcaggtattaccatccattttacaaacatggcaatggctcagaagtcttcagttatttgcccagggtcacttggctgactgtagcagaatcaggatttgaacccaggcccaacttcaaagccagtcctcttctcattgggttgcgcccccagcattagcacagggacagttcctcaggctgactgcccaaggccccatctgtgcaaacaggagaggaaatggcagcctaactccaggcagggcccgggctcagaagggggtctacagggctgaagaggcagctggccagagattccacaggaagcatcttgttgacacatcttcatcactttggaatttgagcaacaacatttaccccttctgaaactcacccagaggaagcggattttctgacgcatatgaagagtgagaactgtctacatctaagtcttctttgagaacaataccagctgagcggctatttacattccagcttcttttgagaatctctgaagatgattaagtcattgtcagctggcccagaaccatatcctgctccacaagcctcgtccttggcaagaagttgcacctgcccagagagaaaaccttttgaaactggcacaaaggcactggagagactggcagggccccctacttgacgatctggctcatccatctgcacactgaccacgctaagagctgtctgcagtgatggaaaccttctctagctgtgctgtcctctatagtggcaccagctgcctgtggctactgagcacttcaactgtggctgcagagactatgttaaattgtatttaatcataattaatttaattgtaaacaactacatgtggctagtggtttctgtactgggcactgcaggtgcacatttcctgctggccatggacagtaagctccataagagactaattgtgcctggtttgcttataggcttatcctcagcacctgcaccagcctagaatatgattggcactctattaattaaaagttcccaggtaaatgaattagtggattctctgtttcctccactatgccacaacctccttaagggcagagatggtgtcttcaaaaaaaaaaaattctggtcaaaaacacataagatctaccaccttcaccattgttgtgtccagttcagtagtattaactacacttacattgtgatacaacaaaagattgtgtctttttacattcttaggacccagcacagtgtctggcacataatcttagtaaacactggcagagcacatgcctttgccaaggccagaacagaggttcagtgccatccattaccaccctttcacacatccactggggctttaaaaacaacctggaatgaaagctgttgagtctagagaaatgggctacaaagaaggtttacaagataatctattaagaatagggaatacaggccgggcacggtggctcacacctgtaatcccagcactttgggaggctgaggtgggtggatcatttgaggtcaggagttcgagaccagcctggccaatgtggtgaaatcctgtctctaccaaaaattatccaggcatggtggtgcgtgcctgtagtcccagctacttgggaggctgaggcatgagcatcgcttgaacccgggaggcagaggttgcagtgagccgagatcgcgccactacaccccagcctgggtgacagagcaagactccgtctcaaaaaaataaaaaaacctaaaataaagcttaatacacatgacatatggattggcagtcacacataaatatgattgataaggatacaaatatttggaggtgctgcctgaccatctgttgctgattatgtggagatcacttgtctaggaccctgagatagactgatgtttctaactctgccacacacggtctctcccaccctccagacactttcttccttcagttcagggaaccctcaatacacagtaagaatgaagaggttgcaggtctgagcttgaggaggactggactaaaaggagtttagccctgccagggcattccgaggactgtgaagatccggaatattggccacaggcatctatgtatttgaatcatatccatttttgagctcactcctagcagaggagtcaaaacttacgttctggcccccaggtacatttccagtctcttactcataaaattgtgacatacccccaggggtgcccaaaggggtttgtgaatcaagatagtttgaggagaatcgattttctgatcctcagtttttctatgctctttttcctaaaagcgatattcctaaaaaggcatccaagacaaggcatcccctttcccatttgctggggaagacagctttacaagagaaagctgcccctctcacccatgtgaccccccactctggggcactgccctaggggtagaaatctccaaggcatcaaacaaagtgactcctgggggtcaagtgacagaggagcaagtctttctgcaagtcaagtggtttccagctctgctttcagcaaaattgaaagaggcactaatcaaattgccagcggatcataaaaaaacattttgataataatgttattaggcatataacttggaagaagttcaaagaattgaatggcatcctcataacaaactcatcggcttccatttatttatttatgtggacagtgtttctcaatgtttaaacctacaaaagactaaacatgggagtaaacttcatgttgaaccttgtgtgagtctagcaataagtcatccacatatacatacactaattgggaagaaaacctgtcccaaccccaactattttattaagagatgcatttccaataaaaatttaccttttatgtttaatagttgtttatcaaatttcgtaattatttacattgctctgatcaattggatataaactattctaacactaaactcataaccaaaaaattaatgctcagctttgggaacagaggaatttttttttttttttttttttttgagaaggagtcttgctctgttacccaggctggagtgcagaggcgcaatttcagctctctgcaacctccacctcccgggttcaagcgattctcctgcctcagcctcccaagtagctgggactacaggtgtgtgccatcacgcctagctaatttttgtatttttagtagagacagggtttcaccatgttggccaggatggtcttgacctcttgacctcgtgatctgcccctcggcttcccaaagtgttgggattacaggtgtgagccaccagtcccggccagaagttttaatctttaaattttatttaatacaataatcaatcaaagatttttctttctttcttttttttttttttttttttgagacaacttctccctttgttagtcaggctagagtgcagtggtgcaatcatggctcactgcagccttgacctcctgggctcaagccatcctcctgcctcagcctccccaaagtactgggattacagtcatgaaccaccatgcctagccaataaaagattttcaagcataaaaaataaatacaggctgggtgctgtggctcacacctataatctcaacactttgggaggccgaggtgggcggatcatttgagcctaggaattggagaccagcctgggcaatatggtgaaactgtgtctctacaaaaaatacaaaaattagcagggcatggtggtgcaggcctgtagttccagctactcagaaggccgaggtgggggaatcacctgagcccaggagattgaggctgcagtgaatcaggatcacaccactgcactccagcctgggcaacagagcaaaaccctgcctcaaaaaaaaaacaaacaaacaaacaaaaaaaaacccttacattagcataaaatctgtaacaggagtgaaatggaaatacaagttcttggagagaacgaaataatgtaaacttctaagctgtttaattagcgtttgttcccctattttttttaatggataatgttggacacagaattgctctggcatttagattccattggacatttaaaagaaagatacaatttgtatttgaaaatatcaatattcatttttctttgaattttttgactataaaatataataaaggcatatagaaagtgaaaaaatattcataaaatgctaaaaaggatatcctttggaactatttaaatttctgatggaaaatttcaaatgccaacttaaatacaagagggtaggtcatgtaaaaaaattatttaaggggctttgaaggcggctgtctggggagttaaggtcttgtgtctccagtgccctctctcacccctaaggtactgggtgggcctctggaggtacatctgcctatacaaggaatctttgatgtagcaaaaaaaaaacacaaaacacaaaaaaccctcacagcatgccctgcccttgggctctggaaaccaccgtcctgcctgccccactcctgctctcagccccctcctcaggcctaagcctccccaaccctccccaccccccaccccactgccccacccgcagtccaccccgctgtcgcctcccagccctggcccggccagccctggagtaaataaaccaccgggcaaggacccagacaatgggccttggcaaggagttaatgggctgggcctctcgcgttagccgagtgtgaccggagctggcagggggcctggcctggcgccagcatcgattacgaccagacggagccagggcagacttggcacgaatgggccccacagctggcagattcagtcaccctggccacaagggcacgaggcctgccctgggcgccggctgccaccgcggctgtgctccctgccaccgccttcactgccagtgtggcagggccgcttgtcaggcactcagtccctaggcccttttggttctccccaggggattgtccctggtcaggcctcttcctgtcccaggctgcctctgaggctgctctgtggccccacagactgggtgcagagcgggggtggggtagggggaggctgagggttgggctgggggatgcagctgtgacgcccctgcccccggcactcccaccactccaggacagagggaggctgctgagccaggctggtgttggtcagcaggaagaacaggtgaagcaagcctcatttctggtgtccagatggaggacagggtctttcttcccctgtttctcagaaacctttgtgggcctgggctctgctctggctcggcagctccaccctgcagggggattggccgggtggcagggaccacctgagggctcactgcgtccctgctaagaagttgttcgagtcagggtttgcaagcggggcttgcctgggggaaagggcatttcttgctttttgggtttactgctcctcccaggctctctgggtccctctcccctgggcgatgggctgtggcataacgtcctcagggcaaggtaacggctccatctggagctgatggctcctccaacgctaaggagctccatggacccagtcttgctgagcaaaggtttctttggcttgactgctggaagacaaatcacaccactgggcagtctccaaattttaggggatggtcagtatctctctgagagagatactgagaggtccaaaaaaccccacagaggagagaaaacaccaggccacatacccagagtgacagcccctgctctctgaggtcacaggtggagagcaggggaggtcaggccctgagggctgtggctgctggagccagctccaccaggcctgataatccctgcagatgaagccggcgcccatcccagtaggcagtggtaatccccacccaaccccacttccccggggaggaagctgacacaggggtgagggggcactggaaacacgggagagcagaggaatggcagctggggcccttaccccggcaccagcttctgcacctgccctgagtttcccttgtccccctccagaagctctcagatctttacttttttgtgagctctgttctcagagaaagttctaatacatgtataataccaactggctaactgagtggggtgggttggggcttggggggctggggaaatgtgtggcccaccaaaggacactaacccaacaaccctgcggagttgtggtctccaaactgaaagaggacacagtgtcaggtgacaaacaaaactggcctggagccaggcatggtggctcactcctgtaatcccaacattttgggaggccgaggctggaggatcacttgagctcaggagttcaagaccagcctggacaatataaggagacccctgtatttacaaaaatttaaaaaattagctgggctaatggtggtgcatgcctgtagacccagctactcgagaggctgaggtgggatggtcgcttgagcctgggaggcaaaggttgcaatgagccgagattgcgccgctgcactccagcctgggcaacagagcgagaccctgtctcaaaaatttaaaaagttaaaaaaattaaaattaaaaactggcctagactagggaagtgaaatgtccaaacattttgaacagataagaggcatggtaggagggatgaatttttataaaagaaatattgacatttggtggcgaaatataaatatatacaaatcttttcctctacaatacttttttattgtccttgaaggacctacaaaaatcacttaggtcgtttaggcacataaaatgtgccatgcataacttggctcataaaattgtcacctttgttatatggttccagagatgtgaaggtctgtttaaaagttaaaaacatgctgttaatggagactctatttttccccaatattttttaaaaccaaaagactcctcaaggagtctgatttttttttctcccctggccttcatctggactcttccttttggtggcctttaatgaagtaggttggagacccttcatactgggtaacctcacaccttgacctgggtagtcagtagcacagggcccaatgcttagaagggccttgcatttggtttaaaactctgttgccgcaatatatatatgtcttttttgagacagggtcttgctctgtcacccaggctggagtgctgtggcatgttcttggctcactgcagcctccacctcctgggttcaggctatcctcccacctcagcctccctagcagctggaactcacaggcatgcaccaccacgcccactaattttttattttatttttttgagacagggtcttgttctgtcacccaggctggagtgcagtgatgcaattttggctcactgcaacctctgcttcctgggatcaagtgatcctcccacctcggcctcctgagtagctgggactacaagcatgtgccactgtgcctgacctaattttttattttttgtagagacaggctctcactatgttgcccaggctggtcttgaactcctgggcttaaatgatcctcctacctcagcctcccaaaatgctgggattacaggcacgtgccaccacacccagcaaacgcttcataatttaataaggggcccgtattttcactttgcactgagccccacaagataagtagccaggtctagttatacccccgcctgaagccaacactgaccttccccagccctcggagctgtccccaggcctcactagtctcatctctccagtaggaggcctttgcccttgtgtaagtcttgcttcttctcgtcaggagtgcctgactgcgtgcctcgcttcgagcctcccgtcccctctagccagctcaacagcatctccttatattccccttcggccctggggaccactgggaacaaaacaaaacgcaacccgttcccttgtggctgtcgggcgggcgggcgttgagccctgttcctcactccagctggtgtacccctccgggagccacgcctcgcgcggagcgggagccttcaaagaggccgcgccttcctggctgctcccttcgcatcctgatccagtccaatgatgtttttgcaattttcctgtgagcttggtgggaaaagctcaaagagactctgtcttcctttctggcttcctttccagacggcgcagctttctctcagctgctcccctgccccacctctctcgaggaaatcggtctctttcctctccccctcacccaaaaggtccattcctgaggcttatcctgaaatcaagccgtagcggagcggtgggggatccgaggcacaagcaacggggcctcatgatgttgcctaggctgggctccagctcctggattcaagcaatcctcccaccttggcctctcagtgttttgggattacaggtgtgagccaccacgcctggtctcaagccttcgctttcgcaatcagcactaaaggcagccagaaatcaaccgtgcgccacccccgacctgagaaacaagtctaaatgtgtccggaattggtgggttcttagtttcactgacttcaagaatgaagccgcggaccctcgcgaatgaatacacaggggcttagaggcatgtgctgctactgag

SEQ ID NO: 3254 - DNA, 2456 bp, Homo sapiens
agagacagagccaagtgatctcccgcagcacctgccctctcctgagctatgcctctggccttcccgcctcctcctccacacggacctccgcgccccctgaagaaggggggaaaaagaaatacgcattaatacctcgagccttggcgcaccagccctcgccccctcaaccacctgtctctgcgttctcccccgcagccttcctcaactctgggcgccccctctgcagcaaaggggcaccacgcccactgcggagaggagaaatgcaagggatatctccactggacgcccaacctcacatttccgcctgtagaaattccacctgtcctttaaggccaactcgaaaacctcttcctctctgattttcccaatcagcaatgtcatttatgacctcagttttctgagagatacagtgagaagatggccaactgcaaaccaggaagcagaccttctccagacacagatctgctgatgccttgatcttagactaccttgcctccagaatggtgtcaacagctgaatggggaacctggacccaccagtgtggtatcaaaggaggggtgctaaacagaatctttcaataagatccagtctttcaacataaatcccaaatttccagatgcaattaaaatcactggtaataccaagaaccaggaaaatctcaatttgattgagaaaaaaccattaacagatgccaacattgagatgataaagatgttgaaaccatctgacaagaattttaaaacagacagccatcataaacatgctttaatgagcaattgcagcatgcttgaaacaaaagaacagaaacactcagcaaagaaatagaaggtataaagaagaatcacatgctttgcttgagccttaaaagaatcactcacatttctggaacaatcaccctcactttgctcctgggacaaggcttcttcctctctcgggaacacccatatctctccttttctcctctttaactcctgcttgaccaaaggatcagtccagacgtcacttctcctgggaagccttccatggtcttccacggcttccatgcccctcccactcagagcttcctataccatagcacttacactcaatgcatattgttctgtcatctgtccctcccacatccacccaatgtaaagacttgacagaagggactatgtcttatcccaggtgcctggcatagtacctggcttataataagcactcaaatattttttgaataaatgaataaattaatgaataaatggaaactcttctgtggctcctcttctattggataaaattaaactctgtggtttagctttaaacaccctacacaaactgtgacacccggatctttctggtactcggcttcccttaacacattctacttctctgtcataccagaaaacacattgtcctttgacagtaccttatctttccccatcactacatattgtatgtactcttctatcagtctcaaatgtccttactcattactatcatcaaaatcgtattcatttttacaggacccactcagaaaccacctgttcatgacccagtctcagatcttctcagctggaaagggtcctgcccacatctagatacaaagcacttcatttagtctttcctcgtgttatttctcactttctgttgtgcattttttttcttgcttctttgtttaaatgtgtgttgtattatccccaagatttaaacatttggggttcaaataaactcacatcctattcatctttgcctctgccactgtgcacgtaacacagtcccttgttattctctgagtttcagtttctttttctgagataatagaacctacttcacagggtttctgtgaatgttaagtaaaatatgctatttaaatattggcaccatatctcaattttcatacagtaagcactcaaaaactgttagctactatcattgtaaatatgattattatttgaagaaataaatagactgagcaagtcctgttacctctactttgaaaccactttttgaattctgcttgatctcatcactgccaatatgatcacctgctcccagccatgatcgttcttcttgctacggtctccttctactttcttatccctcaacctctattctctactcagcagccagcatgatccttttaaaacataaagcagatgatatgacttctctgctcaaaaccctccagtggcttcccaatctacaactaaaaaggccccatgtagtctgacctcctgcctctccccacccccactcactgacacaacctcatggccatcttgccccctgccatctgaggctttctgcacttggcagcttttcatcatagggctttgcacttgtcctttcccctgtgtgggataatctctcccagcttggcatacaacctgcttctccacttcattcaagtgaagctgtgctctccactgttatttttctaaaagtaaccaccatatgtaaaataccaaccatta

SEQ ID NO: 3255 - DNA, 2880 bp, Homo sapiens
gaagagctgcctgggctgcagccgcggaagctgcgttctggggagcggggagcgtgctccggcgccttcgggccgctgctggaagccggaaccgagcccgggccgctgcccctcaccggacgccgcgcgccaccggccctccgcggggcaggggctgctgcgagctcgccgggcgccctttagacgtaagtctcaccctgcgccccgaggcaggaaggagcgcgtgcagtcccggccagaaacggctaataggaagggctgaggggttctgtgttcaaggcagaaggccgtgcgtcagggcggccctcagcggagatgcgtgcacggagcggggagcgccgctcggggcagggaatgaaagcggcgcttgagactggaaatttagggagatgagttccttgggaacaacgctgaaccatctcactgccccaccctaccccttgttatttttttttgagacaggtctcgcgctgtcgtccagtctgagtgcagtgacgcgatcacggctcactgcagcctcgacctccggggcttacgggtcatcccacctcagccctctaagtagctggcaccacgggcatgcaccaccacacccggctaattttttaaaaaaagtttttccggagatagggtctcgctgtgttacccaggctggtctcgaacccctggcctgaagcgatcctcccgcctcggcctcccaaagtgctgggattacaggcgtgagccactgcgctcggcttttcacccctttctaacgttttccatccctttctaacgttttccatacccagcggtgccctgcccaccctctctttatctctcacttttccctcctctgtttcttcctcgctgaagtccattggtgaaagaaaattcatgtgaaagttctcagagtcgtccttgtctactccactaccaaatgttgaagttcttcaagaatcagtcctttggaggcatttaaggaaatctgtttctcttttggatcactagctgcaaattaagctaacagaacaggagctcagctggtcacacacagcaacgaatacagactttataaagttcagaaaagttaccaaacagtggtaaccataacaagtaccaacaatgaactatggggagggaggagaatctgatttccagagttaccacattataatactattcaaaatgtcacatttttagcaaagattacatgacaaggaaaaaccagaaaagtatggcccatacacaggtaaaaaaagaaattaatagaaactacccctgaagaagcacagacttcggatgtacaaaacaaagacttttcatcaactcttttagatatgctagaagagctaaaggaaaccatggacagagaacaaaaaaattaggaaagcaatgtctcatccaatacagaatatcaataaagagattgaaattgtagaaaagaaccaaatagaaattctggagttgaaaagtattataactaaaactgaaaattcactagaggtattcagcagcagactggagaagtcagaagaaagaatcaacaggcttcaagataggtcaattaagattatacagtctgaggagcagaaaggaaaaagaatgaagaaaaatgaacagagcataaaagacctctgggactctatcaagcataccagtatatgcatgaggggagtcccagaaggagaagaaagagagaaagggacataatatttgaagaaataatggtagaaaatgtcccagctttgatgaaatacatgaatctagatattcaagaggctcaaagaaccctaaatagggtaaactcaaaaagacccacaccggaatgcaaaagtgagctgggtgtggtggcacgtgcctgtggtcccagctactcgagaggctaaggcaggaaaatcgcttgaacccaggaggcagagattgcggtgagccgggattgcgccagtgcactccagctgggcgacagagcgagattccatctcgaaaaaaaaaaaaaaaaaaaaaaaaaactattgctgcagtcattcagatggaaatggggaaagaataatattaactgatttcaaaaaggacttgaagatgtgaatcatctattttgctgaagaaatcttaactctttgaaattactttttgttgctgttgtcatactcttaggtgccaaactgcggtaaattttttatcagtgaagtggaagcatgtgttttgttgttttgggaatttttatcaagtatcttcagagaagattatttcctgctttatcttcaaaaactggaaaggaagggtcaaagaaaagacagtagctggccggtcatggtggctcatgcctgtaatcccaacactttgggaggctgaggtgggcagatcacctgaggttgggagttcgaggccagcctgaccaacgtggagaaatgccatctctactaaagatgcaaggattggccgggcgtggtggtgcgtgcctgtgatcccagctgctcaggaggctgaggcaggagaatcgcttggacctgggaggtggaggttgcggtgagctgagatcacgccattgcactccagcctgggcaacaagcgaaactctgtctcaaaaaaaaagaaaagacagtagcttatgttcatgtcaagcacctctcatcacagtctagttccaaggaaaaaattcccagcgttttctacattcggtgctgcgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggc

SEQ ID NO: 3256 - DNA, 2490 bp, Homo sapiens
acgtggtggcgatattgagctgtgtatacctacagccgctgagagccggtattccaacgccatgagacgccttctgtcgtgagcagttgacaagaaagacccagcacttactgcaaccggaaggagcggttcctccctcgctcgcgcagccgctcttccccgccactccctcggtgcccgccagcacattcccagcaagccctgagtatatttgcatatcaactcactacatttttttcttctaactaaaaaatcgaaaggacaaattccagattctccttgtgaagtcttcctttcagttcagaagaaatggaattcgctcttcaacttcaggaagttgaaataaagagttgcttggattttgtgttcacctttaccaaaaaatggatttggtaacactgccaccctgctttggtgacagagaaagcaaaaagggcttctgtcgtgagtggcacacgtagggcaactcgattgctctgcgtgcggaatcgacatcaagagatttcggaagcataattttttggtatttgggcagctggtgatcgttggtcccggcgccctttctttactgttatatgttaggcgaaatattacgcgtttggagtaagtggtgctttttgtaactgaaaagagattctgtgtgtgtttttttttttttttagaggctgcatagttatttgtatgaaccgcaggtgacctaattagcaaggtaattcagacctgtatcctagcacttaagaagtggaagtgggataaccctgcgtgttctcgtgtgggaggctagcttaagcaacaaagcaggaaggccccaccaacaaaagaatttaaaaattatacgtgcgtggtggcgcgcgtatgaggaaattatttggcaactgtgttacagtatagcagcaaatggaatagacctagtccctgactttaggagacctgcctcagccccccgaatggctgggactacaggcgtgcgcctccgcgcccagctaatttttgcatttttggtagagacgggttcaccatgttggccaggatggtctccatctcttcatctggtgatccgcccacctcggcctctaggagtgctaggattacaggcgtggccatcgcgcccggcctgcaatgttattttatgaagcagaggaaattgaaattaccttcaccaggccttagcaaactttttctataccttataccatacacaaaagattaattcaaggccgggcgcagtggctcacgcctgtaatcccagcactcctagaggccgaggtgggcggatcacctgaagtcgggatttcaagaccagcctgaccaacatggagaaaccccttctctaactaaaaatacaaaattagccaggcgtggtggagtatgcctgtaatcccagttactcaggaggctgaggcaggagaattgcttgaacccaggaggcggaggttgcagtgagccgagaccgcaccattgcactccagcctgggcaacaagagcaaaactccgtctcaaaaaaaaaaaaaaaaaaaagattaaagacctaaatgtaagaccttaaactataaaactcttagagaaaacacaggggaaaatgacatcgaatttgtcagtgatttcttggatataaacaatggtttacaagcaacaaaaaataaattggtcctcatcaaattttaaaatgttaacattaattttaaaattaaaatgaaaaacccggccgcgtgcggtggctcacgcctgtaatcccagcactttgggaggccgaggtgggcggatcacctgaggtcaggggttggagaccagcctagccaacatggtgaaaccccgtcgctcctaaaaatacaaaaattagccaggcctggtgtcaggcgcttgtaatcccagctacttgggaggctgaggcaggagaattgcttgcaccgggaggcggtgttgctgtgagccgagatcgtgctactgcactccagcctgggcaacagagtgagactctgtctcaaaaaaaaaaaaaaaaaaatagccgggcatggtggctcccagcactttgggaggctgaggtgggcagatcatgaggtcagaaggtcaggaccaacctggacaatatggtgaaaccctgtctctactaaaaatacaaaaaatttagccgggcatggtggtgcatgcctgtaatcccagctactcgggaggctgaggcaggagaatcgcttgcatccaggaggcagaggttgcagtgagccgagatagcgtcattgcactccagcctggacaagagcgaaactccgtctcagaaaaaaaaaaaaaagaaagaaagaaaacccttgtacatcaaaggacactatcaacagagtggaaagacaatccacagaatcagagaacatatttgtaaataatatatctgataagggattaatatccataatacataaggaactcataactcaacaacaacaacacaaacccagcccagttcaataatgggcaaaaggacctgtatagacatttctc

SEQ ID NO: 3257 - DNA, 1586 bp, Homo sapiens
acaatttgtgcagttaatgcaatcatcacagggtcctgaggcgacatacatcctcagtttatgaagatgacaggattaagagattaaagcaaagacagacacaggaaatcacaagagtattgattgcggaagtgttaaatgtccgtgaaatcttcacaattgatgttcttctgccatggcttcagctggtccctccgttcagggtccctgacttctttcaacacctatcctgtcattctctagagagcttgttcctgaagcatggtgctaagtccatatgcagcagatggagctcatgagaaaagagttgctcttgtgaagaccaaagcttggtgaggtgtcagatccccggcgatggaaagcagtcaactcatgggtagtaaaaagaatgtattgacaacactataggtttgaaaaggaaagttttattagatggaaagaacagtgcagaagaccgcagcagaggacctcagcaagagagaactaaaaatggtcaattacaaagcacaacataagactggaacattggagttaagtagcagagatcaaaagaggagattgcagatggaggtgttgtatgtgactgttttacatggattcttcgctctggtagcagatgttgaagaagctctatgaatgtcctgtctctatgtcccagtttgtcagtttcaaatactcatgtatctgattgtcaatgctggagagctggggccagggcagtagttgatgaatatcacctgactgtctcctgcagaaaaagcattcccagaagcacggagaagtgaggagaaaaggcaatgcacctggagctggagaccaaggccctgttcttactgatggcccttggagcagatatttgaattggagagataaaaccgtggtttttggggtgttaattttggtggctgatgcattctgtgattgatttggctattacaactggtattgattttaaacacattaattgcaaaatctcaattgtgatttgatttctgtatttacaatactaaaaacgaggctttcgccaggagaagacaattggcagtactcagttggaagtgcttaattgttaatatatatcagccgtggttcttcagcgtcgtcagtgttgctcagtcttgctctttgtggcgactactgaatgcttgaaaaattctctcctatactcccactctgcactgtagaagagaaagagaggagagtggaagaaaaaagagagggagaggagaaagaaagagaggagagagaaacatgggcatggatgatacataaggtagttgtaaactgtgatcagctttgataataactagataaattcttttaatacaaaaatatataaggcattttgcctttttttcaaatttcaaataaatggatttgtatagaatgtagtctgttgcccagagttttcatttagcataatgcatttgagatttatccatgttgttgtatattctttttattgctgagtagtattccattgtgtggatataccagtttgtttatccattaacctttgatggatatttgggtttttttcaatatgaggctcttataaataaaccttctgtaatcaggtctttgtg

SEQ ID NO: 3258 - DNA, 7507 bp, Homo sapiens
aagctcccagagcccttgcacagaaaaagaagcatttgctctgtgcagctaagaatccagcttttaattctatcttttcttgtgtttacataaactttcgtttgcatttcagaagccttatggaaagattcctgtggctgacccaggagtagtggtgaatttctccatcaagtgagtattgatgagctgcaaagttcagtgaacaggaaaattctgctccttttattgccaatgtgacaggttactttattaccatgcctttcacagcaatttaacagttaccctggtaacggattcagtgaggtaatgggatcacaggcattggagcggaggcaggctggccgctcggcgcagccatctgctggctgctgttccggaggctgtctgcctggaggagccctgacagtcacggggcctgcatggcaatgagcaggtgaaaccgcaggcctgccctatttagctgtactctggtgatttgtctttctaattctattgaaataatcatcaggatttgtttctgattaattaactaaccttttggtaaaaagattagataacgaaattgctgcctattcagagataatgagatttttattactctgtcaaaggaaaaaaagtacatttatgtgtcaccagccgctgtgtcaagaggaaaaaaaaaaagagagatttcagtctttgtcgaatgtgtatattcctcaacagacgaagggtgtgcttaattctgtaggaactccccagcctcgtttgacgcctttaggaagagtttttaaaacagcaaacaaagtaataaacacatttaggccaataggcttttggggagggtgctaatttgttttaaaatgtctcctaatgggagagaaacgcttgggagtctggggaacttgcctgtactgtgtgggtgtatttatgtaagtgtgagagtgtgaagaaagcagtaaaatctccgtgcgaggctttaaaatgacatatgtagacaggctgcttttcctccgcactacagatatgtcttcgacttgcagtacatttgtcttctggcaggagctgcactcgggcaatgggaaggggaaatcatccgagcttagcaggctgggaggtcacctgtgactgtcacaggtaggctgccttaggaaatgaattattctgactggcggtgagtaaaaagggaagcagcccttctcctgtttcactccaagacacgcagccagtcaatttaaccttttctcttaagaagtcacagctcaatcctttgttaagggggactttcattttctcactcctctgtgccttcttcaatgctgtgatgccaagaaaaaaaaaaaaataccaaccccgggaaaagcgcttcccttggataaagagatgccaaatgcgccaaataggctgtgtgagccaggcagcattggagggaacaaagcgcagtatatttccaaataaaacttcaaagagctacaatattgttttaattactaaaacctgaggaggaaacacagtgcatgtctcttccttcaatgcaatgaaacggaggagtgggagaaagggccaagtggcaggctgggacccagctgagcattttgtgaaagtgtatttgtgtcactgtcttttcagagtcaatgagacacttatgtttcttgtgatatcctgtggccttggctgcctccgtttgtgtgtgtatgaaaatgaaaagatttcaagttctaaaaatggaagtttctattctgaatttcgtatggttcacagacaagttgcaacagaccaaaggaaaaaaaaaaaagaaagaatgtgcaggggatcaaatgtgaacattccagagcccactttcctgtcctgcctggcgttcccactctccttcccctctttattccagttcctcctgcacctccaattgccagctaacaggctccattcctgataacagatgcttgacaaagaaagagaaataagacattaaaaaagagtagactgctgctgggggtggggatttgatagcacattgccaatggctttttacaggaacttgctctccctggctcactaccaagacagggaaagaacagggcgggggagggagcctttgtcctcaaactcccagtgaaatatagggttaatattagcaattattattaaaattagccaaatgttattaaatgatctttgtatagaagaataagtatagttttccctttggcagacaatgacatctgcagctctacattttcatgaaatgactatacttaacaaaaacattacttcattttcatggtatttcttttgtgcctaggagcaaccctgtaattgttcacttcaattacaacattactattttaaaccgaaacccattttatctgcatgccagctttttatttgttttaccaactatatctatttccattactgcaaggctgatggtttgtctcaagaggaaatcaaatccattaattcagaaatttcaagcccgactagctctgccataagcagcatttcttatgctaatagcaaatgtgctgagactgaaaggaactgacatggccctgttttttatcataacttaagcatttatgtaagaaggcaaatctaatagtagtaggaaactgtaagtgttattatatataattcactttcctgagatctggacagggctctggtttgtgtagccatggtttaaatcaggctgccacaagactttaactcacctgactttccctattcagccaacatattgcttcacaacagatacatctagcatgaaactagatttgtgtgtttgtgtggatttgtttgttttattctctactgttttttccccctgcaagacggacttttgtcaatgcagggggaaaaaaaatcattttgtattcaggggatgtctgaaacttacgcgtgtaacagcactagcctgagacaaacctggctccttctgtttcatttttaatacactctgtttgggtcctatcacatggtttgtgttcaattagatagcttgactcgataaaatctgactctgacccagaaaaaaaggagagagagagactgctcctgactcctgcttaagcttttgcaggcactgtgacctgtttatgtcaatggtaaagtttaagagattcctatcacagaaccacatcatcttctgggatcttaaaaatacagaaagcactcgaggaccctggccctcctttgtcactgcaaagcccttcagtgctgtaaatcagtcctcattgggagctcttatacaccagccgtcaccgataagctttggagaagtagacaaggcttttaggaattgctgaaccatgaagttgacctgcttagggttttgttgtaggctattaaatccgggatggccgttttaagatgattccgctttctttttcccttggcctggttaagcaactctacccccacctcattatttgactgattaaaaaaaaaaatcagaatggagcaacctgctgtttaagaatactaccttcacacatcaatttaatgagagtgacttatgctgacgtagtttacgggctcaagcaacttgacgctaattttgcagctaagaaaagatttactaactgtacatactgctctgcttttgttggcaagggtaccacgattcttttctccaaaaacaaactctaaatcttttgtaaacatgcattatttggttaacacattgtaaatggatcccagttgtgcagcacaagcactgttcactattatgtaaacaattattcactgaaagccttgctttaaattgtaaatgaatatatttcagctgtaacattgctttcagacctgcccagtggtataaatctggtcatttgttttttgcactctgcctattactaaccggttagaaatgtgctgattatttgcacaagcctttcacactgcgggcacagttaaattgctgttttatttttcctgtgtttgatgagtgttaacaggagcgccatttgaggaaacccaaaccaaatacagctctttaattggggttggagtgtttgggaaaagccacccggtgagtaattccactgtttaatgtttgaaagttcatccacctcactataggacttatgacaagattaattaaagggagttaacaaaaatgcagggctttgctcagccaaccagaatagcttgaaatacggcgcactcacttgcagggatgtagattatttggtgcaaggtctaattcccaactctctcctttaaactcctgtcattgccaaatagctccattttaaattcagtatctcttcaagaaagcacaatctggagaaaaaaatatgacagaggtatctcattgggcccctgtgacttcctttgctcacagggtacgcccagtggctgatgaaagtttcagctgactcagaaagccttgtctttttatttccccctaaacagtcaatgattcatttttaatgtttccccacctcttgtggtttaattgggtttcagtagtgtgctgatctgcagagcttggaagacagaaataatgaccttggatgatctcattggtgtgcaccagaacaagtgtagttttattgagctctgttgctagaactgcaaaactgtatgttcattaacttagacagtgctgaccttagatcaagcctaggataatgggaaaagccccagattccagccctggatttgctcctgactttgcacactcattttacctctgtgagtcttgcctgtggcatagccgggttggatggcaccatccttattgttccttctgaaactgaaattctcagatacctgcagtgcataattctacctgctctttcacatctataaataaataaaagaggaagactcagtgatcaaaagatatggtgtttaatagctaaaaggacgaggctttttatttccacattgaacattagaaaggggatctgcagttttttttgttactgaaaattctgtagaattcaggtagaataggtatgcttccttctgtggctattctttgcaacttaaatgactatactatccttaagtaaaccacacaagaaatactttgtagatctacaatggtttgtaattatattatttataatttgtttaatatactttcccttatagtgaacaggactcatgctacctttttcttcctaataatctacttattcagatagtctattttgcatattacattcaatttaggttgaaagaatgaaagtaatgtgcacatcaataaatggctgtgaaaattaagatagaagacttttttgtcttctctgaaactttctcttttctagatactgatgcaagttatcactaatgacaaattggaatcataagccttgagtacaaaaagtccatttaaggacaattatgagctttgtcataatggaaaatacaggcattgatttcttttcctctgctaaacacagttttctaaagaagaaacagtcagtctcctgtagcatttctcttacctatatatatgtgttcgataggcagttccacagaacaaatggaaatattttttaattacatatgttttagttagaaacacacttggaatttttttaaattgtagtttgtaatagtcctgagtcctggtagttggtttattttaaaatgtagatgttacaccaaattgaaatattagcagtgctttattttacctgcttccctatctgccctgcctttcatccagtgcttccaagagaaatacacatttcacactgctcacagttctaacattttctttgcctatttctgacttctgaccttgtccagacagataaccatgctatgatgactttacctttccactctctactttataacaccatgtctaggaatgccccagttaaaagaaggagccactgattcaggccaaatgtgtggaatattgataaagtccattcagaattgaaaagtgtgcagggttgctcacaatgaccttcttagaaacacattaaggatgtacaagtgtttctggtctttattatggtcttggctatttatattatacaaggacagacttcgtctgactggtttttgctatcaaactttcacgtttatttcaataaatggtcacttaaatacctgaaagagttcaagtaagtttttacatcagtatgtggaacgagtgcaaagcattcaaatagtctactatgcccaagtcgagacttttctgctgttgtcaatgagtccatataatctagctgaaaaatattctgagcattttcctgagcagacagaattcctgtcctggacttatatcttagagaatgtgcaggtaatctaaagaatctttaaaataaaggccaagcagccttggttgatatgttcctcttcagttacttaaattctaagttctttggcagtaaggaatttatcttattcatctttccaatctgactacctagcgcaatgcctcacatttagcaaatgtccaataaatgtttgttgacctaaataattatggcatcctgaatattcattctttactccatggtagtagagagatgagtcatgtaatcaatgtgtacaacttacatgtataggaaaatagtcattcctacttacagaatgtccagtttgtgaattcacctaaggctagacacaggttcagaggcagaaatgtcattcatattgcaaaaatgaagatttccctaaaatatgattaaaataatacacctattagaattaaatcaatataccagcagtagaagggaagattacaaggcacaaataaagaaacaaatctttgtatttaggtgagtcctcatcttaaaaatgtcttctattattatacctgttggagtgagactcaaatttgacaatcacttatttaagtactttagtaacagaaagaaataatttaatagttgatatggtttggttgtgtcccacccaaatctcatcttgaattggagttcccataatcctcatctgtcatgagatggaccaggtggagataattgaatcatgggagcactttaccccatggtgttctcgtgatactgtgtgagttctcaggagacctgatggttttataagcatctggcattcccctgcttatacttctccttcctgccatcatgtgaagaaggatgtgtttgcttcccattctaccatgattgtaagtttcctgaggcctccccagccatgctgaacttttagtcaattaaatctctttcctttataaattacccagtatctggcagtcctttatagcagcaggagaacggactaatacaatagtcattgtcatataacatattatttcactcttcttaagtaagcatatattatttttataaaaataataaagctattttgaaaaagaaagttgagtatgccattctttcaaatgcagtatgatacaaaatacagtcaaaaggaatcaggaaagtctgcagatggatgttacaaccacactaagtcttgaaggataagggaatttagcctggagaaaggaagcaatgttcatttcaggcagagggaaaagcatatgttgatatacagctttgggtttaaatcacatcct

SEQ ID NO: 3259 - DNA, 1444 bp, Homo sapiens
cccaaatgtggccttgggttttcaggagcccagtagtgacttctgtggtccctgacttgcaccctcaccctattattggagttgtgcttcatttctctgtgtggaaagagtgaagtattgggaaatatgaccctggtcaccaaaccaactcagagacagcaagtgctttggcaaaggaaagggctggcacagagaacagagtcgatttctcattgtcttcaccaatcttctgaacccgtgaatactttttgcatgatgatttgaagcagccaggaggccaagacagcggccaggagaagcagcaaggaattgagccttgtacatttttctcaaaaaaataaaagatggggaaccaccatgctcgagataagaaattagtctgtgaagagaccttcaagttctgtaaatggtagaaaaaaatttaaatgagacatatctttctcaatttgcatcccaattattttcttaaattgtcattcactgtaacctagggaaaacagaattcagaatcacatggcagtaatgattttcatgtcctttccctaactctaccatgactccgctcccctaacacacctaggtgtctttctttcctttgtggctcatgcaatttcttctgcctgcaattccagtaagaatggagactctgggaatggatttcagaattattcaggaggaataattttcaggatgtgtgagtgatcaaatctaggggccaagcaagtcaaagagtgaaagaagagctcagaagttgaacacatttaagaggaaagatgaaaattttggttcagtggtgtcagtagtcaactagatggaagtgtaagaaggaagatggaaatgggagactacaaaataggaaacagagctacaaagagaaataaagtaatccaaagaaagagcatttattagtggacaccaagagttggacgtagatcctttggaaatgtaatatttcaattgctcacaaattctccaaattgacaatatggcaagtctattcaaagataagtaagtcatggtacacagaccaactctattacaccaaggacacataccaagactaggagaaaagagagactgggaggaataattctgccttcggaccagaggaagagagcaagagttagagacagcttcctggaagaggtggcatttgagctagctctttaagtttcaatgggagaagaaagaaaaggcatctggaaacaaggaagcagcagtagcaaatgaggaagaatcagaagggaagccagagagcaccattatcaccagaggatataccaaatccagtcattcataagctatttattttgtgtgattttaaacaatagctgctatcggctgggcacggtggttcacgcctataatcctggcactttgggaggccgaggtgggaggatcacctgaggtcaggagttcaaggccagcctggccaacatggtga

SEQ ID NO: 3260 - DNA, 6424 bp, Homo sapiens
aaacggctggggcctcactcacggcatatggaactaaccacgcccctaactaagaaggcacaccttagttgcagttagcacacaattaaagcaactctccaagttttaccttaaagttcaaaattgctaggagttgaaactactagaaatatatttacatgcaagagtcaaagaaactttgaactatttatggcctttaataattaagtaaggtatactcctgtgatcaagacttggagcatatttgtttctctctgcctggttcctctagaaattggaaactatcagaacagagaccaactccgtttcccgatccctttgcaatctgcattgaaccatgagtcaagttcttgataaaggagtgaaaatggatgacatttaaggcacatctgaagatggggaaaccacagcacagaataaggctgggcccttgaatcaataaatgaaggagaactactcaagagaacaaaaccaccagcaatatccacctgtatttgtcttttcataatgtgtgacacatgtgctcatggattattgtccgaagcaagacatgtgaccaagcctaacatcaactgggtgaagagctatatgttcctttctcaagaggcactacaagtgacatgccactgggcaggattatcctttctactctcctactttctgaactacttttctccctctgtaagtcttaaagaagttcaatgagctataagtgaactcaggtagacaactcaacaaaatcaagaagacaatacatgaacaaaatgatactttgaataaataaatataaaccataaaaaacttgaattattcagttcagtcataatacatgactttaaacttcaaaacagtttgttatagtacagccaaaatcattaaaattggtcagctaagaagtatatattttttctagttctctaatggatagctgtacattatattcacaacttacaaaatctgtccagcaagataacagattagaagacacttaacattgcttcccccacaaaggtataagcagtaactattcaaagacaataaaactaccctgaagttactagaacttgagagagaagcagaggaactgatggagcctgcagaaatgagagaagctgtgactgataaatgacgattttagaatctgccacccactaccccaagccacataacagctcacagaaaatttctatacatttaggatgtctgagttggaagaaattcgaagttgaaaataaacattcaatttccctatcagttgaggaggcttcatgggaagtctacatgggtctcatcccatggaaaacactgagagttccaggagggctgaatgacctgagtgaactgaagataaaatcaggagagctgattgcagcaactgtcctgtggatcttggtagctgctctgcattctgctcagcaggaatgccatgctgaggagactgtcaagtctcatagcactgcagaggttatgagccctggaaatgcctgagtccttttttgtgtttatgtggcaccttcccctgacccagaagcagctgaaatatttagtaagttctggtgctcgcaataagtcttttccaaataacaaacaatggcagagcagtgatttcactccagtgcagcatttaaattctgatacacactaagtcctccccactcaggagtcaaaagctggacagcaattaagttctgatattaagttgtaatgatctaagaccacaaaaaacacctgcaaaaacagaaagaggtgaccatctcctcaaattcacaggcatcaatataaagataaaaggattaataaaaatcaggaaaatatgacaccaacaaaagaaataaacaaagctctataatggacacagaagaactgatctataaaatgtctgaattccaaattcagaataatctactttaaaattttcagggaatcacaataaaatataaatagaaaattaactaaaatttggaaaacaatccataaatacaatgagatatttgacaaataaagaaacatttttaaagcccaaataaatcctagaaataaagaatataataactgaactgaaaaaactcaatagaaagcttttacagtagacataatcagaggaaacagcttgaagacgtatgaaattaatcagaggagcaaaaagaaaaaagaaaaaatatggtgaagaagaccttcaggaattgtgggacactatttaaagtaaactaaccttcacataataggagtttccgaatgagaaaagggagaatagacctagaacacatatttaaggaaatcatagctaaaaacctcctaaatctacatgtagaaaacaacatccacttacaagaaacatagaagttactaatcaaattaactcaaaaggaattccccaacacccttcaaattatgataaaaaaaatcaaagacaaagaaagaatactgaaaaaaagaagagaaaagagacatatcacattaatcagggccctaatacagctttcatcagattctcagcaaaaaccctgcaggaaaggagaaaatgatatgatatattcaaagtagtgaaggagaataaaaacctgccaaccaagaatattgtaccaagcaaaggtattcttcaaacataaagaaaagataaagtctgcagataaaccaaagctgaggggattcatcaacactagacctactaaaatgctaaaggaagttttttaatctgaaagaaaaggatgctaatatgtaaaaagaaaacatcttaaggtatacaactcattggtcatagtaagtaaacaaattcagggcactcaaaaactaattgggccaggtgtggtggctcatgcctgtaatcccaacactttgggagattgaggtgggcgtatcacctgaggtaaggagttcaagaccagcctggccaacatcgtgaaaccccatctctactaaaaatacaaaaattagctgggcatggtggcatgcacctatggtcccagctacttggaggctgagacacgagaatcgcttgaacccaagaggcggaggttacagtgagctgagatcatgccactgcactctaccctaggtgaatgagcgagactctgccccctcccctccaaaaaaaaataagaaactgtaagtgtatataaatcacttacatctttttttcttttctttttttttttttttgagacagcatctcactctatcacccaggtcagagtgtagtggtgtgatctcagctcactgtaacctttgcttcccaggctcaaatgaattacccacatcagcctcccaagtagctggaaccataggtgtcacttacatctttatataatatcgctttcatcttttagtatctaaaagaaaaaaaattaatgataataacaacaattgtttaagagaaagaacatgtaaaaagaagtaaaatttacatatcaaaatccaaaatttggaaaaagactggtttaaaatgtaaaaacttatgataaatacactaaaaataaaaagtgctgaaccaaagcatactagagagaatcactttaccacaaaaaagacagaaaaatgaaagaaagatagtttgctgagaacgatggtttccagcttcatccatgtccctacaaaggacatgaactcatcattttttaaggctgcatagtattccacacacatcagggcctgttgtggggtggggggaggggggagggatagaattaggagatatacctaatgttaaatgacgagttaatgggtgcagcacaccaacatggcacatgtatacatatgtaacagacctgcacattgtgcacatgtaccctaaaacttaaagcataataaaaaaaagaaagactctccaaaacagttttaaaaagtgacaaaatgacagtaaagtctttacctagaaataataaccttgaatataaatgaattcactgattaaaatacatagggttgtttaatggattaagcacacacacaacacacacacagacatacaaagcacccccacacccacaccatatgctgcctacagaaactcactccatttatgaagatacaaatggactgaaagtgaagaaaagaaaaaacacattctacacaaatgtgcaccccataaaaagcaggaatagctatacttacataaataaccttcaagtcaagtactgtaaaataaatacaaagaagattattatgtaatgacaaagctgttataacatttgtacatatacatgcactcagcactgaagcacctaaatatataaagcgaatactaacctagaggaagagattgacagcaggacaataatggtggaaaactttatcactccccttttcagcaatggatggatgatccagagagaaaaatcaacaaagaaacatcagagttcaactgcactgtagataaaatgaacctaacagatatttacaaaacattctatccaacaactacaaaatacactttcttttcaagtgcacatggaacagtttttagaatagactatgctgagtcataacacaagtcttacaaaattttcaaaaataaaaatcacatcaagtactttttctaaacacaatgaaataataccagaaatcaataaaactagaaatcaataacagaaggaatggtggaagctttacaaatacatggaaattaaacagcacgctcttgtatccccattaagaaaagaaatttctgaaaatttctggagatagaaaatgaaagcctatgggatatagcagaagtatgtcaaagaggaaacactagagcaataaattcctacatcaaaaaagtaaaaagatatccaattaaaaaccatctggtgcacttcaaggaactagaaaatttctaaaaagccaaatgcaaaattagtagaagaaaagaaataacaaagatcacagcagaaacaaaaaaaaaacagagattttaaaacaatacaaaaaaatccatcaaagaaaaacaatttgtttgaaaatcaaaagaaattagctacactaagaacaaaagagaaaagagtcaaataactaaaatcagagaagaaaaaagatatattacacagaatttgtcaacagaaatacaaagatcataagagattttatgaacaactataaatcaagaaatttgaaagctagaaaaaatgaatccagactgaattatgaagaaatagaaaacctgaacaaataaagagtaacaagattgaatcagtaataaaaaaaaattctcccatcaaagagaagcctaggatctgacaaattcactgctgaattctaccaaactatcaaataactaatactaattcttctaaaactactatgttaaattgaagaagaaggaatatgtctaactcaggctatcaggcaagcattaccttgacaccaaaaccagataatgacacaacaataaaagaaaactacaggttagtatctctgaaacatagaggcaaaaatcctgagcaaaatgctagcaaactgaatccatcaacacattaaaagatcacttactatgatcaagtgtgattcatcataggaatttgaggatgatgtgttaggctcttcttgcgttgctacaaaccaacacctgagactgcgtaatttattttttaaaaaagatttaattggccctacagggtgtataagcctggttccaacatctgctcagcttctggggaagcctcagggaatatttactcatggtggtagacgaagtgggaacagacacatcacatggtgaaagcaagaacaagagagtgagtgggaggtgccacacacttggaaacaaccaaatctcatgagaactcattcacaattacaaggatagcaccagtcaatgaggaatccacatctatgatctaatcacctttcaccaggccccacctccaacattaggaattacattttaatatgagattggggggacaaatatccaacctatatcagatggtttataatatgcaaatcaataaatgtggtacgttaacacaatcaggtacaaaaaacatatgaccattacaatagatgcagaaatagcatttcataaattcaacatcccatcatgataaaaactttcaatcaattaggtatagcaggaatataactcaacctaataaagacatgcaaatggccagtagatatttgacaaataatgattagcatcaccaatcatcatggaaatacaaatcaagaccacagcgagatattacctcatacctgttagaatggctattatcaaaaagacaaaaaataacaaatgctggtgaggatgaagaaaaaggggaacactcatacactgttagtgggaatgtaaattagtacagacatggaaaacagtatgaaggtttctcaaaaaattaaaaataaaattattaaatgatttagcagtctcactgtgaggtatatattcagagaaataaaatgagaagtcaatgagatatctgcatttctatgttgtttattgcag

SEQ ID NO: 3261 - DNA, 946 bp, Homo sapiens
tgacatgttcagatgttggcaaggctgaaaactgcaggggatctggttgtgataatccaggcctgaatatatacaaatatgaacaagacccacaaggactgctcatcaccccagtattccatttacaacatcctgaatgaactcccgaccaggcctataattctctcttgcagccaaatatcctgcttactcctggtatctacctggtcagcagacctcatgagttatcgcccagtgacaaaaccatcccaaagatgcaccagtccagcacaaagtatgactgtcaatctcacaaaagatgtagggttctacgaggatactcagagtataagaattacgctaagtgaaataagccaagcccagaaagacacatactttattatttcatgtatctgtggaatctaaaagagtcaaattcatggcagcagggagagggctgaagaagggggagatgttgatcaaagtttctatgtatacaaagaccaaaccatcacattatgcctcataaatatatacaattattatttgctaattacaagtaaagcaatacaagaagaaaaaaaggaatcataagtaaatccatgacaagtgaaaacgcaatggagagaagggaatcaatgattgaagaagagaaaggacagtggatttacaactgcttcgaaagagtgatttgactggcaaaggactggggagaggtcctttgggaaatggacaaagccctcgaatggttaggaaagacaatctctttataaatgcagggcataagctgagcacaaggtgaagtttggcatgtactgccgtgggatgttgtaaaaattatgtcaaaagcaaagcaattcttggttcatctgtgttcactgtgagactagcctattattggggttaaacttataaacaaacttctattcatcatttttttctccaaaataaagtgatcaaattgtcc

SEQ ID NO: 3262 - DNA, 1008 bp, Homo sapiens
ctatacttcagtctcctccctggtaaaacggagccagtaacagcacctgcctcacagggttactgtgagaactgacggagacacagcttgagaagaactgagcgtgctttccaggcgacagcggacgctgaggacggctagctcttgtgtagatgaaggcacccagcagctgctcaacctgcaacggctcagttctgagaaccatggacacagaaacataccatgaaggtcaacaatgccatcctacaaacatgccgcagacacacgcctgctgtcctcactggcctgctgtcctcactggccacagctgtggctggctatggggctgctcctgaatgctgtgcctggcgtgcaagtgcagtggggaggagtgtttgttggaagatgctgaatgggcaagaggcagagctcccagaatcagaaggaacgaaactcacgtggagaagccctgcggcagtgcccgaaggccttactccacctcactgtgcagcgagagaaaagggctgccttcagtggggttttagaaaaacaggctgctctcagggctcctgggcctcggatgcacgacaaacatcaattacagttgaacttctagttcgtggtgggacagtcgtgtttccatgatgtgggtgggactgactagggtcaggtgtgaatgtaggatgcaccatcctgagggccataaaagttgcttccaccacaaacggtttctacgcatagcctttcttcttgatagttattgctggtaagagggaaagtgacttggtctctacactagccacctacacagacaggcaggcagacagagacaggaacatggagcatgcagagaggatcacctgctggccgccatgtgcccgacagggaggtggagtagggggaggagacagggtgatcacttttttggggcaggtccgagaacactccttttcccgttgcttttacaccaacagacacaaacagagagaacatcattcaaacagtggccatgtggaagctggttctggg

SEQ ID NO: 3263 - DNA, 4265 bp, Homo sapiens
ggtgccgggagcggggcgaggaggagggtgggtatgaggcggtagcggaccgcggagtcgagacctacccgaacgacgcgggcgagcggggctttggacgccggtggagacgcaggcgagactccagcgggaggaagaagaggcctttgccagcagtcagagcagccaaggggcccaatccctcacattctccaagtttgaaggaaagaaaaccaacaagaagacccgcaaggttaccacagtgaagaaatcttcagtacgtcttccagggtcggatcaaagaaggatattgaaatggattccaggcgtgtgcctcgagacaagctggcctgcatcaccaagtgcagcaagcacatcttcgatgccatcaagatcacctagaacgagctggcgtcagcagatgacttcctccccaccctcatctacattgttttgaagggcaacccccatgccttcagtctaatatccagtatatcacgtgcttctgcaatccaagccgactgatgactggagaggatggctactatttcaccaatctgaggctgggcactcactgcagctggctaatgatgaccatgtggacatgctttcgggccttcaggatcttctccagccagtggatgtcacaacggtgttggagtcttgggcccaaagaccagctcctagaacctgcagggaagcaacggcacgttccatctctccccatgccactgaggaatcattggtggcaggattctcagcaggcatggccgtgggtgcacagaacagagaaaggatggcctggaccacacacatcactgtgtgcagatgctttcctagacactgcagccaaggacacagaggctcagagagaataacctccatctcctgggtcccagcgattctcctgcctcagcctcttcctatttcacaagtagggaaactgaagcccaggtaggcaagcctgacttgctggagtcacacaggaagttggcagctctgctccatccctgggatctggagcccctgctctggggaaggagaggtggggcgctgccttcccagagtcccctcaagctggcagggacggctgtacccccagggtcagaggagaactaaaaggagcggaagctggcctgggtccagggagagacctcgtgtttgcccaaaagggagctggagaggggcagctgggcccatatgcagggaggagctgcagggagctggtggcggggcagcaaagagaagtggatttggtgggtagaggggcccctccttggttctagtcctccccgcagccccttgcaaacaggcggggctctcctgtccttcttgtctcctgcagcaagccctacatgaagaggcctctttggtgagtggcagctcaacctctgctaaatgcctccagtgatggggagttcactaccttccaaagtttttaaaagatgttaaccactgctattcaagaacaattctagaatttttttttttttgaaagacaaggtctcattctgtctcgcaggccagagtgcagtggtgtgatcatagctcactgcagctttgacttcctgggctcaagcaatcctccctcctcagcctcctgagtacctgagactacagatgtgcaccaccacactggctcattgttttcattttttgtagagacaggatctcactatgttgcccaggctggtctcctggcttcaagcaatcctcctgccttggcctcccaaagtgctgggattacaggcgtgagccactgcatctggccttttttttttggagatagagtctcgctctgtcgcccagggtggagtgcagtggcgtgatctcggctcattgcaacctccgccttccgggttcacaccattctcctgcctcagcctcccgagtagctgggattacaggcatctgccaaccatgcctggctaatttttgtattttttggtggagacagggtctcaccatgttggctaggctggtttcgaactcccgacctcaggtgatctacccgcctcagcctcccaaagtcctgggattacaggctgagccaccgcgaccggccctgctgttgcttctgaggtttgaaaaccgctgcctcaatgctcctgattcagctcttcttacccaaaggttcccccacctcatctactctgttcctgcacagtcgcccttttctctgatgccccgggcaggtttctctctgccagctccacgcttctggagtcccccatccgtcttggggcccagctgcccactgtctgggttcagaccttctcaacactccctggcttctctgccctagttttgccttctccaatccactcttggtgggtggaagtacggttaccatggtaacttgaagacaacgcaaatctgattgtatcattacaatgactgggaaaacctccagtgccacaaaataaagctcaagtcactagctttgcagtccaggccctttaccattccggcagcatttctgggggctattctccttccccccactgcacaaccccgcctggccaccccaggctcaggctgcagaacagcgtagaccagggagtggctttggggtcatgctaactacctggtttttgtctctttcaggctgtttgctcagttgcaaaatgggaaggacaacagcacccgcctcacaggctaagaggctgtgtgtgaaaagcccgcagcacaggatctggcacgcgtggacgtgcgggatgggaggaggggatttcccagctcctcatctctgcagggactggccttggcctagggaacactagctgtccagggagggggagctttccctgagccccccgatgtgtggcaggcagaggagagcaagctacttctgggaggggagttgtggggaagggcaagttagtctttactgagggtggcagtgagctggcactttggtctcacctcggctgcagaaacccaccctgctcccgtcttatttcctggggatttcagctgtgtgcaggcacagatgcatctcccaagtgcctcatgcttgccttgatctcctctccttcctctggccagtcctgaacctcttggtgatccacggcggcacctctgtgtcctacatccttctctggccatctccttccctccttccagccctccctctaggaccctgaccccaaccatccttcatccccatggggacattcagtccactgactcatcaccctcccctgtccctctgtgagagaaggagcaggcagagaggatcttgcaagagccttcagcaactctcttccacccatcctgttgcttgctgctttttttttttttttttccaaaaaaatagagatggggtcttgctatgtggctggtctcaaactcctgggctcaagtgatcctcctgcctcggcctcccaaagtgctggattacaggcgtgagccaccacacccggctccgttccctttctaagcagggtgctccttttcttgccatttcccccatcctccttcctctcccacagctcacttccctctctactgaatctgctgaagatcatgcagctgctgttcctgcctctaaaaccctctcttggctgggtgtggtgggtgacatatgtaatcccagcactttgggaggctgaggcaggagaatcacttgaacccgggaggcggaggttgcagtgagccgagattgcgccactgcactccagcctaggtgatagagcaagactctgtcccctccctccaccaaaaaaataaagccctctctgcatccattccactctccactcttgctcattctctcctgccctctaaaaggtgatctgtctttggcagattcaatcacttgcctttctcattctctcctgagcccactattccactctggtccccaccacttcccccaaaactgctttgaaccatcgcactgcaacctgttgcttagcccctccatctagtctcaggcgttaggactgactgcccagcagaggctggtgcaaccaatcacctcctttagtaagtttctccctgggcttcacctcttcacctgtgggctttccacctgtctctctcttttttttttaagacagtctcctctgttgccaggctggaatgccgtggcgcaatctcagctcactgcaacctctacctcctgggttcaagcgattctcctgcctcaggctcccaagtagctgggattacaggtgcccgccaccacaccgggctaatttttgtatttttagtagagtcggggtttcaccatgttgcccaggctggtctcgaactcctgaccttacgtgatccacccgcct

SEQ ID NO: 3264 - DNA, 4135 bp, Homo sapiens
ctaataaaaatagtttattattttgaatgatttaatggttttctacacaatttacatcacaacatgtaaattttagcagtaacatctgattctaacagcacatcatgctattcctttcatagagccttcagagattcaatgctaaacaaatttccttagttggcatcaaggcactgatcactttagaggcttttaagaaattatttaaagatgcaaatgcctctgagtgaagtgtactatcccatcactgaagcccacaggaacaagtcctacaattttaaaaaggctcgatggaaaaatttctcaatcctgaaatcccctagggaaggggtcaggagaaagtgccatggttgatatttaagaactccacagctcttaaaaataagcacttatccctaacatgcaatactgcagatgcaagttaaacttatctgttaacagctgcctgctgttttctgctcccagatgaaatgaagcaactcttctgataacgaagagatacctgtctgaggcaaacgaaacattggcacacagcacagcctcctcaatccacttgatcccaactcatctctcatttatttcggcttcttttattccaggattaatgtagtgtaacattttcatttcttttcgcttttattctgcttttgtaaaagcagtattttgagatggacattgcctcttcattgtatttctcatcaattcattatttttgtggttatagcttgacaagcaattaactttaaaatggtagattccgtaactttaaattggtagctttcatttgcttaaaattttttggcatatgcagataatgttctcatcagtagtaagaatctcagggttatgcttattccccaatggaggtatgacatataatcttttctgcctttacttatcaattcaccaaggagctgttttctctgcatctaggccatcatactgccaggctggttatgactcagaagatgttatctgaaaaaagtctatagaaaaaaaaaaagtttcccctccctcatcaacaaaagcccaccctctaagagacattcaagctgaactatcacaattcttaatcagttacaatttacaaacagataagtttaaaataaacaatttacaaaatttttgaagcataccttaacatcttgttttgcagttaaacaatggaaaagtatttctcctacactaaaaaaaaacttgcttacacacaactgaaaatagaatcttacttgataatacaaaagctaccatcagaagaaatcccttcaggatcattaagccacttcctttgctctgcagtttctatagtagttttaaattattattaaatcacctgaaaaaaattccaaaagagaaccacacactaccatatccaaacaacttttgcatttcccataattgtagttaatgtcagcccagtaggccagaccaacccccagttcaatactttccttccccaaaagctctatactttgaaggaaaacagatacagtatcaaattatgacactttccttgcccaaattaatgcactggtacacccagtggctcatatttaacttcccccagcttcccaattcaaactggggggaaaaaaactaaatcattgggagttacttgccaacttggaagttgatatttctttactttttccattctaagactttaagttctctggcatgagtttatctgcaatcataaactaaacaattacctaaacccaccccaccaatcccaaccgtaacaggccactgccaactaattgccaatatttgcccctcccctttaataaaacttttaagaagtcacattattggaaaacttaacttcaacatttggcctactcaagctcttctgaagttctcctgagatgactgaatatgaaccaaagctgcactgtgctgtacttttcagcttcaactgggaatactcttccaaggataaaagcagctccagtccctgaaggtgttcgtgccaacagcacagcggtacactccttctctaacccagtttgtcaatagtactatagcatctgtggaaaatcttagaaaaaaacattttctcccccaccctctctcttccctgttaagaccatcccaaaatgcttcaagtaaaaaataacaagtttaaggggttaagcacttttaaagtctgattaagggggtggggggaaaaaagagtaactaccagccatttctccaatggacatctcttccacagacctcaacgtgagaactgctctagtttctataaactgtaaacctgtggtggtctgattatcctgatattggattttcttgttttctgttacaccttgagtcatttgcctttaggattctagacagacctaagggaaaaagaactgaaaacatattttgcccccacccccacaaaaaaaaatactgaaaactcccccccgcctcagttacacatccaaactctacatttacaaaacgaattcagggtgaggaagtaaaaacaggtcatctattcacaaaactgaaatacttcattaccccaactaaacatacaaactgcttacagatttgctgaaattgtctcaatttggctatcaaattcatttggttttcctcaaattcgtgtaaaaaaaaaaaacccacaaacttgccatctactatttctccaggacttggcagtctgccctcaaaagcttcagacaagattcatgagtataagcctgaaaaagagaaacctacaacacccggaaatcggcctacgtccccatataaatccctttacacctcagtacgaaactcccccattatattagaaaataaataaaaggttaccataagtaagttccagaaaaacaacatattgccgacctcacggatttttaccaaccactcgctttccctgtggccttggcacactggcatgctggtctaggatcctctacgcacaacgcctgctcgcctcctccgtgtggttgccaagccaagccgcctgctaccttcatcaccaaattgcactcgctccttcctggaatcctttttcctagcttcaccaccaaatcgttagcgctccttccttcttcctagcttccttcaccaaatcgcactggctcctggactcttttcctatcttcaccacgaactgctgcttgctcgcttgctcctcagtcctagcttcatcaaacactggttcctggaatcctgtctgctgctgtcttcctagattcactgaatccacttctgtgtagcacctgggtcagctgtcaattaatgctagtcctcaggatttaaaaaataatcttaactcaaagtccaatgcaaaaacattaagttggtaattactcttgatcttgaattacttccgttacgaaagtccttcacatttttcaaactaagctactatatttaaggccttccaaattcttctaactcttccaaaagccttctgccttagttttttttaaattacaccagtccttttagtagctttttgatgtgatttttaaccaacttccccttctagcttcaagtattcttctaaattggttctggtctacgtaaacaccctcatcttctcaagctttaccttctaacttctgcaccaccagaaattaaattgatgggcttttaaaataaattggttaccaataatttcctcattttttcagtgctattttatccaatttttggctttatatttttctatcttctatacttctccaatacttgtcttagcttgtttttcattttctatctgaaactcttgacaatattttcattttctatcttgtttctatcttccaattttcttctaagtttgtacattttgcccttagctttttgtttcctagcttgtcttttttcttctgcttcctacttttcaggtttaaatttatcttttttcttctaaaagtatgtttttatcttctaatttccctatcttctctattcttttcttcgccttcccgtacttctgtcttccagttttccacttcaaacttctatcttctccaaattgtttcatcctaccactcccaattaatctttccattttcgtctgcgtttagtaaatgcgttaactaggctttaaatgacgcaattctccctgcgtcatggatttcaaggtcttttaatcaccttcggtttaatctctttttaaaag

SEQ ID NO: 3265 - DNA, 1134 bp, Homo sapiens
acacacagtcgctcacccgcgccgggcgcccgcccgccggccgctcgggctacgcgcagcgcgcgggctgagccgacatagaggaagccggcgagggcggaggcggcggcggcggcggaggaggaggaggtcgcggctgcaggcgccgctggagctgccgccggagctgctgcggcgagcgccgctggaggagccgggacccgggccggagtccgagcaggagtcggggccgcagccggagcgcgagcggaggccggggccgcccgcggcgccgccgctgtcccggcgggagccctcgccgggctcgggagtgcggggagcgcggtgagccgagcagggcgctgggcgaggctgccgccggcgatcagggcgcgcgggtgtcggggggccaggtccagggccggacgcagccagccattcaggaaggcagcgctggagagcgggaggcagccggcgaggaagatcacacactttgctctttttgttgtgccggtggcgccgggctctcgctgccttcttctttcgggaggtgacggaagggggagaaaaatacgggataattcacgccggcgacgaaatcacagcgaaatagaaaaaataaaaatcagaagaaaataattgccaaaaaaaggaaaaaggaaaagcgagagagacatccaaaacagggactgagaaacggaaatactaccatcctccagccaatctgttgggaggactgcttgcagaggactcgtgctccagatgttgcactagaggcgctgcaagtgtgagcagcaggtagatgaaactcaagagaaaaggtgtggataaatgaaactagcccatgatgaacctgttttctccgtgaccacaatattaaccaggatgaatggcggtggcagtgggcctgcatcacaggttgcagcagatgttctcaatatttctattaaaatttccttatttccatatgcaagaggagccccagagctgcatccttatggtagctaccatgccgtgatgtaagctgccattcactggggagctttggcaatagaattggctagatcaggaagcctatgtcaactatggaacaacaacttgcagctcatctctattgatgagtaaaagaatatggaattttagctccagatcaat

SEQ ID NO: 3266 - DNA, 18894 bp, Homo sapiens
ggcaacctgctcgggtcccctgccacactatggaagctttgttcttttgctctttgcaataaatcttgctactgcttactctttgggtccacactgccttcatgagctgtaacactcaccgggaaggtctgcaacttcactcctgagccagcgagaccacgagcccactggaaggaacaaactcccgcacgccgcctttaagaactgtaacactcacagagagggcccgcggcttcattcccgaagtcagtgagaccaagaaccaaccaattccgggcacgggatcaattgggattagaattttatcctactgctaaaacataaagcaaaaaggccaaaagtgatctcaccttttcagagaaacgcacttaaatagcagcagcaggtgcctctcttttctgagcttcccttcacctgaatgtggttctggtacttaaaggtacatttctttttctgcatccgctgctctgttaagtgatcaccacattcattgttctcgtttctattatttctgaaaaaaatcttcaggattctgcttgtgggagtggatgacatttttacagtgtttacagacacaaaatgaacaagatgtctgtggcaaccctcagaccattgacgccttctctcctatgtatcaaatcacacatttggacgttgactgaaccctcacatgtcagatgctcaatattgaggtatagtaaaagggagcatgaacttgagaaaatacgctttcaacacaaagctgtaataatataaggtcaaataagattctgcattggagatagaaaactctgaaggaagctttatctattccagaatgtcatatagctggtataaggtatgtactcttttcagattggcttctttcatttagtaacatgcatttaaagtccttcaatggcttgagaactcatttctttttagcactgaatagtaatagttcatattctagaagtaccgtattttatgtatccattcatctcctaagtgtatctttgttgccttcatgttagggcaattatgaataaaactactataaatatccatgtgcaggttttgtgtgaacataagtttgcaactcctttgagtagacaccatagagcacacttggtggactgaatgctaagagtatgtttatttttataaaaaactaccaatctcttcaaaagtgactgagccattttacattgcgaccagcaataagtgatgcttttgttccacatccttgctagaatgttgtggtgtctgtgttctagattttggttgttctaataggaatgaagcaatatctcatggttgttttaacttttatttccctttattatgacataaggtgggaattatttcatatgtttatttgctacctttatgtattttcgataatatgtctgtcaaggcccgttttttaatcaagtgtttttgttttcttattgttgagttttgaaaactcttggtatcttttagataacagtcctttattatatatttcttttgcaactactttttcccagtctataatgtcttcttgttctcttgacattgtcttttgcagagcagacatgtttaattttaatgaaatccagcttatgaattattttttcatgaatcatgcttttgatgtagtatctaagaagtcattaccatatctaaggtcatctaagtttttctgctatgctatcttctaagagtcctatagttttgtgttttacatttaggtgtgtgatctattttgagcctgttttggcaaaaggcataagatccgattaattttttgcatgtggacagccaataagtacagcacaagatcctgatcttttaaaacgtactcccatgggttatactatttttgaaccaaaactatttagcagatacaatttaaccccactgtataaatagattgaaaaagtaaaccaacaaaccattttccacttttttctgttttctctctgcttctaatgctgtacttgaattgctttgctactcagcatcctttgacttatcattaatcagttccaatgaagaagctcatcatggtcaggttttagtcagaacttaatgcccttgtctaccaagtgtaacctgaagtcttatagtcacatctctcctttatatataaactatcatctaaagaaaacatcactctatatgtgaatttatgtgtctatctagttaattcaaaataaattagaaatatatgcatacattttatggatcacacataatatttatcaaatcaatacacatttaacaaaatgactgttagtgagattattcataacatataaattgccagaacaaaagaaccatgtcttaaaattttctgacagaaacttgacaatacatagcatctagcaaagttgtggtctcttgaaagcatttagcaacacttgttaaacaatctgatctttgacaaacctgacaaaaacgagaaatggggaaagggttccctatttaataaatggtgctgggaaaactggctagccatatgtagaaagctaaaattggatcccttccttacaccttatacaaaaattaattcaaggtggattaaagacttaaatgttagacctaaaaccataaaaaccctagaagaaaacgtaggcaataccattcaggacataggcgtgggcaaggacttcatgtctaaaacaccaaaagcaatggcaacaaaagccaaaattgacaaatgggatctaactaaactcaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaacctcatcaaaaagtgggtgaaggagatgaacagacacttctcaaaagaagacatttatgcagccaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaagaggaacacttttacactgttggtgggactgtaaactagttcaaccattgtgaaagacagtgtggtgattcctcaaggatctagaactagaaataccatttgacccagccatcccattactgggtatatacccaaaggattataaatcatgctgctataaagacacatgcacacgtatgtttattgcagcactattcacaatagcaaagacttggaaccaacccaaatgtccattgacgatagactggattaagaaaatgtggcacatatacaccatggactactatgcagccatagaaaaggatgagttcatgtcctttgcagggacatggatgaagttggaaaccatcattctcagcaaactatcacaaggacgaaaaaccaaacactgcatgttctcactcttaggtgggaattgaacaatgagaacatttggacacaggtaggggaacatcacgcactgggacctgtcgtggggtggaggaagggggagggatagcattaggagatatacctaatgtaaatgacaagttaatgggcacaacacaccaacatggcacatgtatacatatgtaacaaacctgcacgttgtgcacatgtaccctagaacttaaagtataattaaaaaaaaaaaaagaaaacttgaagactttgcctctgggtctaaatcctggctctaccatttacctattagctatgagacttggtgaaattacttaaattctttgttcctcacttttaaatgtcaataatagtattcatggtgttgttgccaagtgttacataaaacaatatatgaaagtgcctagcacagtgcatagtgtgtcataaacttagtaggagttagttctttttattttgtaagtctgctgcttgtatatctcattatctgtcatagcatatattatgtccaacctataatttaatcacagaaaaattaaaatgtgagattcaaaactcatcagataaagtgttagtgcagagaaaatataaagttaacaatgatgatgaaacttttaaagtcttagcattttattttaaaatatctgcccattgtagccttttgctttcttgataccattttgataggtctgactctttttgaatgttctgagatatgtaagattttgtatatattggacatcttcacaactctattgagctgtttcctttatagacagagaccatgggatcttatttctcagcttctcagaataaaatttaggtaaaatcactgaaatgccaagggaaaagttaagagatgctatagttagagctgtactgtccaatatgtagtgtttggcagcatttggctatttaaccttggaatatggccagtccaaattcagaggtactgtaagtttaaaatgtatgtgagttagtatgaaaaggtatgaaaaaattaatgtaaccacctcaataattttatagtaattatatgtgaaataatgcttttgatatattgggttaaataaaatacattattaaaattaaaaaaaattaactaatttagaatgcatggggggaaaagcaaatattgaaatacaaactgagtaaaaggaataaaaagttctaaaaagtactaaagcagtattgttcgatagagctatgatgatggaaatgttctagtggctaatagcatttgtataggatagtgcaaatcaagggttcatgaactagaattgattatcacgtcactgataagactgcagggcaattttaacacttaaactcattataactgtttgaatttacttcctgattgaaatatttagcatactgtgttgataaccatgtaactaataatttaaaagaacagaaaaatcatattataaaactacagatggataggctcagtggctcacacctgtaatcccagcactttgggaggccaaggtgggtggataatctgaggtcaggagttcgacaccagcctggccaacatggtgaaaccccatctctactaaatatatataaaactagccaggtgtggtgatgggcgcctatattcccagctactcgggaggctgaggcaggagaattgcttgaacccaggagacggaggttgcagtgagtcgacacggtgccactgcactccggcctcagcaacaaagtgagacaatggggaaaaaaaaacctacaggaataaagattgaatggcaaattttctagactcagcaattaatatcactgtgatcctttcctctttagaaattgagtataaataacatttcagaaattatggatagtatttatcattctcaatcacagatatacaaataataagcctttccaattctttttgtgttttttttttttttgagacggagtcacccaggctggagttcagtggcgcgatctcatctcactgcaagctgcaagctccgcctcccgggttcacgccattctcctgcctcagcctccagagtagctgggactacaggcgcccgccaccatgcccgtctaatttttttgtatttttaatagagacgtgttatccaggatggtctcgatctcctgacctcgtgatccgcccaccttagcctcccaaagtgctgggattacaggcgtgatccaccgcccccggctaagtctttccaattctattgagtataaccatgtggttatgaaaatgtactctggtgacagactttcttttaacccctatactcatctatatatagtttctagttgaagctatattttaaaatgtaccctctgcacattttaacaaaataacgcaatctggttataagttgcattacttaatgtgctttgtcatttcaatgacacaaaaaagggtaactgtacttatttagaaaatatcctccatatgaattttacaagaaattgttccctttgcccatccaaggaacatctggagcagagcgccccttgtgcatgagaatttgtaaagtttatgagatatgctccagagaagcagttcttaagttgtgatgtatacatcctagagtgtattcattggtataacaaacagaaatttggggaattttatgtttttttttttaatctcatgctcttcaattactatatttttgttttaaaagcaaataataaatttgtttactgcatatcatgtaatttacaaacgtaattaaatacacgtatattgagatacaaactccaaaaatttagcttatgaaatgtgaaattttgaaatcattgaccaatatcactccattgagatagcacaagccttctagttattaatactttggtttggtaacaggaaacatttgtttttcttctatgttcaccaagccaaatttacacacaaaagcctcttgaacttttattattcaatttgggtatttttcagtctctttctttccatattttgtgtttcagtgttttacatctgaaaaataaaatagaagatactgaaaaactaggcatggaagcctacaagccaaagaacagactataagccaatagtagaatttctaaggtagcatattctctaaactgtcactcaaagtttccactacaaagggacacattaatctgaaacacaattctatatatttctaaagagcttcctcaaatttagctatttatttatgtaatggtccccaccacttatttgcctcatgtgtccaaattttttagttctccagggatgagttcacattctacttttccagaaaaagttactttagtgcttcctatcttaggccatggtattgaatatttttgactaatcatcaaaacaagatactattgttttccagcaaggcataatagtgtgaaaaaaaaatttggaagaaaaagcaacaaatattactttcacttctgccacatattctggtatttggcaattcagctaatatgagtctcaaaattctagttatttatatgttttttagttattatatactaggattcttttgtttcaccaaattttcaaaataacaataaaataacactattcatgtgtgtaatcagtctttgcaatatatcagcaatgcagatccaattataatcaaccactggagtgtcatgtgccaaatataactttgaaatattatcatgttttacgtttactgctgaaagagattaatctggactaagaattctgacttcatagctgcagtctcctgagaggctctgtcagaaacagactaatttagtttactgcaatcaaaaacaaattatgtcatctctaaatttgtcttccaaatgaccatgaggagaagcagcattgtttctaaaaacactagggactgaaactccaaacaagagaaagttggtatgctgcagaaagaagaatgtttagtttcaacagtgcaattaacacccaaaccttaggcaattatgtagcaaaataaatatgactatatgcaaatataaatatgactataacttcatagctaaacactagaaatatccaaagaaaataaagcggctaaccagttcaattaatcaaggctctataaccaattttaacaatgtttgcaaatgaacactctctttttggtatatcattgcaataaaaatattttaaataaaaacaaaattaggctttcacaggtattgttattttcacatagcttgtatttttcataaaatccaaaatattttcatatttcttatcaagccattactcataatttttatactcctacaaaaagcacaaattattattatgttatagaaatacatttttttaaacgtgatgcctcatgataggaaaagtaaataacttatgaattaaaaacatgaaaggaaatcactaagttaggagtaaagcaaaatttcgtatctaagttcttgggatctgggctatatcccagaaatataaaatattgaaatcaagatgtgagttcaaacaaaagaaaaaaataaacgtctagcagttttgggaaatgtattactgactcctgtaaaatggaatgcattttctaagagaagtcataagctatcacagacatagaacatatttatttatcaagtatggaaaatatgtgaataatgatgcaagaacatgggaaagcagatattgctttgacatactgatttcatttcctttgtgtaactacccagtgctggggtttctgggtcatatggtagttctacttttaattttttttgggaaccattatactatatttttcataatgattgtactaatttacattatgactaacagttttgtatatggattctcttttctctacatcctcttctaacttgtaatcttttgtcttttggacaatagacattctaacaggtattaagtgatatctcattgtggttttaattaggattttcctgataattacttatgttgtgaatttttttagataccttttggccttttgtctgtcttctttggataaatgtatattcatgtcctttgctcatttttaaatcagattgttttcttggtattcaattgagttccctatatattttggataagaactaattaccagatattaactaatttgtgtggtttgcaaatattcccccccaacagacttatttattaagtagaggaaatatctagatgttttctaaaccacctactaactgttggatactatattaatataattaatttttgatctttttataaaacttatcttactgtttttcaaggtaattgtagcctcttgtctttagaatgagtcattaaacacacacaaaagttaaaaacaatcatattttttatacaattaattaagtgtctttgaaacacgtctaacaataaatgatagaaatatgaagggaaaagatttatgtgacagtaagtatggctgtagaaaatctaaaatggcttgattgcgaagtgtaaatagtatgcaacaaacaaagctaaaaatagaaatttaattttaaatgatgagggaaaagtcatattattagttttcaaaacgtatttgagagtcacagtaaataaaactgcatgattataatacaataatacacaaatagaaaagggaagtgagttttgtgttctttaaaatccatggggaatgaatatattgcttagatgttgtaataaactgagactatttcttacatgttcagaaacattcaaaaacttactaaaatcaggttgtgtgatgcctcccaatttgttctttttgtttagtcttactttggctatgcaggctcttttttggttccatatgagttttataattgttttttctaactctgtgaggaatgatggtagtatttgatggagattgcattgaatttgtggcttgcttttggcaatatggtcattttcacaatattgattctacccatcagtgagcatgggatgtgtttccatttgtttgtgtcatctattatatcttttagcagtgttttgtggttttccttgtagaggtattttgactcctttgttaggtatatgcctaggtattttatttttatttttttggcagctattgtaaaagaggttgagttcttggcttgattctctggtcactattgatgtagtagaagagctactgatttgtgtacattcatcttgtatctggaaactttgcagaattattttgtcagttctaggagctttctggaggagtccttagggttttcaaggcaaacaatcatatcgccagcaaacagggacagtttgactttctctttactgatttggatgccctttatctcattcttttgtcagattgctctggctaagacctccagtactatgttgaagatctgatttcaaactatacaataaggccatagtcaccaaaatggcatggtactggtataaaaataggcacatagaccaatggaacagaatagagagcccagaaataaacccaaatacttacagccaactgatctttgacaaagcaaacaaaaacataaagtggagaaaggactcccttttctcaaaatggtgctgggataattggctagacacatgcaggaggatgaaactggatcctcatctctgacattatacaaaatcaactcaaaatggattaaggacttaaacctaagaactgaaactataaaagttatagaagataacatcatatacatcatatatatcatatatgtgtgtgtgtgtgtgtgtgtgtgtatatatatatatatatatctcacagttaggaatactactcagccataaaaaggaatgaattaacagcatttgcaatgacctagatgagcttagagactattattctaagtgaagtaaatcaggaatggaaaaccaaacattgtatgttctcactgatatgtgggagctaagctatgaggacgcaaaggcataagaatgatgcaatggactttggggtcttggggaaaagagtgggaggggggtagggataaaagacaacaaatatggtgcagtgtatactgctcgagtgatgggtgaaccaggttctcacaaatctccactaaagaacttactcatgtaacaaaataccacctgtaccccaataacttatggaaaagtaaaattaaaaaaacttactaaatattgagcactagaaggatgcttaaaatatctgtggccaatttagacaatttggtattatagaaaagattaaaataataaagtatgtctttgtgcttcaacctagaatatcttcaaaatataatgttaactgagtaaaagaaaaagtagaacacaatgaaacataatttcattctgaacaaataataaatgaatcaaaactattttatttgtatgtttgcatgtatgtaaaaatattgaagtaattctaataaataatcatcaaattttgagtgagagtgaaaaaggtggttgaaagattatttaaaatttactccatagattttttttaattgttcacattttaaaacaatagtatatgtaacaaaagagattttaagtgctgtggtgagctactggaaaaatactggaggacattagggcggagcttgttcaaagtgatcaggccatctatattgtgtaatggctgattgtttacaaaaggcttctacactcccttgcataattggcgacaggggctctttctttcttagagctttgttgagctgtaatagattaaaaaaaaaactgcacatatttaatggctacaatttgataatttgaacatatgtatatacttatgaaaccattaccacaattaaggttataatcatatccataacctccaagagcttctctatgctctttcttgtgtaagtattttttcttgttgtttttgcatgcctgtgtgtatatgtttatgcgtgtgtgtgtgtgtgtgtgtgtgtgtattacaaacacttaacccaagatcttccctcttgacaaagtttttaagtgtataatatagtgttgttaagtatagtcaccaggctgtacagcagatctctagagcttattatcttatctaactggaactttatacccattaaacaccttccactttcctcctccctcaagcccccagcaacaaccattctactcccttctatgagtttgactattttagatatcttatataaagaaaatgtagcatatgcatacagtgaaatattattcaaccttagaaagaaggaaattcttccaggtctgacaacgtggatgaacctggagaccattaagctaagtgcaataagccagtcacaaatgacaagtatagcagtatcttccttgagaaaggggtttctgggttgtggaactggccagagactagaataagatgtacatcttaaaggggaaaagaaagtgttcataattgcaagttttctgcaagtagatgtttgggagttcaggggcgtacagtcaggaagaaacctgtctaaagtttagccaaactgagagaaacaatgttaaggccttcttggtcaatactatttgtgtcaacattccaaagtgaggttttgacttgaaaataagcaaactttcccatgaggaccttacacaatatttttctcactctactcttttctccatctctccgtaacagagaaaaacattgggaaattaatctactatcaatgtacagaaagtcaattcttaaatataagctgtaacaataatgaaacataatattgtttaagtttacccaggttaagaaacattccacctaagttatctgatcagcagttttcaagcttgagtccattattatattaaattgcagagttaattgttgcgagtttttctaagtgtttttacctattacctactgtaaggaatccattatttgtattaaaaaaataaaaagaaaacattgatttaattctgttatatctatgtaactttgaaaagatatgctatacagataatttgtatgtaagaataccctgacatatataccctcctcagtagtatgtaggtcatggacaatgcctttcatttctataccacaatgaattaagtcaatgcctcacaggtagtgaaaactccataagaaatggctgaattcacaaatgaatgaatgataaactggatatttggtgtgatattagttgtaggaagattattattaactctcatagtattagttaaaagccttgttattgtatgaaaaattatatctcttgatttaacaatttaaagggttggaaaatcctctttagtgtttatttaaaaagctcctttgtacaaacatggacttgacctttaatagtgtaggagtcaattttatgagaaaaaaataagtgatcattagattagaatattcttttacttctaaattatagccttttcctctattattgtgttggatattatttaaattcctctttagattaataggtggccatttgcaatagaaaatattttgacagattgaaagagctttcgattttcttttggtaacaattttgaaaggacttttttttagaaaaaaatgcatatagtcccccacttctattgcaacacactttgctaaacatattatgagtaacaatcacgtggttgtaagaacacagcacatatgtttatttcatatgtaatatctgatacgttaccaaacagcagttcctgagagatacctttttatacgttatcatattccattatcacaattaacagtatctgcattttaatggaagggaaaactagttcaaatatgtcattttactgtatccaggttacaaagctattatgtttcggagctaagatttgaatgcaaagcagtttgttccaagactgtgccattccttaaattacctatctctactcttggttttgttcatgaaattattgtgagaaaatagtgcagatactcagatttctcttctgtttgtaatcattaagaaataagtggttatcaaagtctgtatgtttcccaagcacttcggagaaaagaacttacatgaaatctctctgatctctatcttcaataagtttataatggccagagaaataaggcaaaaacaaatgtaagaggcctatcaatattttaaaactaaagcctatagtggttagtttcacaggctcaaagaacaataattaaaatcaagttggagaagaggatccaaaatgaaaaacacacaaaagcaaatgaacctaacatagtacaaatgcatatcataattgcacacaaaagagagtggaggtagtgaagaaaagaactaacttaagtaactttggaaaatggtattttctctatatctgataaaactaaaagaaagaactataagcaactgtgttgttgcagtaagtagcttgctttgcatggggtatagattagcaattccacaactatttaatctatattctagaattaaacaaacaaaatgtggataataagaggtagatttttcactgtcagataaagcagataaaaatttaaaaatgaaggctaaaataaaccttgtggaccaggtgtcagtgtgaactcaggtggagggaggggaggtgggggagagagagagagagagatgtgtgtgtatgtgtatgtgtatgtgtgtgtgtatgcatgtgtgatgcatttatctctattccctgagaagaccgataagtagtgacaactcaatgagtatatctaagacctggatattattttgtgaatttccatctccagaattagaaaccagactcattggagaaatggataattgcaggagtagcatacaaatgttcaaaatggaactagaaccaatataagaatggtcccaaaacgtatgaaagtattcaaagcatgatgaagttgtgtaatagatagaaaatcaatttaagaggttcataatgtccaaccaaacatgagacaatatgagccacaaaagataatggtccatactagagtattacacaaaaaataaaatcagaattcatgaatctacactaatgtacatgagcaatgtaatgcatactttttttaaaaaataagggaaatttctttattatagtagtattacaactaatgtaaaatatagtataaattaaaaaccaccatttgacaaacattatggtaataggtataacatgaattttatcaatggatggtaaaaataattgaaaattatggtaagagaaaaatttcaaagaatctcagcaaaacatatttttagttaaagtagaaatgttgttaacagtggagaaacttagtggacaaccccataaccaaataacaaaattaacacaactaacaatggcacatctgatgccttgtgcctgctgatatgatgccctgagaaataataactaagaaatatcacacaagttcaaattctacaaaataagtggccaatattttcaaaaatgtaaaaatcataatattttttaaaagactgggaaaacaaaaaataaaggagaatgaaaaagcatgacaactagatttaatcctagacaacaaaaagtacacttgtaaaacaactattaaaagtaaattaagtctagagattatagtattgtatctatgttatgtttccggctttcatatttgtactgtggttttgtaataagtttttaaaaatatgatatacaagtaactagaactgtttctttttgttttgctttgttattttctttctacttttattttaaattccaggatatatatgcaggaacagaattgttttaattgattttgcaaaatttttgatcatcatctgaaattctttccagataaaaaacttaagaaaaaaagatctaaaataattccttaatatatgctgagtcacattttatctgcttcatgttaagaagagagagataaatacatagccattttgaaaggctttcataaaagaggtaggactaatgggtgccttaaacagagaaaatagagtatatatatggaatcatataatgaatgcagaaatagatatagaatatttgaagttgctgagggtacaaatggtatccaaagaataaattatattggtgagcataaagataacaacaaccaattgaccacctgtaacatttttaacttaatttgatagactgcttactatatatatatatatatttttttttttttttgaggcagggtcttgcactgttgtcctggctggagtgcaatggcacaatgtcagcttactgaaacctctgccccccaggttcacacgattctcctgcctcagcctcctgagtagctgggattacaggcacacactgccagacacagctaattttgtttttatttatttattttagtagagatgggatttcactatgttggtcaggctggtctcgaactccttacctcgtgatccatccatctcagcctgccaaagtgttaggattacaggcgtgaacccctgcatccggcctccttacaatattttttatggtcaaaagtgaatgtgtgtgtatacgttgttataaagaatgttttcataaatggttaatatttcgcatactcaaaaaaataactaaaatgcacaaggaagagatggaaatccaacatggaaatcaagtgagtccactgaattgatggaaaagaatggacaggatgaatctaagtaacttttgatcttgttttaattttgagttatttaaaaaaataaataaaattcttagccatctctatggcagacctagttagacatataatattaggtttgtcagtaaacttaggaggccatgtagtaatgaacataatcctgaattggtggttttaagaacagatttcatgttcctcattttccatacaggatatgacattggccggtgttttgatggatttgagtctctgttttttactaaaatgaaagtagtgtgacgaagtaataataacactgaatttagaaataaaaccaacatgcaaatatatgtatttgcatgtttcttgaaagttattgtaaacttatacttttattgtcagaatctgagtgactgtgtttgtaaatgggaatgattattatgaaccacaggaaattttttttagagtcaaataggttaaatgtgagattactttataatgtatgaaacaatatgcaaacatatatttacagcactggtgacttttcaaaaataagtcccctgactgcagaaaaaaaaaagcatcttacgttttttcctaactccagtactgatcacagtgcctagattgtagcatacattcaagtatcattgaactgcctgtacatattaaagcatggaattaggtatttcaaaatatagaaataatgtaaaaccttataggatgcatatactttttggctttagtgaatagattatgcttcaaaaagtattattaatattttatagacattttgttaaccagaaaactcttacattcttgcccatagcaattaaggcattgtctacttaaatcagtaaatgttggtacatcataactccacagtaagatggttttatttaatggttccgtcacactctgttgaatgtagtgctttttatgagattaccctatttttaattgtttcattcactcggatcttcagagacaatgtagataggaatttaaaaatcacagttaaatgaatatccttgtaacttacatttagtatgtgcaggtattcaatgtttaagcttccatttaaatgtctttttttggcaattctcaaaggaaatagagtatgtgacacatgtaagccagccacaaactatattagttttagaagataactataatatttatttgcatgattcatttttacttataaaatagttatacaattgtggacatatataatgctctagagacaagaaatagcttataagtatgttttcagaaatttgaatgtaatttcattttgcctagaccattttctgagctggcccatactgagaaaaacatatatgaattatttaatgacatgttttcaatactgcttttattacaaaacatgataaacaaattttacttcccgcaacaaataataacttgctcaatatgcttttgtagtagaatttagatatagttccaaacaaaaatttccaacttatttttgaatagtcaaatattgctaatataaattatgtatctgaaatagagtaagttgagattatttactctgaaatatagttgagattatttactaatttattattcttaattttccgcaatctagtaacatttgtgaaaaagtgaaatggtagttgctgggtataaataatgtattaattcaccaggctattaaatatgtcttaaaataaacatgtcattatttgatcagaacagttgctttactgttatttttaaacagtggcaagtaattttttattaaaagtataactcaaaaacattaactatatatgctgtttgcagatgacatgattgtatatctagaaaacccctgcgtctcagcccaaaatctccttaagctgataagcaaattcagcaaagtctcaggatacaaaatcaatgtgcaaaaatcacaagcattcttatacaccaataacaaacagagagccaaatcatgagtgaactcccattcacaattgcttcaaagagaataaaatacttaggaatccaacttacaagggacaaagggacatgaaggacctcttcaaggagaactacaaaccactgctcaaggaaataaaagaggatacaaacaaatggaagaacattccatgctcatgggtaggaagaatcgatatcatgaaaatggccatactgcccaaagtaatttatagattcaatgccatccccatctagctaccaatgactttcttcacagaattggaaaaaactactttaaagttcatatggaatcaaaaaagagcctgcattgccaagtcaatcctaagccaaaagaacaaagctggaggcatcacactacctgacttcaaactatactacaaggctacagtaaccaaaacagcatggtactggtaccaaaacagggatatagaccaatggaacagaacacagctctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaatttaagatggattaaagacttaaatgttaaacctaaaaccataaaaaccctagaagaaaacctaggcaataccattcaatacataggcatgggcaaggacttcatgtctaaaacaccaaaagcaatggcaacaaaagccaaaattgacaaatgggatctaactaaactcaagagcttctgcacagcaaaagaaactaccatcagagtgaacaggaaacctgcagaatgggagaaaatgtttgcaatctactcatctgacaaagggctaatatccagaatctacgatgaactcaaacaaatttacaagaaaaaaacaaccccatgaacaagtgggcaaaggatatgaacagacacttctcaaaagaagacatttatgcagccaacagacac

SEQ ID NO: 3267 - DNA, 12631 bp, Homo sapiens
gctctgtgaagtaccattagccgcgggaatatcagtatggtgactccttaccctggggaagtgtacttaggccacggctaggtgaagcccagggatatttctgttcgcccatgcatccgagaaaggagtgttagacctgaccctgttgtttctcccagcagtgagaacgtggccatggacaagaattccaagtagtggcacttctgtagacgacgcggcccttttggggttactacagcccaggaaactcacatgcgacacggcgccagctgaagtccatctagacccccgcagacccaaggtcacaagttgagaaccccctgccgtggacattcttctgcacctagtggtgaagcaggtggagctgcaccttgctccgcccatttggagactggttctgcacatatgagtgtgccctgcagcgatcctgcaatccttcgtgactaacaaggactttctgtgaaaacagatttatcttttcttctctacctttaaggtttcttgctgttgagaatagttaagggacgaggaattcttattgcccccattttacaggcaaagaaactaatgctgaccccaaccttaccgaccacttggaggtccctaaaaacacatgacctttgtgtttctcggctgttagtggaatcctttctgtctgctcatgaactcatcttcaaacgcattccaggccttcagaactcttccgtgagcgcaagtcactggtatgggccactgttaactgccggttatcacctagattttcttaactatgctttgccctctgaggccgtgagctcttgaatcttcaccttagtctgtaggaggaaaagttgtttgagatgatatttgaatccttcattttaggccaaattcagaacatagcaaaaggttctggctaacatgcagaacagtatgtctggactcccactactgttggtctgcaaagttgaaggctactctaggcaaatatgtcacctttaatgtatctccttaggaggagtctttcaccttattcatgctcctcagcacccacaccaaaagattcatgaagtaaatgttacctagtctctgctttaccccattacccccggcctgaggacctttgaaccattttaaatgctctacctgccagcctggccatctgtgcattgcttgctccatccacccttctgactcagctgaaataccaccttcccaaagaagtctaagtgaccacctcatctaaattgggtttcctgcccacccctcctctatcactttgcgcatggttgtatttctatcacagaacttccgtccatcattcgtgtccttcgttttgtacttgtttatcatatatcctctgtagaacagaacattctgagaagacggactttgggtgtctttctacaaaatcctccattcctaaaactgctttacctgtagatggtcctcaacaaatatctaaaacattttaaataacaaatagatgtcatgctttaaccctacactccaccttcggccatacagaattttagtccctgcgtccatgctcttacctccgtggttttgtacactctgtaccgttctaactctcagatattcttcaagacttcattctgttacttgttactctgcaactctaaaccccactcttagttgagttggctgctcttcggtgctcacaattacctgtaacctctctgtcataaccatctcactctattcatttgactgtctcactcaaacgacgtgtcccttgatggcagagactgttgctcataacatggacagtgcattgttcaattactgttttggggtgacaaagtctgtctgtgcctctttgcgttctctttccttctctcttttctccatgttgtacttgtctttccatttctgcaacccttttaatcctttccttaggttgttattcatgcctagtgattctcatggacattccgaaatcccggttcttagggctgaagactatgctgatctttgaaataatatgagtatcgcattctgatgatacttcatttgcataattattgataatagtgccaggtacaatgctaagtgctttgcagactttatcacatttaatcctgacttcaagaagtggatactgttaactcctggccaggcacagcagctctcacctgtaatcttagcactttgggaggccaaggcaggtggatcacctgaggtcaagagttcgagaccagcctggccaacatggtgaaaccccgtctctactaaaaatataaaattagctgggtgtggtggcacacacctgtagtcccagctactcaggaggctgagacaggagaatcacttgaacccgggaggtagaggctgcagtgagctgagatggcaccactgtcagcctgggcaagacgtagtgagactctatctcaaaaaaaaaaaaaaaaaaaagtggatactgttatcctcattggcataaaagaagtcctcactttgggaggccaaggcaggcagatcatgaggtcaggagttcaagtccagcctggccaacatggtgaaccccgtctctactgaaaatacaaaaacaagctgggaatggtggcaggtgcctgtaatcccagctacttgagaggctgaggcaggagaatcagttgaacccaggaggcggaggttgcagtgagccgagatcacgccattgcactccagcctgggtgacagggtaagactccatcttaaaaaaaaaaaaaagtcctcacttactcaaggtcacactgcttgtaagcgaagctgggatacgaaccttcagtgattctaggaccaaacactgacctaatagaatcacctagatggggatttattaattgccccaccccacccccaatatagccatgaactttgtataaaccacacaggtaatgccttttctctttaaagccacatgtaatagcagcaaatcttaagatgaaatggttaagagggggaaaaaactataaatgaggaagtactaaatgaagggaagtgcacaggttttggatgatggaccagattcagggtctgataaaagtaagatcaatctactttataacttaataacccactaaaaagccttttttaaattataagggccatactaatctctgtatcttgccagttttagtatatgtgctgccaaagcaagcactaaaaagtctttttttttttaactagattgcactagaaagaaccacatggggtttattcttccctctttcaagaaacctaatgaaattgggctgagattccaaggaactcctggaaaagagttatcagtgccagaatgaaagatcctagaggcagagcccaccgttctactctatttatagtggtgaaaggtaaggcctgcacctgcatgggctttaagtattcactcccatgatagtcccagtgtggtccagccttagaggaaacagaggcaatgggcaccatggcaattcacttaatgctggtgtattagtccgttttcatgctgctgataaaggcatacctgagattgggcaatttacaaaagaaagagctttaatggacttatagttccacatggctagggaagcctcacaatcatggcagaagacaaggagaagcaagtcacatcttacatgaatggcagcaggcaaagagagagagcttgtgcagggaaactcccatttttaaaaccatcagatctcatgagacttactatcacaaggacagcacaggaaatacccacccccataattcaattatctcccaccaggtccctcccacaatacatgggaattatgggagctacaagatgagatttgggtggggacacagagcaaaccatatcagctgggatgtaggcaccaccaggaagatacatagccatcattgtgttcctgcccaggcttcagtgaagcaggaaaaactcttgctttttccacttcctcatttccatttcctctcctttctcactcttactttcttcaaagtttgtacattttgaagatgatttccatggaagactgtacagagctacaaactagatgttggaatggatttgaggatcctgccagagactgaagatgctggctcagatatatctcagaatagagtttggctctccctactttcattcaacagcttcactcatttagacctagcaacccaacctcacaccctccactctcacaccgttagaatgaccctttggagcctcaacttttgacctgccttgctccatccccttttcacaagggcaggtttattgtctactggcaatcttgactagggccttggaagaggattggaccttattcacagtggtctagtgatcaaaacaagtcattgttaatacatcagtgttactaccttgctatgcatgtaacgctggaaaacagcatagtgcagtccatttaccaaaaccaaatcttactgctagttgaccaacaccatgtggtactgagaaaaatgtgtatagaacaaccccttactgctgtataaaaccattccttgcttaaggatcacctgacttttgatatctttacaccagtgattgtcaacttggaatgatttttgcccctcccctcatggggatatttgacaatgtctggacacattttttattgtcacaattgggagaattctactggcgtctaataggttggggccaaggatactgctaaacatccttcagtgcacagacagccacatacacaaagaattttcccaaccaaaggtcaatagtgctgatattgagaaactgccttaaagaatcttcaggtgagactacatgggaggttctgttagcagtagcgaatccatacaggtctgcagcaacctcaattcttgcctcctcagaagaaagaattcaaccaaggaggcattaggcaataggaaagaccaatgcaagttttagaacaggaataaaagtttgtttaaaagctttagagaaagaacaaaaggaaggaaagtccacttggaagagggccaagcaggtgacttgaaagacgagtggtttgaccttttgacttaggtttttatatgttaacaaacttccagggcttgcattttattctcccctcattcttcctttggggtgggctgtctgtatgtgcagttgcctgctagcccttgcaaggggagcatgcatggtgtgtttaccggagttgtacacatgctcacttgaggcgttcttcccttaccagttgaatgtccctaggaggccagataccagttcagctctgccattttgtctcttaatgcacatgcttgagcccactagtgcaactcctgagatcttattgggaagctgttgattaccagtttcaggttttttctatctgttgggagacttcctttccctggcactggcagcaaacaattattattttagagaggcaattaacagctgcctgaccatcacctgatggtcacctgacattccttttaggggtttgggcaagtgctctcctgccctgttcatgaccgactagctacccactgtagcatttctcccctcaagattccaagaccccaattctttgggaaaaatggatgatcagtcttctgtaaatccctcctgctgatggtggggcagtggtggttgttctgtgggtcttggcctgttgctagctgtcagagaaggagagtggctccatgggttgatgagagcactatccagccaggtccaagggaggcaggggcagaattttatctccatcatgtatccctgatggacatctaggggtcccctgtaagagggtgactcttgaatattgagaggatggtatccctctctcaggattatctggagcttgatggcctgaagatgaaaatagacaaattgagttattagatttagtagaatgttaaaatgaaataaggaggtgaggacagctccaaaaaaccccaagcctgccggcacacccatgtaactggtggccatagtcatgcctgccaagacttgggtttattgggttgctagccagttccagtatgtgcccagaattagaatattgatccagatttgtatgttacccatcccttttgtttcttctgagctgcagccagagatcactagctggttcacaggaataagggttagtctaaattgcagagaaaaattcaaaaacagctgatgagactagaatctaagaacaggtataccatagttcttgaaacataattttccagacatggtggctcatgcctgtaatcccagcactttgggaggccaaggtgggcagatcacttgagttcaggagtttgagaccagcctggccaacatggtgaaaccccatctctactaaaaatacaaaaatgagctgggcgtggtggtgggtgcctgtaatcccagctactcagaaggccatggcaggagaatcgcttgaacccaggtgaaagaggttgcagggagtcgagatcatgcttctgcactccagcctgggcaatagagtgagagactccatctcaaaaaaaaaaaagaaaaaagaaaaaaaataagaaataaatagaatttttctctccagtcctcatttttattaaaaacaaatcatgacaggacagatttgtttgcaaaataaactttagtcttcttatacttggcctaattatttgcacaaagcacagcaagaataattatttcccttataggctcctttttaaattggctttgatgcaactttgttccataaggaatctcagataagacgtttttaaagccttaagcccagccatgggttggtgccatcaaatacctgtatgaattgaataaattcctttcctcttgaggtccccagataacctggggctcctgggcctgtcagaaactggtattctttacttaccacaggtcaggaaccctgtacagggaccgtgtagataaggtatgttttcctagggggggcttttattggctctataagtcaaatttgattccctgaaggaaagcacaccattacagttaaagccttggtaaaataaccagtggcttcaattttgtcattgcaaaagaaaacagattcttattgcacttatgcaaattactatcttgccataagttaagaatactcacaaattgtttccaaattctggggaatctggaagagagaaatatgctgcaaattttgtttacaggggtatactttgctcatttgttaaaaattgtaaatggctcaaaagaaaagctttctaggctttgaaaaacaaaggagcagccatgttttaagcaaaaagtaataagaggattgttctagttttttattagttcagtccatgtagttaactcctattctgcttgatattcacaaacattttagctctccatgagggtcctgaaagatttttcctctattctaatgtcacaatatccaaagttatcagaaacctgcatttaagagcacctgttagattcccatagctgattataaactgccttctaaaacaatcctttaaccatctaaagtaggcaaaaaaatccatattcccatgagttcttataactttttcccaaaagcacattctaccttccttacacaccttccatgtaaaactatgtttcccatagcctcaagtacatgttacactattaagtcttagcaatttttacttttggtgaaaaacctggtgagtaagtgattttaattatgtgctaggtttggagcctaggacaccagacagaagtccagataaggtctgactgttttcagcatagctagggggcatggctaactctgtatgttcccaggccttacctagctttaaagcagggaatttgtactgttaagagctatagtggcagtttgtgaagcatttagatggcatagtaacctttaaaattgtgtagtagttctttcataaattccctttcacaaatcttttttaacaacttacacagaccacctacaacatgcttggacttttttacttgtcctaaacatccctctttttaaaccaccagtcattttactttaggacaagaatttaccatacaagatttttttttgttctacaatatctcttctttatagccttccttaccagaaataccactttacctttataacctttgaattagacaaaagtcattttccttcttttagaaagttaaggtttgtaccacatgttgctatgtgagtcctgtggagggggagcagataagggggttatctacctactgcagaagttatcccccgctcaagagtttgctcagttagattttcactagaacttgtctgaataaatgtgggctatttctaaacccctgaggtaggactgtaccggttaaagttatttgttaaagaattacttaattttgaggggagagataggactatcagagagaaagatgaattcagaggctggataaatattgagtgagcacccattttggaaagtatatttttgccccaaagaggtgagaggacattgccagggactggtgggagaatagtaattggtcccttaactaatataaaggggtgtgaatcttttcttttggaggggggtgccatttgcccctattgcctgacaggatttggaagagagtttctcagagaaagatattagcacagagtaggcagctcttgaatccaaaagggaaatttataattttacttgccacctgcagagttgccctcagctttgtcctgttgatgatgatgtgtgatttggaaggcaactagagcagagaccaccttcagctcaaggttatcaggggttgggattctgtcccaagggccctttggcccgtcagggcggtctcatttccagtggccaagcttgtggcagagaggcaagccattagaggctttttcccatttatcccattagggcactttgccttccagtggcctggcttcccacaccaatggcagttacctggaggagtgcccttagggcaacctggagggagttggtgggcttgcagagcagccagtacttgagcccacctcctttctctgtgtttctcctttttcttagccttgtcctccttattctgctgtcagttataaaagactgaggaggctaatctgaggacctcctgcacaggggtactgagttctaaggctgacttttgcaatttcctcccagttcattcttaagccaaatagtattacaaaggaaaactagttttttgttttaaggtttgggggaatcagacttttcccagtttgagggggcgcctccaaggagcatgatctttaatttggagatgctattacccatctgcaaaaggcaaacagaggagaaaaaggggggtaaaatttttcctccactttcctattattctgaatgaggcatcctccattgtccttagggttccagaataaaccagtcttaccatgtacccttggtccatctcatcacaattacccacttgaaaacagaagagatactggagtgaaaagtgggccctctgttcgtccctaaggttctggaatgaactggtcttactgtgtacccctaaccttgccttcatctctgttctaatggtaatctgttagcctagggctaaacttcatctctgtccaatgggtctcttgcacctgctgccttgggccagcctatatccttgtctccatgaccctatagtgactctcacttcagcatttagcaacaaaatgattatctattttcttatattcccatttccatgttctttaagtagatgagaagcctgtttttcagttaactgccccaaggggctagacttccctccctgcaaatatgaccttgaaggtcttgatgtatgttaataagggcatggaagtggttagagaaatggaagctacaggaggaagtgggaggaagcaagaggaatactcatggaaagccttcatatcctcacaaaaacagcagcccttggattcaagggggcaacatttatttgccctcttgacataaaggagtaaactccaggggacttggggcttggggtaagaactcgcaaatggcaaaggaagaatttatcctcctcccagtgggtgcttactaaaaaaaaaaaaaaaaaaaaaaaaaaaaaaaaaaaaaaagcaagtaggcaagtaggtgggatccttaaagggccagagtgaggtcctatgtaggcagacaaattgcttcaaaagccactggaaaacttggccctggggtgtaacaggaacaaaaagcatatagtaagttataaggagctggcagagctacagttccaattagtgtctgtcccagcaatgtgccagcagacaggggaagggttggaggtcatctgagctggtaggataaaaacaagtataaatctcaggggctatctgcaaaggagcctgtgtcttttctgccatgaaaattcagcaagagccgcggacacatgaataacagggagtgtgtgtttaagaagtcatgtggcatgtgaagtgaaagcaaagagccagacttgcccccaaggcagactgtctggctgggtgttcaaggccatttcagaacacacagagaaaatagaagaataggcagtgcaggttcttggggaaaagctgattttagttgaaaaagcagaggaaaacccagacattgcacagttttagactttagccctaccactttcatgagcctcctgcccaggagggccattagttctactcagtgtggaccccaaggtccttcccactcccgtgagctacccatcagggtaagctgagagatcagctggggggagtagagccactgtagctgagaggaattgtttgtggggttggttagtaagcaagagagcaaaaaggaggaggaaaccatgtagacgggttgaatgcctccagctgaagcaggcaaggtgtataggtcttgtactactagggaacttatccgagtcatatagcaccaaagtatgttagcagtggcaaattcatacaggtctacagcaacctcagttcttgcctcctcagaaggaagaatttgactgaggagatggaaggcaggagagatcaaggcaagttttggaacaggaatgaaagtttgtttaaaagctttagagaagttacaaagggaaggaaagtccacttggaagagggccaagtgggtgacttgaaatatcagtgcgtggtttgaccttttgacttagggttttatatgtttgcataattccagggtcttgcgttcgttctcccctgattcttcccttggggtgggctgtctgcatgtatggtggcctgctagcgcttgggaggggagcatgcacagtgtgttactggagttgtaggcatgctcacttgaggaattcttcccttaccagtcagatgtccctaggaggtcatataccagttcaactacaccattttgcctcaatgtgcatgcttgagcccagtcgcccaactcctaatatcttatcatgaagctgctgatcaccagtttcaggttttttctgtctgttgggagactgcctttccctggcattggctgcaaccaattattttagagaaacagcactgcctgaacatcacctgatgagcccctgacatttttggtgggggttgtggggagccctctcttgccccgctcatgcctgactagctacccactataacacctcatctatcttgtgcagcttgtttcatctgtttcatccattcccagaactcccaagtgatcaccttctccagacctatcttacccccaaggaactccctagctctcagtacccccacccacattggttgttccttgtttgccaaagcactctctggagctcacctgtttgtcagtgttgtcatttagttccatccatttgttttctctggatggagctggaggaaacttcagatccatatgggcagaagaggagaaagatgaaggaaaccaagctttgccagtttggtgaggtaggggtgaggagcagacattcacaaaaaagatcattcctttccacgctggcagaggaatcagctctagccctgatgcctgcactgttgccaaagggctccatctctgttcagtcttgagcatcagcctaacttaccagttaccaagccctgaaaagagggaatggatgtgcatcccacctcaaggaggaggtgagaggaagaaaacagactattctgccacttgagtatatacattctgtagaaaagtcagaggggcactttctaagactggaccacacatccatggaccttgttgagtctgcgaaaatgatacaccaagataaaggttgcagaagaaaagttttctctgaccttcccctgccctccaatctctggctgctcattctcccccaggatagtcacagaaactagaatccctcttccccaaggcaggtcatagaaaccagaacccctttccccaaaagcaagccataaagcctaaaaatattactccaactttcccccacctttctgtgtgaaaaattggccataaagaaattacctgacctaccatgttagggataaccattccagagaggttcctgccccatacccagaaggaaggaatgctccacagagagaccaagagtcatctaagcagacaggccttgctgggtttccccactcagtctgttagcattagatcataacctttatgtacgatcatatttctacatggctatccatagttcttgaacctaagcataaaaatgggcagtttcctctgtatttttgagtcttcattctgaaggctcccatgtcgtgtaaaatgatgatcaaat

SEQ ID NO: 3268 - DNA, 2193 bp, Homo sapiens
ttgacaaaacttcatttctataagtcaagtgactgaatatgtatccacttgttctgagactctataggctgttcgactgatcaatttatcaactccctaccgatatcattctgttttaatttctgtagctgatccattaatatttgctttatctatttaggtgttccaatgttaggtacatatatatttacaaatgttatatcctcttgattaataagtctctttatataaatgatgttctttgtctcattttacttgtcaatggttcagattagaacatgtcaacaacaacaagaaggaatacttgctgatgaaagttaaagaatacattggacttcattccacataaatgaattctatatgtggtccttgtgtgtggtcaaaaaggaggatcacttttactttaagaaaaatttcatggtctatacaactcatagaaatctcaaaaatggttcccttgcttttggaattgcaggattatagaaaagttaggtaactcataagagtaaacaaacttgaggtatgagaaaagggcacatggaaactgtcttcaaatatgggcatgaccattccacaaagcagccatatgtttgtttcttgtagcttcaaaacagtgaaaggacaaaaaagagaacattctcatgtgcatttattaatagagacattatggtaatgcaacatttttaatggtctataatggaaagctgcacattttgttgtttgaaaggtgtgggaaaaaaataccagtaacatggaaacacaaacattctagctacatagtggcttgcctttgaggttcatccatgataggttagtccagtatgatggcatccttacacctatacacatcacattctgtgtcccctcctggaaacacaagttactcattcttccctctaaataaacccacagaattcagtcaactatttaaagactaccctatgtccccatccatactgatagattcctcccttctttgaacttatgttgcatgtattacttgagtcctacaataccatctcttcactattcccctggatgaatctgacctcccaagcagaaaaaggcagatctgcatcttctacttctatggtatttccagtagagcccagtgcaaatgtggaaacaggctggtcaaaaatagcacaaataatttgtgttacaatcaataggttaccaggtactcccagaaacactatttagttgaagtcttattaacaacctactaatataattgttgagaaaatggaagttgagttatgtaagtgatatatttatggtcccatagctaatgaataggatgagttctgcttctctgaacccgagcttggtatgattaggtcatcctgttatatgatctcatagtactctgaacttctattgcctcttcaacttaataaataaaccagcaattatttgcttttactttttcccctaagtctatgaactccatatgggtaagattctacctggttcatcccaatattttctatagtctttggcatggataggcacaaactaaatatttgtggaagaaagagaggagaggagaggaaagagaaggaatggaagtgtcaataaatgttaggctggaaccagagtcaaagactggagttataggtgagtctatagttctgtatcttacatgcatgtaggcaaactctatctgactcgttctgggggttaggaattgtgtgagagcattaatgagaagagaaactaagaaagcatgagagcatgatttaaatagtataagcagttccatacaccattcccctcaataagcctcatgtccagtagtgagtgtgaggtgggagacttagcagatctagttcttacctgtgcttcatggaatgaacatctaacagggctgtatgtgctttctgtttaatgacacactgcacttttttctatattacacagtcctgaaaatactttaactatattcatccaaagaaatagatatctgttttgtcactggaggaaaaactggccctgttgaatttctgaggtattatgtcacctgcttaggatattttcaagaatagttgtaactaaacctgatgtttgcctcccatgctgacttgagagtccgtttttaaatatgaggcttgactgccttgttagtcttcattgatgcactagttctactgaacttgccttttatcttaaaataacatcttaaaattctgt

SEQ ID NO: 3269 - DNA, 17954 bp, Homo sapiens
agtattgcaatgtctcttggaatcatggctctgaagatgaggagagaagcgggatgggcagtttgtgtggtgaggaggctggctgcaggtaggctgggagggaatgtcacacatagttttctttctcctttaagccgaatgaggtatgctggtcaaaggaacttggggaaggaggatggtgaggggaatgaagttcttcttcctattgattgttttgttgcaccagaggctgtttgtccaaggccactggccaagagcattattttcgtggctaaagtgaggttgggcaggtttcccatccctttcactagttttgaacaagacaacccagaaagcgcagcaaggctctgggaatatgatgtgggttggcttttcctactcagctgcaccttaaagcgccaggccgatgggctgatacttctcaaaccctgaatcattgcctccagctctgtcctgggttcaggatgcaccactccaccctctgtgtagcttggggtcaacttcggggcgtcactccaatagtaattattgctgcgtttggctggacatccttattacggcctgggtccctctcagctggaaactgggctccttcagtttggctggggtgacttctagcacttcccgccgccccaccttacccccctgcgcgctcccttcccaaggcgaccacctgcaccgccccacttaccatctgccccgcggggagggccccccgggctagcggagccctccctgctcccgggcggctctggaggagctcggtgtttgcctctagcccttcgctaccggaggatcaggttcctcccctcctccccctccagctccggccgccgccgccgccgccgccgcctccttcttgcatgacacagcagaaccgcagctgctgcagcaatttcaagccatccgcccaggaagcgccgcaaccgggactcgggaggggtggagggggcgaggcagaggccgcggccccaggggatccttggccccactgtgcaccacacactcctttcccagcccaggggcacgcgaacaaaatgaggctcaagctgaccaggccgagccggaggaacgctggggcttggcagcagaagggatgggaccagagagaagggtgtggaggagaccccagtgagggccaggacatttcaggtaaagagaggtcatatctccgtacctcacttcctgacacaaacaagttttcactgttgtcagcaacaaagccctaatatagctgcggaagagaaaaactgcattgcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacaggaaaaatgaggaagctgtgagtaccagtggaaggaacgagccaggaagagggactggaaccatctcagaagccatgcccctcaggctggaacttgccctgtctcctcgcagatgaggtaggaggctcagcacgggctggtgggagcagcccacagcagcagtgagggtcagtgggcctgtgagttaagaagaaggtggcacagagcgagggtctctggatcctgactgtttgacttttccatgattaggataagtagccagggcttggctagttggagagttactcgaacctcaggtgacagttgtaaggcagcacatagtgaaaaagagtcctagcctgggaaagtccaaaaccttaggtctggtttcagttcactcacctatctctgtgacatagcaaagtctgttaatttctctaattttctgattagtagtatagttgcaggaatgaaataaaaatggtcctgattactcagagattcatttactgattactctttttgtgacctgaataaagagtacaacatctctcaaaaggtaacaatatgatgtttcaggaaattagagaagttaagagactttgctgtatttactatacagatagttgactgacagctgagcccggacccaagattcatttataaaatgaaggagttgagaagtacatactctgaggtttatcctaaataaactgaagtctaggcaagtggctgagctaggtttgccatgaatcaatctgctgagtatatttcttggtaactagttcatctttccttaattcagtcaacaaatatgatatcaagtttagtaagatgatgacagttgtcatgtaatactccatctggaagattgtatgcttctcagcttccctaacttttcttaatctaccttaagcttcctttctgaaaggtttctgtctttcctaacagtctcttctttccgccagctacctcttgtgtttaagaattaaaggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatcactgcaatctgtgttttgtttgattatattacgtattgcctgatctttaaataatgatgaaaaatagcctttaacataaaccatgaatggatatgcacttgagggaaacagtttcttggataattaaactttaatttctcaccgtggattccttggatcttgtaatattttttaaaacagtcctggggatttatttttaaggcgtccaaatgaattattagttctcaaaagccatagtatattcatgggtcgatatatcctcaaaacactatttttaaactgcttagtttatttttcttagcgtgctcatctgctgcataattttctttgctatgtatgggtcacatgcttcctcccgtccataactcacgcacttaaaattctcacttcctgattgagccatcagattacgtaaaatgtaaatcagcctgaatacctaggagcaggaattttaagggagaaaatgccgttttctttttctgtgtcattattaacccttaaatatcagagtgagtgtctgctcacctatttgtatttggaaacgagatactgttaggggtttttcttggcccttccctttcagattgaatcagactttgctgctttccttatacaaaataatgtaccaactagatagacggtgggagtggtatcgttgcaggaatgaaaccaaaagggttccgatgattgagagagattcatttattttttaactcttctcatgatctgaatgaagagtacagcatctatcaaaaggtaacaacctaatatttcagaattgcaagtggccatttagcctttctgctgcctgatataaatgaaagtaattcctagcaggcaggatgacacttgttttatcacgaatctgacaatccagcacattttctcaagcaattttgaagttgtcgtagtaacagcatggcatttggagggtctttttagtagttctttagctagagttaattaattgtattaactctggatgtttttctttttactcctctttgacaaacaagggctataattgctcaaatatgtattttgtgttctatattttttggtgactatagtttaaggacgtgatgtttttaagtggtttcagtaaaaggttatcagttgatttcagacacattaaacttgggtttttaatttctctgtaaaattccactatcattgtaggaccaggatttagttttatttaagaagtgaatctggggagatatttgcacaaattgaattgtggcttgcttccagtggttgcaactatccgttgctttgattttggtgtatttagaaaaagaactggggaatgcagaaagggaaatgtgtcaggcttacaggagaaaattgtttctttagaaatgcaacaggcaggcacaccaccaaaagcatgttccataaaagaaaacaaataaatttgattttgtgaaacttaagaatgcagtgctctttgaaactctaaaatatacttaaataaattctcccctaggaagatttgtgggaactttttattggtggaaagtaggttggaacttctagtattaatagtaaaactctgtggcagaaattcttgccaatatggcggttggtgagaaaggaatcccgtttcttgggcagggagagggtcagaagaaagaattgtctgtactcagtctggatgccgggacttaaaaagtatcagatatacaatgcttttgttttcttgtataagtgaacagagagatgtgacacttctaaaaggtcttgtgagttttgtgggtttaatgctaatgccactatccttactgttctgtgagtatttgttcagccacgggtgattcaagagagttggggtatcagcatgtgcagccaacagcagtccaggtgctaatgcaccaccggtgatgtcaggagttacgagacagcggtttccaaacactgcagtaaacaaggtcaaagtgtcccgtttcgctggaagaagttttgtttttatgagctggacagtacatggatgaagtaatttttcaaaacaaactttaaatttatacatgtgttttttttcttcttctctttggattaaaataaattggcccgttgagattaaataatggttatgtttttaagcagaattatatttcatatgtttttccagtcttttattgattttctgtttttcacagaagaaatgaaaataacttctgatgtagggtttcttaaatgcagtttgagagagcaagataggaaccagtactttcaaaatatggcaagtgcaagtcacaatccctagtaagatattccttctcattttgtgcctttgactcttatttagacagacgtttaagtacgagaaagctaatggcgcagattctgctgactgtgtggctctcgtcttaatgcgttttccaaccttgaacctgagaatgccagaggattgagtctctggacgttcatctgagcagatatctgctggccgcctggttcctgagctaacaagtgggtgtcccgggcttgtgtgtgtagtcacaacagtggaggtgccacgtggcacccagaggtcgactggggctaccgcggggcttcccgatcctcacaagtgtgtcttcagtgtctgacatgaactgggaacttggggcatctttagaagcacagacatttggagttccacggcaaacctggatgtaagcactcacacagcttttaaagtgaaagcagggaccttgaggaaggaatcgccgtcatctcattgccgacctgcttactgtgctgggaaacaaagtgcaggtcttctgaacaaatgcctcctgaggatttctgtgcctggaaaatatctgttaacagactgcttttacacctactttgtatttttatagagacgagacttcaccatgttggccaggatgatctcaatctcttgacctcgtgatccgcccatcacagcctccaaaagtgctgggattacaggcgtgagccaccgcacccggcctattaccctcattttacagatgaggagactgaggcacagagagttaaagtgatttgtgcagggttgtgtgaggagctggtggcagagcttggcattctggctctggagtctgcatttggccatctcaccgtacagtgtcatagaaacaggaaactcgagaagataaactgccaggctgtattttggagtcagtattttaacactgtcaccatctcaagcatgatctgtgggactcatcactgtgctctttgacttgaacttctttaaggttagtgggaaaatgaagctttagagaagatgggactggcctaaggtcacactgcatgtcagaagtgtggtggagggtccaggtcttctgaccattcagtgcaagccaaattgtgctaatttccaatttttctccctttctcttggtgagctatttggtgctacttctactcctcatgaccaaagctggctttcatggtttactcatgtacttactgatgaaaccctgagacttggggccagtgactgttcagaggtccatgtgaagatgcgctgaatggtataaaggacagagcagtaaagagtgctggctgaatgcctgggctggcaatcaggcatgttggagtttgagtcccagtctgccactccagctctgtgaccaagaggaagtgaagtcatgtaccctttctaagtctctagcccctcttctgaaagacgaagatgccaccaccaaccatgttagtggttgtgaatgccaagaaagtccatgtgaagcacatagcatagtgtctgccatgcgttaagtgttccaaaaatggaagctatgactatttcacagagtacacttcccatcacttttcagttcattttggccttctccctcaaaagcactccagtgttctgatccagctgataaaacaccaaacattcacatagtgctttaaaagtgacccactgtttttacagactgcattacatatgaccctaacaaccactgcaatatagaaattcgcatctccattctccagatcaggataccgaagctcagaaaaattaaatgatttgcccaggatcacatagttagtaagcagcccagccagatcctgtgttaacttgttcatccgcttcctataagaaaacatccattcaaggcacatggggcaacaaagaaggacttagagctgtgtggcccctcgtcagggcagtaccagttgcacccatagtccggcctgaatactcagcttaggactattgtgtccaatgtcccaaacattttgaagctacatcttaaagaagtgtcctgctcagatgcagttctccttgtgaaatccgcaggccccaaggaaagtgactttaatccagtttgctcatgcaagaacagactggcatttcacatccaggaaaacaatggatttgtactgttcagcttttgccatgcaaggagttcctggtgtggtttattaatttacatctcaggctccagcttcactatcaatcagatttggaagaaaaaagttacaaagaaaggcagcttgctgagaaacagcggaagcatgacggtacagactgggttttgaaatggagacacattctcatggcttgtgggctgagagacactgagaaaggattttgttcttgaaagatgattgttttaatgctggagatggagagttttgacaattttaagtgcatgttctgtgtgtaagaaagagtcattacgttttttttttctttcagatgttgccatgccttaaaattgctgatgattaaaatagaacatcctgagttacagaaattcagccctagtgtatcctggcctaaaaatacagaacaatcaagttgattgttggaaatgagaggctaggcagggttggaaacatgctaatgtttactgagtgaaatctttccttctcagtagagttgcccttgcagctgaaagtcactgaaagactcaacaaaataagcagatcccacttgtctcactctgttctcctatgcatgccctggaaagagaatgaatgagccctttttaatttatcaactggttttcttccatctctttactagtgagccatgggggttttttgccgttaactgggtagccagtctcttcatggagacttattttcaggaaactagcctcttgctttatgtgaaaacaaggacccaactcaagatgtcttatcacagtgtgttctgttgcgtaacagttgcatctgtagtccagcctcaatactcaggttgggactgttttgtcctgatgtctcgaacatttcaaagctacgttcttaaagaaatgtcctgctcagatagagctctccttgtgaaatcctcaaaccccaggggaagtgaccttaagccagtttgctggcttttcatgtcacagaaaacaatcgactgccactactcagctgttgccacacaggagtacctggcgtggtcactacttgccaactcagtaccccactttctccccaaggacataaaagcaatgtgggaagatataccaaatgaccttgtcacactgggctaatatgaagagcccacagatgcaaaataatgtatcatacctttattcttctgattttttttttttttttttttttcggagacagtctcactcttttgcccaggctggaatccagtggcgcgatcttggctcactgcaacctctgccacccgggttcaggcaattctcctgcctcagcctcccgcccagctaatttttgtattattaattagtagagagagggtttcaccttcttggccaggctagtcttgaactcctgacctcgtgatacacctgccttggcctcccaaagtgctgggattacaggcgtgagccaccgtgcctggccttttttttttttttttttttttttttttgagatggagtctggctgtattgcccaggctggagtgcagtggcatgatcttggctcactgcaacctctgcctcccaggttcaagtgattctcctgcctcagcctcctgagtagctgggattgcaggcatcccatacccggctaatttttttgaaacagaggcttgctctgtcacccaggctggagtgcaatggcacgatctcagctcagtgcaacctccgcctactgggctcaagcaactctcctgcctcggcctcagcctcactacaggcatgtgccaccacgcctggctagtttggttttttttttttgtatttttttagtagatatggggtttcaccatgttggccaggttggtctcaaacttctgacctcaagtgatctgcctgcctcagcctcccaaaatgctgggattacaggtatgagccaccacgcttagccttctgctgaatttttgagaagcatacataaagacaatgtaaaaaacttagcatatttgtttggccctgctaagggcatggttgaatatatagtgtgtgtgatgtatttggtgtatgagatatatatgatcttatcagacataagtaaaagaaattcattcttcaggaaaaattttccccataactgaagtgtcaatcatttgaaaaaacttctaggcagtaggcaaacactgtgactagttatttatcaaaaataagcagactttagagttttgtaactgatgagaataatctggctgcttcttttgtacttcagtcactgatactgcgaattagagtagcatatacagaaggatgcagggggtccctaaaggaatcacagaattagtgaaaccattatttgagagttgcagtgattcttctgtcctggcacttttcccagttttggtgcttaaatttactatccacttgaaatgtgtcactgcctgtcacttcacaaagtatgtgcctttcactgcagtcaacaagctgtttacatctttgatgaaatgattgccacgcatctccatagccctggtgttctattcccttattcacagagattttttttaaaaaccagcctagcagcaataggtatgtgctgtggatgcttctccatgatgataaaggatgagtttgtgctgggatctccttatgaaaagataactggccaagcccatgaggaacaagaatgttatgctaatcagacccaaggtaaacagcctgcagtgcacctcctgactgattagcactgaacccacttggaatcatcaaccacaggcacgtggtaattggatgttcttctaatacacatagtgagattgtaaaatgaggatgatatatgaggaaagtcagacggagaaactaaagttcagttcttaaatacaagccaagggaacagactaagtgaatggtacagccaggattggagcctggttttcacaaggtggtatgtcatgataaaacaagccaaagaaaaggttgggtagtgttttgaggctaaaagagaccaaagagtcttagtgaatcaaccttgatgcgatctgggtttgaaaaacctataaaaaaccttttgtttggagaaagtgggagaagttggatgtaggctggatatttgtgggtaccaaggaattgtttgttttcttaggtatggtaagattttgtggttatgtagaagagtgtcttcattttatagaacgacctcaaagtagttaggagcagtgtatgtatgggtggttatcaatttactttcaaacaatgcagcaaaaaatatgtatctatattacatataattaaagcaaaacatgataaaaaggaatagttattgaatttagatagtatggatttaggaattcattgtattgtcattccaatttaatgtataaaattttttataacagtttataaaaacagtgcacacccctttaattaggtggcctgggtacatgaagtatctttttggatgcctagaacacaaaaagggacgacaacaggccacctaataagatgataccaagaactataccatgacggcgaaaaagaactgctgcaaaaaataatttgccaaggagaactcagagtacaaagccttacctttggagtagagggaaggagagtcttaagtaaagctcacaaaaacccctaactcatagatgcagtctaaggaattcattccggaagcgacattagcatctcattagtgccattatgtgacttacttggcctctgagctagtctattttcttccctagaccccaaaatctcagtaatcctttggatccaagttatctccaagtgaaaataataggtttaggaaagcgtttttcttcaacttctatggagcacttgcttgctttgtcctatttgcatgtccgacggacggttctccagcaccactgctagtcgtcctccgcctgcctgggtacttgatcacaggatgcctctgacttctcctgcctttacccaagcaaaggattttccttgtcttcccacccaagagtgacggggctgacatgtgcccttgcctctaaatgatgaagctgaacctttgtctgggcaacttaacttaagaataagggagtcccaggcatgctctcccatcaataacaaattcagtgacatcagtttatgaatatatgaaatttgccaaagctctgtttagaccactgagtaactcacagctaggtttcaacttttcctttctaggttgtcttgggtttattgtaagagagcattatgaagaaaaaaatagatcataaagcttcttcaggaagctggtttcatatggtggtttagatttaaatagtgattgtctagcaccatttgaaatcagtgttcttgggggagaccagctgcgctgcactaccaacagcaaaagaagtgaatgggacagctctgaagtatttgaaagcaacagcaggatggctgtgagaacctgcctcacatgtagctgaccccttcctcacccctgccaacagtggtggcatatatcacaaatggcagtcaggtctctgcactggcggatccaactgtgatcgaaagttttccaaaaataagttgtgtctgtattgaacatgaacagactttcttcttgtcattattctctaacaatactgcataacaattatttgcatacatttgcattgcattaagtattctaagtaatctagagacgatttaaagtatacgggaggatgtgtgtaggttgtatgcaaatactacaccattttctatcagagacttgagcatctgtggattttggtatccaaggggctttctggaaccaatccctcaaggataccaagggatgaatgtaattgtacaggatatcgcattgttggaattttatacttctttgtggaataaacctatagcacttaatagatagtacagactcattccattgtgcctgggttaaagagcccaatgtatgctggatttagtaagatttgggccctcccaaccctcacgaccttctgtgaccccttagaggatgactgatttcttttggtgttcagagtcaatataattttctagcaccatctgaaatcggttataatgattggggaagagcaccatgatgctgactgctgagaggaaatgtattggtgaccgttggggccatggacaagaactaagaaaacaaatgcaaagcaataatgcaaaggtgatttttcttcttccagtttctaagttgaatttcactgacctgaattgcatgtggtataatactaacaaatggttcactattagcatatcatgaatggttatactttatagaaattccatagacttggtgggggttttgttttggtgacggatacctagaaacactcctggggaaaatcgatgactggcttagatgatgggaaaggagcagcgagggagtcaattctgttgttgatgagaagctgcaccagctatctctgaactctcctctcttagctggctgaggagttccctccatggttaaacaggtcattttcttacataaggaaaaatggtccagagaaactgggtttctatggctgagacagaactgtgctaatatgtgtcagttcagtttagaaggcaaagcaacaaaagcaggtgctacttgaactaggatcctagagtatacctttgatatggtttggatgtttgtcccctccaatctcatgttgaagtgtgatccccagtattgggggtggggcctggtgggggtggttgagtgatggggcggatcccttgtgaatggcttggtgatgtcctcacttaacgagttcctgctcagttagagggagccggttgtttaaaaaagctggcacctccttcctctctcttgctctttctttcttgctccctctctcgccatgtgacatgtctgctccctctccgccttccaccatgtataaaacatcctgaggcctcatcaggagccgagcaggtaccagtgccatgcttgtacggctgcaaaactgtaagccaaataaacctctttactatataaattacccagtctcgggtatgtctttatagcagcgcaaaacggactaacacaacctcactagaagtgaagtcattagaccaaaaacaatactgagtttttaggtccactaagaggcaaaaataaaaggctctttatagcagcatgatttataatcctttgggtataagcacatgtatgctagaacttaaagtataataataaaatataaaaataataaaataaaataaaaggctcaagaatgagccatctcggccgctcctcctccaggggcccctgtgtgcagctcccaacacaggtactgcacagaccggccacctgctgtccccatgtggcgtcctggagaactgcaggggcacctggtggaatttgggccttgtccttctgttttctttctggcctggaaaagccactggcctcacaatcaagagttaatattctatctaccctgcttaagctttcccgccctctcacactgcctccctccttttccctcctgcctgtcacttgtctggaaaaggccttttctcctcggggctaacacatgcaatttgtagccaaaacattctgtctaccacacaaatccaacgagaatcaggatcattccaccacatctttttctatcccatggttattattttcccaaaactcttgtcttttgctttcttacctattcgctgttttccctaagtaatcttatttactcccctggttccaaatacatccctatgtgttgatttccctcaaaccagaggtctggcctgggatattttttgagacatcttgctttttatatttttagtagctcctaagtataatagttcagcctgctcttctaaacttgtctcaatttaatccatttatgcttgaggttgcaattttttgaatttttgccatcagaccttggcaatgaccttgagcagtaggagacaactcccacatgcttagcattccaataatggaacactaggcatataccaaagccatccacattgccttctccccaaagccagctctccctgctctgccccatggtgaaagctgcgaacaccagaggtctgtgacctcttccctctcccttacccacatccatactcagcacaacttgttgctgttctctctcaattctctctttaggatccatccctttctctgctcttcctagacagctttctgggcccacccctcgccattagtctagctttgttatagccaccagttaatctttgtaaaatacatacgtgagctgggcacggtggctggtgcctgtaatcccagctactcaggaggctggggcaggaggttgcttgagcccaagaggttgaggctgcaatgagccatgattgcatcactgcactccagcctggacgacagaccaagatcccatctctttaaaaaataaaaataaaaattgtttaaccacatgaccttgctccttgtccctcacttttagctgaactcttataagtgtgtcaaccaggtaccagacccttcatgaccccatgcctacctgtgtcaccatcttctggctgtgcttcctggggcctgtgttctgtgctcacccagctgcttgctgctgagaacactcaggtatcttggcatttcttagcctgtgtctgtgctatttcctctgcccacatctcccctctcctcctcctcgtcagctagggacctccagcccctagggactgtaagctagggacctccaacctgcagcccctggctcaggtgtaaacttgtctaggaagccttcctctgccttctgcatcaaggcttagatccctgggcaaaggctttcttctctgtaccccttcagagcctgatggcacttcgcatgttatattctcatgattgattacctactaggcttctctgcaaggctggaaaatccttgctcctaggagggacggtagacaagaacaagacatactgtgtacactccattcttacattccacgtgagctatcctttgtgtaggtgtctgtggcaaatcttccttctaggctgcagcctctacttttcatagtttctctccattttcatctgccatgtgcatgaggaataaaaactacttccaatgatgaccaaaataagatggaagaaaataaccctgcttcaaagaacatttctgagaccataaatatgattttgatgtatcttccattatggattacccatgtggttttttttttccttctaaatgcataaacaggaattgtttaataggctagagagccatgaaaagcaaaataattaaggattgttgtcctcatttcatagaagagcaaacaaagacagaaaaacagatgtgccttaaccaaaaagggcagtaaatttatgcaaagcagactgaacccccattaaaagtaatcatttacagcgaccaagggccaagcacgtgatcaccaccctcctctcccaatagctctgaagggtgggtagtatttccccagcttatgcacgaggaaacagatgcacaggaaagtcaagtaacttgcctgcaatgccacggctagtcaacatgagagtttgaattacaaatcaggtggcggtggcggtggtgatgatgatgataatagcagcttatcatcatcattgagctcttattttgtgttagatacttggtaagtattttgcatgaattagctcatttagtctgactttcaaaacagccctttgaggtcagtgttattatcatcattcccattttgccatgaagaaacaaaagaattaaataatccaagatcgtctaactgacatttccaagcaggagcacaaacccagatctctgtgattccagagcctgtgctcttaaatcagcactgctcatttcagtgtgggagatggcgtaaatgggtgtgttcacttgctgggcagcctcatctgtggtccccttgatccccacctactggcattcatgccctgtgctattccctcccctggagtgtggactggacctagtaatttgcttctaatggatggaatatgtcaaaagtgatagatgtcacttctgagactaggttacaaatagactgtgattctgttgtcttcttcctcaggcttgcaccctcacgacatgctctctctctctccctctcctcttttctctcttctctcccttctctcctctctcttatctctctcttctctctctcgtacacatactctggaaagccagctaccatactgggaactgcccaatggagaggcccacattccacaaggaactgatgtcttcagccaatacctcgccaggacctgaggcctgctgagagtcacgagtggccttcgtgggtcctctctcaacgagcttgcaggtgaccactgcgccagccaaaaccttgatggcagcctatgaatgctggtgggatggagctgcagtttgtgtctctgaagcagattaaacactgtctgccccagcctgtcttaactatcttctcactggttaacagtccttggaagaataaacaatccacacaagctctcagaaagcagaagttccatgattcgtgaccagagtctcatagcacagaattcatctctaaaaacagg

SEQ ID NO: 3270 - DNA, 741 bp, Homo sapiens
ctgccagcaaagccctcttcaacccactggagtcagcaggcccagtgcttcataaaccaagttatgagagcagagctgagaatttctaaggagcctcctttttaaagcctttcacttcacctgctctccaacagctggaacggtcactgcgcaggatcaagctacaatgaagaggagggaggcagtctgcgcgcaccgccattttctaggaactgggaagcccccccaccccttaggaagatccatccctgtggaaccttgcccaggcttaccagcctttgctgaggttgatctattgtccctccttgtccccatcaaaatatccagcactccaccttcagggagtagacttgaccctcaaatagcaagttcagccttcccaggtctaggttccctgggaggtcaagattcgtctggttccttagtacagagggctagctgtgagttggaatccccctatgagctttagaatcagtcaagaggaattgggccccttcccttcatccctcttcttttccctttttgtcccagagctcagctctgactcaaaagtttttccatttaccatcaacatggaaacttggctcctcacgtaggtatattatcccccttttgtacatggtcttgttgatccaaactccctttctgtgaaagaggcctgtggggctcaagaagcctggtcagccagccaggctagtcccacatacctcagaaccagtttaataaaggctctatgtcatt

SEQ ID NO: 3271 - DNA, 5935 bp, Homo sapiens
tgcggccgaagaggattccactgcgtgctgcagtttctttatccctttatctgtgcatgaacagtgcaggccaaggccccctgcccatggaggtgtgctgcagacagcagcagcagcagcagcagcagcagcagcagcagcagaggcctggcttcctgaggaattgctggccggtttgaggaaggaaggaagtcccacctaccatgatcaccctccagcctggaggaagctccatgccagcagcatggaccagcatgggagccagagccctgctaatgctgcagctcatcacccctgctcagcagcccagcagcccagcagccattgccacatcccatttccagggcctcctgcccccatgcccccacgtgcccatggaccgacacaccactcttcctgttggcccaaggtaggcatggagggaatttttcaagtccacttttagtaggtaagtcaaaaccaaacaaaataaccactcgacacctggtccaatgcccttccaaactcactcttttctctgacccttaaacacttgtcctgcatctcccagactccactgtaccttgatcagtaggtccctcttcactgcagtgtcttttttgcagagttcttttagctctttcatgcttttgctatgggcagaggaaagaaagaagggtaaatttgggaatcaggggagatttgtgagttccagtcccttttgtttgaaaacccagtgaatcccagcttactgggtgagagttttcagtggagtcctctgatcacaggggctccagaggaccagggtgggacctctcatgctcctcccctgggccccatctccacttcacatgagccactgcgtgtttacagttagctttcagctggacacagagttccactgctgggtacaaacacctgaaagcctccagttggctccagtctgttcctgatggttaaaaaaccttagtcctgagttggaaatccttgcctaggagtccagggcagcttagtgaccacagccaccggcccatccctgcctccagtgtccctggactccaagaacctttcagagtcattgagggcacatggggggagacctgtgagtccctaggtcaaccctgatgctgccatggagagagccctcctcacctggacactcctgcccacgtcttgtgtagctgacctattgggttgctgcacagagcagagacgatgacgtgcaccgaggagaagttgttgaggcttaggcactcctggagagggaagaatgagctgtgcggttcagagttggagcttggcccactacagcctcagccccctctgctgagatctcccctcctggatgaagcagaggcctggggagcctcaggagggcagacctggggccgagtggatgtcactcatctaggaggattttagttcaacccaaggaagaccccaggtcggaagtgagcagccaccactgggccgtgggagtcaaggtgagtgaagctctggcaagaagagcctaggggatgtgcagggtccaggccagagatacagatgccgatcctgaaagccgatggaggagaagaggaagttccccatttttaaagagggaatccccaggcccaaccatagcttaccctggccaccttgatccagtgctccaccaccctggccctgtcccgggccctcatgctgtggtccccgaggcaggaggtggtgatgcagttggtgagcctgttgaagtgtgcgatggtggcacgaactgtgggtgccatgtgctcattccccttcagatgtccttggccccagatgcagcccaagcattcgtggagcaccaccttcttgaacagctcctttgggggaggaggagagtgtcacggacacagcacactgcagctcagagtcacccacagtcccaggcagggactgagctcacagtcatccacggtctctggcaggaaccaagctggagctcagaaagctttaaaatgggctccagacttgtgggagtccctgggtttggttttctgcccccgagggacctgaatgcatcatggcctagaacccaacaagggtgggaagagagagtgacattttctcccaggccatccacactctaagaactagaaggtggctcaggcctgcccatcctgaggcctcgtcttcctcccatcccaatcagccctctactactcctctccgtaccggtgcactttccttgtggcagctgcaactatgggctctgtttgggtgtctaccatagaatccagtatgcatcaggtacctaataagtgctgagggtagtgaggctcctgagcagctgggtgagtgacccatggccctgcctgccccacagtgagcacctgccctgccctgctttctgtccatctcctgtcactcagtctgcacagtcactctgtgcagctggcgctggtgatgtcccatctctgccgtccacatgcagacagggaaggcttgtgggtgaggaaactcatccagatcccacggttggtaagaagtggggctgaaattggaccgagggcattggctgctcctcagggagaggctggtctgagacagctggtgccagagacacagcctgcaaagctcagctgctcaccgcatccatgagggtcagctgctctgccagcagcctgggagggaaggtcgtcatgtcaggcagctcctcactgggttggttctttacagacccacgacagggacaggaggactctggggctgactgtggctccagcactgtccctggagggggcccttcccctggtgctggtgctggccctggtgctgaatgtagatatcctggtggacccagggctgcaggtgactctggctccagagcaggccccaggtccgccagcagtggtggtgctggctccagggccggcattgttaatgcgtgttgcccaggacgtggagcaggatctggaaaaggagaaaaggtcaccacaccagtcatttttcactgggttttccaagcacagaaatgaccgggtggaatttaagggaattgtagccccaaaacaccacccccggaaagtcttgcagactgcaagccccctcaccatctggcttggcctcgttgggctccggaagcaccaactggcctaggacaatttcctgatggtcctccaagcccagtccaggccaggagaggttcctgaaggccagctttatccggaaagatgaccgttgcgggggctgatagtaaactgaagtgttttcggggggccagttgaacaaaatggaggtgatggtgctggtgatggagtagacagctgagtcagaggcctggccttctcccacacaaccctccagggcacccctgcgtggttctgggtccctggcctgttgctgccagtgtggaggacagccccaccctaccgtaagccatcagtgctgtcctggaaggggcagacctggccatacagcagggctgtacagaccctcgtgcgccctggcgtcccacagacattctcttcccaaaggccctggagcacagcactgtacacctgggcactcaagactgcagctgcaggcagatttgtgagcagcttcctcatcaaagctccagatctgggtcccctggtcctggggttaggagggaaggggcagatgtcggggggaggaggacagggagagctgggaagccacggtgctgagggggatgggtctctcagtggccagctgtgaccccagcctcccctctgctttgcaggggacctaagtctccatttacagaactcactatttgcctcttgtgggggaagtccccagatgtcagccttctcgtgggaattataagaagtatgagccccagagctcctttagtctctccccagccagagtccacatattttcccccatgttttgtgggtgaaaaggcccttcagaaccctaaatccacccagtttatatttgttgctgggctgcgtcattctagtcagaatctgggaggatgccaccatacgtagaggaggccatgagggtctcacctgtaacattctgtagatatgacttgtttattctgtctactgtgagtgcctgactctgagtagaatcaaggccgggggattgtcatctgctttgtttatgaaattatgccaagccccaagaagagcgatgcacaaatgaggtgttttgaatgtatgtgttgaatgagtgaaccccaacctttggagaaccccagtgagcctctccagatgtctgagtgggcctgtggctcctttttcagcaccaagggacccctcttctgtctgtgtcaaggagaaagaccagccagaaggaatctcagacatcctttaccagtgccatcgcagacttggtttctatgtgtttttccaaacagtgagtgatacaggccattgaggcagaatgctgagagctgcttcaagtgagggggaagagaaaagtaacaaacatgaatcacagcacccccagcagattttccagagttttaggctctagggacccctttgtttgctgtgtcttagatcattgagtccctacaagaaccctgtgaggttcgtcttctcactactccctgttccagaggagccaaccgaggctccgagaggtgcatcttcaagacagagccagtaggggacagaggcacctctgtgtcttggagggggatggacactcaccttctaaccagtagttccaaaaagtgtggcacagtgataaagtcccaggaggggcccaggcaggtggcataggaggagatgggtttagttagaaaggctggaaccagggactcccaacagcttctccccagtgccgggctggaaagttagcatcctgcagatctcattttcatactagggggacaaggagggacatgggagtcagtggtaacaccatggaccaccagaggatcgggatctggaactcacaccaagaagcaccaacccttcagggacttgtgcatatggagaacctgggtgcccatggtgaaaagcgttctaggctttcaaagtaacattgcatgtgaggatggagaatgataaaacgattcctgccttcaaggcatcgtcccggtgtttgtcagctgtggggcaacagcaccctctgtgtcagcaacctgcatgaagagcatcatccctgcaagtcctcaaggcctggggaggcctcatcccctcctcatttcagcaacagcacacaggacaatacgctctagaagaactctttgacttaaaggtatatgattgtttttgttcctttaacatgaacgtgagtctggagaaacagctacggccatcccagccctggccaaggggaaaatgccggaagactccagggtgggaggaagcgcgtcccaaggcccaggatctgcgaggcgacttggggaaaacgcaggcaggacctgctgaagctcacacccgtggaccacccagactgcctgccgctacaggatgccctccgcatctcccaggacttctttccggcatcagtgtggacattgaccccactggactgcagtcacagtggactcccaaggggcaggatccacctctgatgttcagtgaagactaccagaaaagtctgctagagcagtaccatctgggtctggatcaaaaactcagaaaatacgtggttggagagctcatctggaattttgccgatttcatgactaaccagtgtggttgaggagtgggcccagggcaccttcaaactcaaccccaatgatgaggacatccacacagccaacaagtgccacctgaaggtggtcacggacctcaggttgtggatgtggcagacctgcttcacgctctcgggcctcctctgggagctcatcaggactatgggggattgggcagaggtgtgagtacccaagggacacccagggggcagagagaggtgtgatggcagcctgaacagcagacctaggtggcaggggtgaacagggtgggggtgccaggccctgggggaccggggcatcccaaaa

SEQ ID NO: 3272 - DNA, 4585 bp, Homo sapiens
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgt

SEQ ID NO: 3273 - DNA, 4585 bp, Homo sapiens; identical to SEQ ID NO: 3272

SEQ ID NO: 3274 - DNA, 3327 bp, Homo sapiens
aagcctcaggggtggtggctgttgactgcaggagcagagccagaacagctggcggagaccaaacctggtcatccttcacaggctgtgtggccatgggcaagtcactctacctctctgggtcccggtctccacattttcagagtgagggcagtttctctgtgccctgaaagtggctgggagtctaggccaggtgacagctcagggcaagttctcaagggccccagaagcatctggggtgcaggggaggttccaggatccccagttcccacctttaaatgaggtgactcgagaccctctgagatgaagggaccctgaacgttgatcattttgacctcccatctctaggagcatgtccagagtctgccattccttccagaaaggaaaaaggagaactcacatcaagatctcccttgtttagccagggaggtgggagtggggccggggggcagccaggaaacatgagcacgttcgtcatggagggcaggggctgcacgggcggccaggcagtgtgagcccatggtcagcaccagcggcgagctgtcatctccctgtgcctcagttcccttccctgtaaaacagaactctgcaccgcccccgaccccatgccaaggtgctgggcaaagctgcaaaggtgctggtgcccggccaccctcagtcaaggcggcaagaacccctcggtgagtggacgtggccccacagggatgtagaggatgaggcagaacccagggctccccgagttccaagtccacgctcccctgcacacgggcccaccgccgccctttccagagagaaaaagaaatttctgtctaaagtcagtcagaacacccccagactccacactggtgacgtccgaatccccccggacaccggtgtggcctcagtccttcctcccagctggttcgctcagctcttgctccctgccagcccccaggtcctggtccttctgccacaggctagcaggcaccccacagcccgatggcggctcagatggagactgcggtactggatatcctgggggtaacatcacagccacaccctccgccaggctggggacagctgcccatgggccgggccaggccagtgctgggattatgtctggggccacccaacaaaagaccacaaatggggcagctgcaaacaacagaagtctattttctccgagtcctggtggccggaaccaaaatcaagctatcggcaggactgtcctctctctgcaggctgcaggggaggttcttcccgcctcttctggcatttggtggccccaggtgtcccgtggacgtggccgtgtcattcccatctctgcctcatcttcacgtggcctctgtcgcctccctctcaaatctcccccgacctctgtcttctaagggcctttgtctctggacaaagacccttttcccaaataagcctgtcgtgttcacaggctccaggtggaccgatcatttgggggccaccactgtgcccactgcagtggagtcggggacggggccactcatggccatgaggccacaaacgggtgtggggtctgagagcagcaggcaggtcacccaacaccagacaggagcaagcccaagcaggggtggccgagagagccgggagggtgatcgggtgaaacgcctgccctcagaggaagagacgggacatggcccacggcggggtctcacctgcggcctctggttctccccgtgctttggcgccgctcccgctccatcctgtcccttcactcccctgttggagagggttttcccacaatggcctggacatggagggctcgggaggtgggtgaccttcccagtgtgcccagctggaactggtcgacttgggcccaggtccatgtgagtcccgggccccgctgcctcctgagaccaaggagcatttccctctctggcgatgggcacgggagctcctggcaggacggcgaccgtccggtgggcccggagaggaggcagctgctgcaccctcggcgctggctctcagggatggctgggctgttaggcccgaactagacctgctgccgccgtgtggagaagaggtggccccaggagcccactgtctcgggtgtgggccatctccatgcctgttcctgtccccatcacacaccaggcagtccccaccagcgcccacatcctcaccagggctctccacgtcccctcctctggtccccacccatgtgtcagctcctcacagttccaaggggccacccagcatccccggggcccaagcccttagaggatgtggtctgggagggtgggacagacacttcttccccaagtctgcctctgatgtgtcacccaaacctttaaactttgcacctcagttttatttatttatttatttttattttttttgagacagactcgctctgtcgcccaggctgcaggctgtggggtgtggcgtgatctcagctcactgcaacctccgcctcccaggttcaagcgattctcctgcctcagcctcctgagtagctgggattacaggtgtgcggcaccacatccagctaatttttgtatttttagtagagatggggtttcaccacgttggccaggctggcctcgaactcctgacctcaggtcatacacccgccttagcctcccaaagtgctgggattacaggcatgagccaatgcacctggtgggacctcaggtctataatgatctaaatcacccaacaggaggaggcagcaagacctggcagcgagggccaagcaggaaggccatctgcctgccccctgcctgtcccctccccacccccagctctcccaggcactacagcctggggcagcccctcccccagggccccaccctcagcctcctgtgcaggtgagcaggagcgggcagcctcactggagcccagatgacggagccggagcccctgccccaccccacctgcatttgaggggtgggatctgcttctggccatgagggaggacagacccccacactctacaaagcctgccccttggctgcttggctgtctgggccaattctggttgtcctgaaccagaggccaccaacgggccccgtggaggctcagaaccaaaatcccacattctcagaggttcttggggtcctcagggttgggtagtgcagcagcgtgcaggctgggagggaagcctgggatcaaatcctggctccccttcttcccgtttggtggccttgacggagagtgagggcttcctggtgactgagcctcgctttcctcgtgtgtcctgggctcggagaagtcctttctggaggaaggagggtcccttcctcttggtcagggcgggaagaaatgtgccccaaggagggatggcagcgcccactgcgcctgcgctgttcataccttgac

SEQ ID NO: 3275 - DNA, 3697 bp, Homo sapiens
aaaaaaaaaaaaaaaaaaaagtttcccctccctcatcaacaaaagcccaccctctaagagacattcaagctgaactatcacaattcttaatcagttacaatttacaaacagataagtttaaaataaacaatttacaaaatttttgaagcataccttaacatcttgttttgcagttaaacaatggaaaagtatttctcctacactaaaaaaaaacttgcttacacacaactgaaaatagaatcttacttgataatacaaaagctaccatcagaagaaatcccttcaggatcattaagccacttcctttgctctgcagtttctatagtagttttaaattattattaaatcacctgaaaaaaattccaaaagagaaccacacactaccatatccaaacaacttttgcatttcccataattgtagttaatgtcagcccagtaggccagaccaacccccagttcaatactttccttccccaaaagctctatactttgaaggaaaacagatacagtatcaaattatgacactttccttgcccaaattaatgcactggtacacccagtggctcatatttaacttcccccagcttcccaattcaaactggggggaaaaaaactaaatcattgggagttacttgccaacttggaagttgatatttctttactttttccattctaagactttaagttctctggcatgagtttatctgcaatcataaactaaacaattacctaaacccaccccaccaatcccaaccgtaacaggccactgccaactaattgccaatatttgcccctcccctttaataaaacttttaagaagtcacattattggaaaacttaacttcaacatttggcctactcaagctcttctgaagttctcctgagatgactgaatatgaaccaaagctgcactgtgctgtacttttcagcttcaactgggaatactcttccaaggataaaagcagctccagtccctgaaggtgttcgtgccaacagcacagcggtacactccttctctaacccagtttgtcaatagtactatagcatctgtggaaaatcttagaaaaaaacattttctcccccaccctctctcttccctgttaagaccatcccaaaatgcttcaagtaaaaaataacaagtttaaggggttaagcacttttaaagtctgattaagggggtggggggaaaaaagagtaactaccagccatttctccaatggacatctcttccacagacctcaacgtgagaactgctctagtttctataaactgtaaacctgtggtggtctgattatcctgatattggattttcttgttttctgttacaccttgagtcatttgcctttaggattctagacagacctaagggaaaaagaactgaaaacatattttgcccccacccccacaaaaaaaaatactgaaaactcccccccgcctcagttacacatccaaactctacatttacaaaacgaattcagggtgaggaagtaaaaacaggtcatctattcacaaaactgaaatacttcattaccccaactaaacatacaaactgcttacagatttgctgaaattgtctcaatttggctatcaaattcatttggttttcctcaaattcgtgtaaaaaaaaaaaacccacaaacttgccatctactatttctccaggacttggcagtctgccctcaaaagcttcagacaagattcatgagtataagcctgaaaaagagaaacctacaacacccggaaatcggcctacgtccccatataaatccctttacacctcagtacgaaactcccccattatattagaaaataaataaaaggttaccataagtaagttccagaaaaacaacatattgccgacctcacggatttttaccaaccactcgctttccctgtggccttggcacactggcatgctggtctaggatcctctacgcacaacgcctgctcgcctcctccgtgtggttgccaagccaagccgcctgctaccttcatcaccaaattgcactcgctccttcctggaatcctttttcctagcttcaccaccaaatcgttagcgctccttccttcttcctagcttccttcaccaaatcgcactggctcctggactcttttcctatcttcaccacgaactgctgcttgctcgcttgctcctcagtcctagcttcatcaaacactggttcctggaatcctgtctgctgctgtcttcctagattcactgaatccacttctgtgtagcacctgggtcagctgtcaattaatgctagtcctcaggatttaaaaaataatcttaactcaaagtccaatgcaaaaacattaagttggtaattactcttgatcttgaattacttccgttacgaaagtccttcacatttttcaaactaagctactatatttaaggccttccaaattcttctaactcttccaaaagccttctgccttagttttttttaaattacaccagtccttttagtagctttttgatgtgatttttaaccaacttccccttctagcttcaagtattcttctaaattggttctggtctacgtaaacaccctcatcttctcaagctttaccttctaacttctgcaccaccagaaattaaattgatgggcttttaaaataaattggttaccaataatttcctcattttttcagtgctattttatccaatttttggctttatatttttctatcttctatacttctccaatacttgtcttagcttgtttttcattttctatctgaaactcttgacaatattttcattttctatcttgtttctatcttccaattttcttctaagtttgtacattttgcccttagctttttgtttcctagcttgtcttttttcttctgcttcctacttttcaggtttaaatttatcttttttcttctaaaagtatgtttttatcttctaatttccctatcttctctattcttttcttcgccttcccgtacttctgtcttccagttttccacttcaaacttctatcttctccaaattgtttcatcctaccactcccaattaatctttccattttcgtctgcgtttagtaaatgcgttaactaggctttaaatgacgcaattctccctgcgtcatggatttcaaggtcttttaatcaccttcggtttaatctctttttaaaagatcgccttcaaattattttaatcacctacaacttttaaactaaactttaagctgtttaagtcaccttcattttaatctaaaagcattgcccttctattggtattaattcggggctctgtagtcctttctctcaattttcttttaaatacattttttactccatgaagaagcttcatctcaacctccgtcatgttttagaaaccttttatcttttccttcctcatgctactcttctaagtcttcatattttctcttaaaatcttaagctattaaaattacgttaaaaacttaacgctaagcaatatcttagtaacctattgactatattttttaagtagttgtattaatctctatctttcaaagagaaaaaaacttatctgcggtttcctcaagctccgcctgccccctcagcagaagcccctgcgctggctgcctcaatgcctaccgcacagctcgggcgaggcgtatttatagacggagaacaactcgcatcaccggaattcgatcaccttccgccgcctttgtgagggaggcaaaaagtagtt

SEQ ID NO: 3276 - DNA, 4364 bp, Homo sapiens
ctactttttgcctccctcacaaaggcggcggaaggtgatcgaattccggtgatgcgagttgttctccgtctataaatacgcctcgcccgagctgtgcggtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtgatttaataataatttaaaactactatagaaactgcagagcaaaggaagtggcttaatgatcctgaagggatttcttctgatggtagcttttgtattatcaaacttttttcagataacatcttctgagtcataaccagcctggcagtatgatggcctagatgcagagaaaacagctccttgacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaagacccttcacccctcacctcgatgcagccagtagcttggatccttgtgggcatgatccataatcggtttcaaggtaatagcctgcagctggtgttttgagaagccctactgctgaaaacttaacaattttgtgtaataaaaatggagaag

SEQ ID NO: 3277 - DNA, 3579 bp, Homo sapiens
aaaaaaaatctatagaaaaaaaaaaagtttcccctccctcatcaacaaaagcccaccctctaagagacattcaagctgaactatcacaattcttaatcagttacaatttacaaacagataagtttaaaataaacaatttacaaaatttttgaagcataccttaacatcttgttttgcagttaaacaatggaaaagtatttctcctacactaaaaaaaaacttgcttacacacaactgaaaatagaatcttacttgataatacaaaagctaccatcagaagaaatcccttcaggatcattaagccacttcctttgctctgcagtttctatagtagttttaaattattattaaatcacctgaaaaaaattccaaaagagaaccacacactaccatatccaaacaacttttgcatttcccataattgtagttaatgtcagcccagtaggccagaccaacccccagttcaatactttccttccccaaaagctctatactttgaaggaaaacagatacagtatcaaattatgacactttccttgcccaaattaatgcactggtacacccagtggctcatatttaacttcccccagcttcccaattcaaactggggggaaaaaaactaaatcattgggagttacttgccaacttggaagttgatatttctttactttttccattctaagactttaagttctctggcatgagtttatctgcaatcataaactaaacaattacctaaacccaccccaccaatcccaaccgtaacaggccactgccaactaattgccaatatttgcccctcccctttaataaaacttttaagaagtcacattattggaaaacttaacttcaacatttggcctactcaagctcttctgaagttctcctgagatgactgaatatgaaccaaagctgcactgtgctgtacttttcagcttcaactgggaatactcttccaaggataaaagcagctccagtccctgaaggtgttcgtgccaacagcacagcggtacactccttctctaacccagtttgtcaatagtactatagcatctgtggaaaatcttagaaaaaaacattttctcccccaccctctctcttccctgttaagaccatcccaaaatgcttcaagtaaaaaataacaagtttaaggggttaagcacttttaaagtctgattaagggggtggggggaaaaaagagtaactaccagccatttctccaatggacatctcttccacagacctcaacgtgagaactgctctagtttctataaactgtaaacctgtggtggtctgattatcctgatattggattttcttgttttctgttacaccttgagtcatttgcctttaggattctagacagacctaagggaaaaagaactgaaaacatattttgcccccacccccacaaaaaaaaatactgaaaactcccccccgcctcagttacacatccaaactctacatttacaaaacgaattcagggtgaggaagtaaaaacaggtcatctattcacaaaactgaaatacttcattaccccaactaaacatacaaactgcttacagatttgctgaaattgtctcaatttggctatcaaattcatttggttttcctcaaattcgtgtaaaaaaaaaaaacccacaaacttgccatctactatttctccaggacttggcagtctgccctcaaaagcttcagacaagattcatgagtataagcctgaaaaagagaaacctacaacacccggaaatcggcctacgtccccatataaatccctttacacctcagtacgaaactcccccattatattagaaaataaataaaaggttaccataagtaagttccagaaaaacaacatattgccgacctcacggatttttaccaaccactcgctttccctgtggccttggcacactggcatgctggtctaggatcctctacgcacaacgcctgctcgcctcctccgtgtggttgccaagccaagccgcctgctaccttcatcaccaaattgcactcgctccttcctggaatcctttttcctagcttcaccaccaaatcgttagcgctccttccttcttcctagcttccttcaccaaatcgcactggctcctggactcttttcctatcttcaccacgaactgctgcttgctcgcttgctcctcagtcctagcttcatcaaacactggttcctggaatcctgtctgctgctgtcttcctagattcactgaatccacttctgtgtagcacctgggtcagctgtcaattaatgctagtcctcaggatttaaaaaataatcttaactcaaagtccaatgcaaaaacattaagttggtaattactcttgatcttgaattacttccgttacgaaagtccttcacatttttcaaactaagctactatatttaaggccttccaaattcttctaactcttccaaaagccttctgccttagttttttttaaattacaccagtccttttagtagctttttgatgtgatttttaaccaacttccccttctagcttcaagtattcttctaaattggttctggtctacgtaaacaccctcatcttctcaagctttaccttctaacttctgcaccaccagaaattaaattgatgggcttttaaaataaattggttaccaataatttcctcattttttcagtgctattttatccaatttttggctttatatttttctatcttctatacttctccaatacttgtcttagcttgtttttcattttctatctgaaactcttgacaatattttcattttctatcttgtttctatcttccaattttcttctaagtttgtacattttgcccttagctttttgtttcctagcttgtcttttttcttctgcttcctacttttcaggtttaaatttatcttttttcttctaaaagtatgtttttatcttctaatttccctatcttctctattcttttcttcgccttcccgtacttctgtcttccagttttccacttcaaacttctatcttctccaaattgtttcatcctaccactcccaattaatctttccattttcgtctgcgtttagtaaatgcgttaactaggctttaaatgacgcaattctccctgcgtcatggatttcaaggtcttttaatcaccttcggtttaatctctttttaaaagatcgccttcaaattattttaatcacctacaacttttaaactaaactttaagctgtttaagtcaccttcattttaatctaaaagcattgcccttctattggtattaattcggggctctgtagtcctttctctcaattttcttttaaatacattttttactccatgaagaagcttcatctcaacctccgtcatgttttagaaaccttttatcttttccttcctcatgctactcttctaagtcttcatattttctcttaaaatcttaagctattaaaattacgttaaaaacttaacgctaagcaatatcttagtaacctattgactatattttttaagtagttgtattaatctctatctttcaaagagaaaaaaacttatctgcggtttcctcaagctccgcctgccccctcagcagaagcccc

SEQ ID NO: 3278 - DNA, 4726 bp, Homo sapiens
gtcagacctaggctctcgcagagaactgcatcgcgctcccagctctgctgcctcggtgcggggacggggctctgcatgaggactgggaatgtaagtcccgggcctggacaggcgcccctgggagctagcctggaggagattcagtagaaggctgaggagtcggcttggagggtctcggcaaggcggcgcggatggagatgaagctgcgaagaatgctgagaaagagcggccgggggccttggagggaagctagggaaacgctgcgggggcagccgaggccgtcggcgccccgggagaaggtgcatgtggagtggcgccggggggacgggtgggcgctgggcggcggcggcgccggcctggaggtgcggcctgggctccttccggacccgcccggccggcgcaggggctgcagcctccacgcgggggccttcggttccgcctcaactttccaaccgggccgccttctcccagggcgggtgactgagccgggcacacgcagcctctcccgcgccgggctgccccggccagggtctttcctccctcgcccagtcgctgccctctcctttcccgcagcccgcggggcctgggctctccctgccagctcctcctgtgtccacttcagccttcccggttccccaggcagcctgtcctgccggtcactccgtctcccacctgctttgccgggaactagagcacacaccacacaggaggcgggaggggggcgcaagaggtgggtgttggaggcgggggtgtggtgtggctgtggtgtgatgtgtggtgtgtggtgtgtgtgtgtgtggtgtggtgcatgtggggtgtgtgtagtgtgttgtgtgtggtgtgtgtggtgtgtgtagtgtgtggggtggtgggtatgtgtgtggggtatgtggtgtgtgtggtgtgtgtagtgtgtggggtggtgggtatgtgtgtggggtatgtggtgtgtgtagtgtgtgtgtgtagtgtggtgtgtgtgtggtgtgtttgtgcggtgtggtgtgtttggtgtagtgtgttgtatgtgtggggtgtgtgcgtgtggtgtgtttggtgtagtgtgtgttgtggtatgtgtggtgtgtggggtctgtgtggtgtgtttgtgtggtgtggggcgtgtttggtgcgtgtggtgagtttggtgtgtgttgtggtatgtgtgtggggtgtgtgtggtgtttgtgtgtggtgtgtttgtagtgtgtgtgggctgtgtgtgtggtgtggtgtgtttggtgtgtggggtgtgtgtggcgtttgtgtgtagtgtggtgtgtgtggtgtgctgtgtgtggtgtgtttgtgtgtggtgtgtttgtgtgtgtggtgtgtatagtgtggtgtgtgtagtgtgtttgtgtgtgtggtgcggtgtgtatgcggtgggcgtgtgcagaaacaacaagcccctgctccgcatggggtgtggagcagatgctgcggaagccgcctggcctgtgggcgttggcagtggggaccagctgacccagagactccgcgcttccccgcgcttcccccacccccgccccactgcggcgctccggggctcactgagttccgaatccacctcctgggatccgcgccctggctaccaggccctgagccttctgcgggccagcgagctcccgccaggttctgccaacagggggccccagagggcggcgtggtggccgcagatcgcaggacaggagcctgttcccgtcagcagagccccaataaccccccggactcccaacggtggcgcggtcatgcccagttttctagcttgcttcatgcactcccaggacctgcctgcccacatcccgcccgggccggctggtccatctcggagatttgagtccagctctctgggaggccccagggccaggcaagtgcagaggtccggttccactccccagggccccttctccagcttccaggacctcggttctcagaaccctcatgacttctctttgctctttagagaccttcactgcttctatcagtcaccatatctgaatcttggcttgccactcaatcctccaatatcgaccaacaacaggagattctctctatctgaggggggaggtgtgtttccctgactagactctaaatacaaatcctccacttctccatctgtctctccagtgatctcagaggcatggtcttaacaccgcgcacagttccttgcaagttgaagagtagacccaaatgatcagttctaaaattctattcttattgaagattactggtggaaatatcaatgcaaacaaaatgaaaaagttcaacaatgattaatactgcatttcaacagaagaatcaaatcatcttgacaaaacttcaatgggcaaaatttgccttggggaattttatgcaggggaatccttgggtctgatgtgtggtgggctttggatgtgttgtgtagctcagtgtcccttcctgctactcctagtcatctccagaaactcagaccacccatctactaaaggcaggtggatgagcaagggggcctcggaggcattccggatcacactgaacctgagccccaccgcctgacccactcagtgtcactgttaacagaaactcgctgccatctggcctcaggcctgcctccttcctatagaacttgacactggaagcaccaggcgagctggaccttctgctgctactgcactcccatgatgcagcctgagaatgaagcccaccagagtgacagagagcagacctgagtggtgagctggtgacacagggtgtgggtggtgtcccttgagcttcgacaccacgccacacctgaaaccagcctgacatccatgattttgcttttttgcttaaaccagtctgcgtcattttcaacaaaagagttctactagatatgacaaatttctctagaagacctaagaagtgaaagacttgaagctattccagtggttcaggaactaggacactggtaggaaactggaaagaaggcatcagagttaaggaaatatttatgaggtcaactctggaagtcttggttactgagtgaatacagtggctgagaggaatggaagcatccaaccaaataaaaaaagatggtgctgagatttgggttatgaggtcaatgactgaagcaatgcgattaactgagttaggagtctcaaatataggatgagtgcagagttgaggatgaagaattctgctttggacacaatgagtgtgaggtgcccaaggataacccaacgggaagcagtcacaccaaagcaacagggtgtgcacctgaaactcagaagggtgattgggctatggtgaagattcctgatcacccataaatgaattcattaaaagcatgagagtgagtggaggggcccctagaatatggtgggtgcatgagactaaccctagattggggatagctccctgggaaatccaagggacaaggtgaggaggaggaggcggagcccaccaaggaaactagaaagagaccgctggagaggtccgaggacagcaaggagcacagccttcaagtctgggagccaactatccaagaagagagtggtttgctatggatgccgtgggccaccacgtcccatctaggaaagcaagttgaggtctctcttgaatacattgggattgattacccagactttaaagaatctatgtcccctacttcccttcattcactctgctctttaccttctcctcttccctggtcaccagcacctctgctaaagggtggagaaaggaacttctgatcagttacagaaaagctttggggttacgtggtgcaagctgctctgcctctgtttgtgaagaaattagactatggccagccatgtgagtggcatcactttggtttctggagcaatagttagtagcaacttttagaggtggtcatttcggttcccttctggaaagtgattcgtgtttaagaaaaatagatgcaacgttgctaagtacacctaacatttaaacagtctccagcagataaatgctgatactgacacttctcaccagaaaaagagaaatacccatcatgaggaagagaaatgacttttgttcagttatgctcccgggtcccctttcactggagggatatctcagctttctgagcccctggttactgcaatcctcggttccagaacccagcaattcctatcatcacaattgtttcaagtcttatccaagccctgtatatttcagatcatccttaatttcttgttctgtacccagaggagatcaggaaaacctttaagtctctatgtgaggcaaatacatcctcctcactgccccagccccatgtgattgatgaagcaactgaggaagagaagtagggtgcttctggcactggaggagcgcagtgctgagaaactccgggctccattcggaaatagcactgatttcttagtgtacttttttttggtgttaatatagaaaacatcaaaaacacagttaaaagaatgaagcatgtctacatacgtgtggccagaaagactgaccagaagctggtagcagtgagggatgacagtgcttgcccctgggttgaatagtggaagagttaggggggaaacagtctgctctttgagaccctttcaatttcatgtgatggatttacagagacagatgaattaaacattatataaaaaaggaataaaaccactggtaggatctgtattccaggaagaaaaaagcatattacataataggtcaatgcacagaaataaaaaaaggaatttaactagagcctatgctaatcataaatccc

SEQ ID NO: 3279 - DNA, 605 bp, Homo sapiens
actgtctgagtgcagagatgttctttacaatcccaatacagtacagatttcttccccaaaacgaaatgagcaaggaaaaacagaaaaagagctatatcaaatgtgctcatgaagaaccaagccaatctcacctttctttaaaaacaaaacaaaacgatccttttgaatgtgtggtgcagacgcaggactgaagccacaggcttttggggtgctgtgagcccagggctttgctcagctcacagctagcgcggcgggcagagcaacccttcggcccaagccatcctcgcagcttacacagaagcttcctgaacctaagggatccgttcccagctctccttaaattcccagtccccaccctgggcctctctccctaacgatcttgtcgctttgggagcccctgaagtgaaccctgaaatactccctccgtcaactctgggctcagacctttgcccttctctgtgtcacaaggaaatttcggtcaagagggtgggaacaggtggtttcagaccgtgcagcaaagccactgccaggtaagttttaaggcaaattttatctcttcttattcagtctgagccggacctaaccttctcaccaccgagcaatcc

SEQ ID NO: 3280 - DNA, 1052 bp, Homo sapiens
ccgggtctcacactgtcacccaggctggagtacagtggcataacctctgctcactgcagcctccacctgccaggctcaagcaattctcctgcctcagcctcccgagtagctgggattacaggtaagtgccaccacacccagctgatttttgtgttttttgtagagacgaggtttcgccatgtttcccagactgttctcaaactcctgagctcaaagcagtccacccaccttggcctcccaaagtgctgggattacaggtgtgagccaccttgctcattctagtttaaactttggagtggtttgtgtctcctgattggactcctgcaaatacagaattgatgctaggaagggtaccaggagatagacgcacacagatgggatttgggaataggtttggttatccaaggagcagtgctgagctccttgctaatgggatatgggatgctggtgatttccagtaagtgacctcaaaattactcaggctaccacatactgttgattgtgatgaaatgccagttgaagcacctgtcctgcgagcttaggggtgctacaagttgaccactgcagcagtaaagatgactctgaagaatggcatgggatggatcctttcgaatgcacttgagcagcggtctccaaccacagggccacagagctggagctggatctaccatgaaagacctctgaatccaggaagagagactgactgagcaacatgttattcagggtctccatctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcgtatacgtggattccagaggggtgacagtgaaacgtgagtaagcatggattttggtatatgcagagatggggggctggaactaattctgtatactgagggacgactgtatatgtttttacaattacgctgtaggatacatactgttgcatagccttgaaaataataattttt

SEQ ID NO: 3281 - DNA, 26060 bp, Homo sapiens
ggagaggcgccggcgtcgcggcagatggcagggtttcccgcccactggccgggccgcggcgctccggtcccgggtccctagaaacggaaggggagattcaccgggatggcggcgttcccggacccctgaaggccctgactccggacccaagtgggatcggcgactcctctgcagtccaggaagagtggaatgcagggattgctttggtccccagaaatggtctggggaaagagggtgggtctgactctggatccctggaggagaatgacctcaacatggcccttcagtgtttcttgagaagcacaactgctgtcactgagtctactaaactgatctcgagagaaggacagcatccagttctgattcctccctataaccttagcgtccagttgcaaggtagtggtttaataaatgggttgaatgcggaataagtggggcccgggcgcggtggctcacgcttctaatcccagcactttgggaggccaaggcgggcggatcgcccgaggtcgagagttcaagaccagcctgaccaacatggagaaaccctgtctctactaaaaatacaaaaaaattagccgggcgtggtggcgcatgcatgtaatctcagctactcgggaggctgaggcagaagaatcgcttgaacacgggcggcggaggttgcggtgagccgagatcggtgagtcgagatcctgcctttgcactccagcctgggcaacaaaagtgaaactccatcccccctcgcccccccccaaaaaaaaagataagtggatgcatgcatgcctaagacagtaagtctcaaaccagaactccagaactaggtatagccggttcctcacagatctcctcaccccttaacttttaattcatttaataaatactgaaggcctactgtgtataaggcatatcgcatgagatatagcgatagcgagacagacaaggctgctctcaggaccttccctcagctggagggaagcacataggcttgtaaatacataacttcagagtgaccactgctatgaagaaggtaaaacaaagtgatgggatagtgacaggggaagccaggcgcaatggctcatgcctgtaattccaacattttgggaggctgaggcaggtggatcacctgaggttaggagttcgagaccagcctggccaaaatggtgaaaccccgtctctagtaaaaatacaaaaattagctggacatggtggcgcatgcctgtagtcccagctactcgggaggctgaggcaggagaatcgcttgaacccgggaggtggagcttgcagtgagccgagatcccaccactgcactccagcctgggcgacagagcgagactccgcctcaaacaaaaacaaaaacaaaacaaccaaaacaaaacgagaaagaggtttctgattggttagagaaaacttcttccagaaaaaaagacctagaaatagcaaggatgaagtggctatgagaagatctggggtgacagccttctaggcagagggcacagccaatatacaggctcaaggcaggaataaacatgttacatttgaggaataagaaggccatcatgactaaaggaacagtcctaggtgaggctggaaacatagacccgccagattacatagggccttggatgctatggtcttaagtatgggctccttctactccattttatacactgttgccaaattaacactagaataacaacatcattcagatacctcttctactcagaaacctttccacattccccaaagcccccaaatatccctattcaaggccccccataatctaacctctacctacttttacagccttttgtctcatatcctggccaaatttttgactccaggaaaatgaacccacttgctagcccctgcacacaccttatgtatatcgtcacttcataccctttccttcaccttctttacattttttatcaaagtaatatgtttggaagtcaaatagtatttaaacagctttttttttttttttttttttttttttttgagatggagtctcactctgtcgcccagggtggagtgcagtggcacaatctcggctcactgcaagctccgcctcttgagttcacgccagcctcccgagcagctgggaccacaggcgcccgccaaattttttgtgttttttttagtagagacggggtttcactgtgttaaacaggatggtcttgatctgaactcgtgatccacctgcctcggcctcccaaagtgctgggactacaggcgcaagccaccacgcccggctttttttttttttttttttttttttttttttttttgagatggagtgttgctctgtcgcccaggctggagtgcagtggcacgatcttggctcactgtgaactccgcctcccgggttcatgccattctcctgcctcagcctcccgagtagctgggactacaggtgcctgccaccacacctggctaattttttacatttgtagtagagatggggtttcaccgtgttagccaggatggtctcgatctcctgatctcgtgatctgcctgcctcggcctcccaaagtgctgggattacaggtgtgagccaccgtgcctggcccttaaaaagctttttaacaaaacagcagtcctccttattggtatagtggtgagaaaaacaaaacaaaaaacccgagcaattctttgtcctatttccctaccactcttagtacttttttttagctcataatacttgttcttgatttatacattttagacattgcttattgatttccaaatttgattgatgattctctgtcttccaccttacccttccctcttaaaatagtgaaagcacactttttggctaagtcaatatagtacttagtagtgaccttattttgactatgagcaaatgttcaccgctaagtcatgtggagttttttttgttttgtttttgtttttgtttttgatggagtctcactctgtcgccaggctggagtgcagtgatgtgatctcagctcattgcaacctccacctcccgggttcaagcgataattctgcctcagcctccgagtagctgggattacaggcatgtgccaccatacctgcccaactcatttttgtatttttagtagagacagggttttaccatgttggccaggatggtctcaatctcttgacctcgtgatccacctgccttggcctcccaaagtgctgtgattacaggcatgagccaccgcgctggcctcatgtgtgttttataatcgtttcctttacaacttttttgtttcctctgactttaatcattgccttgtgttttcatttgttttaatatattatacctatcattagtttttcccatgtaatctaatagtttctcaatacacattttgttcattcagtcaaagctattagataatccatcagttcaatttttccctggaggcttccatctttttttttttttttttttagatggagtctcactctgtcgcccaggctggagtgcagtggcgagattccggctcactgcaacctctgcctcccaggttcaagtgattctcctgcctcagcctcccaagtagctgggattacaggcgcctgccaccacgcccagctaatattgtatttttagtagagacagggtctcaccatgttagccaggctgatctggaactcctgacctcaggtgatcgctcgccttagcctctcaaagtgctgggattacaggcgtgagccaccacgcttggtggaaccttccattcttttgctctggtctgcaccgccggctatctcagcctgtgcacagctgtcatcctgggacttctctgcatcctcaaaattccctttacctgtctctgtgttgaatctgtttcctggatactttactcctttgttttatttacctgtttattgagacaaggccttgctctgttgctcaggttggagtatagtgaggtaatcatggctcactgcagcctcaaactccttggctcaagcgatcctatcgaagtgctgggattataggtgtgaaccaccgtacccagccaacaataaattcttgaattaagaccaggtccatgcctgtaatcccaacgccactgcactccagcctgggtgacagcgacactccttctcaaaaaaacaaacaaacaaaaaagtagccgtgtgtggtggtaagcacctgtaatcccagctactcaggagactgaggcacgagaatcgcgtgaacccgggaggtggagattgcagtgagctgagaccacatcactgcactccagcctgggcaacagaacaaaactcagtctaaaagaaaaaaaaaaacggaaaaatggtaattaaaatgttctttttttttgagacagagtctcactctgtcactcaggctggagtgcagtggtgtggtctcagctcactgcaatctccacctcctgggttcaagtgattctcgtgcctcagcctcctgagtagctgggattacaggtgcacaccaccacatgcggctaactttttttttctttttttttttttttgagaaggagtctcaccctatcatccaggctggagtgcagtggagctatctcggctcactgcaacctctgcctcctgggctcaggcgattctcctgcctcagcctcctgagtagctgggattacaggcatgcaccaccatgcccagctaatattttgtatttttagtagagacagggttccaccatgttggccaggattgtctcaaactcctgacctcaggtgatctgcccgcctcagcctcccaaagtgctgggattacaggtgtgagccaccatgcccagccctaattttgtatatatttttttgtctttgtatgagattttattaaaggtctttacagagcaacatccagactccagaatacagctgctaaggagaccctgttatgctgtagggactggctggggcatggcaggtggtcaggcaggggcttcttagggccagtcttaccagttgggtcccagggcagcatgatcttcaccttgatgcccagcacaccctgtctgagcaacacgtggcacacagcagtgccaacgtagtagttaatagggtctccactgtggatcgtcaggccatccacaaacttcatggatttagccctctgtcctcggagtttcccagacgccatgaccttgcagcctttggccccactctccatgatgaaccgcagcacaccatagcaggccctccacacagcaagccctcctaggagtttgtaacgcagagactctgcctgggcaatggcacacagacctctagtggcaaccttttcagcataaagctctacactgccctctggaaagccaaacctcttctgaactatagcagtcagttcccgaatccgtcagcccttctcaccaggaatattctgtgttctggtggctaagataatgatttctgtcctggttggtgtaacttgcatctcaactccagagtagccatcttcagccagctcctgagtaagaaactcattcagttcagctttgaagatgtcatcagtgacaaacatcctcttcttggaaatttgcacagccatcttgccgccacgctccactgaaaggaaaggcctaattttgtatttttaatagacacagggtttcaccacattggccagtctggtatcaaactcctgggcttaagttatcctctgccaaccttggcctcccaaagtgctgggattacaggtgtgagtcacatcacacccagccttttttttttttttttggaggcaaggtcttgctctgtcttcctggctggagtgcagtggtgtgatcatagctcactgcagcctcgaactgggcacaagtgatcctcccacctcagtctcccgagtagctgggactacaggcacacaccaccacccttggctgataatttaaaattttttgtcgagatgggatcttgctatgttgcccagctggtcccaaattcctggcatcaagcaatccatctgccttggcctcccaaagggctgggattacaggcatgagccaccacgtccagccgatttttcctattctgtttccgcagcccagtagatgattttgggccttatggattgatcctttactactttttttttttttttggatagataatatattcatgattcaagattcaagaagtatgtaagaatggaaatacagtgaaacgttaccctgctatttggtcctcgaatcctccaattctcaagagaaggaattagtttacttatttttaatttctaagaactctttcttctccaattcttcctttttaaagtacttcatagacacaatatcttttctttgagttttgagaatagttattgtagctttttccccatgaagttttcagaaagctccctactttgttattgtttccttggtttcaattttctatttgtttgttttggtctttcatattggaaggttactcagatgtttaatggtcctttgctgtctattcatatttaacagtgagataccaaaaagtggattggaagctcagtctatttacaagctttattattaatgaataggcttcactgtagggtgatcatgtggggggaaagctgacattttgttgttgaagaaaccaaaaatgtcagtgtcagtatgcataggcatttttttccctgcagttgtttcttttcatactggaggttctgtcagtgtgtgctgatgttgagtctcaccgctcatatattttcacttaattcttcattttcaatctaatacctcacctctatccccactatgcctgctgctgaatgcagaggctctgatagtttaagttcccctggacattctgaaatttcatgggctttttcattcattatgctgggcactcatggacagttggtctggaaacttgtgacctttgggcttaggaaaccttaagtctatctttgctaacttcctccctaccatttctccagagacggaatctcccattttatgcaagggagtaggggtaatcacttggctggatcagatgaggttgggacttggtggggctttttcttatacagatcatcgtgtaatctccttccaccccacccctagttctcagcgtcagtccataccctcctctgaggtgctgaaccttttatgggttcagaagggcacattggcttacttcttgccattaactccctcagcaggtagaacccaactcattctactctgttaagtgactgttgactgttctgtttttcatcttccaaaatgttggcatctctcattcattgtcacctcctattttccttatcactgggtcatgtggctttattattatattttttgagagtttcgctcttgtcacccaggttggagtgcaatggcatgatctcggctcactgcaacctccgcctcctgggttcaagcaattctccttcctcagcctcctgagtagctgggattacaggtgccccccaccatgcccggctaaacttttgtgttttttggttttttttttgagatgaagtctcgctcttgtcccccaggctggagtgcaatggcgcgatctcggctcactgcaacctccacctcccagattcaagcgattctccttcctcagcctcctgagtagctgggattacaggcacctgccaccaggcccagctaatttttctatttttagtagagatgggggtttcatcatgttggccaggctggtctcgaactcctgacctcaggggatccacccaccttgacctcccaaagtgctgggattacaggcataagctaccacgcctggcttttttgtatttttaatagagacgggggtccactatgttggccagggtggtcttgaactcctgacctcaggtgattcacctgcctcggcctcccaaagtgctgggattacaggtgtgagccactgagcccagccagcacgtgcctttttaaaataattcctttactggtatttcaatagaatttttggagggggcataaaggctcatgtgtttaattttccgtatttaactggaaagtttttgttttgcttttaatgcatgcttccagcctcttctattttttaggccactccagcatcaaatttctgtaaagccttccctaatcaccctaactggaagtaatctctctttctgaaaaagctctgtagactacttctgatttctgctatacattcagtacagatacagggatgtctcactgtactaggtccatgccataatgccagaatcttcatactagacactagatcctatacctaacaagacagaaactgagatttactagaaaattaagccaaaccctggccagcctgtcttttccttttccagtgatgccttcatacccacaagctgacttcagtcagcccatcctcagtttatatccttttttttgagacagagtttcacttgtcgcccaggctggaatgcaatagtgtgatctcagctcactgcaacctccgtctcttgggttcaagcgattctcctgcctcagcctcccgagcggctgagattacaggcacccaccaccacgcctggctaatttttgtatttttagtagagacagggtttcaccatgttggccaggcttgtctcagactcctgacctcagctgatctgcccacctcagcctcccaaagtgctgggattacaggcgtaagccaccgcgcctaggccagtttatgtctttctatccaactaaaatgaataaaggcaaccatttgttctgtaacatctgggacggtagggatgggggggtagagcatcacttgttacaacagtcacattagccaccgtttaagtaccactaaaggaaattattattattatattgttttgaggcagggtctcgctccatcaccaaggctggagtgcagtggcacaatctcggctcactgcaacctccgcctcccaggttcaagcaattctccctgcttcagcctcctgagtagctgggatttcaggcgcctgccacaatgcccagctaatttttgtatttttgtagagatggggtttcgctatgttggtctcgaactcttcgcctcaggtgatccgcctgcctcagcctcccaaggtgctgggattacaggcgtgagccactgcacgcggccagaattgttgactcactctatatgaagacaaggaactcaaaaagaaaagacagaaaggcatgtctcttttggttaaggttaaagcaatacagcaaagtaacaagctccaggtcaagagtccaatatcacacctggctctgtcagttactagctagggaagctctgtgagcttcaggcaccttatctgaaaatggggataagacttcatggggctcatgtgaggattaaatgaaacaatatgtgaaaactgcttgcctgtcacatagtaaacactctcaagggaaagcacccttcacatggccttcctgtgttcttgggacctccattactggctctgggttatatttgtctgtggggccaattttcccttcactgaaacacaatacgctgaaggacagagttctggattctgagggtcaagtccttagctttacccctcaagagtcatgtgaccttgagctgatttccttatttctgatgaagcgtggcccagcttcctgacagaacgagtaccagatcaactggaaaaggcatgtgaaaggaactggcatgtctaatgggctttacatatggttggcaacataatcctctggcagaaaagtgttcaaaatgggactctatggaaacgggcttaggcacaccaccccaggatcacaagttggtccacagaggctggaaaagaacctccgccctccactacccatgagccatgggaaaggttaattagcaaggtaccacagtaccacctagtggctggcacacccgtcctccctctcccccaggtgttaaggaaaggctatcatgtgattctggtcacatacttcactggctgattagtcagggatggagacaaaccaaatacaccactctctcttttaatattaacatatacaagcagcagaaagagccaactgctctctgctgttccctgagggaaagccggagcacaaagctgttcctctggccttcctccaactgccgggcctgcttagctcctccctaggcagaagctttgttccagccccacttccacatcccaactccacagtcaggatgggaggcacatggttgctagcaggggaaagaatactgtagttccagcctctgctcctttcagtctcagcctggatggtggtcactcatccctctgcagctagttcctcacttgtcccagcccaggagccaggagggcactcaatcacacccaaaggagcaggcagtgtgacttcagtcatcttcagatgactcctcttctgcctcttttagccactggatgaacctctgcagctgtaaagaagcagaggagagatcggctgggggaggtgcacataactctcctgctcccctcggcagataaacagctctaacaaccagagccccagaaaccaaccaccctagagtctaggggccaggacctgggaatgagataaccatcttggcgagaggaggacagcctgacgcacctgttgattcttgcgcaactgctggcccttgtcagttgtatctctttggctgaaccagctcagaattgtttcctcagccaggatctccagctggtagaaagccatcagtacctgcaaaaggccaataaaggggacctcaggggccttggaaagtccagcaggatactctaccaggccctcagatccctctatgcactgagtagcctcctccaaaacggacaagagtgagctgttcgctctgctcctggggcaggtctaacttctggaactattgctggggagagctttgcacatttccagaccaccccccagatggctaccttattagtccggctccaagctgtactattctagcaataagcatattgggagtggatggtccatactggattcacattagcttctattttatgtctcccaagggggtcaccaaccctcgtttgaaagcaagtgcagaagaatggggcttgaggtcatattcaccttggccatggaaataccaagagcttcatgctctaggaagaagtcctcaatggctgctaacgcttccaaatggtcggctgcgcgctttatgtagttcctaaaaacagggctccaggcctttagcagctatggaagaaagaagggagctgcagtatattcctaagcattcacctatacctggacatccaagcaaatccatactgatgacatgggtggacaaaagggagatgatacaggttctgtggaattatgtcagagggacttgggagttgttgacagggtttgggaaaaagagattccttagggaaggtgaaaggggatcagatgctataggctgcctcaaaatacctattcccaccccagaggctgatcttgtgttgggtcaaattgctgccatagagtctgaatgtccaggtccattctgaatatacctttgtgggcctaggatggtatgaaatcctggagtctcaaaggccagtcagtattgaactcaatctgacccctctgaaccagccaaggctgctctagagcccaaccagcttccagaggcaaggaaaaaggaaccagaagtgacatacacccaatataacaagacagtctactcctgatttcctttgcctgtacccaatcccttgtactcagctccaatctttgctcacaggaagcagcagggcacagtagcggcttgagtcaagcggggaatccatctgttgcagggggaactccaggaccacgtggctcagtacctgcatcacctcctttagacttatgttataggcatacctgtggggagactggggtgacaccagggccttcactggcctttcagcaggcttagaactatgactttgatagacattggagaggaatctggatggaacaatatggaaggggagggtttaggaaggagaaagtctatgctgaggctagaacttaataatgctctccttgctccaaatactactggtctttccatttgggatgtcgaaggaataggttcctatttggagacaaaacacttacgagaaagcctctaccttcccgggatcaccccgaggagaacagggaggggctgctcttacttgagagagttgatttccaggacgagattgtcacaagaaatgttctcctctttgccccgctgtagtgttcctaaaacttcattctggaacactgaaatcaaagcaaggataagttcatgggccaacatcattcagaatgctctaagtcatctagtcttgactcgataccaaaccctttctgaggaacgtaagcctctggctagttgatccaggcagagaataaactggtccagcgcatttctcccctgccactcacctttgatgtcatccatctgaggggagcctccccggctgtccggctcctcagaatccatactttgctcactttcactttcactctcttcttccatgttgatcttgattcctcctcttcctccatgttcatgcctgcagctttccagaggtagcccttgccagcagctcctacttctgctggattgtaacctggaaaaggcaatgatctatagagagggcccggcggaagcaccaatccctccaggaggaaacactggttcttctatgaggcagcgagacacacagatgccccacacctgttgagtctcacacctttcatcttcactttgtccttttcttggtcagccccagaatcatcactgaactcgccatcatcttcatcttcctctgcatctggagggtgcaaagagatcaccgagccctcaggcagcgtgatatttgggcccacgaccacctaaggggaaaaaaaacacagaaccattagggtgtggaggaaaagtgcatcctgataatgagagcaacttttttagacaggattatgggtggaaataatgccccttctggctcagtgtgactgccatgcaattcagggcctgtgcacagtatagatcaggtctcacctgggaagtgaggacagagcgtggtttcagtgtcactcgttccttgacctcagcattgtcacaaagcagagactgatggatctgtgctccagccgccactcgaacaccctgccacaggtaggtctggtccagcaccacgttatcacctggctcaggatgggaagacctctgggtaactcagggttccaaccgcagagcagagcccttcatagaggacagggctgactgacaccagcacagctcccacctagctctcattccccatcccgcaagtcaccagaaacacccactcaccccctaagcccaggcctgagaagatacttcaccaagtttacaacaattatagactacacacagagcttaagaacccgagaaccttcaggatttctggggaccctctgaactcaaaaaaccttattagaatcatatccacgcctacaagcagaaccaaataattccacctcttctggtacattttagaaaccaagtcttttttttcttttgagacacggtctcattccatcacccaggctggagtgcagtagtatgatcatgactcactgcaccctcgacctctgggctcaggtaatcctcctgcctcagcctcccgaatagctgagattacaggcacgcgccatcatgcccagctaatttttgtatcatttgtggagaaggggtgtcgctatgttgcccaggctggtcttgaactcctgggctcaagcgatcctcccaccatggcttcccagtgtgctaggattacaagcatgagccaccacgctcagcccctagaatctgagccttactgttgttcttggaaaggggcagtactattagacgcatcacactcctgcaaccaaaatgagataccaagaggccaaccaggcagttatggtagactcaaaagaacactggacttacattcagaatacccagattcaggtcccaccattattaccaatgaccttgggcaagaaaatcttgttgagcctgtttatttgtaaattatgaagattaaatgtaacaatgtatataaaagccctttgtaaactgtaatgtgctaaatagatgttgttactgcatgttaattatctacttgctcctgaatgtgactacagggtaccctggaatgtgaagagtcatccaatgagaggcccacaggctacaaattaaggtatcgctgttttcaaatccctgtttcctcctttcctgaggtagccgctctatagttccttattcccagggactgtcccttgtgtagccatcccttgtgtttctggagacgtggcccccccaggttcctgttcctaggatagttggcttgattccccacctgtgctcaccaatgtggcagccggggccaatgacactgttggtgataaagcaattgctgccaatgacagtgccagagcccaggagcacattttcctctaggatgctgccatggcccaggctgacctcaggccctcggtagatgttgtgccgggaatgagtgcagctctgggtggtgctgtcagtgaagttcgcctctggggtgagagggtagacccatcggcggatgacgtcagcacagacagctgagtacatgtgtaggttggagacacgggcaccatattccttagctgttacgtgcatgtggatctggttccctaggatctgaatgagaaggaaagggaggtcacctaagcaagaaagacaggaagaatgcccccaagtacaacttttctaatccttttaagttcccctctgcctctcactgccacaaagattcttctttgtgtactgttcctcctgtcccctgcttttcctccctcctaagcctcaataaaatacaaaaaagatcaaaagttaccagcatgagatacaatcatagccttctcctctctcctaaagaggcattggaagacttttctcacctcctcattcactaagagacctcgcacaaagtcatctcgagtttggtagtcaaagttgtctgtaaagagttgtgccacctgtggaagggaagtggagtgggctagaattaagtactattcttttttttttttttttgagacaagtctagctctgttgcccaggctggagtgcagttgcatgatctcggctcactgcaacctccacctcctgggttaaagtgattcttgtgcctcagcctcccaagtagctgggattacaagcgtccgccaccacgcccagctaatttttgtatttttattttttagtagagatgggatttcactgtgttggtcaggctggtcttgaactcctgacctcatgatccactcacctcggcctcccaaagtgctgggattacaagcgtgagccaccacgcttggccaggattaagtactattctctaggagcacagataatcccccagagacctagcaaaccctatgacagctgaacatggaccagaattccaaagagactcccagtgggatactggagacaagatctttgctttacaatagattctaaaaaaaaaaaaaaggccaggtgcagtggctcatgcccgtaatgccagcactttgggaggccgaggcaggcagatcacctgaggttgggagttcgagaccagcctgaccaacatggtaaaacctcgtctctactaaaaatacaaaaattagctgggtgtggtggcacatgcctgcaatcccagctatttgggaggctgaggcaggggaattgcttgaacctgggaggtggaggttgcagtgagctgagatcgcaccattgcatccagcctgggcaacaagagtgaaactccgactcaaaaaaaaaaaaaaaaaaaaaaaaaaaatgctgggtgcagaggctcacacctgtgattgcagcactttgggaggccaaggcgggaggatcacctgaggtcaggagttagagaccagcctggccaatatggtgaaaccccatctctactgaaaaatacaaaaaatagccggatgtggtggtgcgtacctgtagtcccagctacttgagaggctgaggcaggagaatcactggaacccaggaggtggaggctgcagtaagctgagatcatgccactgcactccagcctgggcgacagagcgaggctccatctcaaaacaacaataacaacaacaacaacaaaaaaaactggtggctcatgcctgtaatcccagcattttggaaggctgaggtggtcagattgcttgagctcaggagttcgtgaccaggccggacaacatggcaaaaccccgtctctacaaaaaaatacaaaaattagtggtagtgcatgcctgtggttccatctactcaggaggctgaggcaggaggttcccttgaacctgggaggctgaggctgcagtgagcagtcatggtgccactgtgctccagcctgggccacagagcgagaccctgtctcaaaaaatatatataaataaaaatgaaaataaggccaggtgtggtggctcatgcctgtaatcccagcactttgggaggctgagacaggtagatcacttgagaccaggagttcgagaccagcctggccaacatggtgaaaccccatctctactaaaaatacaaaaattagccaggcatggtggtgtgcctgtaatccctgctactcaggaggctgaggcaggagaatcacttgaacctaggaggcagagtctgcagtgagctgggatcacaccactgcactccagcctgggcaacagagcgagactctgtctcaaaaaataaaagtaaaaataatgaaaataaacagggagaagaaatataccctggccttctaaggggacaataacagacccacagagttctactctttgggtgtgcagccccagccctaaagagctcacctgaggagaacagatgctgatatgacaatccagtaaatcatatcgaacctccactccatcactactgccctgaaacaggctctgtggggagaagttacaaggactttaatttgtttctcccactgaagcctgtcacttccccatctcaaaggaccccagatatccacacaccagaggaaatgcaaaacgccggagaccctgggtcttctgaaaatggagaaccctgtttgtggtactatccacagccactaccacattgtcttcgtggcaacgagttgggtggctgggggatgactccttgaagatcatcgtcatcacagaaacatttttttctagcttccgtctcaacctataaaggacaggagggacagaactgcaaaaaagcagtctcagggctctgctggtctttaacccttgttcctgtcattttcccatcctgacctgtgttcctcaagggctctggtgatattgatgtttgagatgacatccccatacaccagaagaaagtcagagcgcaccaaagccttggcatcaacatcacggaggacatctcccagtgatcgatagagctctgatgtaattattcgaaccacattgagagatgtagggcggcaccactttgacttcctaaaggaagggagggtgaggggaatgagtgtatcaagcataaagatcatttgagccttccccatttttcaccccctttcagcactcacagtccttctcgatggcttttttgggttcttgccagcgtcttcaacttcaaagagtattatgaactataatgaatgctttcagcatcctgtgtcaccagtcttgttttatgggttaggaaacatggttatttcctctccataccttgaccccttgtccctaaacatcaatttgaactcaaaatcctgctgaagcctagggtacacaaagtagcctgggaacacgcttcacgtcagctttccccttctgcaatccatataacatttaggaactgtctgatggagaccatgctaatgtcctagtctttacatcctggacttccataagcaatgcgattccctagttttcaagatttcaacaaacatgtaagtgctcactatatgcttgggactgagctaggcagtgggaatacaaagatgacaaggagctcatttatatccttgaaggtgagaacaaacaagatttagaaactcagtgggaaaacaaagatgttatcattgtaacttccatactgaagccattaaataaaagcaaagtccactggcaccaaactttataatgagattcagaaaaaacccaagtttattctttaatctttgtcacagaaaacccaagacagacagatacaaagtttcagctgctcacctcctgataagtgtagaaaatacccttagaacttacaatgacatctaagtagacacatttttcccctctcacatttccccttagttacattcatcctgaaaaaactggaaaaagatggcgaaacatggaaagaaaagttgcagggccttacagtaaatgttctttgatttgagcagctttccagcaacaaaagacaaatgtttcctgtacacctgtggcagtcaggaattccagagtgtagtcaattaatgccacattggccaggggcaagaggacctgaaggatacaagatgaaaaaaaacttgaggtctcgaatccctttgggtaccccactgcaacaattttcactcctctattcgtatttccaaacagtgtaattttgctgtatctttccaattcaaagataaacaggttcctgcctttgatgttcatgccatgctctaagcctgagtctgagacattgcaatttggggatggtaagtacagaatctatgtgccttgtatcagacacagagctgtgacagaatggcagttcactgctggcaaaggataatactggaaatcaatcatatttccataaatttaagcattgctaaggccttcttccccataagatttccttccttgatccctttctaagtgtcagaggttagccatctcccgtcacttgtcaaaaatgaacagccattaggctttttcgagggaattagagaggattttccttaaatccaatgcagttccctctttctgaactgactgctgaacgacccagctgagtccaataccccattgtctagacaactcgggggctgatggcaatcaaccactaaacccattttgtcctttcgacagatagcaccggctatcattagaacctggaaggaaaaaaaaaatacactgcctgagatctagcccgctctttttaaggcatattaccgccctttcagaggcaaaaggtcgtttcttttcacctaagcaaccgtcatcggcaaggttaaaagcggcgcagcctcttctaggggcactgaatccccgcgtgaaggcttctctcaagcgctgtttctacatttagctctcttcattcctttcaaacccgaggtggacagcattacgaatgcccaaatctgccggccactaacttggtcagcagtcatcagggtttagacagtccctctgcatccggttttaggataacagcatagacgcaggtccttcaagggcatgctgttgtagttagccgaaatgagaacttgctccagccctgccacccttcctgccctctggctgctcgcgtgcgcggcgctcacccgaggctggtccttggagatggggaagaagcggcgatcgaagctatcggccaccagaactgcttgtaggggcggcggcggttcctcctccgcccctctggctcccccgccaccgctgcctcccggccccgcgccgctgcgcttgttagcccgactaaccaccacaccaggcggcgccactacaggggccgccatcttcttctctcacggtcaccacttccgcaaggaagctgccaccgcacgcagtaggggacaaaaaggatccagcacttgaaatgcgatggactaattaacgaagggaaggagacgaggagggagcagtgcgcatgcgtcttccccgggagcccacaggggtctgaggttgatcccggaggcgcgaggagtcggtacgggtcacggttgtcccggcccctgaggcgcagggtaggagtggggtcccatagatgtcagactcggtctgcaagtatcgtcggccttcatttgtaggtgaacaagccgagattcttgtggcgtgataggacttgtggtcgccacgaaggggccagctccatcgggaatctgtaatcgcccagcagtttccccgccccgcgcatgtgaaatatgtagccctccgtattcattctagaaacttctgggaacccagcgccttggggagatagaaccgagccagatgttcccccgctgcgaggaactcagaacctgcataaatagagaaggtggcaggcatatagtagggagaccagtaattccattgagcgctgattttgggccaggcacgatacaagcattatctctgcaaaacatcttattcattcgttcagcaaacgtttcttgaactctcagaaggatgaaggaagtttacccagctagtaagtggaagaactggtattggaacccgatctgtctgactgcagagttccacaatcttgctgccaagttatgtggggataacaatgactattttatgtcatctattcattcttccagcctatcagcctcctgtgtcttaagcagagtggagacgggggtggatccaggcgcaccagttccacgccacaggcttctgcagttcctgcaaactgttcccatcccgccccgcgttgcacgtcgggatttggagttcgcgatgctgagagctgtttccacgtggcgattccgacttgacccgtcgtgctccggcgcccgcctagggggaccgaggagtttgtcatttcttgcctcgttagggtgcggaacgaaaaccatttgatttatcctagaaaaggaaaggctgaagccaactaagtaaaagttttccattaaatgaatgcacgttgtagaaaaggaatgttcaactgccctacaaatccagaggtagaaatgggggaggggagaaggaattaaataggacacacacacacacacacaaacacacacacacacacactcttgggggggtgtttgggtatggaaagtaggtccgattgcagaatttattttaaatgattcccgcaaccttgggaagttgggaagtggtgaatccgctgccgaaaggcatttgtgcttatggtaaatccaggtcttaaaattctgtagactggtagctatatggatatgattttaatagacgagtttcaggaagactctctcaaactgttttttgttgttgttgtttaaaaacttacttgaaatatattggaaaccacatatacataatctctcacacacactacataaagaagtaaaaattcctttccctacttctttcatcctatccaatttgtagagtcataaccattcttaataatttgatgggtattcatttcttccctaaatttatatgtctagaactagagctagagtgtatgcctacatacacacacacacacacccatacatatatattcaaacataatatatgtatatccacatgtattcaaacacagaattatgtttagataattatggttatatgctggtatgccagagccagactgcctggcttcggttccaggccctagttggatagctttgggctactcagcctctttatgcctggacttcttcatctttgaaatgggataataataatacttatcccataaagttattgtgagaattaaatgaaataatatatgaaaagcccttagaacaggcattgacacattgtgaaggtaatgtattagctattttgatgattatgcattttgtctgcaacttgatttttatttaacatatgtgggaaagtagacaaacatagccattttcaatgattccataatattccatagcacgagtataccattgtttatcgaaccatttctctcttgagaaacattgcagattttttttgcagtttctacgattacaaataatgctgcaataaacatctttctacatatagtctttataaatttgcgtttatttcttagaatttattattgaattagagtaactggttcaaattggatgcaattcccatggcagaaggtacattgttgaactcactggcaagcctgatgaggcactggtggaattcatggagatactgcttaattgctctccctggacaatgtgtcattttgcacttacaccagcaatgtatgagagcgcctgtttccccatagcctcaccaacagagtattttgtcaatagtttggagtttctgccaatctgtaaaggaaaataagtgtagttttaatttgcatttctctatttcagtgaggttgaacattttttcatatatttggtcaactgccagttctggttctttttctttttttttttctttttgagacagagtctcactctgtctcccaggctggagtgtagtggcacgatcttggctcactgcaacctctgcctccgaggttcaagtgattttcctacctaggcccccctgaatagctgggattacaggctcacaccactacacctggctgatttttgtatttttaataaaggtggggttttgccatattggccaggctggtctcaaactcctgacttcaggtgatccacctgccttggcctctcaaagtgctgggattacaggtgtgagccaccgcacccagcctctttttcttttcttttctttctttctttttgtttagaaacagggttgtgctctgttgcccaggctggagtacagtagcacaatcatagctcactgcagcctcaaactcttgggctcaagcagtccttcctcagcctccagagtagctgggacaacaggcacctgccaccacacctaagttttgtagtttttgtagaaatggggtctttctgtgttgctcaggctagttctggttctttctctgaatttagatttcaaaatgagtcttgaatatgaaatcagtttagaatataatctctgtgggccttctgtttattttattcactactataccccaggtacctagaagagtaactggcacatggcagatgctcactaaatatttgttgaacgaatgactggttgttgctagtcagtaactgagtatgtgatcaactgtagacaaacaaaagtaattcctgactctcccaaggctgaggctgtttttaaaagattatggtaaaaatacaacaaaacataaaagttatcatcttaacaattttttaaccttggcatggaaaattgatcgaagttggccatttttaagtatacaactctgtagtgttacttatgttcacgttgttgtgctaccatcaccaacatccacccacagaactcttcattttgtaaaactgatactctgtacccattaaacacaatcctcatttcccactcagtccagctcctggcaactaccatgccactttctgtctctgtgaatttgactgccctaggtccctcatataagaggaatcacatagtattttttttgtatctgccttatttcacttagcataatgtcctcaaggttcatccatattgttgcatgtttcagaatttccttccgtttaaaggctgaatgataatccattggctgtagataccacattttatttatccatttatctgtcaatggacacttcttcggttgtttcccccttttgctattgtggataatgccactacgaacgtgatcgtacaaatatctgttccagtccctgttttcactgaaataaatggaactactgtatcatatggtaactctacatttaattttttgagaaattgccatactttttttcatttttcttttcttttctttttttttttttttttttggttttgagatggagtcttactctgtcacccaggctggagtgcagtgacacgatctcggctcactacaacctctgcctcccgggttcaagcaattctcctgcctcagcttccctagaagctaggattacaggtgcacaccactgcgcctggctaatttttgtattgttagtagagacgggggtttcactgttttggccacagtggtctcaaactcctgacctccggtgatccacctgccttggcttcccaaagtgctgggattacaggcgtgagccaccgtgcctggcccccattttttgagacagggtcttgctctgtcacctaggctggagtgcagtggcgcaatcatggctcgctgtagcctcaaactcgtgggctcaagcaatcctcctgcctcagcctcccatagtgctgggattataggcatgagtcaccacactcagctgccatatatataatttttacagcagatgccccattttacattcccacctgcagtgaacaagggtttcaatttcttcacatccttagtaacacttctatttttttttcttttttttttttttgagatagagtcttgttctgttgcccaggctggagtgcagtggtgtgatcttggctcactgcaacctccacctcccaggttcaagcaatactcctgcctcagcctcctgagtagctgagattacaggcatgtgccaccatacccagccaatttttctatttttagtagaggcagggtttcaccgtgttggccaggctggtctcaaactcctaacctcaagtgatccgcccgcctcggccccccaaagtgctgagattacaggcattagccactgcacctggcctgttttcttctaactttaagtggcacttttcccattccaaaattctacttataaatatattaaaataatggtaggatatgtccccttcagggcacccttgatgcgtatacaagagctggctttttctaggcactgctaaagagccagggctctggtgacaggaagcattaaactggtggagcaccttgagggtaagtcttggggccttttgtgcttctcagctgggctcacttgttgcttagtggaccaagcttgttcactgctgtgagtatcatttatttttctagttactttgggtctgcagtagtagttgagttctaaatatactatgggatagctgaggtccgtgtcctaggttgctagaaaatgacagaagaaatacagttctggactggatatgtggctcacacctgtaatcccagtactttgggaggccgaggtgggtggattacctgaggtcaggagttcgagaccagcctggccaacatggcaaaaccccatctctgctaaaaaacaaaacaaaacaaaacaaaacaaaaattagccgggcatggtggtgtgcacctgtaattccagctacttggaaggctgaggcaggagaatcacttgaacctgggaggcggaggttgcagtgagctgatatcacccactgtgcctgggtgacagagcgagactctgtctcaaacaaaaacaaaaacaaaatcaaaaacaacaacaacaaaaaacaactgagttcttccctgtttttcttagcatgtccagagatatacctagtctccagggtataacaattctttttgtcttctaggctgaggtttgagggaaaaaatgtcctttaagttttatccatagtagagttgaaacaggttgggatttttcagaagagactttactcaaaatcctaagggaagagaagggagaaaaaatgaaaataaagtcattaacaataaatacactactttggctgggccctgcctcatgagaggccagagtggcttgtggagtttggcaacaccgccccccctagaggtaattgctgtgctgcgctccaacctctccaacaattgttagactcttcagatccctgttgatacagagcattccaggattgtgaagtgggagccagccacatccatgatgttcatggagcctagaagagccctgtggaaacaaattttacctggttacactgagatccagacatgcacagaccagccctcttgaagagagcttgagcttcctgactggggctggaatggagagagacaatgaagttcctgagagtattgccaggagaaaaaggtgtggctgaatggatcagccgaaacatcaggggcttgaatccagagggaggatggggtctcgctatgttgctcaggctggtctcaaactcctggccttaagcagtcctcctgcctcagcttccaaaagtgctgggattgcaggtgtgagcatctgcacctagccaacaatcatttattgtatatttcacagtagctagaagagaagggttgtaatgttcccaacacaaagaaagatagggctggccacagtgg

SEQ ID NO: 3282 - DNA, 673 bp, Homo sapiens
agattttattaaaggtctttacagagcaacatccagactccagaatacagctgctaaggagaccctgttatgctgtagggactggctggggcatgggcagcatgatcttcaccttgatgcccagcacaccctgtctgagcaacacgtggcacacagcagtgccaacgtagtagttaatagggtctccactgtggatcgtcaggccatccacaaacttcatggatttagccctctgtcctcggagccatgaccttgcagcctttggccccactctccatgatgaaccgcagcacaccatagcaggccctccacacagcaagccctcctaggagtttgtaacgcagagactctgcctgggcaatggcacacagacctctagtggcaaccttttcagcataaagctctacactgccctctggaaagccaaacctcttctgaactatagcagtcagttcccgaatccgtcagcccttctcaccaggaatattctgtgttctggtggctaagataatgatttctgtcctggttggtgtaacttgcatctcaactccagagtagccatcttcagccagctcctgagtaagaaactcattcagttcagctttgaagatgtcatcagtgacaaacatcctcttcttggaaatttgcacagccatcttgccgccacgctcca

SEQ ID NO: 3283 - DNA, 9619 bp, Homo sapiens
gtcaagcgtgcggcggcggccgtggaaggtggggttggccgcctagggtcggcggtgggctcggtgtgggatagccggcccggtccgacgcgctccgcgaggtcacgcgagacactcaccgaggcatggcggcagggcctgggcatgggaatcgtgcgcacagtgcgaggaagcctcggaggggatacgagcacagggcgggtggttaggagaatggggctggagagacgggcgggaggggcgggacctgggccccggggacctgccggctcccaggccccaggaagacgctgctcatgcgtggagcggccgcaggaaaggtactccccgctaaggccttcagggagcggccctttgccctgtgcgatctcttccttcctttcccacgggttgccaaatcctgtgacgctgccccttctctggtgcttctcagatgctctggtcggttgaaatatggccagtccacctgagacgggctgtgagtgcgcaatgcacatcaaacttctaagactgagtgtgcggggccgagtgcggtggctcacgcctgtaatcccagcactttggaaggccgaggcgggcggatcacgaggtcaggagttcgagaccagcctgatcaacatggtgaaaccccctcacctcccgtctctactaaaaatacaaaaattaacagggcctggtggcgcgcgcctgtaatcccagctactcgggaggctgaggcaagagaatcgcttgaacccaggaggcagaggttgcagtgagccgagatcgcgccattgcactccagcctgggcaacagagcgagactccatctcaaaaaaaaaaaaaaaaaagtgtgcgtgtaggggctggaggacagaaggtacagtatttcgttaataactttacattgactactacatgttgaaatattctgtatgcatatgttggattacataataatattgaggccaggtgctgtgtggctcactcctgtaatcccaccacttttggagaccgaggcaggaggatcccttcagcccaggagttcgagaccagcctgggcaacatagtgagactcccgtctctacaaaaaataaattaaaaaaattagccaggcacggtggtgtgcacctgtggtcccagctacttgggaggtggaggtgggagaatcatttgagcccaggaggctgaggctgcggtgagccatgatcccaccactgcactccagcctgggcgacagatcgacaccctatctcaaaaaatagtaaaaaaatgtcctttttttaaaatttttattttttatttttttgagacagaatctcactttgtcatccaagctggagtgcagtgggcgatctcggctcactccacctcccggattcaagcgattctcctgcctcagcctcccgagtagctgggattacaggcatgcaccaccatgcccagctaatttttgtatttttagtagagacagggttttaccatgttggccaggctggtctcgaactcctgacgtcaggtgatccacccgccttggcctcccaaagcgttgggattataggcgtgagccaccgcaccaggcctcctcttctatcttttaacgtggcttttagaaacttttaaaattacatagatggtctgcattttgttagtgttggacactggcagccctccgtctccctcactgcctggaatctgctgctctccttttccccaggtgcctgccctctccattcctcctcactttcctccgctgggaatcggcaccgccactgattttaaagttgaaacttggcaggcaaaagggaggtactcccatgttaaatgtatacacattgactgcaatagtatcctgacttttgaaatggtaaaacgtagagtaagttgcttttgtactttgagagtttctgtttgttgatcagttgttcctgagaacatgcttctccttccgacagggaactccctccactagaatatgagctccttgtggtcaagactgggtcccctgttcccttccccccagtgccagcggagcaaaggtcagtcagcggcataagttgtacctgctgggagaactgtctgcttcctccgggtgacttttctggccaagaaggaatatgagtatgtgcctccctgagcactggcctggagcccactcaggaaacaccatctcttcataaatggttttgattgcaggcattgttccttctgctctctggatgatggaaattgcttcaggtcactgcactatcttccaacgtttttgtggttgccatgagctgttgtacagaccacagtttggggcctgagacaagctgggcatggtgttgcatgcctataatctcagctactttggagggtgaggcaggagaatagcttgggcccaggaggtctaggctgcagtgagccatgatcataccactgcacttctgtctgcgtgacagagaccctgtatcttacataaaaccccagcccatatttgtaccacatctagatacgaggtcagagttcagatgcctaaatattgtagcttgtgttttgtccactgttgggggaagagtgaagagatttgacataccataatgttgattagcttgtgatggtttggcggcagcttaggccagagcataaagtaaaaaggaaaagtgttcacagacaatgaaaactgggaccaagtggtgaatactcaaggcacacagaccaggcaaggatcccagtggccgtggatgagtctcaggctggctctgggccagtggaacacacctcagtgtgggtgaaggcctagccagggtagcagagggcagggctacagaacagcagcccaggtggctgtggccgacctgacattctcctgtgaaaatcaggtgcccaaccagcactaatctagatagatggcagcattttttttctttaaagacaggatcttgctatgttgctcaggctggtcttgaactcctgacctcaaaggatcctcccctcttcagcttcccaaagcactggggttacagatgtgagccagcacgcccagccgaatcacagtatcttagacagatgccatggctgcccatagggtcctctcaaggtgcctctgcccttggactggcttcctacaccaacctgacaggtgcagcaaaggtggactttctggtaaggctggaggaggaagcctggtctgcgatggcctgagacgccctctatgggggttgttgagtggatggaaatgtgcagggcatgggtcctgcccccaagaatgcaggctggttccgctgggcacctgcagagggctgatgtccttttcctgaggcctgctcctgtgccttctaaccctagggtgagaagatgggctgtgttcacctcatgcccaggcccttcgaggagtgtgcccttgggggtcagagccctcctgtggctggtatttctttggatcatcacaggtgctccagacatcctttagggagtctcaggcttggtgaagggatccattaaatgttgcttagttggtttttgtttgttttttgttttttcgagacagagtctccctctgttgcccaggctggagtgtggtggcgtgatcttggctcactgcaacctccacctcccaggttcaagcgattctcctgcaacctctgcctcccaggttcaagcgattctcctgccttggcctcctgagtagctgggattataagcgtgtaccaccaaccctggatgatttttgtatttttagtagaggcagggtttcaccatgtttgtcaggctggtctcgaactcctgacctcgtgatcctcctgcctcggcctcccaaagtgctgggattacaggcgtgagccatcatgcccagccaactggtttgtgattaaatgttttgattgatgcagtttttgaaatgtactgtgtgtacaatattactcttttgagacagggtctcactctgtcacctaggctggagcacagtggtgcagtcatggcccactgcagcctctgccttgtagcctcaagtgatcctcctgcttcagcctcctgagtagctgggactacagttgtgcaccaccatgcccacctaatttttatttttttaaagatggggtctcctgtgttgcccaggctggttttgaactgctgagctcaagtgatctgcttctggccagctactactcttaaaagtagagttctcagagcaaaacagctccctttcaaccttcagtccggtcgaaggtgtggtgggggtaacaacagcaggctcatggatacctgggcagtgctccgaggtgagaaatccagcagcagcgcggtggtgagtgtgggccctgcggagtgtggcaggcgctcattatggtgcagggcagtgttgggcacagagaaggttctcagaaaccacagtaacccatggttagttggtcacatcccagaccctgacctagcactggctggcactgtgacttgtcactctcctgaatggaagaagtgtccacctgggggtggctgaggaggtggatgctaggggactgctgggagccacggacctgtggaggttgggagaggagactgcaggcgcaggctgctggaggcgaggaggcctctctggagcgccaggccatacaaacaggtcccaggtggggccacgaggatcaggttagacttgggacccgagagacacgtcatgcccactgtgcaggtgccacctcatgttatcctgcaccaggggaggggccagcccaaagtcctggctgctggcagcatgcccgtacagcttggcacctgggtctgagttcacatgtctagcaaagctgggaaaatccaggagcaagaaggtgaagccctttggctcagcccaagctcagaaggcccttgcccgatgagccgaactgctgacaacaccctggcactgggcttggggactcccctggagcatgtaagaagtgaactgggagcgtgggagaaactgtctggcaggggctgctgcctcggagctcatcctccctggctgtgctggtgtctgtccagtgggattagcctccatcctgtggtttcaccaccccaccgcctctctcccccacagcacaggcagaagcagcaacgcaacacgagaccacctcgcttggggctagtagcagttctgggaaaggctcggtagggtctttgctccctgcggaatcaagggctgggggctgacccaggctttctctatagctgcttccagatctgggtctggaccagcttctgcaggaaggcaccattctgttggggtgtctgacacggtcagctctaggctcagcctctgcggcccccacaaaggcctagcaaggatggggcaaggtggcagtggtgcccgcacgcactgccctggcacaggtgtgtagttagtgacctgaagcatgagggcatctccctgcccaccccagctggagataagccccttgcggggcccaccctgctgataaaccccagagcagtatggcctgtgtcagaatgaccagtaggagggccccggggtagcagctgcccagcccagctgcgtgtgtgtgtgaagtattttcctcaacaccttataccacagaaggcagattttgaaactcgcatcaggccagaaaaagaatttctgaatggacacttctaaggggtgcctggttactcatctgcctcttccccctgcagggtagaggggcatgggtttgaagttcccgggggctcttggagactgcagacacggacgagctggggttcctggatgctgcagcagttggggcccctggctgagcgcacctgccccaggaggccctgcgtggttcccccagtagccccttcacaccacaccgcagtgaggatgccctgtctcctgccgatcccatcacaccaagccttttcgctgttgggctcctggcactgcccgatcctggagggcacttggctgcggctgtggctgtgaagggctggtgctctaggcgcctccgtggcccccgttgcctgggcacctacttcctgcctcagccacagctgcatccacgtgcgccaggggccacaaggccgaccctggcttgggcctgttcctccctgggtttccttgggatccagtcattggagggcccgcgcacagctgggccaactcgacacctccaagcccggccagggaatcaagcagctctccctctggcagcatgagctacacaagccaggcccgtcttcccattcccttagcaaggaggggcaaccccagccaaggccttctgcactgttctagactgttgctgcctagggctactgtagctgggagtcacattcctttctccccagatagttgcaaggggcccagcagccacagcacttcaagggggccctgcccttcccctcccaccaccccaccagggtccccatcttcccctttgtctcctaaagcccgtgaggcagtagaggagccaggccctcccctgccacaccctggagaagccaagcagcagacacccccagctccttcaggggcatttatttcccggtcagaaaagaagcagggacaggcgcctctgcctgagcctggcagacacaacacgaagaccggggatggggcgggggaggcacaggagacggctctcagcaatgtgtgcacttggtcccttgtttgttcctggctgggtcagggaaggcctgccgggggtggtggcactgagagcctgggggaacaggcgccaggccagtggcccagggacggcacggacggaggcaataaatactgatggccaggcggggctcctggctgggcccaggtggggtgagtgaggctgtccatcgagggctcttgggggggtgtgggctctgggcactgcccgctgagacagaaaaggcagaggcaggacaatacccagcctcctggatggtactgaggtgacttgagttttggcaatttggctttccccaagccgccggagccatctccacagccctgtccagggaagggggcaggctggccaggcactggtgggctggggagcagcagcagcacaccccacgtgtccctgggtcactgggttcgccaccggggaagggacggggaggccacatgctcatgcagacacagggagttagaggctagtgaggccccacggtacactccacatgttaaggcatcatggttagacgggaccgacagcgacaagggggctggccagggagcagcggggctggaggacggcccggcccccacgaggccgtgcatcccacaccccagctccaccccggagcagcagacgcacacgtccaggggcaaccacggggcctggagaatggctgctccgctccctcctgaagccaggcctcgggtgtgacggggagatagaacctggggggcacagaaagggcagcagaggcctggctgcggcctctctcccccacagcacaggcagaagcagcaacgagacaggagaccgaggaggctgggcctgtgggtgggggagggctgaggaggggggtcggaggcactcggttgagccaggccagggaggcggaccagggtgggaggggcacggagggcctgtcagcactttggtatggggaggggaggggctgggggggacacatccgcctgtccgtcgtccgtccgtcagtctgccctgcccgcctctggctgggctcagtccttccagtccttcttgatggtgagattccactcccaggacaggtggtcggtcttgtcgtcgtctgtgaagcgggacttgatgctgtagctgccccgggccagcatacccttgggtgcctcctccacgggggtcaggaactcgtactcctcggcccggggcccatagctgcctaccatgtagtcagtcttgtcaactgcggcacaaggaagagggcggtcagcggccccgcttccccgcctggcagcacgcacccaagcggccccctctgccctgcccggggccccactcactcttgacgcctttcctgtacgtatgctggatgtacttcatgccggacactatctctcggttaacctgcaggacccgaagcgaggatcagggaaggtcggtccggaccccagccccagccccgcctccattccctggccacagcagcctgtagcttacccggaaagagatttttatccggtactccacaccctccttcagcacaaacgactgcttcttgaagctctccaggtcgcctgttggggggacctccccctcaatgactgcccagcagccctgcgcgaagccccagccctgcgcggccccctggctgcacttcccgagatccccaccaggggccgcccggacccccgcggccgcagggcactcacccgtcaggtccagctccagggggcccggggccgagctgcacaccagggtcaggccagtcaccacgacgttggggacgttggggtctggggagtgacagcaggtgagggccccacccccaccagtggaagtaggggctggggagcggcaagacagctggagtgaacgggcggccacccggctcccgcagcccagactcacctgcggaaacggccacgcggcccagcagggcctccttgtactttcgcaggctctcgtcgtccttgtccagctcctggatctcctggatgctcttctgggccgggggcttgtagttgaccgagtgctcatcctcctcgttctccgctgcaatctgggccagctgctcggctgtgggctcctgctcagccatgctcaagcttagcctgggtcgggacacctgtgggcgggacggtgacaggccttggacctggatccccaacggaggcgcacttctgagcaggagtgtgggctgcagccggagctccaaaagggctccaagggggccaccttcgctcctctccacccccgcgattcctgctcaggggcatcctctggggcagtgtgaggtgcccccaccccaggtataacatctaagacaaaatgggaactgcagccgatcatggggagagaggacacacctccccctccacgatggaggaggcagcagccccctgtatgtgtggggcggggctagcaggccccagaatcaaccggcggggcccacactaaaccctctcttagggtcttgccgctcttgagctgcccaggccctcgccctacggggtaacggggctcggtatccctcagtagggttgctcctctggccgtggtagtcacatgtaaacgtgtgtggtcggctcagcgtcatctttcaaacaggatgcccctggagctcggatgttaggggcagctagaataccgcacggggccacctggacacggggatcctaagtatctgcggtttctccacaattgtgagggtctgtgacctacaacttgggagctaccacagccactcagtactctcgggccctcttgtagatggtgggcccggagtgcccggggcagcactgacccggcaggggatctgtcaggctcagatccttcccggcagcgtgggaggtgggtcagggagcagcacacccgggacacccaggccggggtccaggccgccctgcttcctccaggggctggggcctccgcgccgcgcgaggatagccgtaggcgccgggatcctagggcgcggcccgcacttccgcagggcccgcaatccgtgccgggcgtggcccgggcgctgggggaggccgcgccccaatccccgcgtcgcccccgaacgc

SEQ ID NO: 3284 - DNA, 768 bp, Homo sapiens
gtgagccccttggtgcggagaaacttggagatgaaggacacggcggcggcgatctcgcctatcatggtggcggcccgggtgtagaagggatgcatgggggcggcgtgcgggggcggcccggggcggctggggctcggcggcgcggccccgacggcggagcagccaccccgggcttcctcaccgggcggaaggctgagaggaagagagggcgtgaggggcggacgactacttttgtctttctttctttagactaaaaaagttattttcgagacaggaggcggcaggagagaggaagagacgagcgatggcggcctggtcacatcgctcggacctccccagctgcctccgcctccagctccgcagcattcgaagatctcaatagctgcatttccagctccgagaggcgaagagatgcaagcgccgtgcagcaccctttatagtgccacgaaaaggaagtggcgtagctggagcgtgatggccgactccagccaatccgaatatcgcaccattgtgacgcaagccgtaacttcagcagtcaacggagagaagagtggaaaccttactggatgcggacaggagagccagttactgaaagcagatataacgcggatcctgtaaagagtgtgattgacagacaaacccctaaaatgagaaggatcagtgcgtctgtctgtagagagtgacagcgttgaagcaagacattcagaagccagcctgacacaaaggggacaagaacaactgccaccccagcccccatctcattccaac

SEQ ID NO: 3285 - DNA, 6716 bp, Homo sapiens
agcaaagacctgaggaccttcaagagtgtggccccagcgggctccagcctccgagcctagctcgggaggcgtggtgtagaaaatggcagactagggcatccatgaagaccgggcggccccaagccgagaggcatggcaaaacaggggttgcaggtggctgttctggcagagcgaggaggatggatttgaagaagacaggcatgcaggggagacctttgaggggaatgtgtcaacagccaaggggggcggggcgccggggaggtctggatgaagtgggaatgaggatggagtgcagagtgcctggagaagtgttcaggagggaaggcgaggcatcgggacgaggggctgggcggtcgcgccatctctgcgatagacaataatcgggtcaacacgcggcgagtggcggaaacccgggcacagagaggttaagtaacttgccccagggcacacagctagctgatgtcagtgccagaattccaaccgcggctgtcggaccccatgccatcctcatgtcaacccactaaggacgggatccttctgtccatcttaaagatgaggcaactaaggcacatggaaatttaagtataataccttgcccaaggtcacctagctggaaaatggacgagacagaaagcgaacccagggctcctttctgtacgcagaacccgcggtcttggccataggcgatgccacttccgacagcccagcagggtctggccctgggtcccagaggcgcagcccctgcggggtttggatgggttcctgcggcctccgatccgctggtgaattgggtgtgtctgagcatcgtccccgctcagcccgcaggcgtaggatagggaggcgtctccgggaatctactccgggacgggtccgcggtcctcagtcgggatggagcgggggcggaggcagccggagggaactggagtccccattgcagaactgcggggccgggctctgggctgggcgcctgccccgcgcggccggcagagggcgctgccgcacacgccttggatctcactgtcactgggacctcggggcaggctgacgtcggcctgcagacgcctggactcagaaccccgaagcaagaagcttcccttcctggtggctgccatccctcaggcccaccatttcagccctggacctgctttccctgaccacttttccccatcttctgtgctcctgccatcccaccactggccttcaagacttccccagtccctgcacagcgggttttgtcatctgctgagaggcgcggacactgattcccatcccattaaaaggcctagatgtctgcaagtcaaattcagccttgcttccccttctcgccctctggtgatttaaaatagggatacatcatctacttggaataaatgactaatttttctcttctccaaaatacggtgggtatggggagggttggttaagtaggcgcacacagatgaaaggatctattttcataatagctaccgagtacagagtgcttcttttgcgctgagccctttatgtgctttgactcattaatcctcactacagccctaagaggtgtggatgatgattgctgtttgatggatgaggtcacaaggctggtaagtggcaaagctgggattcttcccaggagtgtctgactttaaagctatgttctcatcacccagaatgtacacgctgaaacaactgaacagaagaggtaagatgcaaatcatgaaaaacaaatcaaaatctacgctgagagtgcatagaaataccacatgtcatgggaggcttgaccagcttgagtccccaatgtgggactcagatgttgaacagaaaaacaaaacctaaaggtgcaaggagagaataagaatgaggcttttggctttagcttggaagagcatccggagaggcccactcactttctatgtctgggctctgagaaaataaaggtggttctaggaaaatctgaaaagtatgggagaaagaaaaaaaaaatcccttttgtggtttttcctttaaccaagcctcattttgctatttgtgttttattttaaaattaatgtggctctccccaccctttaaattggcacataaatagcaaaaacagaaggaaagccagctacaaacttaaaatgtggtgggtttctcaggaaggaggtacatgacttgaaatggaaatgaggattaaatgagatgccttaaacatttcaaaaacagactttccacaaggaatttagatcataagcccttagggcagaagctttgtctgggtctgggcttggtatagtgtctagaatctgtgagtgcccaatgaatgtgtaaaacaaatcacccttttagtacatgcttgcatcatctgaccatctgggctaccacgttgcttatggttttatttattattattattattatttattttttgagacggagtctcactcttgtagcccaggctggagtgtaatggcacaatcttaactcactgcaacctctgcctcctgggttcaagtgattctcctgcctcagcctctcgaataggtgggattacaggcacctgccaccacacccggctaatttttgtatttctagaaaagatggggtttcaccatgttggccagtctggtctcgaactcctgacctcaggtgatccgcccacgtcagcttcccaaagtgctgggattacaggcatcagccaccacgcccggcctgcttatggttttgaagtgttgcttctggggtgatattcctgtcctctagatctcagtcactcctcagacccctcccttttccagaaatttgctctggaaattcaatcaaggtgaggcaataggtgatgatgtcactaggcttggtgaagtagaatgactgctcagctctggaaccaccaactggaggtttttccaaacgaggaaaacaaagtcatgggacttgtcacttaatagttctgactgtattgccctgtgcctttaaactggaagaattccccctcttcacccaataccctggccatcccaggtggcctcctgcaaaattattggacttctttgccctttcctcagtctgcttcttcttccctccttctttcagtaccttcactccacagacatgtattgagagcccattatatgtaggtgctgggaggacagcagagaacctagcatgagctcatgggctcaccttctcctgttcccacctccacctggctcctttcttcatggctccaactttcaggtttggctccaccatagtaactgacttgcttctccatgtgggaacaactactcagacacttttttttttttttttttttgaaacggaatttcactcttgttgcccaggctggagtgcagtggcaccatctcagctcaccgcaacctcagcctcctgggttcaagggattctcctgcctcagcctcccgagtagctgggattacaggcatgcaccaccacacccggctaattttgcatttttagtagagacagggtttcttcattttggtcaggctggtctcgaactcccgaccttagatgatccgcccacctcccaagtgctgggattacaggcatgagccaccatgcctgaccagacacatctgacattctatcagctccgggcagcttcctgagaccatacctgctgactttagaaccccaccttgggggtacccatttggcaggtttggatcctgatggaccttcaggagcagaacttgggaatgttctagctccaggacctgccaatgccgtcccatcctttcctagttggctttccttccattcataagaacactgtgacaactgaaataattcaggtcatatttatgaaacatctattacaatgagaatcccatagtgacataatactccactgttcacaggaaaatgctagctaaaacaaacaacagtgactgtctggcaagggacgcatcgaataatgcttatgagtcttttgggtctttttttttttaatcttgggatcgagtgattgataataatgaaggggaaggaagacattaggcctgttttagttctcagaattattcacagggaatagactttcaccatcaacaccctaaagatgcagaatgctcaaggtaaattgccagtttttgtctttctggaaaatccattaatactgaatgatcttggtcttgacccattccaaaaaaaaaaaaaaaaaagaggattgagccatgggattcagattatgtccttgaaaatccctttaaaaactagattccaaatcagtgctctcattcttcttgaatatcccacccaccagcttagcttgtcctatcccttctagatacagcattattttctctctttgaggaagaatggcccagaggccggaagagtgagggaacgtaagaacgacttttccactgacctgagttgctaaagccatttggacccagagaactcattgtatatgtgtgctgctcaatatatatgtgtgcatgaatttgtggttgtgcattttctggctaatatccaaagtcttcataacaaggggcctgagatacgacaaaaggaagacctatgtgtcaaggacgtgtgtccacccaccaagaagttctggatgcccaaaggggctcctagctcagggtctgtgtgtccagctgctggggtaaagagatttggaaaccactgaacatttctgctgggatccttccaaacccttttgggaaccggcaatagcacttgtcaggggaaattagttctgcactttcacagagtgagaaattcctcagggggcattcttgtacttgggaagagaaatcgaacccagctgattccttcagggcccttgccattaataaagcagacgaagtccagttcagttagtcccgcctgggtcagggcgtggagtgaggacaggagcaatggcgttcagggaatttcacctgtggctatggccctcctctgatgggtgcaagcttgatattttaggggatcgcgttaccggcatgtaaacaccgtgagtgacagccaaagctcccaggcgaccacagaggatctcaaacccttcctatcttcctagaaaccctggcagcccgaccggctgcttgctgtctgatgcaacagtttgcaacgctgttctgggagttgagtcctgctgcggggcgccgggaaccgggccgacgcgcatgcgcgggctgcggccccgccccaaagggcggagggggagcttttcaccagatgtgcggggggcggggccggtcggccagggagacctctggcagctcgcgcctgcgatctgagcttaattaaacttctcccgaggcattggctgactgattgacccagtgatccaaaaaaatcagagaggcccaaatctccccaaacgcaccggcagagcgaagttgggaagttggcttcggtttccagacttgggcctttggattcggcgtccctctcctgcgcccccgatccgcagcactgtccaggatccacagctcggaagcacagtcaagcctcgcgggtctgggccctcacaccacacactttcttaagaagggaggcattgtggctacggggcggaaaggaggcaagattttgatacctcctttgtcagtatctcctctgcctcgctcatctgttttaggttttatgagcaggagacgtcaccgattattttccaaaattttcagctgttcggatattgccttcacggtttgcttccatgtccacattccaccactattatatattttaatagacttttattttattaactttttctttaactttaaaccgtttcccttttttagatagctttgccctaagcaataacattagcaaagctacaggctgaaaataaattcaaaactattaaaataaaaaatatatatatgggctggtccgagtgcagtggtgtttgcaactaactgatcacattcagttacagatttctttcttttcttttttcttttcttctccactcacactgcttcacttgaccagccatatatatatatatatatatatatatgctaaattgtctcgtctaccacatttggtgaaaaactctggtaattgctggacacaatggctcatgtttgtaatcccagcactttgggaggtcagccagcctgggcaacatggtaaaacccatctctactaaaaacacaaaaattagctgggcatagtggcgcgtgcctgtagtcccaactaccggggaggcgaggtgggaggattgcttgagcccgggaggttgaggctgcagtgagttatgatggtgccactgcactccagcctgggtgacagtgagaccctgtctcaaaaacaaacaaaaactctggaggtaatactacctaacatattgagtgattgtcaatgtctcaggcattattctaagcactttacatgttcttactccttatgacaccacagaaggtggatgttgtttacattttaaaggagaaaaatgaggcacagagaggttaagtaacttgcctaagatcacagagccaggatgcaaactccactagcctgtctccagagcctacatggctgccctatccaaggaggacccacagtttctccaaatcttacccctctttcaaggccaagatcaaatgtcagggcctggatgaaggctacctgggagatgggcacacagggtactggcataggggagcatgagaatccagtcagccagggttcaggtactggttttgctgttactaattttatgatctgaagcttttagtttcttcatctgtaaaataagcagaatcattatt

SEQ ID NO: 3286 - DNA, 1003 bp, Homo sapiens
taactgacgttgttttttactttttactttttaaaaaagactaaaaacgttttgatattatacaatgtatttgtttcagataaggtcattgtcatttagtatatataattaatatatgtacaagtttaagtaaattcctgtgagtaaaaatggacttatcacaaaacatagttctaaagaaaggtatatgctcatatacacggtgtccattaatttaatgggaactaggtataacttcaggagaatttggcaaataattcattaatccatgtaaatattcaaaagcttgttctatccacattatttcaagggatcactttatttttcattatactttcacagcacttttctagtaaattctgtaacacagaaattccattttggaatcatttcatgttaccaataattctagacttttataacatttaacatgttgatggaaatagattacatctgctagaaccttttgccttaactattcaccaatatatgctaatattcataaatatggattgactgtttacaaacattagaatcttgtcttggttccattttgatggctaatatttgttatcttaattaagactatttctgaggtcatgattacttgaaaatattgactaaaactgggtccttagaaattccaggtggagctgatttacctatgactgaggggaaaaaaaaatcaaattttactgataatagtaatgctccaaatgaattaatgacacatctgttcaataaataaagagcttaaatatacaaaacataagaaatctgggcaacaaaacttgtggtctttacttttgaatagctacccaagaaaaggttttaaaggtaaaagttatgagtaatgtcatcacaataagctcttgtttaaaattcttttcttttatgtataattaggtttatgtttcatgtctttttaaaaccttataaaagatttaattatcacatctattcttcaatgtggaaatattaaatattgttggttgtaaaataa

SEQ ID NO: 3287 - DNA, 1298 bp, Homo sapiens
taatgtcaaagaaatgaaggtaattttacaaactcagtttttgtaagtacatgaagtttctatttgattatgtggttttatatcacattcgttcaaatgcatttctctcccttagagggactattccaacatcactcctttggaattatttcagtcatccttaacatgtgactttaccaaagaccttgaagctaaacaaacaagcaaaacaaaatttcaatgactcttagatgaatggaataagaaatagtcatcacatgtcaattagggatgttcatctccaaccaagacactgtcaaaatgtttcttctgatacagcagttataagtcagagccttcaaaaaacaagggcagaacaagagtacaataaaagaagcatctgcaacttaagcctcccacagtcctaagcctgatatgcgcaaagcaaagcctctttcccgcaaactaaattccatccatttgagctttcagagatcgatgcccaagagctatcattaatatatacagcatattgactctagttgcatcaattatgcctgaagagtttaatacccatccaagtccaaaggtggaagaatacatacactggtatggtaataggcaagagcaggctgtaaaagcaaaggctggctgtgctagtgcagccctgtgggaagttttcttccacagaggctgagtagaacagtcctgctaaagaaaccagtggaataagaacagtcaacgtaggaagagacagaaacattcttctcttccacttattacctgccactgtgttttaaaaggtatatggtattaagaaaagttggctgttgcgtttttttaatttttttaaattatgaactagcgctgctccacttcttcttgcttcttactttgacgtgtcatcctagctgcctgtggtatcatattagggatcccatcaatgattggataagctattcccaactcttcattaatcaattcgtttgttgatgcttcatatctgagcggcttcttggagagcgggcacaccaggaactccagcagcgccggatcgaagtcgcggggcggctcctcagtcttcttgccccggtcggccaaaggccgcgaccccgacgcgtgcaggcacctacgggcgaccgcggacggcggcgcgcgcgttccccgcagcgctgaggcgagcctgcagcgtgctccactcagcatggtctggcagccggagaccaggcctcaccgcagcctcgccacccgtggccgagctcccggcttcccgttcgtccaggccagccgggcaggccccgccccctggtcctccagga

SEQ ID NO: 3288 - DNA, 3187 bp, Homo sapiens
cagcaggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgcttttcaacaccaccgagaacctgtatggccagaaggcagggccgaggggtgtgggcgggaggcccggcctggcttagtggggacccagggcatcagacacaggtacagcacataggccaggagccagggggtgactggggtggctcggctcgggaggcctgggaccccacagtgcacgctgtgcccctgatgatgtgggagaggaacatgggctcaggacagcgggtgtcagcttgcctgacccccatgtcgcctccgtaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccagcattgccaacgacctcatgtacagtgccgacctgggccccggcattgccccctctgcccctggcaccattccggaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacggcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggtccataaaatagtggctttcaaactgtagagctctggacttctcacttctagggcagagggaacctgaacaagtgaggctctgggttccccattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcctgcggtcggagggccttgggcaagatcgcctcctcccctccagccctgagtccactgggtgctttctgcccaccccctgctcttgccagctggcccctgcttcccctagggcacatgctggaagccctgggccgccaccagaagtcctcagccctcctgcctgggctatggctccttcctggtttgggagccatagtgaagctttcctctctaagctcacccagcccaaactgtgacaggagaatcttcttcgactgccaagagcggtccaaggcaatggtcagccactgcagccccctgagatatttttagagactggacctgaggcctctggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatcgtacagtggtgctgcacaccctggccctggccccgaggtggctgggaggtggctcctcaaacagccgctttctcatcagtgcccggtgctgggtcagggatcgactgaggctctgagctaactaggaaacacagtggccttggagggctggggagtgtcatgggggtggggacagggagccaccggtcgcatgtgactgaactcttcaccccagtctgtggctttcccgttgcagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctgtgcccccaccgcaacagccacaggcagaggaggacgaggacgactgggaatcctagggggctccatgacaccttcccccccagacccagacttgggctgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaa

SEQ ID NO: 3289 - DNA, 5440 bp, Homo sapiens
ggaagtgcctcgcgacgcggggccgccaccgccgccgggccgagggagggcccggcaaccgccgcctgcgcgccggctgcccctcggctcctgggagccgcggcgctacgggcctgccgagcactcgggcgggcgccgagcaggctgggccccggcgcagtggcctagcctggaccgcaaggccgaagccgcctccgggccgcgtcccggtgtttcgggttgtgtaaccttggccaaaatgcttaagcttttttcctggctgccaaatggggccgatcgtctgacctgctgcctccggaacttgagggatcagatcaaataaccctttcctggcgctcgtctgccgctgtgaatgaatcacgggctcctgtaatcaccgttaggagagattgttaaactcgtacagggttggatgttttaaagttactgaatatttactggacccctactgttcaatcaagacatgctaagttagcttgccattcttgttcatttatgtgtttacttaactatttctgggtctcctcttcccagtcataaatatctcttggagtgtaagctcctcggagcagagatcctgtttccgtatttcctgtacctagaacagtgccagatccgtagtagacactgaaacaaaaaatctttaaaaaaaaaaaaatatacgaatgtggcaccaccatttacacaggccactaagccaaaaatctcgaacttgtcagattgtctcttctcagccatcagcagtcaacaagttctagcatttggtctcttaaaagtggttcaagagtttatttttcctctccttcctctgccagtaccaaccagtcttccgtatcactatgtattgcaagagtctcacaagaagatatccatcactgactgatcttcctcccgtttaacatccccaacaggtgccagggtgatgttttttttattctaaaaagaaaccagattatatcgctcactcccttgcttaaaacagttcttcaatgttaggtaaataaatcatggagtcaccacgagggcgttcatctgccaggcactattctgaacgatattggctcattaaattctcacagaaaccctatgcagcaggtacggtgaaaatgttcctgttacagatgaggtaactgaagcacagagagcttgagtggcttgctgaaacaccagacccactcagtctggctccataataggtctttttgctggtaatgatttaccaactatacagccactttaaaaaaaggaaatagggcccttgtgactggacctcatgccaaacaactcgttacaaaaagagctagggttccagactgcgccgaagcttcatgagacctctccttgtctgcatggacgagtggccaactctggagcccaggctgttgcttcccagtctggtggtgaatcctccatagtctggtgagtgtaaatacatatatatatcttttcccttctcccttcccattgcaatttgcttattatatcatttgcttatatctgcactgccatttgggataaagcttgtttacccttaaaggtattgtgtgtgtgtctcctcccgcgcgcatttcccacacagaacacctaagaacctattttttatgatttttacgagaagtgaattccaagttgtgcctcagaattcagaatatatctttcaacctcctactcatcccctcaccaccctggtgaacacagtgtctggccagcaggaatgaatgaagaagactattttatgttcttaataacttgcttggaaatgaacagagcacaatttatcaaaccaaagcaaatatttatacaggcagatcccttaaaattgaggattaatgcttaggaagaattttttagaattttccaaattaaccacttgtctttctcagaaataaatctgttactgatgcttcctccaccaaccagctgcaaaaccacacactattctttgaaggaggaacacagaaaaccaacttacttcctggggcatttgggagaggaatctaaaaatcctagtgatatggcaatgactagaaccttttttttttttgtaacaacaaagctaaaaggggatgtgtaacttagcttgacttgtaaaaatattcgtagaagtcatctatattttaccactttgtgtaactaaggcagagcattagagattattcacatcattaaatatgtccagttaaattattagattacaacaccaacctcttgttcatagtctctcagtcttcagctgggcacgggggctcacgcctgtaatgccaccactttgggatgccgagacgggcggatcacttgaggtcaggagtttgagaccaacctgggcaacatggtgaaaccccgtctctactaaaaatacaaaaattagctaggcgtggtggcaggtgcctataatcccagccactcgggaggctgaggcgggagaatcactggaacccaagaggtggaaattgcagtaagccaagatggcaccactgcactccagcctgggtgacaagagcaaaactcttgtctcaaaaaaaaaaaaaaaaaaatagtctctcagtcttcatactttgttgcttagttggattatctgctcctaggttttaatataagatgaaataaaagtgctggcctaggaattggaggccaatttaccttaggggcaaaggcaatggtggtgaatatacccaacagcttcactttctatggagccagcttgtaaaatcttgggcaaggatggtggcagcagagctgtctgcctaagcatcatgtagaaaattttttaatggtttctttggaccctagcttgcagtgtcatttctgcttctcattgtattggaaatccatggttttgttacataatgtactcctaaaaatgtatacacatgtgttgagtatgtggaagttgaatatatttatgttataaatgagcagttctgtttctggaaaatgaaaattttcacctcatcactacagacattctttgataacacagtcccagtgtttcatccagattatttcattttcttcttttacatataaccaaccattttggatgttaaaggaacaaccagtgagggcttaagatctgctgcttttgacttggcactcctgatcagttccatccgtgtctcaagtgtatcacattcacgagacaaggcttctcatcagcaatttcaattttatgttttctacttatttttatataagaatacaatgcaacaaaatattcatatattgcacaaacagtgatgtgcatacaaagatgctaacaacattggctggtaataggctttaccatgttacgatctaaatgcttgttcatcagagaatgtacaaaattctaagtttggcatccaaaagggggcttacagttattgaatatttttcccagccctattttaaatcaaattcaagtttgcctatgacaaagactgtctataagtaacagggcaagcataccaacatcaaaattattcttcttcttatctcacgtgcccctatttctcccaaataagtgacaaggagagtaaaaggatcactgagggaacatttgaagaatgctactaagtgccaggtcctgtacaaggtaattaattactacaaacactctcgtgatggacatggccaatagtgtattttgtcaaaaaacaaaaacaaaacccaagattccagaagctgtttctgacaagaagtccttgtttcagtactcttcagtatgagtccttacttgcaggactgaggaatgaaattgagaaagaacctttaatcattagaaaaggacccaataaaactatacttaaatggatcattaatgtggatttttttacattcgtgtgggatagagaataatcccatgggaaacaaacacattttgaatattttttaaagaagtatttctgattctaattttactgtatgtttaggcatcattaaggacctctgatttgaaggtagatttatgtgccagggactccaaattcatgacatgttttaaggctccatattccatgcaaaaatggacttactgagcatggtggtaataataagtatgtaaaaaatagataactacagtcgtactttggtatccatgggggattggttccaggatcccccagtatcaaaatccacaaatgctcaagtcccatatataaaatagcatagtatttgcatataacctatgcacatcctcctgtatgctttaaatcatttctagatttcttataatatctaatacaatgcctacacatcacttcatttacatgaattcaacatacttcttggcatgcagcaaattcaagttttgctttttgaaactttgtagattttttttcaaatatttttgatccaaggttggttgaatccacggacacagaacccatggatttgaaaggctgactgtatttctattttaggtttgtttttcctcctcagaagcctcaacgaagaaaaagtcaaaggtccttctctctctatgaccagaaataaaacctataaaggaaatagagcactaagtggggtccctggaatccccagcttctggtttccagccacttctagatgttctctggaaacataactgcgttgaaaccatactgaagtataaattcccaaattggaaagaaaacaaacaaacttggtagtctcatgcctgggagatacggaagatggaaaattctggaagaccaataggcactgatgaatttctacatctgggcatttcttgagggagagagggcctggctatttggagatggaaaatgtggtgacctagaatgagcaggcccagtctagactaacctctttatttaaccaactgaatagtcttggttccagacttctgtggaacctcagatttgccttctgtataagaggagtttgtactaatccctctagtctttttcagttggttgtgtgtgaccagccctagcacttaaataccctgctgaatatacagaaaagtagaagaattattttaaaattaggtcacttatcttacttgaatactacaagtctcacactataacctcttctagaaatcaggctgaactagcaaatacataaagactaatataagtgcatttcagtaaaatcactggtgaagtacatttatgatcattctttttaggcttctgatatggcaaattagaggtaagtatttcgattaagtcttcatccttttggcaaacaagtatatggttcgatatacttggtgatggtgaatgaagcccttagtttttcacttcttcgtgccttaataaaatcttcgaggcaagcccaaaccagcagggctgcagcattatcagcaatgagaatggatcttaaggtcaacagtcatgctataaaactcaacatgaagacatcattaacaggctgaagactgtgagtcttaaagtcctgaagtaggcaggttttaggaggtggaatcagcgtcctctgggtggaacaggtggag

SEQ ID NO: 3290 - DNA, 599 bp, Homo sapiens
aagcctttaattagaatgtttgtattttttacatcatgcataacttcacatttgtgattaattagtaattatttcaatacttgtaagctcatctgcctcagatttaatcataatacatgaattaaattaatcaaattaaggaacagcaatttagaaagaaacacactttaagaaatcaaaattctcaattcaggcagtctgtttctatcatttggtattctactcctttaaaaatttcatattgcccaacaaaaagtggttatttttactgtttttggagatgactgaacagatgaaggcatcagatgccttcatcagctggtattttgcctaagatctatttaagataaccttttcttatattttttacttaatattgggcataatcgtatcattcaagattaagtctgggttatttctttgataagaactgaatgtggccgggcgcagtggctcacgcctgtaatcccagcactttgggaggctgaggcaggagaatggcgtgaacccgggaggtggaggttgcagtgagccgagattgcgccactgcactccagcctgggcgacagagcgagactgtctcaaaaaaaaaaagaacg

SEQ ID NO: 3291 - DNA, 846 bp, Homo sapiens
acggacaattttgctgagggagatttcactatggcggattatgccttgttagaagattgcccttacgtggacgattgtgtctttgctgctgaatttatgaccgatgattatgttcgtgtgactcagctttactgtgatggggtgggtaagcaatataaagattatgtccaaagtgagaggaatttagaatttgacatctgcagtatatggtgtagtaaaccaatttctgtcctgcaagattattgtgatgccattaaaataaacatcttctggccacttctgtttcaacatcaaaacagttctgtaatatcacgattgcatccctgtgtggacgccaacaattcacgtgcttccgagataaatttgaagagattacaacatcttgagttgatggaagatattgtggatttggcaaagaaagctgctaatgattcactccttattggaggcttattgagaattggttataaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaacccaaagttgtatggattgtatagagcaaggagaactaatgaaaatgaaaggaaatgaagagttttccaaagaaagatttgatatagctattatctattacaccagagccattgaatatagacctgaaaaccaccttctttatggtaaccgagctctttgttttcttcgtactggacagtttaga

SEQ ID NO: 3292 - DNA, 502 bp, Homo sapiens
gagagctgagacttgccagttcccacaggccaagccaggcgtctgcaccccattctcttggttccgacggtgtatggagtcttgctctgtcacccagactggagtacagtggtgtgatctcagctcactgcaacctccacttcccaggttcaagcgattttcctgccccagcttcccgagcagctgggactacagaatatgctctccatgagggtgttcttcagggcctaccacaatggctggcactagagaagggcacaaaattgaagaacagtgaagacaaaagcaataagatgattaaggccatgtgagacagcaacaatatcaggtgaatgtcaccctttatcgagttgtgagtatccagcctctcactttgggggatactgtttgagcctaagtaacattagtggctttattcatttggtagattgtttgtatctttgcgttgtctctatcctgctttttccttggccattttgctattaaaaatctgttgatttac

SEQ ID NO: 3293 - DNA, 3795 bp, Homo sapiens
gcaccggaacgccgcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctgtaggtcggaagtgggggttgtattggaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggaaggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttaggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttggaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaacttttaaacctcacgtaa

SEQ ID NO: 3294 - DNA, 990 bp, Homo sapiens
gcagacttgggctggaagctcccggcccgaggggagggggcgagggtgcccggtggtggccgccgttgcctcttggccccctccccggagtggctggtgcgtggaagctcgaaaggggctgtctcttcctctccccggggacccccctacgagctgcgtcctctccccgacgggccccctggggcgagggccagagggttcagtgccacccggtgcccgggtccaatcttgctgaagccgctgcttccccggaggaccgggggagggggtggcagccgagaaaggaccttctcccctccgcagcgtcggccgttctgctggcggcgactgggtttgcaccccggagggagccgccgcggccactgcttccaggacgcacgagagcagaggagaggagtgcacgcacgcaggctcccgccgcccccaggcctggccggcgcccgggccgccgcggctggcggcgctcacgttggctgcagggcgctcgcgcggcgcctcggcccgggtcgcatcccttcccgctcgtgctcacgctcgcccggaatgtggggttgtgattgttactctacgttccggaggcgcgtctcggcgctcctgctccggctgcggctcgcgctgtccccggcttggccgcgcgggatgccgcccgggcggagcgctgacgtcaccgccatgctctgcaccagttcttccccctcccctttacacttcctctgtggagcccacttgttgctcaggcaaggcgcatgcgcggcaggacgcccagattcctcccagccggcccctcctccgcgcctccgccctcccctcccccctcgccgtgtgtgtacaacagctgaggcccggcgagctaatgctggaagtccagagctgggggtggaaattaaacagacgatgacctttcctttccctgccgggcattcccaagtaaaaacgcatttaagaaccactagcgtcgtttccgatccctgctccccaccccacccccaa

SEQ ID NO: 3295 - DNA, 4590 bp, Homo sapiens
cccactgctcgcggtagctgggtgttggctgcggtttgcctcttcactcttcatatcccagctaaagtacctcggctaagaagggcaaaatagatgtccgcaccccagggcctgcccacgtaggtccagggttttcagcgtcagcctggttacgcgaaacgcgacggatccaacgatttgtgttcaatttaaccgatccccgttaagttgaggaaactcggccaacagacctattttattggtttcgcttggccctccacccccacagtactgatcttacagatgggaatcctgtaatctacccatgactgcggccgctgtactttgcaggctcccattaggcctgtatatggtcgtcaaatgaaattactccccctgggcttccagtgaactccaagaacatgactacagggacaacctatacatagtgttgcattcttgactttggggcagatcgctgaacttcaaaaaacattatcaactgcttgatgtttcctcctggataccgcaaatgtctgaatccaaaccccttccccagatacacttttaatgtcatcagcagcactacccatttaatccaacatccatcatgaaattttttagttcattcagcaaaatgtgaatatgcccacgcactattctgctcacaagggatagtgtccaaaatgttcctgcccctcgtggttaattctaggttaagttttaaatgctattaagcagaagtatccagtgagtaaagtgactaaggatactattttagaaacgaacactgaaggcctctgacggggtgacactggatggaacaaggacctgaaatttagaaagaatgagccctgagaatatgagtgaaaaacttccccgtgccaaagatgtacatacaaaagctccaagatgggggagtcctggcaaagcagtcagtgtggccaaagcagtgggcaagtgaaggaccagatttagaatttaattctagtcatgatgagaaaccactggagtttgtgggggacagggaaatgagaaaatctgctttgccctcttaaaaggcttcctgttatgcaaaaactaaatcacaggaaggcaaaagtagaaaaaggagaacaattataagctattgtagtcacctgtgctaggatggtagttgtggtagtagttagaagtataagataactctggatattcaagttagaaccacgtggactcacttaaggattagatgcaggttataaaagtacattgaagatggcacccaaaacatttgctctgagcaactggatgaatgaacaactggtgttgggtaatcaaggagttgacttggaatattgagaaattcatatcaagatgttgaatatgagttttgagaggtttggggcctagaaatattcaggactaaaatgctgatcatattcaaaatcatgggattggatcagatcacccagggaagaacacagctagagatgaagtctgacatccaagacctggagaaatcagcaaaggatactgagtagtgaccagtgagatagggaatccatagaatccattcactaccaccaccccatccgcaccttaagttggaatccatttctcacatgggccactccaacaagcctccttaccatctcttggtccatatatgttgttcattgcattgaatgttctttaaatggtaactttattaagtgagccaccaaccccaccccaaacaatacagcctttttttttttttttttttttttttttttttttttttttttgtgagacgaagtctcgctctgtcgcccaggctggaatgcagtggcgcgatctctgctcactgcaaccttcacttcccgggttcaagcgattcttctgcctcagcctctcaaatagctgagactacaggcgcatgccacaacgcctggctacttttttatttttaatagagacgggatttcaccatattggccaggctggtctcaaactcctgacctcgtgatccacccgcctcggcctcccaaagtgctgggattacaggcacaagccaccacacccggcccaacacacagctttaaaaccttcaatagtttgcaactgttcttaagagacaaaacatgggatgcaactattatgccgtccatagtagcctttacctgtttctctaacctgtaactctgctagtcctttctctttccacttgatcctgataactttctcagtcactggtgatcagatgtttaggtatgttcttctctccctttctttgactagtctgctactcctcatccttcaaatctagctcaattacccctttcagttaagtctcccctgatcattttaactagggtatacactcagtcatggctttaatatctgccatcaaccacattgctccatcatggcatctgctacactttggtgtcatcagtctttgattagacagttcaatgaaagcagaaaccacagtaatttttgtcaccactaaatgcctagtgcttggcatgatgctgggcaaaggataccctaatttgctgaataaagccttagtttagttgcttaatacagtgtgtctccctattaaacacagtacttaaaattggtatttccaaataagcattaatacacaaatgcctttgctagatgatcaggaacaaactgctgatcttccactgcctctactcaaaacagccgtactgcttatgtaactggattaagcttcagaacagcttgttaaaagtaggatattagtagcagaagctgagaagtgtattagatgaggctatcagattgcttttataaaccttttcctctcttcacaccagtagcacttcttcacctacagcttttgctggatggtttttaacaacttaagcagactgcgttcaaggacagtgagaaaaccagactttcatattatttaatctagtgtaattttaaacattcactagtcttttgcagtatttttgtaggattcaaaatggaaaaaggtatgaagatgagccttaacaatttactttcgttttcctgaggggtcttcctccccgttaactccataaaaaggacaagatcaagggcaatactgattctgtgaaatctaacttataatcaactaaaatttagaatgcttaaaaacaacccaagtggaatgcagattcaggagcttaaacataaaatgaagggtttgaattcggcacttatctgcattccacttcctctagttatatgacggaaaatataatgaacaaatgtcctaaaacacttaggaagctgactgctcaactagttgttaactcatcacctcagttaatgaaccttctgagaataagcacacattctatgtctcctttaagtggaaaagtctcccacgtaagagctgcatataaaaggagacaaaagaactgtagaagctaactgattagaaatacttaaaggatatttgttttaatatcaaggtacaatgattgaaaaaaaacttttccatattttttaggaattattaggatctggaaataaaactgccctaatcaaggtaatcaataacattctacctttttaagttttaaaaaagaagtttcatatccacatgagatgatttatattatgcatatacaaaagtattttgtatgtgagcttgctacaccaagaggctacagtgacatgtgtgacaatcatttccttgaaactctgctaaaatatgcatttgaccaaacaaaaggccttctgcagctaggacaagcaatcacatattatacagaatgcttagaaccaagattcagatcttaatgagacttattgaaaagttctctgccccataatgaggcacccctttaaaaatatggtctgagtagagacataaaagatatacatttaaactgtgatggtaaaataaccaaaaaaagaaaaattatagttcaaaaaaaggaacaattctttgaaaaaacatacatagaaacagtcaaactatgaacacctttacacattcacaacatctgcactaatgcatagaagttcaaaacctagaaggcattttctcccccatcccttctctgaaactgattcagaggtcactgtgtgaagaacttacttcagtcctgattgtaaatgtcatgaaattattttctacacagatagcaaatttagttttatataggactgcaagcatacatcatctagggattacccagtaaaccacaaatattttatccattcccctaagatacaggtaacatatggttgtggtacatcccaggcagatgtcatttaaagcacgcaaggggaggtgctagcaaaaaaatactcatttgccaaagtaacaggttaacccttccaatatgatgtaccacaaccacacatgagaaaagtcaagaacttattttattttattttaaaataaacattgaagatcccccatttcccaccaccctacaaaacttttgaatgtggaatgttcaacagcctatccattttggtaggttacaaaaccagcaaaaactccagttgtctaatgatgaatgtttgagaatagttttgtttttaaatagctgagcacctactggaagaattcctgggctaaatcagcattaacttcctaggcacacagaactagtgctcaaactgcta

SEQ ID NO: 3296 - DNA, 816 bp, Homo sapiens
ctgctatttgctcaaagttgtaggtctatgtatttccttctccaatacgtccccatttataagtttatttccatgcatacaaacgtgcacatgtgtgcacgtgcacacccacacacacacactcactctcaagtaagacacttttttgtgtttgttgataaattatgaggattatgaaccaggtgtgtacagggtttcataggtgctttgtaaacatcagagtcacttgggtcctttcctccacaagcctcaaatcaaattacgcaaccaatgaccactactttcccagacgctgttcacaggctgcatattgacgaagggcagagaaaaagtcctcataactgatgtttaggtgggaaggcaaagagacaatctcagtcaatctgatgtgccagggaagaaagcctaatgtgctgtccacaggaccgaacttcaatactaaatcaggatcaggacaaccatttgaactaagtaaactgcctaacgtatctacatccaaatctgtgggtctcttttgcttctgggccactaactggcaaaagtcctgagcagctcttacaatatctgcttttccatcttccggagacagcaccttcactgccaaatggcaatttaaaacttgatcgtctttgtcattactatttgcaaattctggtgagtattttgaacaatctaggcccagaagttcttgctgttgttttaaaatttcatccatcaatctggaattatttcttttgaaaataccttggtggtcgtagacgctaatgtaggagatgcccacggccatacaccacaccacgaggctcgcgatgtccg

SEQ ID NO: 3297 - DNA, 1007 bp, Homo sapiens
atggcgccctggacgctgtctcgctgctgccactgcgtcatgggctgggtgccggtgctcctcatcaccttcgtggtcatctggtcctactacgcgtacgtggtggagctgtgcgtgtttactatttttggaaatgaagaaaatggaaagaccgtgttttaccttgtggctttccctctgttttttttatgtttgtatggtcctattggatgacaattttcacatctcctgcttccccctccaaagaattctacttgtccaattctgaaaaggaacgttatggaaaagaattcagccaagaaagacaacaagaaattttgagaagagcagcaagagctttacctatctgtaccacgccagtttcaaaaactatcagatattgtgaaaaatgtcagctgattaaacctgatcgggcgcatcactgctcaacatgtgactcatgtattcttaagatggatcatcactgtccttgggtgaataactgtgtgggattttctaattacaaattcttcctgctgtttttattgtattccctattatattgccttttcgtggctgcctacagttttagagtactttataaaattttggacgaatgaactgacagatacgcgtgcaaaattccacgtactttttcttttctttgtgtctgcaatgttcttcatcagcgtcctctcacttttcagctaccactgctggctagttggaaaaaataggacaacaatagaatcattctctgcacccacattttcatgtggacctgatggaaatggtttctctcttagatacaataaaaattggagacaagtctttggtgatgaaaagaaatattggctactttcaatattttcaagcttgggtgatggttgcagtttccaactcgccttgtagggatgggtccagaacaagcttctgttacaaaccagaatgagtatgccagaagtggctcaaatcagccttttcctttcaaaccacttagtgaatccaaaaaactcttgttggacagt

SEQ ID NO: 3298 - DNA, 454 bp, Homo sapiens
gaaacctggaagtggaaatctcgggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgaagagctgggtcctgcagctctgatttgcctgaggttgactgtacatacaaatattgagcatttcctcctggcctccgtgataaacaggggttttgatattgttaggcgagatggaaagaaagtatcaaggagtgagctgaagccactgcccttgagaaccctctcgaggagtctggcctcatgaagatgccagaataagtggcag

SEQ ID NO: 3299 - DNA, 940 bp, Homo sapiens
gcacggccgaggcctcctcccacccgcgagatcccggcggccgccagccggctcctgcgtccgtccgtcggccgggcagtctgtccacgcgcggaaagctcggcgcggcggccgaggggcctgggagggaacgggcgcggaggcgggaccgcggctccctcccactccggggggagcccaggaggcggcggtgctggagcgcgagccggagccggagccggagacgaagagaggcggtcgcgagcacgagtggggtggggcgtgcccacgggcccccgcccccctcgtccccctcgtcccccagcccagctccggagccgcagtccaggcgcgccgcccgagggtccacgccgcacccctcccccgtgcgttctgcggccacccaggccttccaggacaccgtggagagggaacaagggggcagggacgcccccttcggcaggagccgtcggagaagggggcccagaccggagggaggcgagaagccccactgaagccgggcgcagggtctgggacgcagttgggagtgcaaagggctggctgagagccgcaggagcagcaggctgtggcccaggcctcctgggtgacaggccctgtctggcggggaagagggaccaagagacaacacggaagaggctggacctcgaacaggggcggctgcctcactccctacctgagccagccgagggggccaaggactttagagctgtttcctccggcataagagagacacttgctttccagggcagcaccctttatcggagaaggctctacagggaaggggtctttgcagcctggatggccatcccacattcctttaacggaggtctctaggcctcagagagaacccagagttagaaaggaggccagacggtccttgctgtccccctggggagagaggaagttgccgcctgctgccaggcccaggaggagctgggcc

SEQ ID NO: 3300 - DNA, 2631 bp, Homo sapiens
ggtggttgcagagtttggagccattttgggtagctgatcttgcattttctacgactcttcttggtcattttctagaagacatggaagcatatgctgaggacctcagccatgtggcctctggggaatcagtggatgaagacgtccctcctccatcagtgtcattaccaaagctgactgcgcttctccgggtatttagtactgtggtgaggagcattggggaacgcttcagcccaattcgggtcctccgattactgaggcatacgtaacagatgtaagtgcttttggattctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcatgctggtatgtgaattattcttttcctttttaatgaaactgttaatgacttgggctttggaagtagctgttttaatgaagaagtccgaaacatatgcacctttattctgtcttccgtctttccataaattttgcaaaggccttttagccaacagcatgcagcagtctacacgctctgtcctcttccttgccagatgatcttttacagagatgtgttgatgtttgccgtgttcaactagtgcaccgtggaactcgtattcgacaagcatttggaaaactgttgaaatcaattcctttagatgttgtcctaaggtataacagttcaataacaatcacacagaaattcaagaaatttctttagcattaagaagtcacatgagtaaagcaccaagtaatacattccacccccaagatttctctgatgttattagttttattttgtatgggaactctcatagaacagggtaaggacaattggttggaaagactgttctatagctgccagagactggataagtgtgaccagtcaacaattccacgcaatctcctgaagacagatgctatcttttggcagtgggccatatgggaagctgcacaattcactgttctttctaagctgagaaccccactgggcagagctcaagacaccttccagacaattgaaggtatcattcgaagtctcgcagctcacacattaaaccctgatcaggatgttagtcagtggacaactgcagacaatgatgaaggccatggtaacaaccaacttagacttgttcttcttctgcagtatctggaaaatctggagaaattaatgtataatgtatatgagggatgtgctaatgcattaacttcacctcccaaggttggtcattagagcttttttctataccagttgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaaataaccattatgatggtggtagaagcactatgtgaacttcattgtcctgaagctatacagggaattgctgtctggtcatcatctattgttggaaaaaatcttctgtggattaactcagtggctcaacaggctgaagggaggtaggtttgaaaaggcctctgtggagtaccaggagcacctgtgtgccatgacaggtgttgattgctgcatctccagctttgacaaattggtgctcaccttagccaatgctgggtgtaacagtgccagcccgaaacattgtctgaatggtgagcgttcaaaaaactgtgctgtccaaaccgactgactcttcccctgaggttataaattatttaggaaataaagcatgtgtgagtgctacatctcaattgccgattgcgctgctgtgcaggaatggcagaatgctatccatgacttgaaaaagagtaccagtagcacttccctcaacctgaaagctgaattcaactatataaagtaaggctttctgtttccactaaccaatattttaattacagatcattaagcagcttcgagtctggaaaatttgttgaatgtactgagcaattagaattgttaccaggagaaaatatcaatctacttgctggaggatcaaaagaaaaaataggtagacatgaaaaacctgcttcgtaacatgttaagtccagatccaagggaacctcagaaatccattgaagttcaattgttaagaagttctgtttgtttggcaactgctttaaacccgatagaacaagatcagaagtggcagtctataactgagtaaaaatgtggtaaagtacttgaagcaaacatcccgcatcgctgttggacctctgagactttctactttaacagtttcacagtctttgccagttctaagtaccttgcagctgtattgctcacctgctttggagaacacagtttctaacagactttaaacagaggactgtcttattccactcttcggtgaagctttacgttcatgtaaacagcatgatgtgaggccatggatgcaggcagtaaggtatactatgtaccagaatcagttgttggagaaaaattaaag

SEQ ID NO: 3301 - DNA, 1743 bp, Homo sapiens
aagcagcgtcctgaggagacagcggcacgttctagctgcgtctgcggccagcccgtgccagtggagtgggctccgcgttgctcattctctccgacaggttgtcagcctctgtccccgctgcacagggtcttgccccttctccggggcctgtgccagctcccttccctccccgttgtcctgtccccacagccattctgggagctggggaacctggtctcaaggcaggccctgcagttccacagaggtggcaggtcttgccctttggccaacagatttcttgtcctgccttctagatgcctctgagctccaaacccagggcagccatggcttctcatttacaccaacaggtttcagttccaacagaaaggtcggggtaggttcgtgcagagatggggctggcaggggggctatgggaggattattttaacagatcaagaaaatgaagccaaatcaagtgaattaaattcctcacaattattttctttccctgaggtttgattggcacagcagcaaaagttgaggccaccccacttgtgtccactgtttttagaaaaaaatgaatggcttcctgccattgtggggctggactcttgggctttcttggtgggagcggagaaggggcctcccacccttgtccgagttgcctcccactggaggtcaggagtctacactgcagcctcgggcactgtggggagtgcatgcctggggcctctgggtggggaccatggacaggccctggtcactgtcctaacctttgtcaggacaaaggtagcaagaggatttcctggcgggtgggaaggaatggctggggcggccagttttgacacgccccagtgccctggagaacaaccagggtcatctgcacttgatgactgctccccgacccccagcccggacacctcattcccctcccactacagggatcaagtgacctgggaagaaccgagtttaacaccaggatgtgtttccttagatttcctttcctaggcgatttccagggagagccctgattggacaatcacatcacagatcacactgcagtttccatgttagcactgtggatgggtttttaatcaataaaaactgggggtttcttctcaccgactctccacttgcccaaactgccaaaagctggtgattctgggacaggccttcactttggagccacgggatggggtgggggagccccatgggcctgggaaggagggtgctgtggagggggctgcagggctgaccagcaggcagcctcatctggtcgggggcgggggcggcaggagcagaagcggggtctccgtccttgggactgtcctggttggccacgggccctgaggatgcacggtgcctggggctcctgtgccggtgggcggggggcatgctggcctctgagcgatcaggcgaggccagcgagggtgtgcttgcaaattcaagcaataagaggggggttcctgggggcttccagcccaggctagaagcccccatggcttctggcagctggacatcagccccaggtattggggtgattttggtcatgacagtgtgcctgtcccactgttacacgcatgaatgggggttatggggtgggggtggggactcagggctggaccgacgtcctagtggacctgatgtgaaattcctgtcaaacaaacaccacttttcaatggtttgctaggagtatttctgtattgaaagtttctaattatgctttttaaaaaaatactaaaaataaaggttcaagctgccaaa

SEQ ID NO: 3302 - DNA, 1196 bp, Homo sapiens
ggcagagcaccaggtgcataggctgagactgcagacacctgagcatcctatgctgtgaggcgaaagcatccggttttttcgggatgggcctgtccaggaaggttctcgaatgccacgtgattagaaaatttgccgctgactggttgtgcgaatcaaacaataggatttccttatttctatttctgagcataatgagaaccctttaagggaactcattgtctttaaatcagccagcctctagtgaggtcatggagacatgggaagcaggtattcacattagctctattcaagaggaagaggaggagggagtgtgcgcaggcgccctagggtcttccccagcacacgttgggaagaaggggtctgcaagcatgcgcacaattgccagctcaggctaaggactgcaggaggttccaggtgggttgcgggcttcgggcaggctatggtgaggggtcctgagggccttggtgaccgctgcagggagttggactttttgaagcgtggctcaagaaaaacccatgtttaattcctgcctttcgcttcctcagcagcctttctgggcccaggcaggggcctcgagccagggaaggatcctttgatgaccagaggggacagcagggagggcacagcgtggtcgtccacggtcacttgcgcacgagccagtgctgctgctggtgttagacaacaacttttatcaaagtggtttaatgtacagcagcaacaaagctgctttgtggagcagggctcccaataggcagtgtgcccagagtagcagctcggaagcagtactgcaatcacatttatacccactttcaactatatgcaaatttaggggtggattatgccaaaatttctagaaaaaaggtcgtaacttccaggtcgtgggattgttgctatggaaaggagccaaaacttccagctgttgccttagcaatggtaacctgacgtggcactggtgagtgtgttttatggagagactctttcacctcttccctttcagcttgtcttcagtgtggtctggagcccaatccccacctccagagtctagtcctgcctcctacctcagtaataaaaagtagtagtatatggttaattgtcaaatacatttgcaaagtgtaatcaaagatacattaccaatctgaatctcaaaatgtgctatcatctttgaatttgaataatgtattattaaagaagttaca

SEQ ID NO: 3303 - DNA, 4233 bp, Homo sapiens
ccacgaagcttggccaactcctggtccttgccttccttttccgtcagggcatgagccagtgcctcttgcagggtagcgaactccacacgctgctcgttgagggcgttctgcagccgcatctcaagctctgctctggccgccttctccagggcaaggtcagcctgggcacggccccgctcctgggtcagccgcgccacctccctttcctgctgcccacgctcctcctgctgctgcccctggctctccatcagcgcggcccgcagccgttccagctcattgcccatctgctctgcctcccgctccatagcctgcagcgctgcctgtgtgctgcagaactggcgtccctgttgctcttccagccactcgggctgtctgtctcctgccctcgcaggctccttgactaactcccgggaggctgtttcctgctgctcacctgccttgcgcaccaaggtctccaagcgggccacctctttgctggtggcagccatcttttcctgcagagtggagaggtcatctgcaagcttctgggccctgacttccttctcttggacctgctggagtgctctggccaggttggcatggagctcagctagttcgttctgctgccggcttatctggagctcgctgtgggattctatgcctgccaccttctcctttgcctcctgcagctcctggcgggccttctcacattcctccttcaaagtcatcagctgttcctggaacatggcgccatactgtgcctcctcttgctggctatcctcataccgctcacgccaggcagctacttctttgacgagctgctcacactcactctcagctgtgtgctgggcagccatggcctctgccagctcccgccgcaggacttcagtctcagcctgatgggcctccccaagctgctgtaatcgagcctccagccccttgcgcccagccctctcttcttccagctcctttcgttcccgcttatgctgctccaccaggcttcgggtctctgccttcagctcagagatacaacgctgctgctcttccagggcatctgcagccctgcgcttctcctcttcaaggctgcccttggtgaccttcaaggactctttgagggcctggagctgctcctggagctggtccttctcctgggccaccctttctttctcagttgctttttgctgctcagaccgcagctgcaactctagctctgcaacctgggcctgggcctcatgctgttcctggcgggctgtctcaacacaggcctggagttcctccaccttccggctcagctctgccttctcccgctgggcctgtgtcactgaggtctgggcactgtcccgggcttcattagccacctgaagttgctgctgcagaatctccagcttggcagccttctccttctccagtgcctccagctgcttgagagccgcatcccgctcccttaaggaggcctctcgctcctctgcagcagtggccagttgctgggcatggtcctgcctagttgcctcctgcttctccgctacctccttcaactgctgctccttctgcttcaggctactgcttagctgctccacctggtggcggaggccctgggaggcctgttcttgctgttggagggtctgtgctagctgggcctgcttctctttggcctgctgcttcaggccagccagttcttgatcctgttgctggatggtggcattgagtgtggtgagctcagaggtcagagaggccacctgggcagtcaaccgggccccatgagcctgggaggcctgctccagctcttccttggcctggctgaggttggagatggagctctgcaggtcagtgatcaggctagacagctgctgcttttcttcttcgaagtggccccgctcagcaagcagcttggcttcctgctggcctcgctcagtctccagcatctctaccctggcttggagctgtgtgttgtttgcagcaagagtggctgcctcttgcttcaaggtttccagctggtggtataaagagacaaactgggatcagcatgactcctcagtcatcaagactcctctggaaatggaggaacaccaggaacccaaatgtactgaatgtgagtccacaccaaccagcagcacacaggtctttctgtgcattcctacctgcaagacatcacccagcacctcgcccttctcctggggtgggttatcctgcagctgggacaagtgttcttccagctgtgaaagttttccctgaaggatttcgttcttctcttcaaggcatttctgggagtaaatgagacccatgtgaacagagagggggaacaggcaccagattaccacacaagccctcataaacatcagcaaacatggggcccatcatcttgttaccaagatctccttttgccctggcctagaaaaaagcagaaaccatggaactgggagcatgagggacctgattctctagacctagttctaaggcacaataaagtcataatgtaacctgcttactacttccccaaggctgctgagtttacttcaaatttccttaccgtatacccttcctcagataagtcttgagtcctagattatccaaatcaccaccagctgcccaccatcctctgggcagcaataccactggcagcagctactcgttactactcccattttagggaaaggatgcttagaaaaacagactgattaacttgtccaagatccacatcttgtgaacagcagagataggattgaaaggtgtactataaagtgagggcattgactggggaaaaaaaaaataagttaaaaaaaaaaggtgtactagactgaagcccacaatctttcaattacagcacactattgaaccttgaagagaaagcaacttaatacccaaaggcccagaagagcacagtggtaaactggactcagctttgcacatgtggtcaagactgtggctgtgaccccagcagagggttaccttgtcctgcagggctgcgctgagctccttctccagctgggcctgcttctctagccactcctgagtggccttgctgtgctcctccgtcagctcattgagggcatcctgtagctgctgcagatgactggcaaactcccgcagctgagacgggcaagtgagaatccccatcacccagagtcaacgctgaccccaccactgctgtctgctcccagaaccccaggggctggatgcctccaattatcctgccaaccctctacaaaccaatcacagccatcacacctctaattcagaactacaaatcaacatttagggtcacagcccagtacccgggaagccgccaattatgggataaggaaaggggcaaaatatgcaggtctctggagagactgaagcataagacaggtgctgggacattcttctcaaccctctcttggggagccttccagaccacctcagccctgaggggcctccatgcacacaccaccttaacacccaccttaaaggaaaggtctccattctcctccgaaagctggttgattttgcgatccatctggctcttctctgtcttcaggtcctggcactgcttcagggtttcatgcagccgcatgcaagctgcttcttcagccgtctcatctggaactgtggggtctgcaggatatcacccatgggagaagctggagaacctgagagaaagctgaggagggagaaggcccatatgcattggtctcatgaggaacctgaatacaaggaacatcaaactcaacggctagaactcgcctagacctccttcttacattcctatcatccaccagctgacctcttcatcagaagaccagcagaacgatcactctttctactgtagtaccagccgaggccattgatatattccgtacttagattccttatcattatttcctggtttatgtatctgcctttccacctagaacatgcactacatgacgggaaaaacattttttaaaagactgtgggccgggcgcagtggctcatgcctgtattcctaacactttgggaggccgaggcaggtggatcacctgatgtcaggagttcgagaccagcctaatcaacatggtgaaaccccgtctctacaaaaaatacaaaaattagccaggtgtggtggcatgcgcctgtaatcccagctactcgggaggctaagcaggagaattgcttgaacacgggaagtggagattgcagtgagctgagatcgcaccactacactccagcctgggcgacagagagagactctgtctcaaaaaaaaataaaaataaaaataaaaagactgtattctc

SEQ ID NO: 3304 - DNA, 1120 bp, Homo sapiens
tacagtgagagaaaaatggaattccgttttattttgtcctctctgaaacttccatttacaccatggcctcatctatcaagaagaggaagaaaaggctctgccttataccataaaaatcaagtactcatgtacttgttagaggtggcaggatatttgtttctccagttttttggctctaagaaattacactttcagtaccagtgtagtgaggaaccactggcaaactgttggaaatgtcttctggattagtcagtgtaccatttcataaagtgcttctggagttaaaatctgccaagctgtcaaaagtgtccacacttttgcaacaaaggataaaagatcccagtgggtatcaccgagtccttcccagctgggtctcattattggcactgctgctttaacctccaagccgctggccctcaccccaggcgaagcctcctggccgttcctcaggtagtggattgtaatttggatcctcatctggtgtatcaaaaatagctttcaaaatagatggtgttttcagaattcttattccaccaggttgattgggaaatacatcttccaagaaaaaatatatgtgtccaactgcaatacccaaaaggtccacaatgattgagttccccaacaacaaggaaaatcccatgagcacccagggcagaaagggggcctggaagttgagaaggccgaagaagttcatgcggacataggggttccttcggctccacacatagacgagcattattgtaaaggcctggcccaagaaaactaagctcacaaacagaccaaaaagggtcattaagaatccaccaaaaaggaacataaatacaaagtctgctgtccgacctcggaaagagccttcttctagcattcgacagtaacgatatagaaaaatcatgttaaataaaaaattgaatccaactggcccaaaaaataagaagttggtgattaatctccatatttgaaagtgtttaaagattaattcaggattgaagtacaactgaaaaggtgtgatcaattccaactgcacggcggcggtggtgaggacgcaggcagtggtgtaggcgcggctgaccggtgggatctgcaggtactccagccgcaagctctggtacgccatcttccc

SEQ ID NO: 3305 - DNA, 15298 bp, Homo sapiens
actccgtggcggaaggcggctagagcggctccctctgagctctccgagagattggtcgggacctgaagcgttgaggttaagggcaaggcaaggagcaacgaggagtttttcgttacgttagaaaaatttcgttgcgtgctgaagcgcttttacctgtgttgtatgatttaaccttatgaaaatggacagtattccagttttacaagtgaggaaagaagattaagaaacttgcctccgccaggcgtggtggttcactcctgtaatcccagcactttcggcggcgaggcaggcggatcacttgaggtcaggagttcgagaccagcctggccaacatggtgaaaccccggctctactaaaaatgcaaaaattagccgggcgtagtggcacgcgcctgtaatcccagctactctggaggctgaggcaggagaatcgcttgaacctaggaggcggaggttgcagtgagccgagatcgcgccactacactccagcctgggcgacagcgcgagactccgtctcaaaaaaaagaaacttgccttgagtcctacatatagtttgctgtagtagcagaatttgaactcggaccgactaatggtctacttaataaaatgctatttggattctctataaaattaataatatagaagtaatgttaattatagaaaacttggaaaatattaaattcattcgataaagattgaatatgtagcacgtgtgtttgtcagatactggtctcgtgaaaattatattctggtagggaagacagaaaacaagtagggataaagaaatttttaaaagatattcataagtagtgtcgtgtagaaaactgggtataggttgagtatccttcatcccaaatgcttaagaccagaactgtttcagattgtggctctttatcttggggatggggccagaggctaaacttgaaattcatttatgtttcgtatacaccttatgcacatagcctcagggtaattttatgcaattttaaaaattgtgtgtgtatcaaacaaaattttgactacagctttttacatgcggtcaggtgtggaattttccactgtggcatcgtgttgatgatcaaaaagttttgattttggagcattttaatttcagatggttggattagggttgctgaacatgtaatggtatacagaacaactgagtaggtgtggtgctcacgtctgtaatcccagcactttgggaggcctaggcgggcgaatcacgaggtcaggagtttgagaccagcctggccaacatggtgaaaccctgtctgtactaaagataaaaaaaattagctgggcgtagtggcgggtgcctgtaatcccagctgctaagaaggctgaggcaggagaattgcttgaacccgggaggcagaggttgcagtgaggcgagatcgtgcccctgctctccagcctgggcaacagtgcaacacttcatctcaaaaaaataaataagaagtaaaaaataaataaaatcgtaggtattatcatctatcgacaatctgttctccacactgcagccacagtaatcttttttagtagaggagaggtcttgctatgttgcgcaggctggtctggaactcctgggctcaagtgatcctcctgcctcagcctcccaagatgctagcattacaggcatgagccaacacccctgtcctatacctaggatttaatgaacattcaatatgtggtaggcagtattctaagaatttgaggccaggcacagtgcctcatgcctgtaatcccagcactttgggaggctgaggcaggcagatcacttgaggtcaagagtttgagatcagcctggccaacatggcaaaaccccgtctctactaaaaatataaaacttagccgggtgtggtggcaggcacctgtaatctcagctactcgggaggctgaggcaggagaattgcttgaacccaggaggcggaggttgcactgagctgagatgaagcctgggtgagagagattccatctcaaaaaaaaaaaaaaaaagccgggtgcagtggctcatgcctgtaatcccagcactttgggaggccaaagcgggtggatcacgaggtcaggtttttgagactagcctggccaacatagtgaaaccccgtctctattgaaaatagccaggtgtggtggcaggagcctgtaatcccagctactcaggaggctgaggcaggagaatcacttgaacctgggaggcagaggttgcagtgggccgagatcgtgccattgcactccagcccaggcgacagtgcaagactctgtctcaaaaaaaaaaaaaaaaaaaaaaagcacgattatgtgttagctcatttaatcctcataacagcctttgacataggtactactattatcccctgcttgggaaaatcacacacctaatcagtggcagattatagacacgtgccaccacgcccggctaatttttgtatttttagtagagtcagggtttcaccatgttgtgcaggctggtctcaaatgcctgacctcaggtgatctacctgccttggcctcccaaagtgctgggattacaggcatgagccactgcacccggcctggagaggtacctttaaaccatataaatatcacattcctcattatgcttgtaatttgtttatgtttgtattcatatattcacatgagctcatggtttatttcttctgatgggttataattaattactactattacttattttgatgctcaaatttgtccagtgggaacccttttaatctgtgtgtcatttcaatgattcatcctcatcaatctttgggcactttttctctctggcacaagaagttccacactcatgtattttctctgccccagccctgaatttagccattttatcaaagagtcttggttcctttagttgatgttatggactgaatattcgtgtccctcaaattcatatgttgaagccttcaccagcaatgtgatggtctttggtgattcagcctttgggaagtacctagggttagatgagataatgaggatgggactgtcatgatgggattaatgcccttttaaaaagggacaccagagagcttgtgctgtctgccatacaaggacacggtgagaaggtggccatctgcaagccaggaagaaagccctcactagaaaccaaactggctggtactttaatcttggacttccaagcttctagaactgtgaggataaatttctgttatttaagctgcccagtctatggtattttgtaatgcagcccaagcagactaagacagtgaagaatttggaaggcaagatatgggtactttatgtgctcattattattggagcataactgctccaaggccaccttggtggacagactagggaatatacatatttggacacatacacacgtgtatatttatatgcttatatgtcctctatttttatttgaggcaggatctcgctctgttgcccaggctggagtgcagtggtgcgatctcagcccactgcaacctctgcctcccaggttcaagtgattctcgtgcctcagcctcccaagtagctgggactacaggtgtgtaccaccacacctggctaatttttgtatttttactagagatggggtttcgcagtgttggccaggctggtctcaaactcctgatctcaagcgatctgcccgcctcggcctcccaaagtgctgggattatatgcgtgagccactgtgcccagccgatatttcatctatttttatagattttaaaccatgaattcactttcttaaacccaattcaagctgaactccaggtttcattctagtttcccccctttctgtatttataattaccttctctgtggttagtatattcactttattccatcaagtctttggtgtgcaaccaatctaccatctctgctgacacccttaccccatatggacacccctttctgtgcttgagcttattcctcattccaggttgcccctatccaccatgtgaataactgcctcaatctgtccctgacacctcatacctagctgtccatcattgtagacactgtcttcaccctattaggtctctgacacccaaatttggacttccataggtcccctctacccaatgtaagcacattgatctgaaccactgtgcaaacacgtgcctgggactgctatccccagaaagtcctgctggcaaggttggcccttgccaggcatctgggaacttgaatttgaggggagattccctctattccctaacaagcttactatgtctaacagtgaggcttaacactttcacatgctgtcacttgttgctggagtgacatcctgtgtgacttcattaggagagaacccttagaagctggtgcttggtttcctctggacttcacttaattccttttttccctttgctgaatttgcttcatatccttttgctctaataaatcattgttgggaataagactatatgctgagtcctgtgagtgctcctaacgaatcatcaaacttgcacatagtctcgagggcttaaccacctaatgactttaaaacaatagttctggcagggtgtggtggctctgcctgcctgtaatcccagcattttgggaggccgaggcaggaggatcacttgagcccaggagtttgagactgcagggattttgagactgattacgccactgctgtccagcctggggcaatagagactctgtctctaaaaaaaaacctcaaccccctgaaaaaaaaaaaatccacaacagttcaggaaggaggaaggtaagcaatttagtgacattattaatttcagctcttccatcccactgttttatcttacacttctttgctctgtttttctttccttgatttcatttgactaatcacataattcttagtgacccattttatcttctctaatggctttttagatctactgcaccccagtgatggggtgagagattacaaaatgcattcttatcacaatctaccttacactaatgctatctcactttgtgtacaatatagtaatattatctcaatataattacatttattgccctctctgacccttcatgctatttctgtcctatattttacttatacatatattataaacactgcaatactatttttgtttgctttaaacagcaatgatatttagaaaaataaaaaagaaaaatgtctttcttatttaccaacatgtttatcatttcaaaattcttaattccatcctggagatacaggttcccattgggaaatccatttactgataagtccatccaaggaaaattttaatttcagatactacgtttttcactccagatttatattttccttcagcctgaagaatttcttaaagcattccgtataaagtcagtctgccagcaacaaattctgttttcatctggaaaagattttgtcttaagtttttcaagagatagggactctgtcccccaggctggagtgcagtagcacgaccacagcccatgcccagctaattttattttttgatggggttctcactaggttgcccaggctggtcactcatggcctcaagggattctcctgtctcagccccccaaagtgttgggattacaggcataagccactgagcctggccattgccttaacatcttgaaggatattttaactggatacagagttttaagttaacctttgtttcatctttgcaccttaaagatgtcattccatcattttcttaattccatcatttctgatgaggttagccatcactcttgtttatctgaatgtaatgctactccttcccactccccaccttgattgcttttaagattttttttttttttttttttggcaatgtgatgtacccagatgtagtctttgttgtatttattctgcttggggattcagtgaacttcttagatctgtacgttgatgtctttcaacactttggggaaaatttcacgcatcattgcttcaaagatttctcttgccccattctcttcctttccttctttacttcaaattacaggaactgataatgttccaaaggtctcaaacctctgctatttcttttttctttctctctctgctttggtttgatacttacttgtctttttcagtctttcctgttgtgcctagtttactgttaagtccatccatttaaatttttaatttcagatactgtagttttcattacaagactttccagtgggttattttttattattttctaattattattattattatttttgagacggttgcccaggctggagtgcagtggcgcgatctgggctcattgcaagttccgcctcctggggtcatgccattctcctgcttcagcctcccgagtagctgggactacaggtgcccgccaccatgccaggctaattttttgtatttttagtagagacggggtttcaccatgttagccaggatggtctcaatctcctgaccttgtgatctgcctgtctcggcctcccaaagtgctgggattacaggcgtgagccaccgcgcccagccaattattattattattttttgagatggagttttgctcttcttgcccaggctggagtgcaatggcatgatcttggttcactgcaacctctacctcccaggttcaagcaattctcctgcttcagcctcccaagtagctaggattatgggcatgcatcacccatgcccggctagttttgtatttttagtagagaccgggtttcaccatgttggtcaggctggtcttgaactcctgaccttaggtgatccacctgccttggcctcccaaagtgctgtgattacgggcgtgaggcacggtgcctggcctctgttgggttttcaattcttatttttctgctgaaactccctatctattcacccattatctcttcttgtaaattcttttaacatattttaacgctattttaaaatcactctcatagaggtcacttgtgcatctgcttctgtatattttctgttgagtatggtatggaccacttttttttttccatcagggaagttgagtcaaaaggatcacataatttttctttgcatgcttagtaactgtttattatgtactgagctttggatatatgctgtgatgactgaattgttttcttctcaagaatgctgtgttttgttctggttttaaattactaatggataaccttgatgctgtgagatttgattttaagcttcattacagtaagtttatttccattttgtccttagtgctgaagcacagcctttagttctaggatgctgtcattcttccttaaggcgtggcattttgggggttcaatgggaaacaccaagtatttactcagtccttcttagtggaacttgaatttcaaactctctgtccttgggcagctgcaatcgctgctgagttttttagactttaacttgctttctcctgggttcctttaaataatcacactgcaccagcacaattttggaatccaccaaggatttgaaaggaatatgtaggcagattttagagcttactttctgaggcactctccttcccaaaatttctcttctaattttcaggtgttctagaagtcccaaatgattcctcagcctgtcaaaactgtcacattctacctgaattctatatccaagtgaactgcacaaactggaaattgccctatgggtaaaagctggttaaggtgaatctcgtttactttttattttttgagacaggttctctgtaacctgggctggagtgtggtggtgtgatcttggctcactgcaacctcctcctcccgggcttaagcgatcctctaacctcagcctcttgagtaaccgggactacaggtgtaggccaccaaacctggctaatttttagtttagttttttttttttttttttttttggcagaaacagggtctccctatattccccaggctggtcttgaattcctgagtgtaagcgattctcccatactggcctcccaaacaggcatgagccaccacacccagcctgaatctcttccattataggactttgcagtttctaccttgttttgattgctctgcagagccacccaatcattgctttctatattttgttaagcgtttataattgttactaagagtccaatacacacaactccttcattatcagactccaacccctaaaatatcaaaaagttttaaagtaaaaaagtaaagacaaaataaagtttatcatttatttccaatacattaggataaaaacccactttatgcaactgtaccctttaattcatttcttctgaagaaaagtacaaaagaccagactaaaattgagacaagcatttaaaggaaaatcctttgactcagagtccaaaaccgaactgtaaatggttcattttaccaaaagaattagtttttgtacaaaatataaagaattctacactataaacaaagacggctgtatatgtaattaaattagaattctagtatctgcttttcctctaattcttctggagtacaaacatatttgcaagtcagaaatctaatattctcaatggacagactgtcttagaataagcttttacccttaagatatctggaaagatagtactcattctttcccttggctcaaagtccaatatatcagtaagttttaatttagtttacaaaactctgccatattaacatgaagagcacactaatgcttaatgtttaagcattatcttttaggaagtaatacaacacagagctcaacaccgaatctaaaaggtcacaatctaagtcattattaattcagaaaacttcagcaacttctatctttattgaaaaagaccaaaccaatcccttatctcctactatatcattactctattttcatggcccttctatcaaagaaacagcttaaaataaaacttggttagagttaagtcatagaaaatagttctctagcactagctgaagttcagacttgatcaggaaagcaacttctatacagtaatgattttctgactcagtgtttaagatagtattaacctgacttttatctcttttaacatttgaaatctttgttatctaaaagtctttcccaatagaattataaccatgatagttttaaaggagacaatatattaaaagttgagctggaaccacatagtcctttaatatgattagccagttatccaagtatcaataacgttaatcttttaaatgaaaacaatgaaattttatgagcttaactgaaatgtcttaatttagaacttctcaattcttttcatcatatatatttcattactacctttcgttatcagtatttcataattgatgttgtaatgtttgagaccttaaagggatactacccatcacctaacatatgcatagctctggcttgaaaaaaattttttttcccctatttatctcaactctcatttttattattcagggagttccaaagtcatgattggaagagacatgatttaccttatggctacaaacagcatatgatcctaagaaatcatgcatcttctggctgggcgcagtggcttatgcctgtaatcccagcactttgggaggccgaggcaggcggatcacctgaggtcaggagttcaagaccagcctgaccaacatggagaaaccccatctctactaaaaatacaaaattagctggggtagtggcgcatgcctgtaatcccagctactcgggaggctgaggcaggagaattgcttgaacctgggaggcggaggttgtggtgagtcgagattgcgccattgcactccagcctgggcaacaagagcgaaactctgtctcaaaaaaaaaaaaaaacccagaaatcatgcatcttctatattcaaacaaatctttaacaagagcaagagtaaaattaagaagaatgtatgtcttcattataaagttcttacctagtaggggcaagttttttattttaatgtattctttcaaaacctaagaaatctttcctaaatgaaaaattcttgttactactacaaatattctttccactcatgacattttacatagcatcatttaagcaccagagaaaagttctgtaaacaaacttttaaccagtaaactaagggcaaatatctatttgcctttattacaatatttaaaaggccatgatatgagtctctactccctacaatgacatttttataatgaaaatccaggcatatttatacaaacaaatggaattactgtacattttgggagaacaaaaggcagatcaacagactagaactagaacttttgagttaataaagcaagcagaaggaactagaaaaatgtatgccatgtataaaaattcagtttttttaaagtttcattgaagggattaataattattaagaataaaagatggtagttccacttgcttataattatcctgtaaaattaagaaagtaataagcaataaattagaaatgtcttagttcctagtatttcccttctcttgcactggaaacattttcacagcagttaaaattggctctcttaaatatcagaataattcttgcagaaaataaattccatcaggaagaagttaacagtctacaacagatttctgacaaatacattagaaaaaaaaatactgcaggtcacatgaagactgatctacatgttatatgacagagtaactcaaaccttcaaaccttctctattttaccatatttgcttttttgctattatattgctatctaaactgtttggtagcaaggtaatagaaaaataaaaggtaaaaagaacacaacaattgtttaatgtctgtagatttatgaagaagaaactctcaaaataaactttttcctattacagttacttaggaaaaaagtttcatttggcacactgaatttataaaacgaaaaaagaaaataaacttaagagtgtttggcattccaatcacctgtagttaagacaacagtagaaaagaaaagtaggagaaattactattttaagaaaaaacatcagaagacaaacaaacaaatgttcttgtgtcttctaccattcactgttcctggaatactttcatctgcaacacaatatacaaattattatttacattatgattatattggtaaagaagaccagaatcaggttttgttgtgctctaacttagtgtccattgggataactgtgaccatcaaggcaaggccttaaacaacaaaaaattacatttgcattgtatattttgtttaagtctgttttctggttcatcttcaagtttggtgcacaaatatgtaagactctaaaaagtcctgtaaacttaggctgtttctgtagccgatgacgttcattgaagatcttgtgtttcctcttttaagtaaaatgttctgcaggtttacaaaggtatttccttaaacagtggtatctccaaagtccttgttccaacgtatgtacgcttctaaagtttgagggctgacgctgcgttttatttttttcaaggattcagtgaagtcagataatcgaatatttctcatctagatttttaaaaagcacatgacaatacaaatgatcaacaggtatatggtggttaacgaaatgatggattaaagtaatgatgctgctgtttcttaatgttataaaaaatatacgtgtatgtattcttagaaaattatgtcagccatttaaatatattttctatgttgatctgctacacaagaaaccttaataaatgctatactaatatatttattacttgtgtttagtttcataggtattaacatttgaaagcataatatttttccaatataaaaacaaaacacaatcatttatagaaaagttcaaaaatacagacaaagagaaaaaaagaatcacaatttcaccactcagatatgcaacctccccctccaaggttcaagcaattcttctgtctcagcctcccgagtagctgggattacaggcacatgcctccatgcccagctaatttttgtatttttagtagagacagggtttcgccatgatggccaggttggtcctgaactcctaacctcaggtgatccgcccaccttggcctcccaaagtgctgggattacagacgtgagccactttgcccagcctaaagtatgcatttttatattaatttggtcttattttctgatcttttaaattgcctttggaaatatagattaaaacaatgctgagttaatgaatatctatatttacacctaagtatttttaaaaggcaaaatggataggttcacagagtccaggcaatagaaaaattaataaaaattttggccaagcacggtggctcacacctgtaatccccgcactttgggaggccaaggcgggtggatcacctgaggtcagcagttcgagaccagcctggccaacatggtgaaaccccgtctccactaaaaatacaaaaattagccaggcaggtgcctgtaatcccagctactcaggaggctgaggcaggagaatcgcttgaacctgggaggtggaggttgtaagtgagccgagatcgtgccattgcactccagcttgggcaatgagtgagactccctctcaaaaaaaaaaaaaaaaaaaaaaattaaggcaaaatgcagtttggcataaatgacctgtgttaaaaatcatttctagcgtatacctgtattttggcccaaaaataagaagttaaagaactttaaacaaaactccaacaactggtatttatccgtattttaaaaactactcttaaaaacccaatctaacttcatatcatctttgatatctccatgagatatcacctacacttgtaacttgtaaactaatctgaaaaattttagccaaaaagaaaaaaacatatagttaaaatataggctggctgcagtggctcgcacctgttaatcccagaactttgggaggctgaagcaagtggatcacttgagcccaggagttagagaccagcctgggcaacatggcaaagcctcatctctacaaaatgtacaaaatttagctaggcatggtggcgcacgcctgtagtctcagctactagggaagctgaggtgggaggatcacttgagtctgggaggttgaggctgcagtgagccatgagcatgccaatgtatttcagcctgggagacagagtgataccctgtctcaaaaaaaaaaaccccaaaaacccagcaaccccccaccaaagaaaaccccataagcactatatgaaccctacttgtttcctatttaactgtaacacacacactgcctcttcctaaaggccaaagtgtagaagaataatgaatgtaacatgggtattaaacatgatattactaaataaaatttatttgttatagaaattaatatttttgttttgagacagggtctcactgttacccaggctggagtgcagtggcatgatctcggctcactgcaacctctgcctcccaggcttaagagatcctcccaagtagctaggactataggtgtgcgccaccacgcccagctaactttttgtaatttttgtagagatgaggatttcaccatgttatccaggctggtctcgaattcctgagctcaagggatccaatggcctgagcctcccaaagtgctgggattataggcatgaacaaccacgcctggccagaaattaaggttttaaaagatgttgatgtaattgtactttaagtctatagtttgatatgtgtatatatatgaaacttatatgatattttaacgtaagagactaatgtatacaacaggaaaaaggcagatggtagctggttcagttaaggggggaaataagtagaaaagttgtcttatcaaaccaaaataataaaggacttaaagttaaattagatacacaaggtacttaaaaaacaaagtatattgtaccccaatttataaccaacaattttagtactaaccttaaaaatacagaaattccaaaccaattatttgaacttctactattataaactgtaaaagataagttgggtttttcttttttttttttttggagatggagtctcgctcctgtcgcacagactggagtgcagtggtacgatctcagctcactgcaacctccacctccccaggttcaagcaattctccttcctcagcctcccgagcagctgggattacaggcatgtgccaccacgcccggctaatttttgtatttttagtggagacggggtttcgccacgttggccaggctggtctcgaactcaagacctcaggtgatccaactgcctcggcctcccaaagtggtaggattacaggcgtgagccactgtgtgcgaccaagttgggttttccttacctaaatttatatatattcaccggtaactgacaatacactttggtattaaagttgcatcaaataatgggtatataaaattctagtatacagttttagagagcaaactacttgtgtttacgtctcatcccataaatggaaatgagagaatggattaccttaatctctataataaaatgccactatcagttttatattttttaaagttatttaatggatctttacatagtgtttactacgtgccagctactttaagtgctttataaatattaactcataagtaagcaataacagctaaaggtcattatcaaattattaataccaaaaccactagattaaaaagaaacaactgaatgaaagtatatagtagagccaggcatggtggctcacacctgcaatcccagcactttgggaggccgaggtgggcggatctcctgaggttgggagttccagatcagcctgaccaacatagtgaaaccccgtctctacaaaaacacaaaattagccaggcatagtggcgcatgcctgtaatcccagctactcaggaggctgaggcaggagaatcacttgaacccaggaggcggaggttgcagtgagccgagattgcaccattgcactccagcctgggcaacaacagcgaaactcagtctcaaaaaaaaaagtatacagtagaaccaaatattgtaacaatataacctgaatatatataattaatgggatgctcacaaaagggaccagtaatattcttccttgtaaatcactcagtagttttattaagctttaatttttagttttaccatctaaatttttaataaataatgttatgacttttaaaaaatggtggataaaattatatttttaggtgtgggattaaaaatttcaagtctggcacggtgtcacacctgtaatcccagcattttgggaggtgcaagtgggaggaatgcttgaggaatctgagaccagcctaggcaacatagtgagaccccatctctacaaaaaattaaaaatttagctgagtgtggtggtacatgcccgtagtcccagcaactcaaaaggctgaggcaggaggattgcctgagcccaggagctagagggtgcagtgagccatgattgtaccactgcactccagcctgggcaaccaagtgagacactgtcccaaaaaataaaataa

SEQ ID NO: 3306 - DNA, 288 bp, Homo sapiens
gggcgctatctccaactgtctttgcacttctgagtaagaatctgatgattgtgcacagtgacctggctgttcacttccctgccattcagtatgctgtgctctacacattgtattctcattgtaccaggcatgatcactttatctctagtagcctcagttcttcctctcctttgtttgatggagctgtgattagcactgtaactacggccacaaagaaacatttctcaattatattaaatcttctgtgaatattacttaagaaagataaccttaaccaggacacgaggt

SEQ ID NO: 3307 - DNA, 2584 bp, Homo sapiens
ctctcggctggcgcccggcggggctccggggctccggggctccggggctcctctcccgccgcccggctcccctcggcccacggcagggccccggtgtcctgggctggcagcgaagctcggagctctgggcgtgcggcggctgcggtggctcctgggctcctccgtccaacccgggccgcggagcctctacgcgcaccccatccccctcccggctgcggagtctggcggcggcggggactgctcgggacccggacccccggcgcctttcgtcccctgtccccattgtgacctgtctcttggccccggagccctcccgccccacccgcgccggggtctccagcgcgaagggctcagtctctggtgtccccggcctggggctggcaagctgggttaggagctatgaccttggggcaaatagggatacgatcctagaggcgcaggggagcgcgcagcatgagtgctgagaggcacgcgccctctgctgcacggccgtggaataaaacgagacaacggccccacagtcccctgcccgcagcccacgctcgggcgagcctggaggattgcatttcctcgtaggctggcagagccttacatgaagcgctcatcttctcctactttcctcctctttaaaaaattaacgtgggtgaggagacgtcctagttgagtacatattgatttgaaataaccaaaacttttaacaaatcacttttctcagaagaatccagtaagagaaagataatttcttccaaagacatgagacgttccctggctggccaagaaaaattggcatctggcatacctaggaatcattcaaaatagtttaataggaaggacattttgaggccagccagcattatgacatttgtgggtcctacggcatttcaccttggaaacattttcctgggcatctaaaagtattgtggacctgagacactgtgcttacagggcctactggttttcactgtatgagaccgagaatggattatggcagttcctcttacctccgctgcatacttgactccatccacggtgtgctcagagccatgatcatccgaagagccccagtgaagatgaaactggcgaagtcggtagggtccagggagaggaccccctctcagcactgtgattcagataagcttggtcaacagtgaattcatgcttcttttacagagctctactttaaccaagtgctcttagagccaaggcttaatggacaaaatgtggtcagtttgctgggtggatggtgccactcccaggacactggactcctcacaaaatgaagtctggggatatgtcaagataaatgattgttcttttctgtctttcttattttgtttgcttgtttcattattattgaaacatcattttaacatttaggaaagcaaaattaaaacaacagatagacaatgaggatgcatacacccaaagaacaagtcagtagtgtggtgcagtgggaagaactggacagttgagaaccaggtggaggtaggtttccaatgctggcttcaccccttgctagttctgtggtctcaggcaagttgctaaacttctctgaacccactttcacatctctaagaaggtgataataataccaaactttcagagctgctgtgaagattaactgagattaagcaccttaaagtgctcatcatagtgcctgcatgatgatcactgagcagatgtgaattccttctccacgtgttgcttccaactacacttttcttcaagacaacgagcaaaaactttcatctacgtctaatttagactgtgtctattcaaatgagatgaaatggaaaattcagaaatttcccagaaaaccaatcaatgtggatgattaaactagataattctcagcagcattaatttgggcttgttgataaacatctcaacccattgcagagtgatttagaggttcaaatgtcttccaaagtatattggaaactatgcagaaaccctaagatcaagatttggcaatataagctagatcaaaatagaattcagagcatagctattttagaagaggttgcccacactaagtggcccagggaaagccataaatatagacctcaaacaatgaggctaggcctatatgagtttgttcaggtagaaatggagtggttcaattcattgcatttttcctgtccaaccactcagaacagttattatagggacatgtgagtccaatttattagaagaaactatatgaaattgacaatattcaactatttttgcacacaaaaatggcattttcatatggttcaacctaatagatatgtttaattttgttatgttgctttcaaaatggtacttgatatataaggagaaggggaaaaaaggaaacaatagcaatacgaaaccactgtttaagaaaatttaaatttctgtaacttggaacctcctggtaggtaggaattatgaatatcattcttcattacaaaatcattaagaatgttcatttatgtatatcaataaatataactttattagagatggggctataaggaattattttgctgtatatcaagcaccaaaatattaaaggaagattctttcttacctcatttatcgtgaaataaagtatttc

SEQ ID NO: 3308 - DNA, 402 bp, Homo sapiens
atgaacggcacggtaactatccgcgttagaaagttcatgtccaaccgactacttcagaggaaacaaatggtcattgatgtccttcaccctgggaaggcaacagtgcctaagacagaaattcagggaaaactagccaaaatgtacaagaccataccggatgtcatctttgtatttggattcagagctcattttggcggtggcaagacaactggctttggcatgatttatgattccctggattatgcagagaaaaatgaatccaaacattgacttgcaagacatggcctttgtgagaagaaaaagacctcaagaaagcaacgaaaggaacgcaagaacagaatgaagacagtcaggggaagtgcaaaggccagtgctggtgctggcaaaaagccgaaggagtaa

SEQ ID NO: 3309 - DNA, 508 bp, Homo sapiens
tggcttcagcgtcacctagtgcaggctgccattcaacaaacgcattgtcaacagtcaaccaaaagaaacccattggccaccataccctgaggactaaccctgacacagatgcccttccagatgccctcaatagtctaactgattccatcgccccagccttgggggagaagcactgctgcctatgcactccatttacagaaaaacgttgacctcttggcgagaatgcaaagaagggaacgcttgcttatacgctgttggtgaactgtcacccctacaactcagcttgcaaccagccctggccaccagtttccccacactgagctgaatatcggacatgcccatctcagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 3310 - DNA, 3777 bp, Homo sapiens
gcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctgtaggtcggaagtgggggttgtattggaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggaaggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttaggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttggaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaacttttaaacctca

SEQ ID NO: 3311 - DNA, 3821 bp, Homo sapiens
ggcgccgccggggtcgcggagaagggggggtttgttattgtttttgtcagtgaaaggtcagagttcgtgaccccggtgccgccgccgccgccgcccgcgcgctggtaggaggagggcgaatgttcttcttcctcttcccagcgccagcctcgccgccgcggcggggggcgggcgagaacgcgattggctgaggcgcgcgcgcgcaccggaacgccgcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggaaggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttaggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttggaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcct

SEQ ID NO: 3312 - DNA, 838 bp, Homo sapiens
taaagaacactctttaaaaaaaagaaccgtggaacaatgaattaaaatctgtacctgatctctttaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcc

SEQ ID NO: 3313 - DNA, 6625 bp, Homo sapiens
agaccaggcctcgcggccccggccggcgtgagccgtacaaaatctacgtcacttggggtagaaaaacaaaaacaccgaaaagcccacgccggccgctctgaccggccgacacgctcacttgcggcccttgggcactttggggacgctgggcttggccgccttcttcaccttcttgcccccggcggccgccgtcttcttggccttgccgcctttgtccttcttggcgccagcgcccttcttgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgaggtaggtgcgcccattctgctggtcgaaccacggaaccttcttggcctcggtgtagatcttggccagcgacgagccgttgcgctcgcccagcctacggatggtctccaccaccagctggctgtacttgcccggctggttcttcttcttgctattcttcctcttcttagatggggacaacgccgccgagccgccagccttggtcaccttcttggccattccctcgccggggggccgcgccgggaagaggaaggcgaggggccgagggggtgcaggggggctgggggcgcgcggcggctccaggcgggagcggccgcggccgggcctggggccgggcggcagggctggggtgggggccgggccgggccggagcgagggttggggggcccggagccggggccggactaggggaccgagttgggggtcagagaccgagtccgagccggcggctggagctggggacgtagacctaggccgagccggagcgaagagaaatcccgccgaacgcgagacaccgccgccgcagcttccactggcgcctctggaactcgctgggcgtgcgcgctgcgctctggcgggagggcgcttctctcggctttttatagcttcatggcggaccacgttgagaacaacaacagcctggtccggggccagcgccaacttgtgcttcttggagccccttctccggccgctggcttctcggaccgcgcctctccagcgccgccgcgcccgcagcggggcgccccggacagggcctgagctcccggcgcagtggagaggcgacttgcgtcctggaagggctcagcaaaggcgaacggagaggtgcaccctaggctgcgggagcgcgagaggaggggggcacctcgtttggaggccaatagcgcgggccccagaggaggccccacggccgggagcttggcggccggcaacccagagaacgccacgggcacccgagccttgtcccggcccggggggctccaggcctgcccgcaagaggagctttaatttgtccaaactaacacagggcgcgccctcacgtggtcggctggggcaacgtgaactgcgctaggacatcctcgggggttttccgccccatccaaaggggatggcggatgggaggcactctccagctgcaccccgggttctggttgtgcctctgggagcctaggcacaacccggggaatggaggactacggcaggacctctctagggacactgcctcgccgctccccccaccctgttgccgctgatgttcccagggcctcattttgtaatccacaagtagctgccgccggtccccccaaagccaaatgggggctccagggtgggacagggtgggcgggggtgaggctgtgacacccagaggaattcctgtgagaggatggggaagggattcgctcttagttcctgggtgcacccctccccctctcccgtgcacagggaaatgatggcgggaacacagcaaaggagaccatgtcctggagagggtcccgggccccaccctccccgggggggcttgtgcaaggctggcggcccgatctctgctgattccagtattgggggtgcagagaaggcacaggacagtttttgttgaagccgttgcagcctccacttggggaagctgaggccaggagcaccaggtaccctgagaaaagtgagaagagagattgcagcccaggtccctgcagaggaggatgggctcctttcccaggaaggactggctgagtggactgtctccagggcacaggacaacgttgagggcctgaggcctccaccttcttgaagaaggaccatgtgaatttcctgacagagaacggggatgggtttctgaaagcaccacccagctgagcctgccgaaactgcacagctgtttccaggccaggctggctgcatggaggacgtgagaggaacagccagctgtgtgtgctgggcccactgatcagggtgctcaggaccaggagccttctgaggatgtgcagaggggactctggggagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccgtgagccaattaaacctcttatctttgtaaattacccagtctcaggtagttctttatagctttgtgagaatggactaatacaaggggcttgagcttgggtcttttgaaaagttaaagggtgagcagaagcgatacccctgaaggagtcccagccatgggcaacagggccatcgcttggccttttgtgcagccaccgcaggggggaggagtggcatgctggacatgccactctggagctggctgcagccacaggctgggccagggacactcctgggtcatctgtgctggaggaaggggatgctctagtggagacaaagggacagggtcacggaggaaggcgggacccaggtgtggcctccttcatgacatctgaggagaggagattcgagagaggagggctgggcaccgcagccagtacagccactcacaaagtagagccgcagtccgggcactgaggagagcggccaggctcgcagccacggtgccccgggggacctggctgggactgcaggggagaagcagtcaacacagggctggagccctgtgggcagggcagtgctgtccagtcccggggggaggacacggaggatgcagctcagaccccacaccagccttggtgggcacacgggctgggggccggctcctcagcctgtgaggggagcggggcttttgtcaagagggaggctgcctgtggcgcagggctcagaagactaattctagactttgggagctggcatagactaagtgggatcttccacttgccctcatgatatggtagaggcaactgaggcttgaggagggggttagccaggagaccaggactcaggctggggtcttgcagccttcagggtgcctcttacccccacactgctggtcatcccttctgcattaccccaccaaggaaactgtaggtggggaaggtcccaggtcctcaaccaaaaaaaatggccaaatatgagaaaaggagcttctggaagtggccagggcctagcagagaccagggcaagaccatgtgcccagcacctgagtcgcgcccttccctgggcctggccagtctggaggaggctctggcttgtgagcagtggggtttctggggtcggaatctggaaggggctctgtggctgctgggctctctctctcctccttatctaggggattgttcagtcctggggctgcaaacaccaccagtaccctgatgatgcagttcatttccctagcccgaggtcagcctctctcccgtgcagaccccagcatcccgctcctcttgccaccctcacctggagcctgggtgtggccaacacagaccctgctcctcccaaacttttgccagtgattctgcccagagacagggactgctccctgatttccctactctcttccaacccatggcttcctccccatctaccccagaactggtcccacagctgccgagcccccaccctctctaccctttccacccagcctcctgttctgtccgcacagccccaacacagaagtctgagtggtgggtcctggctctgccagaaggtctctaatggcttctcaccagacgtagggtaaagtctcccaatgcctttgccactggcccctaccaaggctctgaccgcagctccccagctgagcactcagcctcatagccttttttgctgcccacacatacccagagggttctcaggacctgggacttgctggggtggccccatggctggctccttccctggccggcctccctagacccctccctagggctcctaccagagcaccctccctgcctggctcacagcccctgccatctagtatgtccgttgagttgtgggctgtgagctaagtgcagggtgggggaggtcatgctcctagctgtaccaaggcggggtggacacagtgcgctcccgacacagacacacctgcagcagcagcggatgggaggatgggggtcaggagctcctggctgggctctgacccgggctgtccttcaaacgctgggtgtgatcccttccccaccaccactgcccagcctcagtctcccagtttgtataaaggggctggatgtatggagtctgaatgatccagctcgacagtctgattctgggcttccagacacacactcaccattcacacctacagttcacacacacagacacctactcactcacactcagatttaccttcacacacgctcaccattcacagccacagttcacacccacagacacctactcacacatatttaccctcacacatgctcaccattcacacccacacttcacactcacactgatacctactcagtcatgctcacacacactcacaccatttacacttacagttgacacacgtacacatcacctactcacacacaatttaccctcctactcacatgctcacacaccattcacatagttcacattcatacacacacctacgcatccattcacacatatatgcacacacactcatacccacacatttatcctcacacataccattcacacccacaggttcacacacattcacctactcacacctgtcatcctctcattcacatgctcacaaaatggtcacacagtttacccctcacacccacacactaacccattcacactcacagattcgtacacatacacctactcagacacatcatccacccattcacgtgctcacacacacatgttcacacaggcatgtgcccttcacactcataagctcaccatcacatacccttcacacccacaggttcacacacgcattcacatgctcccactcacttccctcacacacatatgctcactgatttacacagccactcgcacttatacatactcgctcacattcacacaggctcacccattcacacacactcgacacatttaccctcacattcacccactcaccattcccactcaccagttcacatgcactcacccaagctcacacttgaccacggacacaccctcaaacataggtgcttacacacaagccaacacacactcacctagccattcatactcacgtgcacctataccttcacacacatcctcacatacccacacagctctacacatacccactttcttacacattcacacacatacctatagacacattcaaacacacccattctcacatcctcaaaaacacctgtggccacttactcactcacacacaaggtcgatgccaactgcagggaaaaacgtggtgtcagccagggtctggctggaggctccccctgccctcgccctctctgtcctgtcttgtttctgccctcatgttctggggacctcgagactgacacacacaaacacacatgcccatgacagaggccccagaatctggtggcacctcgcaaagctcaggctgcagtgggcagaacccctggccaccgagccagctgcagggcgctgcctccctgaccagacacaagctcccagcacacacccctgcccactcctcatcatctgctgggaggtcagcgaccgcacctctgctcccagaccagaggaaacaaccctagaacccaaggggccaggacggtgacacatctgagcagagagccagtgccagtgcatagaaaggacacctgtcaccactccatgggacagcaggactgatgtgccctgcactgaccacgaggactcgagccctgtctaacgcgagtcctgctggctaatgccacgtgcaggcaggaagatcaaagcagtgacacgtcccatgtgatggggttggagatacttatgccttgaatttgaatgttttctctaagagcatatatctatatatctatatctatatacagatatatatagctttcaaaacataacttttagaaaaagaaatgttaatgaaattcaaatctgtattccagaatattccagaatttattgtattttcttttctctattttttcactattggtttttgttgg

SEQ ID NO: 3314 - DNA, 5696 bp, Homo sapiens
tgcaagagttccggtctggcagagagcgcggagagacgcagagcgcgggccgctcctccagggcgctccaggccctccggccccgggtcggcgggtgagctagggggcgccccgggacaggccgcgccctctgccctgcagataccggaggcctctgctgtggctgcccactggctgggcccaggccttgaagcggtggcgaacgtctcttccctaccctacctcggtgactgatggcggcggcggcctctcccagtccggaccctgccggccgtcgggtctcccggcccaagcctgccgggcctggacgaaacccccgccgagcagcctggacgcagcgcctttgggtggcggcgggagtagcgtgccgggaagcatggcggccgctcgaacgccgcgcggcggagggcgttagggcatggagggcccgggaaggcggcctagggacgcaggcaggctcggccgcctcttcaggccacggagccgccagatctgggtcccgggtgaccactctgtcgccattgggcgagacctacctagtcctaacgacaacggacaaaggccttaacgggcctgggaggtgagcgaagtcccgaacgacgacgggtggaacggttagcggcgatcgggcggttggtctccgtactaccagaccttgctgtcggaagagacaaatggtagaatgacaggccacgtttggcccgttggaaatgccctccatcctctgggaagattcacaggccgtttacggaaggcctgtgtatataatatgaaaaagctgctctcaactccaccccaaccttttaatagaaaacatttgtcacatctagcccttctagatggaaagaggttgccgacgtatgatagagttagaaagtcacacatcttgtaaattctcatttgtttaaaagaaatcatagaaaatacatgtcttccggagttgacttttggaaactgagttgttagacggcctctagaagcgatacgttcacgtttgttcagtgggttagatgacatggagctcgaagacctgagaaggaaaaaaagaaggttctatgctagactggtcatatttagaagacattttcatattctatccattgttttgtgtgcattcgcttcctcactactatgtatgtagttgacaatgctaagcttttttgaaatgtctattctttttagatattctgaagtgtctgatatatgttaaaattagaggtagtaaaaccacattttgtaaatatctttttgttacaattcatagaaatgttgttttttggggggaatggccaaatcacctgttgagtaatactcattgtgtttgtgcagtagttcaggggaggagagaggagggggaggtgcagagagctctatgccatcctgcttacagcgaggcaagatgaatcactatgtctgtgcattttgttttatctatgtatataatgtacataaaggacaaacgagtcctaatttacaacatctagtctttctggatgttaaagaggttgccagtgtataacaaaactagagttagtaaactaatatattttgtacattttgttttacaagtcctaggaaagactgtcttctgaaaatttgagcattcttgcccactgggttgatggagatgggaagggttctaggccagaatgttcacatttggaagactctttcaaattataactgttgttacatgtttgcagtttattcgagactgctgtgtacatacatagtggacaaattaactccttacttgaaacatttagactatctagatgtttagaagtgcccgatgtatattaaatgtagaggtagtaaaataccaatttgtaaatatctttttgctaaaattcataggaaatacttttggaagttgaattgtgaagccacctttgtgagcagtatattactgtctatacttgctcaatggtttagaggaggtgggagggaagaaattgcaaaagataatatgctagtgtgttcatacttggacattttcagacaccatttttctgtatgttttgtgcattttgttttgctctgtatatagtgtatataatggacaaatagtcttaattttttaacatctagaggttgccagtgtatgacaaagtagtaaaattagcatattttgtatgctttgtgttgaaattcataggaaaacttgtcttctgtaattgacttttgcataggaatttgttcagccatctctaagcattacacatgcgtgtacttgtccactgaattgaaggcagagaaggaagagaagagggaatgattcaaggccaaaatggtcacatttagaagataccttagatgataaccattgttatgtgtgtgcagttttatttaacagtgccgtgtacatggtggacaggctatgaaatatctagtctttagatatttggaagtgcttgatgtattttaaagtagtagtagtagaataacactttttgtaaatagcttttaaaaactgatgggaaatgctgtttggaagtggatttgttgaaccacctgggaggtgggagggaaaaaattgcaaaaggtgttttgccattgtttattagaaaatttcagcttaatccattgcctatatgttacaagcatttcatttaactttgctatactgtatatattgtgtatatactggacaaatgagtcctgattttataatatctagtctgtagctattaaagaggttgccagtgtatgacaaaagtagttagtaaactaacgcattttgtacactttgttaaaattcatagagaggctgtcttctgaaaaggactttttggaagtgaaatgataacatcagctcgaagtgacacatgtgcttatatccaccaggttggtggtggagaggagttggaaggaatgaagggttctagaccagaatgttcctatttagaagacactttcagatataaccattgttacatgtgtgtagtttattcaacagtgctatgtatatagtggacacacttaagtccttatttgaaatatctagtctttctagatgtttagaagtgcacaaagcatgttaaaagtagaggtagtaagtaacacattttgtagttattttgatatgaaatattgtcttggaaattgatcaattctctgagaagtacacgttatgatatttgtgctggttcagggggaagaaggagcacaaagttcaaagggctttctaccagtgtccagtgtgtttatgatgaggcacattgaccattgtcccttatgtctgcattttcgtttactgtgctgtgtatataagcagacataggagtcctaatttatatctagtcgatgttaaagaggttgccagtgtatggcaaaagtagagttagtaaactaatacattgagtacactttgtgttaaaattcataaggaacacttcttaaaaacagaagtaaaattgttaaacgccccccgcccccaagcattacagatggcttatagctgtcaacggggttggtagaggtcagaaagggaagtgttctaggccagaatgttcctatttagaagacactcaaattatagtctatgttatgtatatatgccatttattcaatactactgtgtatataatggaaaacttaagtgcagtttgaaacatctagtctttctaggtgtttaaaagtgcacaatggtcaggtgcggtggctcactcctgtaatcctggcactttgggaggctgaggtgggcagatcacgaagtcaagggatcgagactatcttggccaacatggtgaaaccccatctctacaaaaaatacaaaaattagctggtcgtggtggcacatgcctgtagtcccagctactcgggaggctgaggcaggagaatcgcttgagcccgggagacagaggttgcagtaagccgagaccacaccactgcactccagcatggcgacagagcaagactccatctcaaaaaaaaaaaaaaaaaaaaattccacaacataggttaaaagtagagggctaaagtaacacccctctaagcatttgttttcagtacttcctaggagtggttgcatttgggaatggaattgttaaaacttgatgcttaggagcgtatgctgactattcactgcgtggtggggtggggaggaggaggaggtatgcagggagaagggttctgtgcccctgagttagattagttcagatggtctaaccattgttctatgtatgcattttattgtgttaatattgtgtattaaaggataaacaagtcttaatgctcaaagtatgttaaaaatagatgtagtgaatcagtccctttgtgaatgtcctattgttagtttttaggaaggcctgtcttctgggagtgacctttattagtccacttcttggagctagacgtcctatacttagtcactggggatggtgaaagagggagaagaggaagggcgaagggaagggctctttgctagtatctccatttctagaagatggttttagatgataaccacaggtctatatgagcatttttagtaaagtgcctgtgtttattgtggacagagtttattattttgcaacatctaacctttatgaatatctgaggtgacaatgtgtgataaaaactagagctagtgggccaggcgcggtggctcatgcctgtaatcccaacattttgggaggctgaggcaggcagatcacaaggtcaagagatcgagaccatcctggtcaacatggtgaaaccccatctctactaaaaatacaaaaattagctgggcgtggtggcgcgtgcctgtagtcccagcttctcaggaggctgaggcaggagaatcacttgaacctgggaggcggaggttgcagtgagccaatattgcgccactgcactccagcctgggcaacacagcaagactccatctcaaaaaaaaaaaaactagagctagtgaattagccaatttgtaaatacctttttataagtgatagaaaagatgcatcttggacatggaattgttaaaccgcctctgagcagtatatgtcaggacttgttcattaggttggcagcagaggggcagaaggaagtatacagggagagatgtatgcagatgtgtccatatgtgtccatatttacattttgatgatagccattgatgtatgcatctcttttggctgtactataggaatacattaagtaattcaatggaaatataccttgctaatattataatggtatagctctgttaatgaattctcttagaaacattatacttaatgtattctgttgctgtatgtttcattttaattgagcattaagggaatgcagcatttaaatcagaactctgccaatgcttttatctagaggcgtgttgtcatttttgtcttctatgaaatttttgtcccaagaaaggtaggactacatttttttttaacagattaagttggtgtagtgtattcttgtttatcaaaatactaataaagctttgggattttgaattggtaaatattcatgatgtgtcaaaaatcatgatacatactgtacaatctcagtcccataagatgggatgttgtgcctacacacacacaggacctagaagaacatgtcaaactgtaaactgcttgtgattgtgaatgactttgttgtttgcttcttgtgattttcagtttcctataatgcacatattaacatattaactttttaaaataaaggttattttaaaagcctgtttaaaaaaaaaaatcactggaaaa

SEQ ID NO: 3315 - DNA, 5679 bp, Homo sapiens
cactgcaagagttccggtctggcagagagcgcggagagacgcagagcgcgggccgctcctccagggcgctccaggccctccggccccgggtcggcgggtgagctagggggcgccccgggacaggccgcgccctctgccctgcagataccggaggcctctgctgtggctgcccactggctgggcccaggccttgaagcggtggcgaacgtctcttccctaccctacctcggtgactgatggcggcggcggcctctcccagtccggaccctgccggccgtcgggtctcccggcccaagcctgccgggcctggacgaaacccccgccgagcagcctggacgcagcgcctttgggtggcggcgggagtagcgtgccgggaagcatggcggccgctcgaacgccgcgcggcggagggcgttagggcatggagggcccgggaaggcggcctagggacgcaggcaggctcggccgcctcttcaggccacggagccgccagatctgggtcccgggtgaccactctgtcgccattgggcgagacctacctagtcctaacgacaacggacaaaggccttaacgggcctgggaggtgagcgaagtcccgaacgacgacgggtggaacggttagcggcgatcgggcggttggtctccgtactaccagaccttgctgtcggaagagacaaatggtagaatgacaggccacgtttggcccgttggaaatgccctccatcctctgggaagattcacaggccgtttacggaaggcctgtgtatataatatgaaaaagctgctctcaactccaccccaaccttttaatagaaaacatttgtcacatctagcccttctagatggaaagaggttgccgacgtatgatagagttagaaagtcacacatcttgtaaattctcatttgtttaaaagaaatcatagaaaatacatgtcttccggagttgacttttggaaactgagttgttagacggcctctagaagcgatacgttcacgtttgttcagtgggttagatgacatggagctcgaagacctgagaaggaaaaaaagaaggttctatgctagactggtcatatttagaagacattttcatattctatccattgttttgtgtgcattcgcttcctcactactatgtatgtagttgacaatgctaagcttttttgaaatgtctattctttttagatattctgaagtgtctgatatatgttaaaattagaggtagtaaaaccacattttgtaaatatctttttgttacaattcatagaaatgttgttttttggggggaatggccaaatcacctgttgagtaatactcattgtgtttgtgcagtagttcaggggaggagagaggagggggaggtgcagagagctctatgccatcctgcttacagcgaggcaagatgaatcactatgtctgtgcattttgttttatctatgtatataatgtacataaaggacaaacgagtcctaatttacaacatctagtctttctggatgttaaagaggttgccagtgtataacaaaactagagttagtaaactaatatattttgtacattttgttttacaagtcctaggaaagactgtcttctgaaaatttgagcattcttgcccactgggttgatggagatgggaagggttctaggccagaatgttcacatttggaagactctttcaaattataactgttgttacatgtttgcagtttattcgagactgctgtgtacatacatagtggacaaattaactccttacttgaaacatttagactatctagatgtttagaagtgcccgatgtatattaaatgtagaggtagtaaaataccaatttgtaaatatctttttgctaaaattcataggaaatacttttggaagttgaattgtgaagccacctttgtgagcagtatattactgtctatacttgctcaatggtttagaggaggtgggagggaagaaattgcaaaagataatatgctagtgtgttcatacttggacattttcagacaccatttttctgtatgttttgtgcattttgttttgctctgtatatagtgtatataatggacaaatagtcttaattttttaacatctagaggttgccagtgtatgacaaagtagtaaaattagcatattttgtatgctttgtgttgaaattcataggaaaacttgtcttctgtaattgacttttgcataggaatttgttcagccatctctaagcattacacatgcgtgtacttgtccactgaattgaaggcagagaaggaagagaagagggaatgattcaaggccaaaatggtcacatttagaagataccttagatgataaccattgttatgtgtgtgcagttttatttaacagtgccgtgtacatggtggacaggctatgaaatatctagtctttagatatttggaagtgcttgatgtattttaaagtagtagtagtagaataacactttttgtaaatagcttttaaaaactgatgggaaatgctgtttggaagtggatttgttgaaccacctgggaggtgggagggaaaaaattgcaaaaggtgttttgccattgtttattagaaaatttcagcttaatccattgcctatatgttacaagcatttcatttaactttgctatactgtatatattgtgtatatactggacaaatgagtcctgattttataatatctagtctgtagctattaaagaggttgccagtgtatgacaaaagtagttagtaaactaacgcattttgtacactttgttaaaattcatagagaggctgtcttctgaaaaggactttttggaagtgaaatgataacatcagctcgaagtgacacatgtgcttatatccaccaggttggtggtggagaggagttggaaggaatgaagggttctagaccagaatgttcctatttagaagacactttcagatataaccattgttacatgtgtgtagtttattcaacagtgctatgtatatagtggacacacttaagtccttatttgaaatatctagtctttctagatgtttagaagtgcacaaagcatgttaaaagtagaggtagtaagtaacacattttgtagttattttgatatgaaatattgtcttggaaattgatcaattctctgagaagtacacgttatgatatttgtgctggttcagggggaagaaggagcacaaagttcaaagggctttctaccagtgtccagtgtgtttatgatgaggcacattgaccattgtcccttatgtctgcattttcgtttactgtgctgtgtatataagcagacataggagtcctaatttatatctagtcgatgttaaagaggttgccagtgtatggcaaaagtagagttagtaaactaatacattgagtacactttgtgttaaaattcataaggaacacttcttaaaaacagaagtaaaattgttaaacgccccccgcccccaagcattacagatggcttatagctgtcaacggggttggtagaggtcagaaagggaagtgttctaggccagaatgttcctatttagaagacactcaaattatagtctatgttatgtatatatgccatttattcaatactactgtgtatataatggaaaacttaagtgcagtttgaaacatctagtctttctaggtgtttaaaagtgcacaatggtcaggtgcggtggctcactcctgtaatcctggcactttgggaggctgaggtgggcagatcacgaagtcaagggatcgagactatcttggccaacatggtgaaaccccatctctacaaaaaatacaaaaattagctggtcgtggtggcacatgcctgtagtcccagctactcgggaggctgaggcaggagaatcgcttgagcccgggagacagaggttgcagtaagccgagaccacaccactgcactccagcatggcgacagagcaagactccatctcaaaaaaaaaaaaaaaaaaaaattccacaacataggttaaaagtagagggctaaagtaacacccctctaagcatttgttttcagtacttcctaggagtggttgcatttgggaatggaattgttaaaacttgatgcttaggagcgtatgctgactattcactgcgtggtggggtggggaggaggaggaggtatgcagggagaagggttctgtgcccctgagttagattagttcagatggtctaaccattgttctatgtatgcattttattgtgttaatattgtgtattaaaggataaacaagtcttaatgctcaaagtatgttaaaaatagatgtagtgaatcagtccctttgtgaatgtcctattgttagtttttaggaaggcctgtcttctgggagtgacctttattagtccacttcttggagctagacgtcctatacttagtcactggggatggtgaaagagggagaagaggaagggcgaagggaagggctctttgctagtatctccatttctagaagatggttttagatgataaccacaggtctatatgagcatttttagtaaagtgcctgtgtttattgtggacagagtttattattttgcaacatctaacctttatgaatatctgaggtgacaatgtgtgataaaaactagagctagtgggccaggcgcggtggctcatgcctgtaatcccaacattttgggaggctgaggcaggcagatcacaaggtcaagagatcgagaccatcctggtcaacatggtgaaaccccatctctactaaaaatacaaaaattagctgggcgtggtggcgcgtgcctgtagtcccagcttctcaggaggctgaggcaggagaatcacttgaacctgggaggcggaggttgcagtgagccaatattgcgccactgcactccagcctgggcaacacagcaagactccatctcaaaaaaaaaaaaactagagctagtgaattagccaatttgtaaatacctttttataagtgatagaaaagatgcatcttggacatggaattgttaaaccgcctctgagcagtatatgtcaggacttgttcattaggttggcagcagaggggcagaaggaagtatacagggagagatgtatgcagatgtgtccatatgtgtccatatttacattttgatgatagccattgatgtatgcatctcttttggctgtactataggaatacattaagtaattcaatggaaatataccttgctaatattataatggtatagctctgttaatgaattctcttagaaacattatacttaatgtattctgttgctgtatgtttcattttaattgagcattaagggaatgcagcatttaaatcagaactctgccaatgcttttatctagaggcgtgttgtcatttttgtcttctatgaaatttttgtcccaagaaaggtaggactacatttttttttaacagattaagttggtgtagtgtattcttgtttatcaaaatactaataaagctttgggattttgaattggtaaatattcatgatgtgtcaaaaatcatgatacatactgtacaatctcagtcccataagatgggatgttgtgcctacacacacacaggacctagaagaacatgtcaaactgtaaactgcttgtgattgtgaatgactttgttgtttgcttcttgtgattttcagtttcctataatgcacatattaacatattaactttttaaaataaaggttattttaaaagcctgtttaa

SEQ ID NO: 3316 - DNA, 5688 bp, Homo sapiens
cactgcaagagttccggtctggcagagagcgcggagagacgcagagcgcgggccgctcctccagggcgctccaggccctccggccccgggtcggcgggtgagctagggggcgccccgggacaggccgcgccctctgccctgcagataccggaggcctctgctgtggctgcccactggctgggcccaggccttgaagcggtggcgaacgtctcttccctaccctacctcggtgactgatggcggcggcggcctctcccagtccggaccctgccggccgtcgggtctcccggcccaagcctgccgggcctggacgaaacccccgccgagcagcctggacgcagcgcctttgggtggcggcgggagtagcgtgccgggaagcatggcggccgctcgaacgccgcgcggcggagggcgttagggcatggagggcccgggaaggcggcctagggacgcaggcaggctcggccgcctcttcaggccacggagccgccagatctgggtcccgggtgaccactctgtcgccattgggcgagacctacctagtcctaacgacaacggacaaaggccttaacgggcctgggaggtgagcgaagtcccgaacgacgacgggtggaacggttagcggcgatcgggcggttggtctccgtactaccagaccttgctgtcggaagagacaaatggtagaatgacaggccacgtttggcccgttggaaatgccctccatcctctgggaagattcacaggccgtttacggaaggcctgtgtatataatatgaaaaagctgctctcaactccaccccaaccttttaatagaaaacatttgtcacatctagcccttctagatggaaagaggttgccgacgtatgatagagttagaaagtcacacatcttgtaaattctcatttgtttaaaagaaatcatagaaaatacatgtcttccggagttgacttttggaaactgagttgttagacggcctctagaagcgatacgttcacgtttgttcagtgggttagatgacatggagctcgaagacctgagaaggaaaaaaagaaggttctatgctagactggtcatatttagaagacattttcatattctatccattgttttgtgtgcattcgcttcctcactactatgtatgtagttgacaatgctaagcttttttgaaatgtctattctttttagatattctgaagtgtctgatatatgttaaaattagaggtagtaaaaccacattttgtaaatatctttttgttacaattcatagaaatgttgttttttggggggaatggccaaatcacctgttgagtaatactcattgtgtttgtgcagtagttcaggggaggagagaggagggggaggtgcagagagctctatgccatcctgcttacagcgaggcaagatgaatcactatgtctgtgcattttgttttatctatgtatataatgtacataaaggacaaacgagtcctaatttacaacatctagtctttctggatgttaaagaggttgccagtgtataacaaaactagagttagtaaactaatatattttgtacattttgttttacaagtcctaggaaagactgtcttctgaaaatttgagcattcttgcccactgggttgatggagatgggaagggttctaggccagaatgttcacatttggaagactctttcaaattataactgttgttacatgtttgcagtttattcgagactgctgtgtacatacatagtggacaaattaactccttacttgaaacatttagactatctagatgtttagaagtgcccgatgtatattaaatgtagaggtagtaaaataccaatttgtaaatatctttttgctaaaattcataggaaatacttttggaagttgaattgtgaagccacctttgtgagcagtatattactgtctatacttgctcaatggtttagaggaggtgggagggaagaaattgcaaaagataatatgctagtgtgttcatacttggacattttcagacaccatttttctgtatgttttgtgcattttgttttgctctgtatatagtgtatataatggacaaatagtcttaattttttaacatctagaggttgccagtgtatgacaaagtagtaaaattagcatattttgtatgctttgtgttgaaattcataggaaaacttgtcttctgtaattgacttttgcataggaatttgttcagccatctctaagcattacacatgcgtgtacttgtccactgaattgaaggcagagaaggaagagaagagggaatgattcaaggccaaaatggtcacatttagaagataccttagatgataaccattgttatgtgtgtgcagttttatttaacagtgccgtgtacatggtggacaggctatgaaatatctagtctttagatatttggaagtgcttgatgtattttaaagtagtagtagtagaataacactttttgtaaatagcttttaaaaactgatgggaaatgctgtttggaagtggatttgttgaaccacctgggaggtgggagggaaaaaattgcaaaaggtgttttgccattgtttattagaaaatttcagcttaatccattgcctatatgttacaagcatttcatttaactttgctatactgtatatattgtgtatatactggacaaatgagtcctgattttataatatctagtctgtagctattaaagaggttgccagtgtatgacaaaagtagttagtaaactaacgcattttgtacactttgttaaaattcatagagaggctgtcttctgaaaaggactttttggaagtgaaatgataacatcagctcgaagtgacacatgtgcttatatccaccaggttggtggtggagaggagttggaaggaatgaagggttctagaccagaatgttcctatttagaagacactttcagatataaccattgttacatgtgtgtagtttattcaacagtgctatgtatatagtggacacacttaagtccttatttgaaatatctagtctttctagatgtttagaagtgcacaaagcatgttaaaagtagaggtagtaagtaacacattttgtagttattttgatatgaaatattgtcttggaaattgatcaattctctgagaagtacacgttatgatatttgtgctggttcagggggaagaaggagcacaaagttcaaagggctttctaccagtgtccagtgtgtttatgatgaggcacattgaccattgtcccttatgtctgcattttcgtttactgtgctgtgtatataagcagacataggagtcctaatttatatctagtcgatgttaaagaggttgccagtgtatggcaaaagtagagttagtaaactaatacattgagtacactttgtgttaaaattcataaggaacacttcttaaaaacagaagtaaaattgttaaacgccccccgcccccaagcattacagatggcttatagctgtcaacggggttggtagaggtcagaaagggaagtgttctaggccagaatgttcctatttagaagacactcaaattatagtctatgttatgtatatatgccatttattcaatactactgtgtatataatggaaaacttaagtgcagtttgaaacatctagtctttctaggtgtttaaaagtgcacaatggtcaggtgcggtggctcactcctgtaatcctggcactttgggaggctgaggtgggcagatcacgaagtcaagggatcgagactatcttggccaacatggtgaaaccccatctctacaaaaaatacaaaaattagctggtcgtggtggcacatgcctgtagtcccagctactcgggaggctgaggcaggagaatcgcttgagcccgggagacagaggttgcagtaagccgagaccacaccactgcactccagcatggcgacagagcaagactccatctcaaaaaaaaaaaaaaaaaaaaattccacaacataggttaaaagtagagggctaaagtaacacccctctaagcatttgttttcagtacttcctaggagtggttgcatttgggaatggaattgttaaaacttgatgcttaggagcgtatgctgactattcactgcgtggtggggtggggaggaggaggaggtatgcagggagaagggttctgtgcccctgagttagattagttcagatggtctaaccattgttctatgtatgcattttattgtgttaatattgtgtattaaaggataaacaagtcttaatgctcaaagtatgttaaaaatagatgtagtgaatcagtccctttgtgaatgtcctattgttagtttttaggaaggcctgtcttctgggagtgacctttattagtccacttcttggagctagacgtcctatacttagtcactggggatggtgaaagagggagaagaggaagggcgaagggaagggctctttgctagtatctccatttctagaagatggttttagatgataaccacaggtctatatgagcatttttagtaaagtgcctgtgtttattgtggacagagtttattattttgcaacatctaacctttatgaatatctgaggtgacaatgtgtgataaaaactagagctagtgggccaggcgcggtggctcatgcctgtaatcccaacattttgggaggctgaggcaggcagatcacaaggtcaagagatcgagaccatcctggtcaacatggtgaaaccccatctctactaaaaatacaaaaattagctgggcgtggtggcgcgtgcctgtagtcccagcttctcaggaggctgaggcaggagaatcacttgaacctgggaggcggaggttgcagtgagccaatattgcgccactgcactccagcctgggcaacacagcaagactccatctcaaaaaaaaaaaaactagagctagtgaattagccaatttgtaaatacctttttataagtgatagaaaagatgcatcttggacatggaattgttaaaccgcctctgagcagtatatgtcaggacttgttcattaggttggcagcagaggggcagaaggaagtatacagggagagatgtatgcagatgtgtccatatgtgtccatatttacattttgatgatagccattgatgtatgcatctcttttggctgtactataggaatacattaagtaattcaatggaaatataccttgctaatattataatggtatagctctgttaatgaattctcttagaaacattatacttaatgtattctgttgctgtatgtttcattttaattgagcattaagggaatgcagcatttaaatcagaactctgccaatgcttttatctagaggcgtgttgtcatttttgtcttctatgaaatttttgtcccaagaaaggtaggactacatttttttttaacagattaagttggtgtagtgtattcttgtttatcaaaatactaataaagctttgggattttgaattggtaaatattcatgatgtgtcaaaaatcatgatacatactgtacaatctcagtcccataagatgggatgttgtgcctacacacacacaggacctagaagaacatgtcaaactgtaaactgcttgtgattgtgaatgactttgttgtttgcttcttgtgattttcagtttcctataatgcacatattaacatattaactttttaaaataaaggttattttaaaagcctgtttaaaaaaaaaaa

SEQ ID NO: 3317 - DNA, 3700 bp, Homo sapiens
ggaagaggaagggatcctcgcaagctttgaaaggcgccgtcaagtcaaataaataaatgccctacaacaccaacccaggactgagatctgcatgctggaatgacggtggtggtggtggctttcagtattccccaggttttgtccggagcaccggcacgccctctcttgaagtccgctctccgcacagtggttagacgggaagatccggagctgtccagtgtcttgggtaatgcacggcatcgcctgatgtctgacgctagaacaccacgtaaagtcaagcagagggaagtgaatgcgccctaggcccctgcaggccaccaagaagagctagagggagttggtgcaatcctagagatgccggcaggtgcaccaatctgtggcacacgtacgctctccaatggaagacaactcaagaccacaccaagtttgtattaaaaaagtactgttgtgttactttttaccaacctccaatcattatacaaaatgttaaaaaatacacaaacacacacacacactcacagccatagaggttatcgcaaaagatcaacccagaatctttcagaatatgacagatgcactgagaaggcagataaattgattcaatatacaaaaggcctctttcctatggaatttcattagattaaataaggtgttccctcctcacagcctcatccttatgagcaatcatataaataatctatttaaagtccttgaactataacttgtataatttttagttttccccctttgaaggggcctaagagaaaggtttgagaaaccagctcttgaggggggcaggggtgaggggtaagaggtcctgtgcctttcattcatcctgggagcttctcaggattgcagcatttccacctgagtgttcattcttgtacattttctcatctttctcctgggttcctaggatcttggagattacctagtccaatccttttacttcagaaacaaaaaacctgaggctcagaaaggctaagtcaaatgcctagggtcacacagggaaactgtgggagttggatccctgagtcccagtccttaaactggttgctacatgacattctagaacctctccccaccaactccctttttaaagacagggtctggttctgtcacccaggctgaagtgcagtgacatgatcttggctcactgcaacctccgcttcctgggctcaagccattctcccacctcagcctcccaagtagctgggacaacaggcacatgccactacgcccagttaatttttctaattttgttttgtagagacagatttgccatgttgcccaggctggtctcgaattactggcctcaagcgatacgcctgtttaggcatcccaaagtgctggggttaccggcaggagcaattgctccgggccagacttcccttcccccgcccacacccccccaacccggcctagatccacaggcactgtaatcacagctgacacactcgactcggaatcagcatagagagcactctgaaaattgtcaaatagggtccctgaaacttgtataccatacttctcctgaagatcttgaagcatctttgtgtttgctttttttttttttaacttaaaatatggcattcaggttttatccctctccccgacgccatgtttcctttctgtattagtcacacacgtgatcctaaagtctgtcttccccactttaactggggagggctggacaaggtggaattccaattgcaggagacaggatgtgacatgggtgaggtgcccaaggctcaccgactgaaacttcgatggctcttccctgtttccttgtgcagggccccccttctctccactgctcacctggctctcctcctcccttcctgcctgctttgcagctcttgctactattttccttttctttccctgctcccaccctggcccaatttatttcacagaaatatcacagggccagccaggcacagcggctcacccctgtaatcccagcactttacgaggctgaggagggcagatcacttgaggtcaggagtttgagaccagcctggccaacatggtaaaatcctgtctctactaaaaatacaaaaatttgctaggcatggtggcaggcgcctgtaatcccagctacttgcgagggaggctgaggcaggagaatcacttgaacctgggaggcggatgttgcagtgagccaagatcacaccattgcgctccagcttgggcgacagaacgagactctgtctcaaaaaaaaaaaaaaaaaagaacgaaagaagagaaatatcatagggtcctggaccacctctgaaactgtggggaaccctgctccctggtagacatgatgcagaaacatcctaagtgcattagtgtaaaggaaaggtgcacatgtgcttccttcaaagtgcaccactttgaatatgtaaacaatgcactgaatgatactatggtccccatactgggaatgtgcataggtgatgtcacctggaagaaaggaacaccacagtttcctcctccttcccttggagaacacttgcagacgataaggcagcaagttaggatgcagagacaaagaaccctgtaggtgcttgtctgtccaagttcattcaatagttttggagtcatctcattatataaccatccccaaggtcaacatctgactcagaagtgtcactttgatcagatggagcatcttcggaccacaggccctctgaagaggggctgggaaaggttggctgtgtcccttccccgctggccagcaaatggtttgattgcacattatcaggatcctctgggtcaaccatctcttccagatgagacgatagcatcagaggggcttctaagtcgtcactgtcctcgtcatcaagaactctcaaaaacacagagtttaagtccacattgaaggtaattctgcccccagacccctccgtggagctgtagtcctcttcgggaaaagggtcctggagtggactctttctcctctcacagggcccactcaagagttccaactgctgagggctgtcctttggcatcgtggggagctccacatcaacctcaggcaggtcaggctcctcctcggactccgggtctatcaactgggattctgtagaggtggcagaggcctgacccagaggcctgacagtcagtccatgcatggtatagccaccgccacttgtcctgggcgctgcctcagtatcgctatcactttcatcatcataattataatcccacactttcttctttctgttgatgtaaatgacctccaccatatccatggcttccaacggtggcaggttaggaaatggccaggctaaaaagttatgaaaattcttaaaaaaaaaaaaaaagagagagagagtccgtatcagctgtactgtttgctctttattttctacataataaaacttaatcactggggcacagggatgcacgcttgtaatcccagctactggggaagcttaggcaggacgactgtttgagctcaggagtttcagactgtagtgcattatgactgcacctgtgaatagccactgcattccagcccttagcgagaccttgcctctaaaaaaataaaaaataaacttaatgagattgaatgatgatgcagttgatgatgatgacagcaataataacagctaacagttacaccatgcttactatatgctgggcatgactcttggtgctttatatataatttacctttcccttgcaactgctctatgaggtatgctt

SEQ ID NO: 3318 - DNA, 1573 bp, Homo sapiens
actcaccgaggttgacgaccttgagcgccgtgaagaagcggttctgccgggccaggtcctgccagggagccttggagcagtggtacttgatgaaggggaagcagccggtgcgcaggacgtggtagttggcgccctgcaccggccagttgaagtgcgagaggccgaactggtcgttgcggacggcgctgtagggcacgcagaaggaggtccagtgcggcaggcgccgctgcagcagatgccgcgtcagcacctccgaggcgctgggcttggggcgggcggcggcgcgcgaggcccacggcctacacagcagcaggcggagcgcgacctcgtgggccctcctcagggcctccatggcccgccgcgccggggacgcaggctggtgtccgcagccgctggcgcgcaagcgcgcccccgggcgagcgccgggaaggccaaccggcgccgcgcgggtgcccgagagcccccggtgtgcggcggcgcgtgcgcacagcggccccgtggcctcccgctgggggtggagtccgggggatgggaagcgtgagctgcgcgaggcggagggtcacctgcgtcaaggagctggttttgagtggccaggtgtgacctcacgccgtcattagtaactcgggcaggggagggattcggggaggtctcatcaatttgggcctgaggaaaattcaggtggaagacaattaaataactaaccacctccgcaaggtgcagaactcaaacccaagtctccctcccacgccctgggctccagggaagcccttgggtgttgttgttgaaacaggacgaggcgtgaccccgggtctgcgttgtttggcgtgggttctcactatgttgcttaagctggtccagaactcaagccagtctctcacttcagcctcttgagtcgttgggattacagaagccaccatgtccaactgtaagttcaaattttttatattaactttatagataaaaaacaaaacaatgaaacttcagtgtgttgttgtcttggattttcttttgttttgagcagaaaggggattcattggaggaaaattaggtagcccaaatagtaaacaagaagtctagagaaccaggctcagaaaatgggaaggaacgaggagagtccgaacagcaaagacatagataagaccaacaggaactagtctggcgagcatgccattgctggccccactgccacaggactcttgatcctgttgcttgcaaaatgttgaagctgggggttgtggttgtgaaagtggatcctttgaattgagttgttcttatccccagctaaaacagtggaaaagccagggggagaaagcactcaggacatatgacattactttagaaatgtagttctcggccgggtccagtgactcacgcctgtaatcctagcactttgggaggctgaggcgggcggatcacgaggtcaggagatcaagaccatcctggctaacacggtgaaaccctgtctctactaaaaatacaaaaaattagccgggcgtggtagcgggcgcctgtagccccagctactcgggaggctgaggcaggagaatggcgtgaacccgggaggcggagcttg

SEQ ID NO: 3319 - DNA, 2380 bp, Homo sapiens
gaggccccgtgaggacacgcgcggtggtggcggtggcggcgggcgcgcggccgcagccggaggaggacggcgggagcgtgcgaggagctggctcggttatttcggagcgagagccgaggccgggggaagttcctgcggagtgctcaagggcagaagaggtgccgcgtcccgaagaggggaagcggagaagtttgctgctgcccgggtcgcctcgcgacgctgagagaatcgcccagccctccgcagccgcccagcgagaaccggagctgcggccccgcaccggcgtgagtccagctgagctgacacgccgagccggttgtgcctttccgagggaggaatgtgccgtggaatccaaactttggaaaacgtcccacccgaattcccagcgagcagcaaggagaccagagcgtcgatggagccaccgttagttgcgggagggctgtccccaagaggaattcatcactgtcgtccgctgggagggaccaaccttgaaatggggttggtggagagagggatagagaagagccggcgtgcttataaataacaaaacttagctatgaacccttccgattcccaagtggggaagatggggtaaaattctaagtgacttctcgctccgaagagggataccacaaaaagcggagcgcagggtacttggcgtataataagccatcaataatttatgggtgaaattgagagccaaatataagatgataaactgaagaataaaaacagctgacaaatactgtatagaaaagattgcgttggaatcataactgtggattggaagtgatgttaaggattattggattgagtatttgtagctgaatttctgctggcatttctatcagtggggaaagccctcacagctccataggtaatttttgttaggggaggaagaagtgttgttctgtcacccacccccaggcaaagagtcgctgatctaattctccatttctttctttctttcctttctttccttccttccttccttccttccttccttccttccttccttccttccctccctccctttcctttcctttcctttcctttctttcctttctttctttgaaacggagtttcgttcttgttgcccgcgctggagtgcagtgcagtgctgtgatctcggctcattgcaacttccacctcccgggttcgagggatcctcctgcctcagcctcccaagtagctgggattacaggcgcacgccaccgcacccgggtaattttgtatttttaatagagacggggtttcaccatgttggccaggctgtttgaactcctgacctcaagtgatccgcccgcctcggcctctcaaagtgctgggattacaggcgtgagccaccaagtcctgcctaatctcctttttatagttgaggaaagctagtaacttgactgaagtctcatatattagagctgtaactgaagtttttaagtgtctcaattctgcaactattcgtttttctatcacatcactgtttggcatatatatagcgggaaaaggaaaggctggaaattagttgaccacacactgattaagcttgaaacatatttctactggagaaaaaaaggtactgtaattttggcataggcatcacatattgctggagtggaaagacccatgcactcaggtcctgctttctataatctgtgacctcgggccagtcactccatttctcctgaactagatcactgatgatctgttgaaagaaaaaatatggctagtaatgccttaattatctcacagaggttttacatggagcaaaaagacaatgtatttttaaatgtactttgttgaaggtgtgtgttgtcgagacaatacagcagtgaagagaaggcatgcaaagctgtcttgttggagtctggctaaagagcaccaaagcagcctgttgtgggatgtcctctgggggccacctggacttgctatgttaacatggagggactaggcaggggtatgaagaaggaagcccagcagagcaggaggcagcagcaacaatgagagattggttatccatatgacttggatctgtgtccccacccaaatctcatgttgaattgtaatccccaatgttggaggtggggactggtgggaggtgactggatcatgggggtggatttcttatgaatggtttagtaccatccactttgtattgtccccgtggtaatgagtgagttcttaagaaatctggtcattgaaaaatatgtggcacctcctccctctctcttttgctcctgccccggctatatgatgcaatttgtcttcagccatgattgtaagtttcccgaggcctccccagaagctgagcagatgccagcatcatgcttcctgtacagcctgccttccatgagccaattaaacttctttcctttacaaatta

SEQ ID NO: 3320 - DNA, 1015 bp, Homo sapiens
agtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtgtcatcaccaatccatcgccagaaggggaggaaactggaatccagcagcggcgagcagcagctggacggtaacatctggaaatggaaagccgacctccccctcctcctccacctcctcctcctcctcctcctcctcctcctcctcctctcacccaggatcacttccaaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagggcccgcctggcaggacgactgagcaagtccttggaaaaccagagatattagagcggtgaatcgcgctggtcacgttggacacctgcgcgttaggagattctggagccagagggagagaccccagaaactccccggtcggcgacccagcccgagacgcctggggtcccaagggaagctgaacgcccgaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaacccttttcatgtatctttaaaattacattggttctattattttatgattacaaacgatgctgcagtcat

SEQ ID NO: 3321 - DNA, 4259 bp, Homo sapiens
aacggaagaaggcgcgagtagcagcggcgcagccagggcacctgggggtgacacgagagtgggcgggcggtccagggagcccctgctggaaaccagacgctaaagcttgcagctgtgcagctaggggagcatctgttttccacttgagagcaacccgggcacgcgagaacggcccgatttcggtgcaggggtgcgtcccgaaggaacgggggactgtttctgcgcggacaggcgaacccggcaggggaaaccgaggccacgctaggtccgcagccccgaggtgtccacaagagctccgctcgcgcaagggcgcggagcgaggctgcccgcgggaccggcctgcggagcgagcgggtgagagggcagggcggcagctggggcctgggggaggagggcggcgaggcagcgtgagcgaacgagcgagggtgtgtgtccgggcgtgagtctgggcgggtgtcgggaaggaaggcgacagggaggggcggaggcggggggaggggggaggagaaagagcgaagggcccagacggggctctgggcgcccagccgcccggcttcgagccctcaagccaccgcccccaggccccgcgctgacgctggacggtccccgcctccaaaccccccgccccggccagagaataacttacctgtttggcgacggaatcgctcctgctcgcccctctgactgactcctccggctcaccgtcttccctttgggaggaagaggcgggacatcctgtttctccgtcgaaggacttccggtggcttccaaggcgactccgtagtggatgcagcgccggacgccacagccgaaaaacagaatcttggaactggtttagtacaatccaggtcgagttccttgttttttatccgagtggccggcaggcccatgtgctgtcttgtttttaacacatcagctcttgccggaagccgctaagagataaaataggaagtcccacccttcccttagagaaggaaaacggagagccgaaggagtcaatctaaattcgatgagcgcgtcgggctccaaggcaggcgctgtcagcccgggagggctgtctgggatttctagagggtcccagaacgggttcttcccaggccgatcccgcctgcttcctgccccgtctctccacccgcctcccgccctctgtaagggaccccgagggcggcgccggaaacacggagaaggcccagaacggcgcgggacccgagaggcctacgttggcaaacgcagcccgctgcccctttgctcgcttcccccgggcctggagtggctcctgtcgcttctggcgctccgatttcgagaaatgactttcagctgtgcaaggcgagaatgctactttagatgatgagaaaaaatctctcgaatggctcccaaaatgaggtccttgtttaagaggccacaggaagccgctagccgaactctgataccaaagaggaggccaagaagcggactgtggcttggtgacctgtttggtattgccaaattttcagcttttattaaagctgaaacaccttggctgtttaaaacgttcgacaaggacttttttatgaacgttaacggcacagcatacgggttttttggaaaaaaaaaaaggcaggacttcagcccgtccgcccccttgtgcaggtccattcatgaacctcgagttagaggcctttcttctgaaactcagaatctagtagggaagacctgtgtagacgaataaaaataaatacatcacagcttgttaagtgctgtgacaaagaggcagtgaaatcctgcttgaggtcatctgccttgctaaagaggtttgactatgttgtaggcacagggttagggttagactctgtaatgggaagttatgtgatcagatttctgtttaggaagatcactggccaggcggggtggcttacgcctgtaatcccaatactttgggaggccgagtcggtggattgcttgaggctaggattttgagaccagcctggggaaaccgcgtctctactaaaaatttgaaattagccaggcatggtggtgcgagcctgtaattccagctacttggaggctgaggcgggagaatagcttgaacccagtggcggaggctgcagtgagccgagattgcgccactgcactccagcctgggcgacagagcgagattccgtctcaaaaaaatcattccaacgagtggataaagaaaatgtgatatatatgcactatggaatactaagccataagaaggaatgaaataatggcatttgcagcaacctagatggagttggagaccattattctaagtgaagtaactcaagaatggaaaaccaaatattgtatgttctcactcgtaagtgggagctaagctgcgaagatgcaaaggcataagaatgatatagtggactttgaggactcaagggttgaaggatgagactacacattgggtacagtgtgcactgcttgggtgatgagtgcaccaaaatctcagaactcaccactgaagaacttccccatgtaaccaaaaaccacctgttccacagaaactatcgaaataacatttttaaaactttactatttctgaataaaatttacatacatttctcagaaaaaaaaatatttggaattgaggtatctaatagagaactgagttaaattattgccacttaaaaacacaaagtgatatagccactttatgaattaatcagtcagcagtggctaggttatgcttagtggtttataaccaaatcttagtttataacaacaaatgtgtattgttaattcccactacaagtttataacgacattgctggatgctacactccatgtctctttgtgggacccaggctcatgggacttctgttacctgcattagagagagagaagacaacaaaatatgcactggttcttgaagctttggcccagaagtaaaatatgtcttttacctgttcacattgcattgggccagggcaattatcatggctgcaagtaacttcaaaaggatggggaagtgcgatcttggcatgtgtcagaagaaatgaaaacatttggtgaagagcattaatgactgtctttacaggaaaaaagcaatcaaatagacatgattgcttgtttcagtttcatcatttcctactgtgttacctaaactttctgagccccagtttcttattactaaaataaaataaagatgatattcacttcaaggactttgtgttaactagggtaaaaaaattgaaaactagtaagttatgcaaattagaaatgtataatattactgctttgaaagtgatggtgaaatgtagaataattggaaggataacacaaagcacttataccaggaggcttttagctgcagataatagaaatgaacctccactactttaatcaataaaaaagtgtatcagctcacaaatttgtcatccagacataaaggaggcttcagaatttattgactcaggagttgaatgttggtatcaaggacctagatttttctcatcactctgcacttcaattctcaatgccctattgaacatcaggctgtagtaagatggctagagtgattccagggataacatctagagataaaaaagagaactccttttcttatgatttttttcttaagagaaaaggaatttcccaaaagcccccagcaagcatgccttcacatcccatggccagaagtggctcacatgtgtaccctgagctaagcactgcagacaggaatggaatcgcctgtaggcctcagagaccacctggatcttgggaaggtgtcagctctacctgtggcacttggctgagtgggaaagggatggaaacatgaataaagtaagaattaggaaggaaaaggagaaatggatccagggtatgaagccaatagtttagttatctcaacaaatatgattgatttcatctttatgaatgtgatgacctaatttaatacattcaatcaatgaagtaaaaaaaagtgcaaggacaatatgacatctgtcattctctgttgagatttgagaggtaataataccaagaacgtgtggtgacctgggtcctcactgctactgtcttcctgtacctggacacttctagcaagagacttcaacttcagaacaaagaggatcccaacttgtagctgcattatacacaccccagcagcacacataagttgatttctaattattcctctttaagaaattgtttgtggaatatttatctatttataaatggaaaaatagaaaattaaaataacaaaaataagtaacaccatgtattgagtgtctactgcgtgctaggcactg

SEQ ID NO: 3322 - DNA, 1331 bp, Homo sapiens
ttttgagacagagtctcgctctgtcacccaggctggagtgcagtggcgtgatctcggctcattgcaacctccgcctcctgggttcaagcaattctcctgcctcagcctcctgagtagctgggattacaggcgcccgccaccactcccagctaatttttgtatttttagtagggacgaggtttcaccatgttggtcaggctggtctcaaactcctgacctcgtgatctgccctccttggccttccaaagtgctgggattacaggcgtgatggagatgatactccctaaatcacaagggtgtggtgtgaagatgaaatggctgcacgtgacagaggagttggagaacaggaagcaagtggattacttggatgaactgtgatgggcccaagaagaactaagccaatcactccagggggcgttttcccaggatccaggcagagagctgattccagcatccacgttgtatccccctcccgctgtggccggggtctccaagagccgggcacccactgcagagcttccaagcccaggcccatttgaacacaggaggacttttgaggttcatttaaccccaaaatcagtgattctacatctcaagctcatattttgaagtgtttacggaccagggatttgccaattattctggatgggcacagggaaggggccctcagatcctgcagagggagcatctgaaagacaatgagaccctgtacacaaccaagctgagcctcctcgttggtgcatgcatggatccaggaagagcagctgcctttgtgatcccgcgccccggtcctcggcctctcacctccagcgccggggcgccccctgctgtcggaagcggctgtgaccgggcagaggtgctatctgggactctgggttctcagcccggggacagcgaaccgaggggcagatgatccatcagaaaagagccggcactgcccagccccgcgcccctgcccctgcctttttccgggagcgcgccgcgccgcacccgctacggccgcttgaccccatctttgagcccggccccaagctctgggaccgtcgtgcccctcatcaaggaagagccaaggaccccaaggagaagagaaaggagttcatgaaggcagaaatgcctggggcccacgaacatcccagtgtggccctggacgggacatcatgctgggcaacacagctaaaatgcgggtgaagaccagatttcttgcacatggcggtgacgggatgctccctagagagcttcaagtggattctttgctttttattttctctcttaataaaaatgtatgatgtttacattgtcagagaacaaacagaactgtggcttgtgtttca

SEQ ID NO: 3323 - DNA, 7185 bp, Homo sapiens
ctgatgactgaggagcctggtagctccaggtcgcccacactttcaggtctcttgcaccagaaggtggcaggatccattgggaggaaacaggtcaccttggaaggcgtccctgggcccccatccccaggggtaggggccgtagggggcccgctctgctgccttgaccagactcctgggcattgaaggctcctgggcccagtaagaaggaggtgggtgccaaggttgaggaggaagcatccgagtatgtgtaggaggaggacaaggtgggaccatagactttgccaaaagctgcaggtggatcgggggaccctgggggctcaggatccagcaaggggcggcaggagtaaaggaggaaggaatgacaggtgcaaataccttcccaccaaagcccttgttgccctctggctcctccccagagttgtccccactctcagtcggtcacccactccttgaacttgagatcggtgtcagtggtgctaaagccatcatcagcaatgacatcatcaccccctcctcctcatggatgaccgtgtgctcctcgtcacttgctatgtcctcactggccatgtgctgggaatgagcagctcaggtgggcagcagcagggctgcccactggtcacctccctcaccaggggctgcaaagtggcctggagctccatactgagtagaaggctttgggccagagtatgatgcagtgccagacaccacctgtgtcagttcccgtagtgcctgacggtctatttccctgccgtccaggctgtgtaccccactgtgggagaaggcttgggccaggctaagccaggttccctgactgtgtgcagccattctgccccacagaagctgctccttggtatccgagctctggagtgtttgggctgcaactgacaggagttcagaggacaccccaggggcagtggcagtgcccgtctctgatattctccgctcccacgagcccttgttacactcctgctagcccctggcttgtgggcttggcctctgagctggacttctttcggtccttgttgcaagtgggccaccttcacctggaaggccaggtcgtggtatttctgcgtctcattgggccccagggtgtaccaccgcttgctcagcatctggctgacggtccggttgtcctggttggggtgaccctggtgcgccctgccagggcctggtgccgcttgctgaagatcatgaccgccactcatgggccaccggatgtggtccttgtcccatttgttggggctgcatccatccttctcagaagatgagtcctgttccttgcgcagggcactgagggactgggcctgacatcatctggctggtagaggcaactgggtgtcaggagacatgatggagaggaaagcatcatcatggtcattctctgtctcactgtccagcagggactcccctgaggggcccagggctcctcctccatggtgggaggtgagcttttaccaggttccaccacccccaaagtgtgtggggttgcgggccctgggctttcagggcaggtggctccagggggccacccagggtcagcactccctgtcccacctggtggacactcatgagcaacagctgctgacttggcaggttctttgctctggttggaggccactgagtgactggcaggttgctggacctcacatagctgcagggaggggtcaggaaggggacagagtaccaggagaacacagccacagagcaaggttccacgttcctccacacaaacatgctgacgccactggaggcctcgctggacgcagacatcaggggcctgtgggccaagtacatggtctgggcagggggttcctggcaggggctcacacctcctcagccccctcctcagccaaggcagcttggacccacggaagtggggatggaaggggagcatgaggccaggcctcaagtttttgtttttgttttttttttttttgagatgcagtttggcaggctggagtgcagtggtgcgatctcagctcactgaaacctccacttcctgggttcaagcaattctccggcctcagcctcccatgtatatgcacctttactgctgaatattatatattttcttatgctttcatgtgattgattagcattctttttttttttctttttgagacagagtgttgctgtcgcccaggctggagggcagtggtgtgatctcggctcactgcaacctctgcttcatggtttaattgattctcctgcctcagccccctgagtagttgggattacaggcacccgccaccacacctggttaattttttgcatttttagaaggcgtgggtttttgccatgttggcctggctggacttgacctcctgacctcaagtgatccaccctccttggcctcccaaaatgctgggattacaggcatgagccaccacacccagctgctttctttcatttttacttgaaaaactccattaagcatttcttttaaagtagacctagtggtggctcatacctataatcccagcactctgggaggccaaggtttcaggatcgcttgagcccaggagttcaagaccagcctgggtaacataatgagacaccatctctacaaaaaatgcaaaaattagctgagcatggtggcacgcacctgtagtcccagctacctgggatgctgaggtgggaggatcacttgagcccgggaagtcacagctgcagtgagccatgatcgcaccactgcactccagcctgaacaacagtgtgagaccctgttttttattttttatttttatttatttattttttaaagacataggtagctagagtaatacagagatgaaagggagagtattcacacacgcttcttaaaatagaaattactaaattttattttacttaaaataaaatttagctgtgaggattctccacaaggctgctcatgacatggcagatggcttccccttgggtggaatgacaggagggcgagggccaaggtgagggtggtacggagagagaaaaaactaccaagatgaaagctgcagtgccttttataacctaatcttggaagggacatatcactacttgtgccttatcctttcagtcacacagaccaaccctgatatgttatggatagggacttggagactgctccaaagaccaggaggtgacgatcactggggtcctctgggagactggccaccacagttgccttttccttttcaggtcacttacaagggtctttgttgctatggaggtggatgtgggcataatcaaagggtacatgttgtacaggcctttattatacaaacctctacaataaaacaataacacatcactgccaagacagttatacagtgttaaattggaatggaaaggaaggaatcagaatttcatgtgatagaacacttaaaagtctgcctgtgcacatgtatgaatatgcattagggagaagtaaaagagtgacctgaaaatcttcctaaagtaatattatctagaaagtttgagaggtttaactgtggctaacaagatttcctgaagataaaatgttcctggggccttaatagttacaagaactttaccaaatcaagaaagcaaatatataggagtctaaaaattatttagttttgcatattcatttcagagtaccaattatgattttatttctttttaatttttaaaagtttagaaaaaaaacgagaaccaattacaatgttaaaaggaaacaggaaggatagatttggggccaattatattactgtttgggtttttgttactataaaaatggaaatattaaagattttaaaaaatgagtggtaatagagtacaaatctgcaaatgatgaatcagcaattatatttttataccaaatggtatgtttgtgatattgatatagtattaatgcactgtgaatttatttatttattttgagatggaatcttgctctgtcgtgcagactggtgtgcagtggtgcgatctcagctcactgcaacctctgatatggtttagctgtgtccccacccaaatctcatcttgaattcctatgtgttgtgggagggacctggtggaaggtccatgaatgatgggggcaatcaattctttcctgtgctgttcttatgatagtaaataagtctcacaagatctgattttttttttttttttttttttttttttttccaagacagagtctcactctgtcacccaggctggtgtgaagtggtacaatctcagctcactgcagcctctgcctcccgggttcaagtgattctcctgtctcagcctcccaagtagttgggattacagttgcctgccaccatgcctggctaatttttgtatttttagtagagaggggatttcaccatgttggccaggctggccttgaagtcctgacttcagataatctgcctgtctcagcttcccaaagtgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattacccagtctcgggtatgtctttatcggcagcatgaaaacggactaatacagtaaattggtaccaggagtgggatgttctgaaaagatatctgaaaatgtggaaacgactttggaactgggtaataggcagaggttggaacagttttgagggctcagaaaaagacaggaaaatgtggaaaagcttggaactttctagagacttgttgaatggctttgccaaaaatgctgataatgatatggacaataagacccaggctgacgtggtctccgatggagctgaggaacttactgggaactggagcaaaggtgactcttgttatgttttagcaaagcgactggcagcattttgcccctgccctagagatgtgtggaactttgaacttgagagagatgatttagggtatctggcagaagaaatttctaagcagcaaagcattcaagaggtgacttgggtgctgttgaaagcattcagttttaaaaggaaaacagaggatagaagtttgaaaaatttgcagcctggcaatgcgatagaaaattgcattttctgaatagaaattcaagccagctgcagaaatttgcataaggaaggaggagccaaatgttaatccccaagacaatggggaaaatgtctccaggccatgtcagaggccttcacggcagtccctcccatcacaggcccagaagcctaggaggaaaaagtggtttcatgggctgggcccagggtccccaagctatgtgcagcctggggtttggtccactgcatcccagctgccccagctgtggctgaaaggggacaatgtagagctcgggccctggctttagatggtgcaagccccatgccttgtggtgttgagcttccatgtggtgttgagcctgcaggtgcacagaagtcaagaattgaggttttggaacctccacctagatttcagaagatgtatggaaatgcctggatgcccaggcagaaatttgctgcaagggtggggctctcatggagaacctctgctagggcagtgcagaagggaaatgtggggtcggatcccccacacagagtccctactggggcactgtcctccagacccagaatggtagatccactgacagcttgcactgtgtgcctggaaaagccacagacactcaatgccagcctatgaaagcaaccaggagggagactgtaccctgcaaagccacaggggcagagctgctcaagaccatgggaacctacctcttgtatcagcatgacctggatgtgagacatggagtcaaaggagaacattttggagctctaagatttgactgccctgctggattttggacttgcatggggcctgtagcccctttgttttggccagtttctcccatttggaatggctatatttacccaatgcctatacccccattgtatccaggaagtaactaacctgcttttgattttacaggctcataggtggaagggacttgccttgtctcagatgagactttagactgtggacttttgagttaatgctgaaatgagttaagactttgggggactgttagaaaggcatgattggttttgaaatgcgagatcatgagatttgggaggggccaggggcagaatgatatggtttggctgtgtccccatccgaatctcatcttgaatttctgtgtgttgtgggagggacaggtgggaggtcattgaatgatgggggcaagtcttttctgtactgttcttgtgatagtgaataagtctcatgagatctgatggttttaaaaagaggagtttccctgctcaagctctctctctttgcctgctgccatccctgtaagatgtgacttgctcctccttgccatctgccatgatgtgaggcttccccagccacgtggaactgtaagtccaattaaacctcttttctttgtaaattatccagtcttgggtacgtctttatcagcagcgtgaaaacagactaatgcactctgcctcctggggttcaagcaattctcatgccttaaccttccaggtagctgggactacaggtgtggactaccatgcctggctaatttttgtatttttggtagaaacagggttttaccatgttggccaggctggtcttgaacttctgcctcaagtgatccacctgcctcggcctcccaaagtgctgggattacaggcatgagccaccgcacctggcctgcactgtgaatgtataatcccagtgattagatatggatattaatgttattcatttcctttttaccttattttatgtttgtttttaataataataattttgtaacatttgaagatataaatatccttaaatacttttacagtcatgttaaaaattcttcggatttcaaaaacaatgaaaaaattgataatgcatttggaaattgtagaaatatgagagagtcctaattttgaaaatgaggcactctgatacaggtcagttgtacaaggacatgagtacattagtactttgataccttcatgtttggcagttatagtcaggtacttcttttatgaatttaaaattagtaatttattttatgaccaacttcaacttttcaggagctgttattgtgaaagtttttttgctactatgagttttatccagtcagaaacag

SEQ ID NO: 3324 - DNA, 1027 bp, Homo sapiens
cgctcgggtccccttccacatcgtggaagctttgttctttcgctctttgcaataaatcttgctactgctcactctttgggtccacgctgcttttatgagctgtaacactcaccgcgaagatctgcagcttcactcccgagccagcgagaccacgaacccaccagaaggaagaaactccgaacacatctgaacatcagaagggcagactccagacacgccaccttaagagctgtaacactcaccgcgagggtccacggcttcattcttgaagtcagtgagaccaagaacccaccaattccggacacaatttcttggctctcagtggtaagccccacatggaaatataatctacttttttctaatttcagttttctttcctataatatattttggttttggtttattaacttacatttgttaagctattccccattggtggcagcaatgattgaaatctgattttaacatggctgacgcctgtaatcccagcaccttgggaagccaaggcgggcagatcatttgaggtcaggagttccagaccggactggacaacatggcgaaactctgtctctaataaaaatacaaaaattagccaggtgtagtggcgcatgcctgtagttccagctactcaggaggctgaattaggagaatctcttgaacccaggaggcagaggttgcagtgagctgagatagcgccactgcagttcagcctgggcaaccctgtctcaaattaaaaaaaaaaaaaaaaatctaattttccaattttatcctctgaatatttgttaaatggattaataatttagagatagcaacgttctgttggatgagaggtaatgaaatatctctgctcagctagtgttttttgtttgtttctccatttaagctcaactcagttaagaatcctatgccccttgggaaggacaatagttttttgatacaagaaccaatgacatttttatggttttgtactaagtcgtgacccatgatggaaattatggaattaaagctataatctctttgtgtgttt

SEQ ID NO: 3325 - DNA, 587 bp, Homo sapiens
aggaaaagaagaaagctgaaaacacactgaggattatgggagaggggcaagtgcatgaagcttctcaatgacatacagacactctaaaagctcaagagatcaattattcaacttcaagaactgaaatttgaacacagattttgagcttccaaatcaggagaaaaagaagtgttctataagaagtttggacaagactctgcaagaagttaagaggtccttaaaggcaactgtgaattaacggagactagttttgagaaaatcagtcctgatttgtttctcctggagttttcttctttatgtgatccttcataaaagctgctaatatgggaaagattgaaatcagcaagtttctggctgtaagctaaaagaggctcttgaatcatatttccgcctgcttagcaaatttctcttgcgacaattggatgttatttggggttccatactagcaggaagaagtacaagcaaagctaagtcattttgagaataaatattatctctctatatatttgtaaatgttattttctttttttttgaggtttatgattgatccttggcatgtgtccccttgtgtattgctctactaaaaa

SEQ ID NO: 3326 - DNA, 11415 bp, Homo sapiens
gcttctgagacttgtttggggaggtaaagagtgttggacgtgcttctcctggttaaaatttggaggataactcccagctagaaaggaagaaaagctctaaagtggaatcgccttcccccggaagctgttgtaaaaattaaaggatgtatgtttctattgtccctagtgactggagtgaagatcagtgaaatgctacaattaatccacagccttctgcaatcttcctgcagtgggaagagaggccatgaaccatcccttgcaggagaaacaaaccttagagattggttaagacttaaaaacccaccactatgacattaccacttaatcttacataggcaggtcaaaattttaatataaattacttttgccaacacatagcttatgcattctttgctcctttttttggaggattttcaaattgatatctaaagatttacatatgatatattactgttacatggtctaatgactaagaaaatttctctggtaaccaaagctgatgccatatatggtagtgttcttggcatatactctatatgcctcagaccacttccacattctttctattcagctaattatagcttagtagccactggtgaaggattgtgaagaccctgtcatttctacagaatagaaaggcaaggctagttactgcaattcagccaaacaaaaagaaaaaagaataaaccaaccccttaaaaaggagaggtactgcacctttgcaaaattgaactggctcactgcagctgagcaacagaaccaccactgaagcaagaaaacaagttggtctatacaagaattgtacatggtttgaaaatgaaaaagttacagcaatcaactaatagctgcaacttaaattttcattgctgcctcagagttgaaacttaaatagtttctgcaaacctaatgctagcttctcagctcctttactaaaactatttaggaatttgttctccgcagcaaagaaatagacactcaaaacacgtaggtaaatacagcaggacattattgaaaaacagctgccttgtagtacaaaatacagtacaagtatacggatgtcattaaaacatcaaaaatactattgctcccatacaatttaggaaacattctttgcaacggagaaaaatttaaaagaaaagctttaaaaaaatctgtttaaaaattctactgtggatgatgagagtagagaaatagtctgaaaagggcaccaatgtttgtggctcttccactttttaatctaagatcaacaatattctgcatcataatctatttttttaaaaaagcctaattttatgtacacaattatttcccgccctctcagccacaaatacatgaaaacctttttgtatattactcatttcccaataaatacaaaaagattgtatagattgaataataccaaaataagataataaaaaggatatgcaataaattaaaaaggcagctcaaataaggggcaggcatgcagtttaaaaaaaatactaagattgtggaggcggggttacttgcctcctggttgagaaggtgtcacacaaagaatacctgaaaactttggaaagaacgttagctcccattcaattcaaagttacctaggtctatgacatttctaggaataccttttgatggggtgggattaacttgattagtaaaaatcatttctactgaaaatccatttaaaatatagaagaggcgatccttgaaaaccccaacttttattcttgaaagacagctggattaactggcaaaagccagtttgttgaaatttcaagatggtataaaaatgcttccaggatatagtcagcatattcacgttcacttcagttccattcacagatggatttcagcttccaccgggtgcactgcttgaatcactcatccatcatttgccaactctgattgtgaggtactgatacaatggatcaagttcttaaaaattttaaaagaataaatgatgctggaattctggacctgaggatctttagtatttgaacaaatccacagattaaactgaaggtaaattaagacttcagttttggttatttccaacttttctgtgaggatgtatatccattaaagctcaggcttatagccacactgttacttttgtaggtaatcttcaagttttatggtttaaaatccagccaaccagtggctgtaacagccgaattagccataattcactggctcacacagtggagatctggctctcattcataccaaagcatttcttggtaatgacctccatatttagagatcaggggaacaactttagtgagcagcaaccaatccactcaaacagtctgccttgtgctttatgcctgactttttcttgtgcctacctcagcaacccccaatgtaaaactgcttttatctttgaaaattttttgtcaactttgaaactattttagtaacggattctactccaagcattgctatctgaatccactggcatcctggaaaacaattctgcgaagaaaagacatttgccttggtccaggttccatgcaaaaccatttttttaaaaaaatggatccaatttggttctgtattcttagatggcttcttgaaatcttatctttaacctgttcatgattatcccaagttgcatttcttttcgtgaacctgaaccctcagaactgggtaattgtaaaggcctctcttctcaaggattccatgaagacctagatccaaaatgctgatttcaatggaggtgaagggatagacaccgcaacagtgaggcctagagagatcttttatgccagattacccaggtgcaacctaaatgcaactgttatcaatggtctgggtaacttggacatgtttcttgccctggatgtgcaaggatctattccctccagggattatcctgatgggtttacgaacctcagttgagaaacaacagaagctgagacaattttacgcaggtgaggagatgctgttttcctctttgcaggttgctgtcagttccttggaacttgactgcttttctcaagttgtccgtcactgttctcttacgattatttctcttaactgtgttacgttttgttttttccctctgcggcctcccttgctccctctccactagctcactggggatgagcaggaaagggaattctctagccaaggggatggtggttgggtggaggcctgtaggggaagctgcccgtttcaatcctcatccacctcctcaccctctgactcttcgccgccgccgctgcccccaccacgtcgctcataaagcttatccctctgtcgttcctggatttctttcatctcatccgcataccggcaaaaggcgcctccgaacttgccccaggctttgaagggtacggtgatggcattgcggtaggacggcttcacctcgctcactcgcagaaacaccccgtatttgttgcagcccacatcgaagaagaagcgcttggagtccacggtgatggaggtgccctccgggagctctccatacaggccgccccctgggcccccggcgccgcctcccgggccgcctgccagctcgtcgtcctcgcctccgtagtcgtctatgagcttcgccagcgcgtcgcggaactcgatgaggccctgcgcaggcagcgcgatggtctggccgctctgcaagccgcccggcccggggcccgcgccgaagccgccaccgccgcggttgaccgtttggcggatgcgcaggaagcggccgcgctggttctccttgaggtccaggtagtacttgcggttctcacgcaccaagaattcgctcttgagcgcgcgccgcggcccgccgccctcctcggcgccagccgccagctgctcggggctgctagggcccagctgcgcgtagtgttctatgaagtcgcccagcgagtcgcggaactcggcggccaccgccatggacagcgtgaggcggctcttggaaccgcccgcgcccacctcggcgatcttgaggaagcggcccttggcgttctgcttcacatctaagtagaagcgcttgttctggatgtccagccgcttcgaggccagctcctgcgtctcttgctcgccgccgccgcgggacgcgggctggaacccgcacggcccaccgccgccgccgcgctcgctgccgctgtcgccgtccgccatcttctaggccgccgcctcgccgccaccgcccgccgcgctcgcgcccccgccctccggctcgcgctccggggccccccagcctcgcccgcccggctcgctcacgcgctcccgccgctcatcgccggccgccgccgcccccccatcgcctccgcgccccgcccccgcgacttccgtgcagccctagccacttccggcgcgcgatttcccgtgaagtcactccgtcccgccctccgcggcctcgcggccggaagcgccgcggcggcgtggcgcagaggggtgacgtcaggggccgcgccgggcgggcggcaagctgagagtaggctagtgttactgctcggtttctagccctggggacttgccagccttagcgtgactcagccgcccgctgcgtctgtctacgcgcctcttcccgtgacacttttactttagactccggtgtcgtccacttccctccttctcgcttccggggcgttagctgagcatactcaggccccagcctgctcgcgctggttgtgtgctgggaacagagttccagtctatacactggcgaccggggggagggagatcctttggagcactcggaagcgggttctgaccagcctgtggggttccctagaggaggcatgagctgactctgaagggcaaactgcagttggcctggcaactctggagaagagccacccagcataggagacggcagtgcagaggcacccagggcctgatgctgggagctcagagcagctgggggtgtgtatgcctgaagaatggtcgtagatgacactggagggtggattagatcaaggaaagccatttgcagtgcgggagagttagtgcctaccccagagtctggagccaccgtatgtgatcaggttcacattttggaaagatcactgtgggaacaatatagaaagaagatgatttaggatgaggttagatttgggatccagagatcagttaactgtccccacagttagccatattaaagtggttaaggaaattgactgccaatctttagtttctttatcaataaaatgaataattcctatgaggtctttttgttgtaagcattgaggtgtaacaagaggcagaattggaatagtgttaaaaagtgtaggctctgcaactgcactgggtttgaatctgtgaccttgaccagttacttgattttccaaagccaaaatgtcctcatccttaaatttttttttttttttttttgagtcttgctctgtcacccaggctggagtgcagtggcgtgattttagctcattacaccctccacctcccgggttcaagcaattctcctacctcagcctcctgagtagctgggattacaggcaaccgccaccacacccggctaatttttgtatttttagtagagatggggttccacaatgttggccaggctggtcttgaactcctgacctcaggtgatctgcccgcctcagcctcccaaagtgctgggattacagatgtgagccaccacacccagcctaaatgtagttattcatagatagtgaatccaacaatggacttgtaaagaacacaaataatagataacccaatataaaaggtgaaagattttaacagacacttcgtcaaaaaagccagtaagcacatgaaacagtgctcaacattattcatcattagggaaatataaattaaagtcagaatgaaataccaactagaatggctaaaattaaaaaatgtaacatcaagtgttgagaaggatgtgaagaaactggaactcatacattgctagtaaggatataaaatggtataaatgctttgggaaacagtttggcagtttcttatatacctttcataaaataagacccaacatttccactttttttttttttttgagcagtcttgctctgttgcccaggttggggtgcagtggaacaatcttggctcactgcaacctctgcctcctgggttcaagcaattctcctgcttcagcctcctaagtagctgggactatagccatacccagctcattttttgtattttagtagagatagggtttcaccgtgttgctcaggctggtctcgaacacctgagctcaggcaatccacccacctcggcctcccaaagtgctaggattacaggcgtgacccaccgcagccagcctccacttctaggtatttacccgagggaagtgaaagtatgatcacacagtttgtatgaccccatttatataaaagtatatgaaagaggaaggtgtgtgtgtatgtgtctgtgtgtgtgtgtgtcagagagcaaatcagtagttgcctgggcctgaatatggagggacagattggaaagggtaatacaaggaaacttttaagggtgatgtattctgtgtcttgtttatggtagtgatttcacagatttgccaaaactcattcaaatgtagtttattatagagaaattagaccccaataaagtaattattattattttgaaaagacacgaatcaaagaggatgttggggacaactgcactaaaaaaaaaaataccttgtagggttgttgggcagtaatccttgaaacatgtttagcgtaatgcctgaattacagtgagtgctcaataaatgtgaattcgggtgcatccacatgggtcagtagtaattaggtgtgggagctgccagcaggtagggtggatttgacatcagtttcctagaagaaggagagttcagaggaagataccaaattttgggtcgtgaacaattcaatccttggagaggattgagacattaaaatccctaaggaaggaatgcaatgtcaggcatcacttgacctttgtgaaagatgtccacccagctccttctctggtttcttgctaaccaactttctgatttctcctctctaatgcaacttccctacatagaggacaccaacattcagttcatgaaaaggactatctctctgttcatttctttttttttttgagacagagtctcactctgtcaccaggctggagtgcagtggcatgatctcagcttactgcaacctctgtctcctgggttcaacggattctcctgcctcagcctcctgagtagctggaactacaggcatgtgaccaccgtgcccagctaatttttgtagttttagtagagacagggtttcaccatgttggccaggatggtcttgatctcttgacctcgtgatccgcccgccttggcctcccaaagtgctgggattataggcatgagccactgcgcccagccccctctgttcatttctttctttctttcttttttttttttttgagagtcttgctctgtcgctcaggctggagtgcagtggcgtgatcttggctcattgcaagccacgtttcccgggttcatgccattctcttgcctcagccttccgagtaggtgggactgcaggcgcctgccaccacgcccggctaattttttatgtttttagtagagatggggtttcactgtgttagccaggatggtctagatctcctgaccttgtgatctgcctgcctcggcctcccaaagtgctgggattacaggcatgagccaccgcgcccggacccctctgttcatttcttatcagtttgattttaaccagtccaattctatttaatgagtcagatatattgcttgtttcttttgaaatttcattctttgctttaagcctaggatcttctcccctttcagatattcggtagtcatgtttttgaacacttttggaagctttttatggttttattttttatatatgtgattttactatatatttacattttacgtttaactatctgaaatatattttggtgtatagtatgagtgaagaatttaaaaaatttcctccaaatgactaaccaattgttccagtactatttattgaataatcctttagggatggatctcaacaggtggagacaggggtagattattttgggcagagggaacatatgtccccagatggtgagaagttcagtttggatagagcccagcatctatgaggagtaagtggtgaacaatggatctggaaggtagttagactgggtcctactggggaggcctttgacttgtaggcagggagcttgggctagattgaagagtcaagggggagccacttgactgtgcgaacagaagtgtaacacctcgagctctgtgcttcaaggaagtgatccatagtagaggatagcatgggtgggttagggtgggacctaggatgggctcttagttggaggcaatgactgtgttgcagacaagagccagcaaggattgggtgcagctggtggcagtgctggtgggaggggagggagcatgtggggcctttggctcaggattcgaaaactaaatgtggggcatgagagaaggagaggaggatgatttttttttcttttttttcggagacaaggtcttgttatgttgcccaggcttgtcttgaacttttaggctcaagtaatcctcctacctcagcttcccaagtagctgggattacaggcacacaccactgcacccagttggaggattattattattatttagacagagtcttgctgtgtcgcccaggctggagtgcagtggcacgatctccgctcactgcaacctccgcctcccaggttcaagtgattcgcctcccttagcctctcaagtggctgggactacaggcgccagccaccatgcctggctaattttattttgtatttttagtagagatggggtttcactatgttggccaggctggtcttgaactcctcacctcatgatctgcctgccttggcctcccaaagtgctgggattacaggcatgagccaccacacccagccggattattattttttattatttatttatttatttatttttattttcattttcgagacagtcttctctgtcacccaggctagaatgcagtggcgtgatctcggctcactgcaacctccacctcccgggttcaagcgattctcctgcctcagcctcccaagtagctgggattacaggcgcccactactgtgcccggctaatttttgtatttttagcagagacggggtttcaccatcttggccaggctggtcttgaactcctgacctcatgatccacctgccttggcctccaaaagtgctgggattacaggcgtgagccacaacacctgacctattttttatttttttatttttattttattttttgaggtggagtctcactctttcgcccagtctggagtgtaatggcacggtctcggctcactgccacctgcctcccaggatcaagtgattctcctacctcagcctcccgagtagctgggactatgggtgtgtgctaccacacctggctaatttttgtaattttagtagagacagggtttcactgttggtcaggctggtctcaaactcctgaccttgtgatccgccggccttggcctcccaaagtgctggtatcacaggcgtgagccaccgtgcctggccgaggattattttgaagtaggtgctcagatgatgagggaccaaggctaaccttagcaaaataaggctaagaggatgaactctttagatgaagatgatatcaaacactgaattgaggctttcacagttccccttgctgcagatgttaggtacttctcccctgtgtaattcacaatacatggcacataacaggatgagctgctttgatgcatttttggaatatcaaatactttcctcagaagttttttacttcttagtggccttgagtccctgctttgactgctttttggcaatttgagcgtaattgaggatggatctcactgttggcatgttaaatttgaggagctggccgaatgcctgagaggatatttccaagtgtctctggaactcagagaatcagagtccagaaaagaggcaagtaacagagatgcaggtttgggagccaccagcagacaggtggagtggacatcaggctcagagagggttgtgtggggaaatcagggaaagatgaagaggatgaggagagagaaaggccaaggggtcagaagactgtgaggtcacaggtgatagttcatagtgagctgtatatgaactatgtacttgggcttcccacaagttttggaaacacatcacaaatcacccagctcttaggaggtggagcagagactggaactcgagtcttctgattctaaattctgtgtctctgacactgtgtcactttggggccccaggggatggaagccagatgtcagaacgctcacaagtaaatgcaggggcaggaagtgtagattgaggaggtatttcatgtggcagaaggtgacaaaagatgggtactggcaaaggaaggcaggatgaaggctgttttaccccagagaaacctgagccagctctgaggctgaggagaggagaggggtgctgaggggtcatgacagaagcctctcagtgaggcctggagtaggcacagaagttgggcactcaggaaaggaattgggtcctagaacatgagaaggcatcctttttcttctgagatcaaggagagaaaaggagatactggagcttccagtggagaggagggaagttggaggagttcttggtgaaagggcctaagagtgaggccacactaaggaggaggctgcaaagacctgtgaggcctgggctggactaaaagcctgctgaacagccccagggcctggccaagactagggcagaagcaggatgggctagatctgcaccttggaggagctgggagtctgggctggaggcagcagatggaagtgggccttgccagggctgggagatggttgtgggggtgccagatcctggggacagtagcctcagatggccagccatgggcagacaaagctgggcattcaggagaaccaggcctggagaatgaggaagggtttgcacattgcagggtgggcacgccttttttccctcattgcttttccttgtagactttttacttgtttatttttgagacatgttctcgctcggttgtctaggctggagtgcaatggcgtgatctctgctcactgcagcctctgcctcctggactcaagcaatcctcccacctcagctcccagagtagctgggattacaggcatgtgctaccacacccagttaatttttaaaatattttttgtagagatggggttttgccatgttgcccaggctggtctcgaactcctgagctcaagcaatctaaccgctttggcctcccaaagttggattacaggcatgagctcggccttccttttaaacttaaaatgtaaacttacagaacagctgcaataatagtattcttcacacagattccccaaaatgttaacatcacggtgtttgtgtcattacgcttttcatctttatgtttcttcatctctgtctctacacaca

SEQ ID NO: 3327 - DNA, 6886 bp, Homo sapiens
agaaagtaccgagacagccaactgagagcagagctgtcctccgacctcagcaaagagaattcactcctacgattatttccattccacaagagagggagggaaacagattgttaccaactcaatgatagcaaagtctgcatctggatcaggatgttaattctctagactactgtccagtagactctgcaagaacaggttatctaaaaagtaaccgttctactcaacatttattcctaatgttaaatattaatctcaaccctagtcaaagtgccttactgaacaattaagtcttaaaaaatctaagtatgttaacaaactgcctttcccgtttcttcctttaaaaagttcactccccttttcgttctttccttttcaccttcctttcgtccctcaaaatggctttctctgtacattttaacttcctttcccctccatctcccttatccgaataagtcctctgagacccttttcacaaccctgagttctgaagctccaagcgcacacagcgctgtgtcctctcaagcgtctccacaatgactaccctaagttattaaacctcttcaatcctctgtcttttagcagttgctttgctcctgctaagtttttaaagcggcactcgaaagaggtttggaaaccatcctcactcatccatccagcgcgctccaatcagcctccctcgcggacctgcccccctctcccagggcctccatcccggtccaggagtccctcttcccgcctcaaacttcccgcagacccgccccgcgccctcccaggctcgcccgagccgccgccccctccccctcccgccgctccccacgtgctgggagcccgggtcgcggcaggacccacgcaccggctaagtgctagccattcgcgggtctcctctcgcggcccggtcggcaccaagccgaagaggccggggcagggccgccgggccggcgcaaggatgcgttctgcggccccggcctgtactcgccgctcacacgccccctgcgcgccaggcccgtacaccgccaccggcactcacagagccacccggccttcacccggccgctgggccgccgcctgggcaccgcgccgcgcccgccctccgcccggccggttcctgtcctctccgccacatcctgacccgcccgccgccccctttcttaccggcgggcttggcggggcggagggagccgactcgggtggacggcctcccccgcgcccaggcccgggatctccgccgcccagtcctagggctccggcgtctcggggtaagcaagagtccgtgcgggggagggggaaggggacagacgcggaggggaaggggaagccccggtccgcagcaccaacgcgcgatcccctgcggagtggagctaacaattcattattgaagcaccaagggcgagggcagcaagagctataagtaaccagtcgtcgccgccgccgccgccgccgtcgcgcgcgcgctcccgctccctccgcttatctgcccccggcagccgccatgacgccgagaaagcaagcgagcgcaaccgtctccgtcgtagccgccgccgccaccgaggtcgccgtcgcctccgcctcccgcgcgacgtaagcgcctctgctcactccccttcccgacagagcgcgaggcgggcgggcgcgcgcacgccgaagcctttctgctcgcgcgcgggaggcgggagggactacgttgaagggtcgtgggcgtaggaaaaaagcgattggtgctggggcggggcggggggggcgagtgcgcgcacgcgcacgaatgggagtgcgcacggcggatgcgcagaggctgtcggactctgactgcgcggagaccgctggactctggtcgcggccttagtccgctgatcctcgcttgggtgcccgcccttagcggcccggcgttgaattccgggaagtgggagcttcaggctcgctccgtgcgggtatgggcgctaatgtcacttgggatggttgcgcaaggacatcgcggcggacactgacaaggaaccggggaggaacgggggtggggagagactgcgatgggactcgggaagccgggaagggccgcgctgaataagcctaaggggccgggtcgcaaggagtgtcgggtagcacaggcctcggctcagtcggagcgccaggcctcagggtccgggcgggggctgctgcgtcacaccaggcagcctgggaacgcaactgttgggcaaccgtggtggcctctcgccacctcttacgcttgggcgatctgcgattgacgcatcctgggagctgatgtcccgcacgggcggggcgccggaggaggagagaaaatagagacccggttgttgacagcctgtgatgccgcttgattcatgtgtgggtggcctggtttagaaatgtaccacccttcctttctaggttcctccccggagggcggggtgacgggtgcggcgccgaatcgcaacaaaaaacgctgctcgagggatgttagtaactgtctcagcttaagttgctgccttttagcttacagtttgtatcgtaactgtaattgtggatcttagttaaatcccttcagtgtgttggaaacatatttttaagtgtatttttgaaacatacttagagcattttgaaatgcttttttgaaagcgttttttaaatcaaaattctgttacactttatttttttcagtctgcagatgaacttgactcactcaaggttaatgatttttgttttttatttatgtttgtagaggcggggttttgtcatgttgctaggttggtgttgaactcctgagctcgagcgatccacctgccactgccttccaaagtgctggaattacaggcgtgagccacggcgcccggtggccgaggttaataataattaaaagtttctaatcccattgttcagttatttgatttggtgtaaaggcgcactttccaagtcagatgagtttgtggtaacatacattccccaaataattatttttcccttgtgggaaatattccagttttaggctaccagctgtttaaacagtttggttcaaatccttcaaaaaaatctcaaaacataactccacatatgtatttactacatattgaagggtgtattcacttggagaagtaggagaaagcaaacagatgccaatggcctttttgaaaacatgtatctatcagcaataattgaatagcaaaacgaagtggaacactaccatcctttgcaatattagatagttttaatactgggttgtgaggaatgaaaagatcatacaaatcgtcatttctgaagtcatttctgaagtcgtcatttctgaactgagtgctaatttttcatattaagctttatgttaatatccttaatgagaggaacttcctgtgcccgtaatttctccagagaaactattaacatacacagaatgttgtaatcagaagtatagttcagttaataaagtcctcaattacaactctgacattttgtcattgtcttatgaaaagaattactgtatatacagtctattttacgttttccggaagcacgtcaggcaggttttttgtttttttactactaattgtgccattgaatatgctattctgtcgtattgtgccatcaaacatgctattcgaaaaaagatcttgcccaatttgtaataaaatattgaacattggagatttagatttcgagtaaaatcatactttattgctttgcagaagtacacagtaggtggaaaattgcaacaatcttgccagttcattttttaaaaagcgtgtaggtaatccaaagatacctttttgatgatttgttatcaacatagttaaatttgcagtgtcactttatttgaataaactagctttatctctacttagtggtactaaaacaatagccaaacagttgataatctcaacacatgactaacgaaaaattccacataattaacattaaccaggaggtttttgttactatttaatttctcatttttaaaatttcatattctttggaaagaatattacttttccggaatctaagacagcattttgtgggtccttaattgtgatatgctttactaggtaaagtactaaatgggtatccttaggtggggataggctgggaaccacatatccagaattgtgaaatatataacataaacaggataacttgctcctttgttagctttttggatgccagggttaagattttaattccataattatgtccttgttgcctggaggatttgcatatgagaaaccacaaaaacaatcgggacattattaaaataccctagaatctcaacctgtgacagtatttcccatgtccttgcaaaaccagaggaagtctttccaatatgattcttaaatttacaaagtcctctgaatagaaaccatgaaatcctaagtcatcttctagtgaagatttgctgtacattttctgttttcctaataagaaattagaggagtttagttcccagtgttgggcaagggataggactcagtcacctggaaagttcttttgtaactacacgtgcctgacactcctattcttcccctctgctgatatgcagaatttctaggttctaggtagtatttgggaagtttcccagattattctgatatctaccagcggctcatccaccttctttatggtcactgtatttggggattttgaatgataaattcttgaatcactaaaagctaaatttcaaacagaaaattgttagagatgatactaagaggcaagtatgtataaaatctaataggcattgaagaagatacaaagattccatcctctactgaaaaattaagtgtgcacgcagagtaagaaagaaggttaagtagccaacctcaaaaatatttaaaaattattgcattgatgctgtatcactcatttccttgcccagattctttttttttttttttttttttgagacagagtctcactttgtcacccaggctggagtgcagtggtgctatctcatttcactgcaatctccgctttctgggttcaagtgattctcatgcctcagccttccaagtagctgggactacaggcacgcgccaccacacccagctaattttgtgtacttttagtagagactgggtttcaccatgttggcaaggctggtgtcaaactcctgacctcaggtgatctgcctgcttcagcctcccaaagtgctgggattacaggtgtgagccaccatgcccagcccttgcccagattctttattcactgctgtccaaatactgttggtcctctgtacctgcagggatttgcaggtacagaggctcaactataagggacttgagcatccccaggttttggtaaatgggggtcctggaactaattctctgcagatactgagggacaaacggtaccactcattttaatgcagaaattttgtattcatcctttctttttaactcccactaccgggcttagtttaggcctctattttctctatctttcccttcagcttatcctttaggtttccttcaaacttgaaatctaactaaatcagtcccctgttatataccacatatatttgtaaactaaacatatatgaagatgtatgtacatatcatatattcctagtattttagttacttaattttttcacagactaatctcagtattgcctctcatcattcctaatggacacttggtactctagacacttcttcaggtcactggaaaggtatctctcattgtaagtggatataacccatttatcttatgggtcagtctttcataagttcgtttaagtaaatgctcaagaactgttgagtaccttgacacaattgtgctgacaacctataagacttgtcagaaaactctctgacctcccttttaggacatggaattgagtattctgtaagtgcggcatgtcattgtatcacaatatagcatttgtttccatactacattgtgaggtccttgagcaaagagtactgtgccccagtgcattgtattgatattcattcaatacaaatgtaagaatgtattacataccagacattctgctgagggtagggagggattataatacagcaaaaactaacactttcaaagttaaagcctagttcaggacacagtcacactataaaatgacaacttagaaaaatagtatgaagagacatacggtgctgtgagaatccataataaagaaccctagtcagaaaagtctcaaggaagtgacgtgatcgttgtggtctagagctgaagaattaatatgaattaggtaggcaagaaagggaagtacaagagctgctttctgggtaaaagaaacaacatgggcaaagattctggggtcagagagatcacgtcagtgcacttgccagtttgccaagaacaggccgtattcactttcagaagtgttcaggtttggatagtaaattgcagggccatcctatctataagggactctaagaagcatggttctgctggagcaaacagcagctggacaagatgaggctacatagacactaggcccaaaggctaagtgaagtatgtttttcaagacaatgaggaagctattgaaggatttgaaactgggtggtagcttgatgggactggcaaattgaaagtttttactttaggtataaatcccaaagaaggattagatgtgggttgaagtagatacagtattcctaattaagtcaggagtctttggcagataagagaggttagaaatgacatgatagactaggatagtgtaatggaggtggagagaagtagaattgggaagggtaacaaaacttgatgggattggattcaggcagggttaggaggaggagggatgttagtcatttgcagctgaatgacattcacttatatagtaatgtatttggagatgtatagatagggagatcattacgtttggtttaagacagaattgggccgggtgtgatggctcatcccagcactttgggaggccaaa

SEQ ID NO: 3328 - DNA, 8976 bp, Homo sapiens
agttccccacagcacagagaggaagcaaggtctttgcatgccctgttcacttggccaaacattgccctagatgtgcaattcaacccatataaagcaagcgtaattcaagagccctgactctttcaccatttcatgatggcttattactcgcacacggcattgtcaggttccagcaactctgtgtgcagcaggcagaaatgcagtgtttatctctgacaggcaaacattcttaggctcatcggcatgagtatccacgctgaactggctatcggggaagtagatccctgcatgggaaagtcaagtatccccactgtgtagagctggtccacaatggagaggaggaaaagttttgcattggaccaaatcactgccttagaaggaaagagattgcaatcccattcatttttaagatctgcaatgggttgggatgatacccatttaaaaaagaaaaaaaaagaggttacctctttggcctctttggcaaaggatatgaactagtaataaagcctcagcatcaaggcttgggagtctggctcaaagtggctaagactagaagcatcttctaacataaatatggcagcattaggaaaatagcttggcctttagagagacccagattatcttcaccttaaaaactaccaagaccctggtccagcaagaccaccatcacagcagtaaatacatagccaccaacttcacagaaggttttccactgagacattgtgaaaaccacaatccattaccggtggatgagtcccagctctcttactacctggagcttccaagcaagacttacctgtcctttgttccagattggttcctgggatcctggaccaacacaaagagaagaggaaagcctcaagggaaataaaagtgaaggtttcagtgatagtttaaatatatatttttaaatgttagcttttttttaaatacttcacagtgatggatggagtatttcaaccacaatggcaaagaatgaattaccggcagtgtcagagtttcttgttgctgtgggaagacagctgccatgttgagaggtgccttgtggagaggctcatgtggcgaggaactgagactggcttctatccaacaaccagtgaggaactaaggccctaaagtcctatagtccacaaggaactaaatcctaccaacaactacatgagtgagcctggaatctgattttccccagtggggacttaaggtacctacaacctggctgttatgggctaaactgcatcctgcccaaatttatatgtttgagtcttaactcccagcacttcagaacatggttttgtttggagacatagtcattaaagaggtaatgaagttaaaatgaggtcattaggatgagtcctaatccaataggactggtgttcttatatgaagaggaaatttgaacacagacacatatacaggaaagaccatgcgaagaagacacagagaggaaacggccatctacaatccaaggagagaggcctcagaacaagccaaccctgcagataccttgatctaggcatccagaattgtatgaaaatacatttttgttatttaagctacccagtctgtggtgctttgttatggcaatcccagaaaactaattaactaattgactgcagccttgcaagggaccctgaaccagaggacccagttaagccatgtgcagattcctgactcacagaactaggagataacaaatgtttgttgttctaaggtgctaaatgttgggaaaatatgttatgtggctatgttgttttgcacatgtgccacataatgatgttttggtcaacaacagaccacacatatgatggtgggcccataagattgtaatactgtgtttctattatgcattctctatttatagatacacaaatacttgccactgtgttacaattgcctactgtcttcagtactgtaacatgctgtacaggtttgtagcccagaagcaatagactataccatacagtctgggtgtgtagtaggctataccatctatgtttgtgaagtacactctatgatgttcacataattatgaagttgcctagtgatgcatttctcagaatgcatgcccgacattaagtgacacttggctttatgtctatcatgcatttaagatattgcaatatagttaacttatgttttaatacacctcttaattctgttttgatcccacaccaaccaagatgcaaaactaattttttcgcccatttccataaaaaacacaattacaatgggcctaatgtggtttatgtcattttccctgaagatttgtggtggtataggaagcagtcacagcaccctgtataaagctcttccatggcctgcccccttttcgcagtcacctctattatttgaaggaatggtccaaccaacctcaaagctctggaaatttgccccaaaataattttaccctgaagccattgaagcttaagtttcagaccccagtttcacattcctgtgagttctgcaagtcactgggagctatagagtcttctacgtagatttgggaaacaaggtgaaaatacctcaagaaatctcagaagccaggggcctgcatctccaagcctctggcaattttcttgtggtttctatcctcactctagatatttgcttttgagactgattttgaattcagaattttatattctctcaaaaagagaattctccaaattctataagcttcaggctctacaaaacttgtctattctgcctaactagatttatcatagcacgtaccaaagatggccctgcctcatgaggacttttcatatcagacccttagataataatattccctcatgtaagtaataatatttccgcatgtagttatgtatgaataattttcattcatctatatcatgttggccatagtcagtgtccatgtccaatttattttttgtgtccttggtgctcagaaagttaccagatgttcagtcagaattttatttaaaatattttgatgaactagatttaaagatagattaaattaattcctacacatgatttaatttaatggataaaataagggactgagcattagcctgaactgtgtacttgcattagccctgatgttccccagagggaataatatgtgaagaatactgcataggctgaaaaacaagagttcccagcagaccaatattctttctttctgcaagctgtgagacacctggggaaagttctccacatttggtttttcagctactccacccatgactagaaggaagattttattttattattttattttattgtattttttaacagtaaaagaaaaattattgttattttaatgaaaaagaaccacctggaaagtctagtgacatttttgaaggcagggaccactttttccagggatttgtttccctatgctagtgctccattcacccttgcaccacttcagcaaagcacatagtaggtgtagcagggagatgttaagatggaaacttggccctgaccataggccaagccagggtgtctagtcgggatttatccataaacatcaatatttatcactagatgatatattgatttcttatctgcctcctatacctattgatctatttttcacagcttatagtggggagggtcatgttcagttattatccttaaaccaaaacaatctcttcttgaaaaataggatgctatgctctgatgtttgcagaggccaggaaattcttgctctgagagttccagaaaaaaagatttgtccagatttgaactaatttcagaaaaacaaaacaaaaacaaaaaaccatccaaggttaagaggtgacttctgactcacagaatgaacaagaaggcaggggaaaaaataagtcccccaagattcaggtcaaaggaaatgaacagaaggatgatggagtggcccagaggaggatcacgtgacagaaaagtcaagataaattagtggcaggacagaggaaaagaactaaagacctgcaggatcctgaaagaaagaatgaaaggaagcagatgaagattctagagcccagctgaatagccaggccgcctgagggtaaagagggagagaaagaggaagcagtgaatcaaatcaaaaaaggatagaaaaatacagagaaacaagccagggcacggtggctctcacctgtaatcccagcactttgggatgacaaggaaggcggatcacatgaggccaggaatttgagaccacgctggccaacatggcaaaaccctgtctctactagaaaaatatggaggaatgtttgagagattgtgcactgccaggggtgaggacataaatttatttgctatgtgaatgttttttgagactcatctagttcctttacaattttaatttagaatttctttagctccaaatcaggatcattagctgggagttcttataaatcaaaagcaaaacaaagctattgcaaacaagtgggagttctcataaccttaatcagaaaggcttgagttgcatttccaaatcctgtctctagagaccatgagtttttaatgatagtatttccatgaaagcccaattgaatacaatcaccacccagaccaaagtgtaggggaaatcataaagctactttcaaatccgagtcttctttgaaatttaaaattatattccatgataatggttctcataaaccttaatgcaagggaaaaaaaaaaaactacagcagaataaagaagatttaaaaagaagcaggataggaaaaaagacaagccagaggctagctatatcttttcataaagcacacctggtctcataagcacatgagagctaggcccagaagtttcgagccttggagactcacttcaaacaaattccagggaaagacactcaattaagtgttcaggacaattgtatatccccagtgcactcatgtactggaagtgcttaaactctgccctcagtggtcaataaaatggtattaagtcacagacaacccattgccattggtattggctgatgtctctggtagtttatgtgatgacaaacattagccttaacagcagagccttcctttctttgatttccgtgtgaaattctgtggctgggagatgtttatgttcacatgaacataactgtaagcaaaccatcttatggtagacatctctccagaaaaagcaaattccatctttttaaatagaaaaaaaaaacagcagcaaaatgaaattaatgcctttggctcattgtgttgtaaaattatccttgaagttatttcacactgccctaaaaaatcattgaattcagattataacacagctcttatgaagctgttaggcagttgcatctttaatgaggctgagtaggtaagaggaacagatactctagattgaaagccatcgcaaaaaatgtgaaacaactgtattaaatttaatttaatttaaccaatgggtgtatttattccctgccttcttccagaaaggatttagggagcttaggtaatgtggaggtctgaaggtgtagatactcatgaaagcctcagattaatatctagaacatataatgtgtccagatagttttcaattatcaatgcattaatctaagcttggaaaggacttttaaactgcaatgaaacctcaactagtttcaaacctgcattttttagtaagctattttgtcatttggagacccacacaaaaaacctattgttcctttaaaaaggagagagagaaaaaaagaaaaacaacctgctggtgttgctttgttcatcttatcaccttatcattcagcagcctattcaggatcaaatgtgggaaagtctgtgtgtgagattaagccctatactcagcacaggaatttcttggataaatgtctttcttaaatggatagctatgtaaaaaacagaagagaaactctattattacaatgcagttgggtttttttgtttggtatgtttcaaatctaatatttaaaattaagaaaattcaaagcaaaccatctgtgtggatgttttcatactccatttttgtgacaatagcttgcttaaccgagattattagtggattctttcaataagaggaagagagtaccatcattaagatggtatgcctccactagcctttatttttgagattaaagaatgacaaaaatatttatatatattttttcattattaagacggagtctcactctatcgccaaggctggagtgcagtggcgccatcttggctcactgcaacctctgcctcccaggttcaagcaattctcccacttcggcctcctgagtagctgggatcacaggcacccgccaccacacctggctaatttttgtatttttagtagagatggggtttcaccacattgcccaggctggtctcaaattcctgacctcaagtgatccgcctgcctcagcatcccacagtgctgggattacaggcatgagccaccacaactagccaaaaaatatatattttctttaaaaaaaagttattttctgcctaattacttcaatatttcatgaacattgtgggggaaagaatattcatacagttctctaaatatatcagtgagttgaggtaccaaatacagaattctattgaattctaattgcaacactgaagcagacttactctaagatcctgctacctggactaaccacagactatacccagattccatctgcaagatgtagtggagccaaacatcacatcactgaggaatatttattatatatctttctgtagaggtgagagagtatttatagatataacaaacaattggtcagatactactggagatttggaagcttcactaggtttttcactaaatttgttgatagccaactctaaagctcattctactactactagccatcttcccttggacaatttcatgggcatcgcttcactgaaaagaaaaatgagtaagtataatctcactagtacatgaataactattataaacacaatactttctacaaggtttattactaatctatgtcatttaagttctagattttacagtattttggagtgatgaataaatagcatgctgttcttctatagctagcaaacaagactcagctttggagacaagaagaaggaatacaggagatgtttccttgaatgagtcttcttcctaaactctgctagaagtatgtcagaaagcgaaggttacctcagtctccaagtcatgaaaacatgaggtctttctgttttctagggaaagtatttcatcatttcctagtgtggctttttgcacaccccagaaggaggaagacaagccatcgtgtcacctttacatggtagttgagatgcttcacatttgtacataacatcttatatgatcgaaagaggaactcaaactcgacaggggagaataaggaaatacatctaaaactgacaattatgttaatccctcaattccctgggcccccaaaatagtctcctctatttgccatttcaaaatagctaatgagagggtaattggacatgtagacactgaatttccactgctcatggtttccttccctgggctcccagtcacccggaaggccccggattacctcaaatgtcataacgggttcatcgcattacgaattacctccttctgccaataaactacaagttctttgaggacagaaactgtgatttatgggcatttgtatccccagagattcaaagagtgcctgatacagagtggtgatagatgattttatcatcttatcatcatcatcctcatcatcgttgtacctaaatagaggttacttcctgtttcttttatttaacaataacctattataatatatactatgcatttttaatgcactttacaaatattgtcctcatttaatccctgtaaggtgaatactattattggctccattttgcagataagacactgagtcgtgaaaaggctaagtacctcacacaagatcacacagccagtgacagaactaggatttggctggactcttaaagactctggtttgccatttaaaggcaatgaatgaagtgttgtggaacaaatgtggatttggactttcaagaccaacttgaaccagagtcttgaatctgcaactttactagctgtggcttctttttaattgattaactttctttttctgtaaaatgggaataatgattcctacctcttacaagcgttgtggtaggaggtattccaaatgagataaatatgtgaaatcactaaaacttccagaatacatggaaataatatatgtctgtattggcaaattatgagtgtagtaatgagggatttacatggacacatttacattctttagttcagactccctttgacgacacataacaaacacacacaagaatatttgccctgtgtccagcactcttttgagaatttctctcttctcctccttctgatatcccaaccaaccaaccagtaggaatgtgccctagaaactatgttttacagctcagtccacatcttttcaccttacaaattacttattgttagtttcttgggaaagtaaaattgagatattaagattctatgaaattggttggtggtattgaagactgtgctgctgctgctgctactgctccagaactctagtggagatattacaaatgggagcagaaaaagtgagaaggtggtctgtagagacagagcacagcacagaggtagaaaggttgagataaagaaacaatgcagtgagagaaggagagaacacagacatagaaacagagacataaaggcaccagacacgagagcagagataatttaataaggccgtagtttctcttggatttccagttccttcttttagtcaattctgatatttagcacactgcactgcaccagatatcttgtcgccttcaaataaagtatttttcccccttaaacatgctaatttgggcttgtattatttgcaatcaatagaattgagaaaaacactctatgtcatatctgaactagtatatcagaatggttttctgccattggtaacagagacccagctcaatggcttaaacacacaagggtttatcctgtcacattaacaaaaaaaaaagtgcagagtag

SEQ ID NO: 3329 - DNA, 1168 bp, Homo sapiens
atttcatcttgaccatctttgagggactattgatgcttttggtatcagcagccacagaattcatcagacacagcacaaaagagcaggagaagagataatggcagatgccagaaggttgtccagctggttactacctctcctcttcacctgattatacctgattactgctgactcgatgggcagggagagtcgctgactcctgacagaaagactctgtcaccccttgccatttattttagatcctgtgaatcctactgtcaatgttgtgacacctgcaatgcctgggatgaagctgcccatgtggtgagatgcagcctgtggaagcctcttttcagtggagtgagagccaagcccccttggcttttcatagacaattggtgaacgggacaaggagacactgtccttggatgtctgaaaaaaaaagaaaaagagctggggaggactcctgaccagcgtgacacctaacattggagtgaaggggcagcagacctctccagccacgtgaaacgagatccagtttggcattctgtctaagttcactgcacagagacgggtttggctctgtgattcatcagaaataagaaaaacaaacactgtaaatggagaacttgaaaaagaggtgggcaccatctccccacccaagagaatggatttaagaggaaatttgtttatgggatgaagttttaaaaggcgacctggaaaatttagcaaagatgtaaataaacaactcttccttggattgcattaggcttcagaataaatatattaaccagcttcagtcaaagtctgcctagaatctgaccctgacaagacccagtgactagtgctgctccgaaccttccccaccaacagcaggcaattttctctgtggcaaagctacctcgaaacaggcatccaggcttccctcccacgaagtgaagatgagaaaactgagtctcagaatggacaagctcacagatggcaagtggtagagcagacttcacacatagccatctgagtgagatgggaagctgatcctccagccctgatcaagccttcaaatgactgcacctccagctgacagattaccaaaagcaacctccttccagaagaccttgagccaaaaccactcagctaagctacttccagatccctgatcctcggaaactgtgcgagacaataaatgttt

SEQ ID NO: 3330 - DNA, 2459 bp, Homo sapiens
cacaaagcaaaaccaagagtatttattttcattattttaaaaaactgcaacgtttatttcacaatccctggaactgtaaaataactattcttttaatttacagaattgagggaagtattttaaatgtcaaaatacacatgctgaatgtgatttagcatataagcaccaaaaatcccaaaagtatacaaagattgtttaaacatataaggtgcatttattcatgaattaattacattcagtttgaaggaagaaacagtactccaaagttcatcaatatttaagaaattatccgaatagcttccaacttggtttacagctaaataacagatactgcttttaggtttttttatacaatgcatctaaaccttaggttcgaaatttaagtgctgccttacactgtgaatggcagtttgatcactaaatttatgttccagtttgagatacttcatacacaacatatatttaatgccctgaaaacttctgcttaaaaactgagttatttagtgaacatctgaaggtaacaaaaaaagatagatcttgtatatttttatgtagaattgggtataaagtcatttggggtcaaacacaattattttttaaatattatcagtccacccagtaataagaacttttgtaaatatgccactatagcttcgggcaataattgctattatgaagttagataaacacaggattaatttcttggtttacaaatcaaaattattgtgatattaaagcatgcctccttccaaaccacttggtcaatgctgataacaactaagaaaaacgtatgctagtattgctctaaatatactgacttagctgtcctgaatgacctaattaggttggggaggggacttggcctggttctccagttctgtgaagctgccacctccagcctcactctaaatagcttatacaaaatcaagttattcccatagctaacacaaatccagcaagctgtggtcctaaatgccatctacatttatatatttacttttttactgtgtacattaagaattttgttgtgcttttcacatatccgatgtatgttttcatattaaacattcctcagtttcttgggaaggaaagaaaaagatcatgaaaagaggtacatcaggagagtcggactgtaaagtaacattacacacacaactagccaaatctctttttaatttaaaagataatgtcatcacaaggcaacatatagaaatataaaagaaaataaagtatccaccctaaaatccctattattccatgatattttcacagcaactagtatatatatcaatatatttttcacaaaccattcagttacacattgtgtatgcttttagaatttaaaatatgtattaccatagcagtctaaacattgtacttttagggaaatgtgcggagacatggttcagtgatttgatcattgtgatgattatttacaatgctatctatttacgttagcaataaataatcctgatatcaaaagagacaatactcatgcacacaccaagatggctgcatgctcttaaaatatttacacatagctctgccttttatagctctcccattaagagtgaaagtgcgctttcttcaattctctccacatttccattagtcttgcttctgggggatgcatccttccatttctacaacttcaggccatccttcatatttgtttgtatccttattgttctttatgtgctgttcaaaagggctttttgtcttaatgcccttcccaccacagaagacccagttgtctctaaaaccaagattagtaatagatgtgctccccaaatcagcaatgagccgccgtgcctcatcattgagtttggttgctccatcatcgtatgttcccattaaaactattgttccatcttgtatggccttcagaaactcaataaatggtgccacatctcctccccacatgtcaaaatatttagtgtctaatacttctcctgtttttccatttgccaaggcaacattgatccctcttccaacattattcttaacaccactcattaaaacattatcttccaggcagattttgggtcccaccacgttggctgctccacttgccattttaaaagcaaaatgcttctcagggcaagcttttgagatcccacacttatatctgggaggctttgtagaacgtgcagctgtgtccaatgctgatcttgcaaatagatttcctaaacttgcatccatttttatttcaaatacttgagaaataacataaaatgtcagtaaaaacactgccacagctaccaccaactttgcagcacctgctaccctcatgtttggtttttcagtttatggcacttttcattaatatgctccggcctcccgcccgcctctccgccgtgcgcgcccgccttccggcttcccagcgctcagtcctgccggaggccgacgggagccgccgcctccagctcgcgcctccgcttcctctcggactcccccgg

SEQ ID NO: 3331 - DNA, 8324 bp, Homo sapiens
gtgaccagcctggccaacatggcgaaaccccgtctctactaaacatacaaaaattagctgggcatggtggcacatgcctgtaatcccagctactcgggaggctgaggcaggagaatcacttgaactcgggaggcggaggttgcagtgagccaagatcgcgccattgcactccagcctgggcaacaagagtgaaactccatctcagaaaataaaaataaaaataaataaaagtacatgaaaaaagtatattcccttaagcaggtaaaatacttgcattgtatttttacatcatgaatttgcttgttaagaaatttcttttctgtaagtggttaaaagataaactgtattccatcctctgggttttcaattctaaattattggagctcaatgtatgacattttactgtagtgtattccactgagaggcaaggaaatgggaaagtgtcaggtaattataaatgggaaaattttatttttatatgatgtaaagttttacagtttaaaatagatcagcatgtgatttcttgtagagattagccatttcatttctttttgcatttttgccagttacattagtttgccctatgatatactattctgagatacttcagccccgcacacatcaagtactaattgtatacagatagtacagatttgtactctgattataagaatttgttactactaattaaaagcaaattaatgtggctgggcgtggtagctcacacctgtaatcccagcactttgggtgggcggctgaggcgggcggatcacgaggtcaggagttggagaccagcctgcccaatatggtgaaaccctgtctctactaaaattacaaaaattagctgggcttggcggtacgtgcctgtaatcccagctactgggaaggccgaggcaggagaatggcttgaacccaggaggcggaggttgcagtgagccaagatcacaccactgcactccagcctgggcgacagagcaagactccgtctcaaaaaaaaaaaaagcaaaatatttttgctgtgattgtatgtccccttttaaggatatttattgcgcttataaccttaatagttgtattcattacatttcaacatgtccaaggttagcagacatgtagttcctgaaaaccaacattttaaaagttgcctctgggctgggcatggtggctcacgcctgtaatccctgcactttgggaggccgaggtgggcggatcacgaggtcaagagatggagaccatcctggccaacatgctgaaaccccatctctactaaaaatacaaaaattagctgggtgtggtggcacacgcctgtagtcccagctacttgggaggctgaggcaggagaatcacttgaacctgggaggcggaggttgcagtgagccaagattgcaccgctgcactccagcctggcaacagagcaagactccatctcaaaacaaacatacaaacaaaaaaaggtgcctctggtcctgtgttttctttttccttctgaaagttcatagaaacctggcatatagagcttattttgctgttttaactggttggctccacaaatcctgctacctgacatcagtacagcttgaccgcagtgaagtacttgatggcttgttcatgtttagttcacctctttagaaagaaagctttgtggccaggtgcagtggctcacacctgtaatcccaacactttgggcagctgaggtgagcagatcacctgaggtcaggagttcaagaccagcctggccaacatggcaaaaccctgtctcttctaaaaatacaaaaattagccgggtgtggtggcggaggatgcagtgagccaagatcgtgccactgcactccagcctgggcaacagagtgagactctgtctcaaaaaaaaaaaaaaatcgttgtgcagtaatagatcatcccaaaaaagaattgccatgaacagcgttatgcgtagaaaacagatggaagtgttggtcattagagccttgctttttaaattttattctttccaaaaattggcggtatgctatctataattttatgtttgatgttgaagaggcaacaccagagactagagagggagattactctgatatttagtgcctaaaactttcatcttggccgggcacggtggctcacacctgtaatcccagcacttcgggaggccgaggcaggctgattacctgaggtcaggagttcgagaccagcctggacaacatggcaaaacccgtctctactaaaaatacaaaaattagccaggcatggtggtgggcgcctgtaatcccagctactcgggaggctgaggcgagagaatcgtttgaacccggtaggcggaggttgcagtgagccgagatcatgccactgcactccagcctgggcgacaagagtgaaactccgtctcaaaaaataataataattttaaaaataaaagacaaaactttcatctttatttcatggctttatttcatctttatttcatttttggttgggaaaacaaacaaaaatctcttaagttagtcctttaatagtctttttagaaccaaagaaggaaagactgcaaaaatgttgcatacgtgactctttattgtcagaatctgtagaaactggaggtctttgtaaagaaatagactagtaggattgtgagaatatatagtgaggggggatttaggataaggcttccttgctgggatccttggacagaaaccttacaattgtttaatatttgcagagtaaaagagcagctattgctatttgaacctacagaagagacctaagacgagcgtctctgtaatctaaatttatatgataatgttgtcccagacccaaaggcacacctattctcagtaacttagagaagtcttggaagttgcttctgaattacagtaaagaaattaaatgaagtctttatccttaaatagggccaggcattgctatcaacatagtgtctttggttttcccctttaaatagaaaacaccaagcagggcctttccagacaatgtagtctttcctgtaaagaaaatggttttggtgtgggatttggtaaaaacactggttagtttgtaatgaagaaagaattttggcatagacagtccgacccagttcatggatacagtttgatcccagggagtttaacaaaaggaagctttggttttgctagcaacagacttgatcttctatagtaattaattgcaattaaggttttccaggagctttctcatttcttagcccagggtccaaccccattccctctttaaaaaagaaagaataggccgggagcagtggctcatgcctgcaatcccagcactttgggaggccaaggcaggtggatcacaaggtcaggagtttgagaccagcgtggccaatatggtgaaaccctgtctctactaaaaatacaaaattagctaggcgtggtggcaggcgcctgaggctgaggcaggagaatcctgctagtctgaattacaataaggaaattaaatgaaggatttatctttaatagagccaggcattgctatcaacataacatgtttggttttcccctttaaatagaaaacaccaagcagggcctttccagacaaggtagtctggaacccaggaggcggaggttgcagtgagccgagatcccaccattgcactccagcctgggtggcagagtgagactccgtctcaaaaaaaaaaaaaagaaggaataggaaaaggacttagaggcagttgatatagaattctactgggggtaaatgacactctcaaaatacttgggaaagaagaatcacatgccacaagctatagcttgattaatattttagcatgttttccatgtttgtattctaaagtttgtttcctttgacattccattatcttacttactagagtgccaccattcttatttgtaatacaatcagtgttttatgccatttgtgaatcacacaattgttcttttttccccatcacacacactcacacacaaacacacacactgttaaaaataaaagaggggaaggataaaacaaaaatagatagaatgatgattattacaatgtaactttaacatatatgaagagaaattctaactcagttaagtgagaattaagattgaaagtattaatgttgcaagtattatctctagccatggaattttttgctggctatagaatgctaatgtgaacagagtatatatcaggaatatgatgtattatggcacagtgataatattattgttgatattagccagatgtggtggtttgcacctgtagtccgaacttctcaggaggatgaggcaggaggatagttgagcccaggagtttaaagcaagcctgggcaatacagcaagaccccaatctttaaaataaataaataaataagaattattcttgaaagtaatattctaaccttctgccaaccaacagagatcctcatattcttaaagaaaattaatatagcttatggttttgataaattggactctgatttaaactttaaaatgttatgacttttattctgatacatggcttctaaaatatgtaaaaaattatattgaatgaattaatacttaacctgttcatttctcttaatttatgtatttattctgactttattatacagcttatgtctcacatctgccttcttgatatgtgcaaaatattgtgtaaaaatagtttaaaactcatcccagttcctagtcaagcgtgggctataagagagaaggcttaaggtgttctttaatggaggaacttttgaaagatcacaaatggaaaaagcctattgagaatttattgcctttgagagtagaaagggctctagaatatgagccagagacttggaatttagtaataggtctcccactgatttgctccgtgtccttaggcaattcgtttaatctctgtgtgcctagtttccccttgtaaataagagtggtaatacctgtcctcacctacctcactaaattgttggagttcttttgttctgagtcagggtctcactctgttgcccaggctgaactacagtagtgtgatcatagctcactacagcctccaactcctgggcccaaactatcctcctgcttcagcctcccaagtagctgggactagaggtacatgccaccacacccagctaattattttcttttattgcagagatggggtctcacatgttgccaaggctgatctctaactcctgagctcaagcagtcctcctgcctcagccacccaaagtgctgggattataggcatgatcactaaattgttgtaagaataagataatgtttgcggaagcatttgagttctccaaaggaaaagctattcagacgttcaagataatagaagagtgttgtgtgaaggattcctttccagtttgcctctgtgaaaatgtctttgttgtagatcattttatgaaataggaataagagaaacataggccttatcatggtgtagtgttcacttacaaacatatcctgttgtttcttccctgcaagatatccagcacacaggctgaatttttctttataataatccttggcaaaagcataacttttcaaaaaccaaatgattttagtggtgctatggcagctgcagttttgagttagattaatgtggtgaaaaccatcaaatacttagaaattgactgggtgcggtggctcatgcctgtaatcccagcactttgggaggccgaggtaggtggatcacttgaggtcaggagttcgagaccagcctggccaacatggcaaaaccccgtctctactaaagatacaaaaattagctgggcacgatggagggtgcctgtaatcccagctactcgggaggctaaggtgggagaattgcttggacccaggtggcagaggttgcagtgagccaagattgtgccactgcactccagcctgggcaacaaagcgaagctctgtctcaataaaaaaaaaaataataataataaaatacaaatacttagaaattaacttcgcctttgccttcaggcacttttgctacatgttagcatcagaggctattgtacaactagatggttattccctgtttcttggccgatttttggtacctttctttgaagaagagggttagattttaagaaagaaagtgtgcttatttcactcatgtctttgcagaatttaactttgctttactttaaaaattccaatcatcatgtacctataaaggttaaaatatagtgaaagtttctgcttcatgtgaattcaattctgagcacctgcaggtcatatcaggtgtctgatgcagttacctttatagatcgtggcaggtccttacatttcaacaggcttatgcatttccatggggggaagagattctgtttctaggaaattacaaagggcacaccactgcagggagtgtaaacaattctttgttgcaacagacaagattttttttaaaaaaagaaaaaaggatgcattttaggtacacagggtatggacgcattcaacatttacttttatctccacagatgccaacctccccttgttgcaggcagttgggcttttccaactcattgctaacaaagctggcatctgcattaatttcaatgagaatttcaagtactgaagatgaaaagttggggagattcatgtttgaaaaatgaaaaatgaacaaaaaatccaccttgtgcagtgagatagctaacgctgatatatcaggaataattttaaactatttttgctgtaatgtgtagctttaatgtctcttttcagttatggacccataaaagtattcctatatcttgtgaataaagatcattcttgtggactagtacgtggatgcattcataggctttgggaagcagtggtgtgcgtatgtgtgtctatatcaatattttatgtttataactctgcgtattaagtttatatagaaaaaaataatgtctttctttagtgtttgggggactcaatggtaatatgaccattgcagtgtaatctgactgctcactctagagaacacttctgttatacacaatgcacatacaaacatacacccctaaagcgtagctaactgctcccactagataattgctgctaaaaacaaaacaaaacaaaacaatacaaaacaaaaaaaaccctaagtaatggaggaagaaatagcattcttttaaaaggggcttttctgaagagtaaaatgtaaatacaggacatgtggggagggtggggccgcctgcaaaatgtcctgaagatggacaaatagccttttaaattctactttttaaccatctttaccgtgtgtgcctatttgtattgcagatgtgaactactatttttggaggttgatatcagtatgttttgaaactgaattattacataaaatcagagtaacctctttctccatcctccttttccacactattcttgccaaatatttctactgaaacccagtttcagcaaggcaaaatgatgggactctcaaacctccctcctcatcttcccttcccctctgtcttatgcctggcctggccttttttgttgttgttggcttttcataagtaagaaaaatttattgtagtatttcaagactgcagaatttcaagtgtatatctataaatctttttttaaaatcttcggctacacagtaacatcaattaaaacagaagagtgagtctaagtctgtaatatgctgtaggaccagataagattttgaatgagactaaacttgactgccatattttaagaggaaattgaaactttatggtggagaatggatgagagcaagtctatgatatatatgtagtcattgtataattagaaacaccaaatgctgaatcctatcactgtgttcttgggggccaggccttggatttggttgtcatttaaactccttgaagattatatgtaattataatgagcagaaggcaaataaagtttttgaacaaaagtccttgttttcagtatttaaaatttggtaatatattttctttttcagttaaactatcttccccacaaaaaatattatacttcagttaaactatcttccccacagaaattattatactacgaacaagttatgagtgagactgagaagcttgaagaagctggtttttaagcagctcatataatattttgtgttaaagaaagtgtcattgtttcctgttgggaggcaaataacaacaacaacaaaagaaattgtcatgattctttctgagccaaactgtcacgaaatgttctgtgacagaaccactactcttttttctgccattctgcctactggagagttctatgttgtatttgtttttaatccttgattttaaaaatattaatggttttagtgttgcttagcttcagtttgaagtataactttcactaataactgcaataaaaagaaaagctttgctcttaaac

SEQ ID NO: 3332 - DNA, 420 bp, Homo sapiens
ggctctgaggcccggggagcgccagttccttgaaggtcctccgtcctggagcagtaagatccttgacgtaactagaaatggcaggacggagtctcgctctgtcacccaagctggaatgccgtggcgcaatcttagttcactgcaacctctgcctcctcggtccaagccattctcctgcctcagcctcccgaataggcaaatgaataaaagaacatcttttatttacccgtatctgcgacattcctcatagtatgtttgaaagcccaaatgatggaatccaaaacaagtttaaactgtgtaggtggaatagcaaggaatgctgggaaacaatgagaattgacagcctgaagtagtaagaaaaagttcgttctatgttcaggatattcttcaaagtcctaaaaataagtggtggaaacaaaa

SEQ ID NO: 3333 - DNA, 1169 bp, Homo sapiens
ctctgaactccatgtgcttcagttaaccctttcccaatgcggttctccgatcattttgttttaaaaactaatgttttcatgatggagactgctaggtcacattccccaggtaaagatattcaaattatagaaaccagccaaaggtttccatgaggaaggatatactgattttggacttagactttttcaaatccttttttttaacttgatataacaagagaggagatcacacttctgagaggcaggctcacatgtaagtattgcatttttttaaattataaagggtagtgatgggttaaatggtctcaatagaacagatacattcattggctaaatgtacatatcttgaatttaaacagtttttatgattttattattatataatctttctaatgtactggaagtctcagtcccccttcaactccctctcacttttgttctttcactgatcccaaatatacattctgaaatacttcaatctacaccagtaatggaatgcactaagttgtcaacttgttggcctctgaagtaccaacattgtctcagctgttgagtcacaaactggggaaaacacatctcaagtatgtccgaggtggggctctaatcaatgttggggagggtttggggatggttgcagggagtgggtgttccctcttcccaattaccttttaacttttcttttttaagagtttcagccaggtcttcaagcgttggtatatcttcgaaaatttttattagtttgcccaaaccagcatcacctcggaacttttcttccatcaagtcagcaatctgaattttgtcatactcttctctcatttttaaattaagttttaaatcgttgctcagtaaggacttaaccattctaaaatgataatcattgatgacctctaatccttttagtagaacaatgttcttgtatttttttcccatctttacagacataagtgagcctacaagagaaaatggtatatacagtgttacacatgtatacagacaatttaaaagatgtatgcctatgtgagtgagtggcccatatgaaagagttgttcatgaatatgtgtgataaagaaggactcaacgaccaaatgtgttactgtagaaattgagtgaagaactgctgggttaggaatgtctaagaaattattcccattgaatgagaatagttgagt

SEQ ID NO: 3334 - DNA, 351 bp, Homo sapiens
ttataagaaactctttggcagtggaacaacacttgttgtcacagataaacaacttgatgcagatgtttcccccaagcccactatttttcttccttcgattgctgaaacaaaactccagaaggctggaacatacctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaat

SEQ ID NO: 3335 - DNA, 565 bp, Homo sapiens
ccttcaggggcatttatttcccggtcagaaaagaagcagggacaggcgcctctgcctgagcctggcagacacaacacgaagaccggggatggggcgggggaggcacaggagacggctctcagcaatgtgtgcacttggtcccttgtttgttcctggctgggtcagggaaggcctgccgggggtggtggcactgagagcctgggggaacaggcgccaggccagctggccaggcactggtgggctggggagcagcagcagcacaccccacgtgtccctgggtcactgggttcgccaccggggaagggacggggaggccacatgctcatgcagacacagggagttagaggctagtgaggccccacggtacactccacatgttaaggcatcatggttagacgggaccgacagcgacaagggggctggccagggagcagcggggctggaggacggcccggcccccacgaggccgtgcatcccacaccccagctccaccccggagcagcagacgcacacgtccaggggcaaccacggggcctggagaatggctgctccgctccctcctgaa

SEQ ID NO: 3336 - DNA, 1072 bp, Homo sapiens
atgcccaccaccatcaagtgggagttcaaggagttggatgctcagcatcgctggcagctgctgtacttgatgatcacagttgtgttaaactgcaaaatgctgagaatgattatattaatgccagcttagttgacatagaagaggacaaaggagttacatcttaacacagggtccacttcctaacacatgctgccatttctggcttatggtttggcagcagaagaccaaagcagttgtcatgctgaaccgcattatggagaaagaattggttaaatgtgcacagtactggccaacagatgaccaagagatgctgtttaaagaaacaggattcagtgtgaagctcttgtcagaagatgtgaagtcgtattatacagtacatctaccacaattagaaaatatcaatagtggtgaaaccagaacaatatctcactttcattatactacttggccagattttggagtccctcaatcaccagcttcatttctcaatttcttgtttaaagtgagagaatctggctccttgaaccctgaccatggacctgtggtgatccaccgtagtgcaggcactggacgctccagcaccttctctctggtagacacttgtcttgttttgatggaaaaaggagatgatattaacattaaacaagtgttactgaacataagaaaattccaaatgggtcttatctcagaccccagatcaactgagattctcatacatggctataacagaaggagcaaaatgtgtaaagggagattctagtatacagaaacgatggaaagaactttctaaggaagactacctcctgcttttgatcattcaccaaacaaaataatgactgaaaaatacaataggaacagaataggtctagaagaagaaaaactgacaggtgactgacgtacaggactttcctctaaaatgcaagatacaatggaggagaacaatgagagtgttctacggaaacgtatgtgagaggacagaaaggccaccacagctcagaaggtgcagcagatgaaatagaggctaaatgagaatgaacgaaaaagaaaaaggccaagattgacagatacctaa

SEQ ID NO: 3337 - DNA, 641 bp, Homo sapiens
attttagagactgtcacttggaggccctgaatgctccttccattcctcacatgcaggctgctccatggtgctggatggattagagttaaggggtcagcagggaatcgtgttactctttggcatctggcattttaaacaccattcaccacgtccattctgcgcagggtccttcccttctggtgcgccttcatcttccatggacattctataagctgggtgtggtgtgagttcagctgtctactctttgacagagattgtaaaatctgaccaaattccccaccagtgccaaggtttaagtccacaagcaactgtttgcaccagaagatcattactttttcagtagcaaacccattcaatgttaggagttactttcaatttttatttagaaagcaccaatctgtgaaaaatacaccaatagtagttgctcctcttcattaattagcatcttttccaagcaactgttaaatgtgaaagatcagatacaaatcatgctactttgtcaactttatgtatattaaaaactttacccaactttgaaatataatcaatacatctttgctaaataaacaaattccatatactttatattaatcatgccaaactgctgtgaaagtgtgacttactgcctcttccacaaaaag

SEQ ID NO: 3338 - DNA, 711 bp, Homo sapiens
gggttctggacagacctacgctgtcggggagtgtttacttcgcctccacttctgttcctccccgccctggtgctgctccaggtcacatactcttcctgagccggcttcagcctctccgcgcagaagtctcccggagccatggcctagtattcttatgtgaagtctaccaagcttgtgctcaagggaaccgaggtgaagagctgggtcctgcagctccggcgggagcctcctcagttcttttcggacgcactccacccccgcgaatccggtggaagccgtgatgcggagagccggcttcgtggcctcccaggcttcgctctgaccctgtctgggctggatggaggccggaccgcccttcctggcgcctgtgcagagaggggcagcctcctgcgcggacgaccctggaaacaggatagacgggcgggtgacccgtgaccccgtacccacgagtttgggtcccttgaggcatctctccaggcctctgcctgatttgcctgaggttgactgtacatgcaaatattgagctttcctcctggcctccgtgataaacagaagttttgatattgttaggcgagatggaaagaaagtatcaaggagtgagctgaagccactgcccttgagaaccctctcgaggagtctggcctcatgaagatgccagaataaatggcaggtatatcctgaatgaatgtgagatttttactctgtgaattt

SEQ ID NO: 3339 - DNA, 624 bp, Homo sapiens
gagctgtagtttacagctccgcgaggctctctagagcttttgtgtgtctgtgtgtttttaagatgcgaggttcggccgggtgcggtggctcactcctgtaatcttagcactttgggaggccgaggcgggtagatcgcctgaggtcagcagttcgagaccagcctgtcttgcgtttgatgttgctcggctgatactcattcccgcgagccttgccccgggcctgctgcggggtggggaggccccaggcgtctgggaaccccagccaggcccggggctggagccacctgcgtgggtagagggacggcgagaaaggtcagacggggcgctgggtgaccttggcgctcaacctctctgagcctcggctcccggagacagagcctggctgcaaaatgcgcaaggcactggcaggtcacgcgggcagtgaagagtggcgccagcctccgaagccgcccttattccctgatttggggaagggtccccctgaggacttacctgccacccagcaacgctgccgacctactcgtggggcccaacagggatccagccaagacagccatatccgcagtgggtcccgcagtaccggctgcgggcgattccggagcccagagccgctccagccctgga

SEQ ID NO: 3340 - DNA, 548 bp, Homo sapiens
ccattggctgcgcccacggagccgccttgcgattggccctaagcgcgggtggctggggttgcgagaggcatcaggatccctggcggcgcctgagccagcggctgctaggaggctgtgtccgcaagccagcggggcgaggcgcctgggccctgcgcgtcaggtcccggcctggggcaccggggctgccagcgtcggaggaggcctgagacctgggaggaagctggagaaaagatgccctctgaatctttgtgtttggctgcccaggctcgccttgacaccgaatggttgaaaacagatatacagatggtagtgtcgaaccaagtggaacaaagaaagaagatctgaatgacaaagagaaaaaaaatgaagacgaaactcctgcacctgtatatagggccaagtcaattctggagacctgggtgtgggtcaagcaaccaggtaatctgagttttggcactttggaaagcttgatctgacgctccttttctaaataacttggatggattattcgtattttttggtaacaattttaaaaaatgtaattaaaa

SEQ ID NO: 3341 - DNA, 2638 bp, Homo sapiens
ggggttttctcttttgtttgtttccctttctttttccttttttttttttttttttttttgttggctttgcgttaggatgctctgatctgacatttgacatgaacacaaagttgctagatgctcttgttgacttccagcagatgggatgggggaaacacagcagttcttggtaaagtcctttgtaataatagtttgatttttttatttcgagagaatctttcattttcctatgtatgcttttttccttttttgcccagtttccttatcacttgctgtagatggcttattttgcattcatgcagactatgttgcaagtctgtttcatctagtaaactgaaaattattgcttaatcaaactgccgtttgtcttttatatttaaggccttccccccccttccttatgagttctaacttagtaatttcaaatgtgaccttttatatctaagaccagtatagtaaacttagcccacagtggcaaataatgagtaatattgtaatatgttccagttgcacctcagtatgttaaacaggtaatgtaagaagttctctgaaatgtcagcaagtaagttctgaaacacatcatgcatgagtaggaataaaacccaagttccccataacgtagataacttaatgctgcataaaaatatgaaagtgtaacccatgaaggacactttttctttccactgcaaagttagccactttgctgtttttcctcttttttaaactttgaaaatagactctttccagaaattggagcaataatggtgttaccacacacagattaaataatttgtagatattttaagtgacttttgggcaaaactggaatgtatacttttaccttgtttcaaacacctaagaccagtaatttaaaaattactaaaaggtttactttgttcattaataaaacatttaacaattcaaattatatgcaccttttacctagttgaaaaaaatacacattcctgttttcacattatagcaactgattaagctgaagctgtaagtcattttttatagatgagtgatccgcatctccatcaattagaacactggaaaagatgttttataaaagaggtatttaattttgtttgtaggattaactcatgcaaataataaaaaagatatcctgttggttcaatagtacactgtctcctttaaggaaggaagcgtgatgaatgaatgatgtgtagacttgagggatgactattaaaggggacgtaggatgaagagaaagaacctacagatgacaatgaatgtaaacttatttttcttcatgtgtaagcagtgtgctcgctggtgatatccagatcctaacaagattacttggttagctggttaggaccagtaactggattgcgaccactatgataatattttgaaccaaatgttaatgcttgatgcagaattgtaaagcagcatctggttcctatatagccttaaggattaattttagtgatcctcaaggaattaaatagggaatttcagaaatgtagactgcaaaggcagtatacaggaaaaggtggagtgggttttgtttatgagggtgtctgaaaactaaaattgagcgggatatcatggtatagttggacagtattggtccttcacactttggccatattgtataatggagcttttaccaaagatgtatgagaagtgtaagactataaaaaaatgaactattcaaagtaaaactcttaacaaacattttacttaaagcagatgcaaaagggtattctcatgtaggctcctgttggtgcagagggatttttttgatttcaggatacaactaaagtacgaagttctcagtttcactttagtagaaagagctctagaaatgaggctgataaacacatctaagaacactggttgctttctaaaatttccaaagctccaccataaatgtaatttttagtgtttcaaatgattgcattttaaagtatataaatatgggttatccaatatcaatgctatagtaacatcctgaaacaaaacaagcacaaaggtataaatgcctaaactggaggaaacttgaaaccctcatgttaaatcttaaatgtagtatttctaacttgtgaagacagattggtaggcagccatttttttgtgtcttaaaataactgggggcatagttaaaattttatacatcaagtgattgctattattgaatgttgcaggtgagatgtggttatttttagtttatttgaaatgtttgactggaaaggggggagggggaagcaaatatttgaaatttggaaaaccctaaaccttttggtaagaaattgtaattttcacttaaaattttctttaaggatataagaggtttataattgatgtagttaaattgaacaataaccattggtgactggagcaggtaattatagcctgcagaaaaaattatctaagaattttaaaaataagatcctgaagttgtttaattgcatccatttctgtatttatgtgaatttataaactgcagtaagttttgaatgaggttaatcttgtttaatataagtaaatgagtctgtagactgtgatctccccaaactaaaaagtacagtacttggaattgtgttctttatggttgtagtgttggtaaagcactaatatgcagaaaataaaggaattacacagtgca

SEQ ID NO: 3342 - DNA, 1422 bp, Homo sapiens
tataaacaagtagggtgtaggcagtcctctatttgcatgtttcccatgggcacaaatttcagtgacctagatttagtttaaataccagtttccttaccaggaaggaaagaaaactggtaaggaaactgttgttgttaaaatctaggttaaaattttagttagcacattgtaactgagtaattacatgaagtacaaacctctctgctagctcttcagtctacaaatcgctatgtaaataacagatatgcttcatgattgtgaccagtcatgttatttctttcaaattcttccagtggtttgtccctgtgcatctgttaattcagttcacgtacagcagagcatgtagttatgctgtctctctgtcatctacttgacattctatagaagtgaacactcgaaagaactggtcaacaaagatgaaagtgcagcaaagcaatgaaaaatgataacactggaagtgaaattttaatcaaacataaatgaatttgtagaagaagtcactgaccatgggaatgttgttcttgctgctgtgtattcataggagcttagtgaaggcaaacttaccaacacaaataagcaaagtggttgcaataaagacagatacgtcccagaggaagtgatggttaaaaaaaaaaaactttacattaaaagatatttaatgtgaatatagaaatatttcacaacattgaaagcacaagcaataaaagggtggaagctgacccaaacttagaaggagtatggcagtttgccgtgaacataaaagatgcttactcagtatggtaagttacttgccagaaaaaaaggcaagccctattcaaactactttgtttttacaatgaaataaaacactttaattctatttctaatgttttaaattacagtgtactaaatatttttaaacatttttgcatttttttctacatttataactggtcttaagagtttttaatatttgagcagaaccttaaaggtcatggaacaatcatcattttccctattgattattaagattgcaggaccatttttatggtcccacagtaccatgtgaaatgaggatcgcttgtagctgggaacagtgcttacttcagggaaaactgattttgatagaaccgactagttgagtattaaactgttttggaaataatttatatatctaagtgctgaaatatatttctcttctccccacttattcaaataaaaaagttttaatactataaacttttcattgttagcgccacgcagtccttgtcaagattgttctgggggacaaaaacttgatgtataaagcatgaatatacacacagtacttaaacagataccatatctgtggtattaaaattttgggggtggttgattaggattgtaaaaagactccttagggagtgaggatggaaaagagaaacactggttaatacagagtat

SEQ ID NO: 3343 - DNA, 3020 bp, Homo sapiens
agaatagtgacattcaattacctcatatataaagagagctccatggagagctggaaagtgcatgccactacaatattaacacatcccatcttccctttctttttgcaaggctgttgaatttcagcccggcatccccacacactaacaccatcaggtcttccacatttgatggttacaccacaggagcccacaccagactgctgcttccctgtgagctcagagtgaaattgttctcaggggtatttgcaaggccttgtcatcagttaaagactagcagctgactccaggtgattctaccccgctgtcacctctccaaaggggaaattgaatagtggtattgctcactgtggtgagtgttctttgcaccaccagaagaaactggttaatgaatgtactatttagaagaaaagttttgacatttaaagattactagttgttccctttccccaggaaaagaaggtcaaagtacagtcttccctgttgcagagtttggaataactctgtttgccctgatgctttccagcaggagaactgtattatgtagaggggtccttggccagcatcaaaggaaaaaaattatttttttcctagacctgtatttttcctattacagtcttccatttatttcttcctccagattaaaagtgcctcttcctacctcattccttaattaaggtcaatttagtgttggctcaaatgctttcatctcaaaaataccggaattgaatggtaatttggataattaagttatcgtgcattttaagcagcatgtgtttcctttttccgtgtgagttccatgagcctctgcactgccgctctgcactgctgaactgatcactgtgggtcattctggctcctcttccttcctgtcatctaccttttggccaatctactcttcatcaggggaaaggaacaaacttcaaatctgtgagttattctttctgtcagaagcaacgtgctagagagaatacatgggatttgaagataatcagtggactcatctttctatccacatggtaactatgcccttgacaggtggtatcatttcacatcatcaattgtctttgttaagtccatacttaattggtttgactccaggttttgaaaacaagatcgtaacattcaaaggactctatattccaattctcagctagcacaactaataaagttgctggacagtaaaactaggcgccagtgctgtgatcctttaaggaagccttgagtatcgcagcagttaatgctgggtcctaagaggagaggtcaggaatgatttgaccttctgaatgcaccaaatgtcccacgtgactttcagatacaccaagcatcttttcaaggagaaagcttttgatgtttaacaaaagaatttccatcacttaattcaaatatttttaaaacagaaaggaaaacacattctctgaattaaagtcacctttgaatcatatccacaaggattgtgttacagggcaaaatccaccaactgccaggatatgcccgagtcaccatggctgggaagtgctcaagactggaacatttgtgtttgagacaatggaatctttttataatgttggctttgggagaaggggtgacggtcttgctttacaaccaagactatctcagacttggtctggaagaatttacactaagacctgttataaaatggtggcctactgtatgaattcaagtgaaacagaagcaggtgaagatgctgtggaagagtcagtgtgtgagagaggtggtccagagtcacttgctgcttaagaacactttcccattagttccgggtgatgactgcatacagctcctttgggaagaaaatgcctcccccagtgagaatctgattataatggctgacgtatggatggatgtgtaggcgcagtgtggttcaacctgtttccattgtggttggaaaacttttttaaaagtccactccaaaacatgaaaagtcgtagtgttaggaagatttatttccaaacagtggcctccacactgcgcggcagcacttctttttagtatttgtaagcttttgcccactttcaattgagccagccctagcgtggtatgtattgcatgctgaacaatatagagtttgtttttcctttctgatgattttaaactcttaaagaacaggaaagcatctggtaagaagaaatcatgagtccgtcagtgcccttactcatatgcgtctccagtggcctcatgttgtggtcacaggagtttcctgttcacagcaatgtgtgtgatatggacccagcatccactgtcgtgcttttaaactgattcctgggacatagcttaccactggaacagcagaccagtgttgcactgtttctaaagctaagcttttccttatttattttggtactacctaagtgacttggttttgactgtccctaagagagggaaccactttgctgaatttttaaaaagtccaactgctctttcatcttttatgcttagaaacctgttctctccagatgcacttctgaggcatggatgagctgagcgtatggctagaaattggaagtttacagctattaccagggggctaactcccggggcatcgcagtagcttctggcacccgtggcttcatgtctttagcaaagtcttgatgtcatggaaagagaaaaagtgtatgcagttagttacctgattttgtaaacaaacagtggctgacctgggcccttaaatcaccttcacaccttttagaaccacaagtggttctttttgactccaacaaaggaaacgaagttgaaaaagtcaagcccctgtgtactggggccggacttcccatcatttgagtgcagcactttagttcagaatctctgtgccatgtggttttttaaacaggaagattgttggttccttagtattaagatagatagtccctattttgagtggaatttttcatttgtaaggggtatgttccttctctgattcttgctttcctcaaacaggatactgcctgctgtaagaccatcctctatggttgtactttaataaacagtaatttttttttacc

SEQ ID NO: 3344 - DNA, 1394 bp, Homo sapiens
gggtctcgatcgcgcgggcctccctggaggggcgcgggctctggcggcggggaggcccctgctcagcgcaatggcgggcttgcatccttgggtgattttttcgggccccttgtggcctttgctcacgcctagagagcaaaccacccgcaccacccaggagcagataaaatcgagaccacagcctccaagggagcgcgcctccatcctgtttgcccctcgggtcgccgtctgagggcgggcccgtgcccgctcagagcctacatccgagtcgtataaagcgctgacagcagagaaagctgcggctttgctccgtgcagatgagcaggggctgagggaggacgctgtgctctcagtagccgcgcttggcccggggaccctgcaggcttagaaacgtgagtcacgcctgcagcgtggcgaggaaacgccgttgatgtggcatcctcagcctggggttgtggctttaagccagaaggtcaaaaaaagaagtcttcctgagctgagactgccctgagtcgctttaggggcgaaattccgagcatccggttgcatttcctgaggatgacacgcgtggtgggtgtggacggcctacaggggtccatcctcagcggcccctctgcagggcagtctcgctctcactctcccagctgactcctctcaagcctgttaaccattgtacacgttcccaaggactccaagcaggttggacttcagggaacattgcagtttgggtcttggccattgtttacactccaccttgcataagtgcttgaggatcacacaaccagatacgtagatcatccgtagatcatcgcagtcacatcgaagatttgtttataataggaaaaaaaaaagctacccactgtcatgcgctgggaaactagtgagctgaaggatgacccatctgtaaatggggtgctccctaatggacagggcacctttcagaagcctgtgctgtgtctcctcgaccccactgtgagctccccgtcccgcacgctgatctaaatcaagctgctaacctcatggagaggcgtccgcacgggagccccggccctgagatgcggggcagtcacccattcaattaggaaacaccagcaagtgccagaagcttctcattagcagggagtgtgggtgtggcagcaacccagcatctaccatgccgaccatgtgccatgccatgcaccgcgtgtcgtaacaggacaacagagcaagagacccagcagacaggggtccccagcaacctcatgaagcgccatccactcacctccagacagtctggggagagagactgaaacttctgtctaagccacttcatctttgatctccttgtttttgtggttcaggttgtatcttaataaataaaacgtgtttgagttcatgtttacatccaaccatta

SEQ ID NO: 3345 - DNA, 1520 bp, Homo sapiens
ctggccgggaggcggcgggtctcgatcgcgcgggcctccctggaggggcgcgggctctggcggcggggaggcccctgctcagcgcaatggcgggcttgcatccttgggtgattttttcgggccccttgtggcctttgctcacgcctagagagcaaaccacccgcaccacccaggagcagataaaatcgagaccacagcctccaagggagcgcgcctccatcctgtttgcccctcgggtcgccgtctgagggcgggcccgtgcccgctcagagcctacatccgagtcgtataaagcgctgacagcagagaaagctgcggctttgctccgtgcagatgagcaggggctgagggaggacgctgtgctctcagtagccgcgcttggcccggggaccctgcaggcttagaaacgtgagtcacgcctgcagcgtggcgaggaaacgccgttgatgtggcatcctcagcctggggttgtggctttaagccagaaggtcaaaaaaagaagtcttcctgagctgagactgccctgagtcgctttaggggcgaaattccgagcatccggttgcatttcctgaggatgacacgcgtggtgggtgtggacggcctacaggggtccatcctcagcggcccctctgcagggcagtctcgctctcactctcccagctgactcctctcaagcctgttaaccattgtacacgttcccaaggactccaagcaggttggacttcagggaacattgcagtttgggtcttggccattgtttacactccaccttgcataagtgcttgaggatcacacaaccagatacgtagatcatccgtagatcatcgcagtcacatcgaagatttgtttataataggaaaaaaaaaagctacccactgtcatgcgctgggaaactagtgagctgaaggatgacccatctgtaaatggggtgctccctaatggacagggcacctttcagaagcctgtgctgtgtctcctcgaccccactgtgagctccccgtcccgcacgctgatctaaatcaagctgctaacctcatggagaggcgtccgcacgggagccccggccctgagatgcggggcagtcacccattcaattaggaaacaccagcaagtgccagaagcttctcattagcaggtcagctttcaataactggtttatccaggtgtgtgagacccgataagcagaagggaaagctcttagcgacctatccagctgctctgcactgggctcctgacatcccagaaatcagtacatctgtcttctggggtccaagaggtatttcagtttctctggctttgtttcccgtcatttgtacctggccctgcagactaccccagtatttccatcataatacccctgtgggcaggtgcatacctcatgacaatatttaatattaatagatttatgtgttgtctccagaatggaaaggggctgtctattccttgagctagttggcttgctaaagactattgacttcattcttcttttcctatctacctaataaaccagtgttcataca

SEQ ID NO: 3346 - DNA, 2463 bp, Homo sapiens
agagccttctggggtggtggatagttattgaggctgagagaggtgaagcaccttgcctaaggtcatacagccagtgttcgagcccagctgctaagaagaccgcagcagccttcataagttgtatcttcccctttactgaagaatcaccagtcacctacagttgcacagcaagcatgggaaaataactgaaattttgatgtgccatttctcacttctttaagaaccctccttcaaattcctgaataaagctgctaactaagacaaatgaattttaaaagtttgagacttaaatacctctctactaaaagggaaatggataaaaagatgctgactgccaggctggtttcggatcctttgtattctgtcagatgagaacacttgtttaccttccaggactgacctgagcatgagattctacatcccaccagagacgtactcaactgctgaccacgaagaggttcacatgtgtaggctctgtggtacagctcagccttttggaagaggggagaagaaaagcaccaggaggattagaataagtactagatgagatggtcgctttatgaaattcagtgctcacaactgacttctcagtgatgacttctcatctaccaggcaaagaggtctcaaaaagctgtcaaaaagccctatacttaacggagaccagccacagacttccttcctgtaccagctttccaagagggtaagtgagtcttcaccctgatatttttgccccgggttttacgaggcttctcttctttatgcaccttcatgtgctgcctcagatgagagctctgactgaaacatttgccacattcactgcactggtagggtttctccccagtgtgggttctctgatgttgaataaggtgggagctctggctgaaacaccggccacactcatcacactgatagggtttttctccagtatgaattctctggtgctgaatgagatttgagctctgtttgaagctttctccacactcatcacatttgtagggcttttcccccgtatggatccgtcgatgctgaatgagattagaactctgaaagaaacttttcccacaatcagcacatttatgggatttctttccagtatggatcttctggtgttgaaaaagagttgaactctgactgaaactcttttcacattcagtacatttatagggtttgtcatccaagcttcttctgagtctactgaagcttgagtcaaatcgaatagtcatgccccacttctgccgctgccggcctgttttgcgcttgttctcataggcctttccttggcttgagctccgagaaatacccgctttaggctttgctaacctcatggtgaataaccaaatgtatttgtaagagagtttacaggcttcttctgaactagtgtttcatttcctagaggtgtacagctcagaattttctgtgtgtagaaggaaaaaaaatttagagatgatcagaaaaaaaattacagatatctgttaactattcaattttaatatctcttcaacccaccaaaattgcattcatgtttaaatttaaaaagtataaatgcaaacaaagataatatggggggaaatttgggggaaatacttgcaaagtaattctaacaattccagagtttaagcttaacaaatatcaccaaattttgactgagtttaccactggagtttctgtctattgggacaagacaaattaaaagtgatcaggtgaaatataaatcttccaagcattaccaaatgagtacataattttgaagaactaaaaagtggagataaggtaaatcttaatgggaatggagtaactccaaaagacaatcaaaatttgtgtaacagaacattactatgctttaatatttagttccatgttaaacttctactaactagtaactgcctaaggtatccaaatgaataagaaatgacaaattacactactttatgatatattcctgtttatctgtatttagcattcgatttccatagctctagatgacagtttagctctaattctgtagcataaagtgttttgaaaattgaaacttctctacagggagtggtaggtttacttagtctatgaagacacgctttattattggtttttatagatcctaatgatccaagaaagcaatttgttgaaaacccaaaacgaaagtactgttttcggagacagaaaaactgcaaaagaacttttaccagaaagtggaatgaaactgagtagaaaacgcatggtaggtaggacacaagaaaaggagaggggggagaaaatgagtttacatgtaaaactaggatggaatttttagaatacccaaatgctgcaaaattcaaaatttcaaatgattttatttatttataaggctgacttgtggctatttaaaataacggccaaaacaaaccaacaaaaacccctacaaaccccacataggtggcaatgtcggaaaatctagaacttcaaaagcaataaaattattggaac

SEQ ID NO: 3347 - DNA, 2472 bp, Homo sapiens
agagccttctggggtggtggatagttattgaggctgagagaggtgaagcaccttgcctaaggtcatacagccagtgttcgagcccagctgctaagaagaccgcagcagccttcataagttgtatcttcccctttactgaagaatcaccagtcacctacagttgcacagcaagcatgggaaaataactgaaattttgatgtgccatttctcacttctttaagaaccctccttcaaattcctgaataaagctgctaactaagacaaatgaattttaaaagtttgagacttaaatacctctctactaaaagggaaatggataaaaagatgctgactgccaggctggtttcggatcctttgtattctgtcagatgagaacacttgtttaccttccaggactgacctgagcatgagattctacatcccaccagagacgtactcaactgctgaccacgaagaggttcacatgtgtaggctctgtggtacagctcagccttttggaagaggggagaagaaaagcaccaggaggattagaataagtactagatgagatggtcgctttatgaaattcagtgctcacaactgacttctcagtgatgacttctcatctaccaggcaaagaggtctcaaaaagctgtcaaaaagccctatacttaacggagaccagccacagacttccttcctgtaccagctttccaagagggtaagtgagtcttcaccctgatatttttgccccgggttttacgaggcttctcttctttatgcaccttcatgtgctgcctcagatgagagctctgactgaaacatttgccacattcactgcactggtagggtttctccccagtgtgggttctctgatgttgaataaggtgggagctctggctgaaacaccggccacactcatcacactgatagggtttttctccagtatgaattctctggtgctgaatgagatttgagctctgtttgaagctttctccacactcatcacatttgtagggcttttcccccgtatggatccgtcgatgctgaatgagattagaactctgaaagaaacttttcccacaatcagcacatttatgggatttctttccagtatggatcttctggtgttgaaaaagagttgaactctgactgaaactcttttcacattcagtacatttatagggtttgtcatccaagcttcttctgagtctactgaagcttgagtcaaatcgaatagtcatgccccacttctgccgctgccggcctgttttgcgcttgttctcataggcctttccttggcttgagctccgagaaatacccgctttaggctttgctaacctcatggtgaataaccaaatgtatttgtaagagagtttacaggcttcttctgaactagtgtttcatttcctagaggtgtacagctcagaattttctgtgtgtagaaggaaaaaaaatttagagatgatcagaaaaaaaattacagatatctgttaactattcaattttaatatctcttcaacccaccaaaattgcattcatgtttaaatttaaaaagtataaatgcaaacaaagataatatggggggaaatttgggggaaatacttgcaaagtaattctaacaattccagagtttaagcttaacaaatatcaccaaattttgactgagtttaccactggagtttctgtctattgggacaagacaaattaaaagtgatcaggtgaaatataaatcttccaagcattaccaaatgagtacataattttgaagaactaaaaagtggagataaggtaaatcttaatgggaatggagtaactccaaaagacaatcaaaatttgtgtaacagaacattactatgctttaatatttagttccatgttaaacttctactaactagtaactgcctaaggtatccaaatgaataagaaatgacaaattacactactttatgatatattcctgtttatctgtatttagcattcgatttccatagctctagatgacagtttagctctaattctgtagcataaagtgttttgaaaattgaaacttctctacagggagtggtaggtttacttagtctatgaagacacgctttattattggtttttatagatcctaatgatccaagaaagcaatttgttgaaaacccaaaacgaaagtactgttttcggagacagaaaaactgcaaaagaacttttaccagaaagtggaatgaaactgagtagaaaacgcatggtaggtaggacacaagaaaaggagaggggggagaaaatgagtttacatgtaaaactaggatggaatttttagaatacccaaatgctgcaaaattcaaaatttcaaatgattttatttatttataaggctgacttgtggctatttaaaataacggccaaaacaaaccaacaaaaacccctacaaaccccacataggtggcaatgtcggaaaatctagaacttcaaaagcaataaaattattggaactatttttca

SEQ ID NO: 3348 - DNA, 435 bp, Homo sapiens
atgaagttcaatcccttcgttacctcggaccgcagtaaaaaccgcaaacgttacttcaatgccccctcacacgtgcgcaggaagatcatgtcatccccgctctccaaggagctgcggcagaagtacaatgtccgctccatgcccatccgcaaggacgacgaggtccaggtagttcgaggacactacaaaggtcagcaaattggcaaggtaatccaggtgtacagaaagaaatatgtcatctacatcgagcgggtgcagcgtgagaaggccaacggcacgactgtccacgtgggcattcacccaagcaaggtggttatcaccaggctaaaactggacaaggatcggaaaaaaattcttgaacgcaaagccaagtctcaacaagttggaaaagagaaaggcaaatataaagaagaacttattgagaaaatgcaggaa

SEQ ID NO: 3349 - DNA, 1389 bp, Homo sapiens
tcagaggtcaaggagctgatcctatattggtatgaggaatggcttattttctgatgaccacatgtgggactatttcaaccgccacaagaaaccccagaagggttattgttttgtattatttatatatactatacttttttaataaaagtaaattaacacataacgaaattcaggattgatcccaacctagagccagatcctctggggtcagggaggaaacagttgtcacatcaccacgcaggttacattcgtcttccactggaatgactagagcccccaggcagtaggcagtgacctgactgcagaagagcagaggacagactccgctcatggggacagacaggctctgttgcttctcctcactggtcatggcttagcatggttcctccccaaagtccttagtaaacaaagcactcgcaaaaacccaagtcactacttttaaactctgttggataaggggagcttttccatagcttagactgagaacctgtgctctagaactgctattctgactagattgtatgaagggagtgggtgcaggcgacaaaatggctaaaatgaaaatgggagccactggtccccatctgcagctacaactcaagatgtctacagatgtggtcagtgtgacatgtgcaggtgggaggggcagagggacaagatgggcagggagggtgctcctggggacagtatcttccccgccggccttcacttcttggccttgccctgggcagccacagcttccatggctttgcgcaccgtctcctcatcccccagaaactgcatgggcttgataggcttcaagttcttgtccaattcatagacaatgggaataccagtcggcaggttcagctccatgatagcctcttcagagagaccctccagatgcttgacaatgccccggaggctgttgccatgggctgcaatcagtacacgtttcccctccttgatctggggaactatttcttcattccagaagggcagagctctggcaatagtatccttcagactctcacaggagggtagctgatcttctgtgaggtctgcatacctgcgatccttactgatgttgctgtagaaaggatggtcgggctccatcggaggtggtgggacatcataggagccacatctgatcaatggcatctagcactgtccagagggtccggatcgctctcttctgcactgaggtgaagcagatgtcaaactcatagccagcatctcgtagcgcctgcccgccgcgcttcgcctcctcgtggcccgccgggctcaggtcggcgtcgtaccagccgctgaagcggttctccaggttccatgcgctctcgccgtgccggatcagcaccagtttgtaggcggccatggcggcgggctggggatgcggcaccgactgggatt

SEQ ID NO: 3350 - DNA, 834 bp, Homo sapiens
gtctggaggaggtgatatctggctgagatccgggagaagggtggtgtcactgatgtctggagagagagtcacctggctgaggtctggggaaagggacatctgaccaaagtttggggaaagatctgtctcaccaaggtctggagaaagtgtcatctggtcgaggtctggggtaaggggaatttgactgagatctgcaaagaggggcatctcactgaggtctggggaaaggtttgtctgactgagttctggagagaggtttgtctggctgaggtctagagaaagggttgtatggctggggtctggagaaaggggcatctgaccgagggctggggaaaggtttgtttgactgagttctggagagaggtttgtctggctgaagtctagagaaagggttgtatggctgaggtctggagaaatgggcatctgaccgagggctggggaaaggtttgtctgactgagttctggagagagagtcatatggctgagttctggagagaggtttgtctggctgaggtctaaagaaagggttgtatggctgaggtctggagaaagggttgtatggctgaggtctggagaaatgggcatctgaccgagggctggggaaaggtttctctgaatgagttctggagagagagtcgtgtggctgaggtctggagagaggtttgtctggctgagttctggagagagggtcacctggctgaggtctggagagatgactgtctgccagacttcatgttctgaggaaggggacatttgacttatatctgtggggaaggacttgtgacttcggtcatactcaagcatttcactgagctctggagaagaggatctgtg

SEQ ID NO: 3351 - DNA, 1938 bp, Homo sapiens
gttttgtgttctcatttattatcatttttttctgtacaaatctattatttctagatttttgtataacatgatagacataaaattggtttatctcctccaaggcagtttgtctttttctattcctcccccttcaacctgcgtcacaaaagaccaagaacagatgtcggaaaagtttttttttcttcagtattgtttaaaagtttcaatacaaaataagttataaataaaaggcttgtatgtacaaggctcctcagagggaatgagttgtcttcaaccccatagaatgatgtgagtccaagctggctctagaggatcacagcccaagtatcacaggcctaggtttaaacaggaaaataattagcttaaattgtattctagtcatgaaagatatctgataaaagttgtaatcaatgagaattctacacattagatgaggtctcctgagtccagtttcaattagttcagtagtgtagtttgtcatgatgaccgcccctctttggcattgctggacctctgtcctgcagccttcaaacaactgccctgggaaccatcagcatcaatagtcttcaagctaagatcaaatcctgtagatgaactaatcaaacatcctcaccatcaggaaaccactgaccagaaagattgtattcaaactcttgatagcctggagcttttagagcccagcaggaagatgagactccaaatctacacaagattgaagcaggtatgtatcataggggaggtgcaaaccatgcatgatcagtacgggcagaaaacatgtaaagacatgatcagtaagcacctgagtgtaaaactgcctcccgactcctgggtggctcagcctctccactatgctaaggaatccagtctgtccttaacccatttatgccagaggttgcaaatttttttgtgtgaaaaatcagaccttggcgatgaccttgagcagtaggggatcaataactcccacaggcttagcgttccaataattaaacagtaggcataagtgggttactcttgtttcttaccacttccacaggtaatatgtttggctttctctaaaagacactgtaactctgctaataggcggtttggcatattccatcccaggaccaccacttgagcaccgccacatccgaaacattcctcgtcttgtgatagagtgcaatcttctgtaacccacccctatctttcaacacatcctcagccatctgtcctgagcgtccctacgtcctgacctcactggattctaacacaatggtccttgattcccccttaagtgaaaaccaaaggtctagtggaactagagcattccaaatgtctacctttccaaatgttgaactcaagacctacagaatacaattttgtctttccccctcctcttttttttttttttttaaggcacaatctcgctgtcacccagcctggagcgcaatggcgccctctcagctcactgcaacctctgcctcctgagctcaagccatcctcccacttcagccttccgagtagctgggagtacaggtgcgagccaccacacccagctaatttctgtatttttagtagagacagggtttcaccatgttgcccaggcatgtggcgcacgtctataatcccagctactcgggaggctgaggcagaagaatcacttgaacccaggaggcggaggttgcagtgatccgagattgcgccactgcactccagcctgagtgacagagcgagactctgtgtcaaaaaaaaaaaaaagagagaactgatttctgatgccaggacgaccctgctgattccacatacttggaatctgtgttgttcagaatctgtgtgctcattcattcagcaaacatacaacagtacctagtatctgctagtcacaggggcacaaagatgaaaaagactgtcattgttgagctcacagtctagacattagggaaggggtcaaaaaactac

SEQ ID NO: 3352 - DNA, 13114 bp, Homo sapiens
ctttcatctataggatggcgggaaggaggagtactacgggccgctacgaggttcaatccaagctcatttaatcttgtttgtcggtgcttccggaagagcgtatttaatctttctataaatatttaatgattctctgctacgcgcctggagctgctataaatgctgaaaaaacagcagtgaacaaaacagataaaaattcttgtccttgtggggttgagattctagtggaacaagacagatactaaaaccaacaggagccggcgccgtggctcgcgcctggaatgtcaggtactcccgacgctgagacgggaggatcacgtgagcccaggagttggacaccagccctgggcaacatagcgaaactcttgtctctacaaaaaatttaaaaactagccagactttggcccggcgcggtgggtcacgcgtgtaatcccagcactttgggaggccgaggcgggcggatcgcctgaggtcaggagttcgagatacgcccggccaacctggtgaaacccggtctctactaaaaatacaaaagttagctgggcgtggtggcgggcccctgtaatcccagctactcgggaggctgaagcaggagaatggcttgaacccgggaggcggaggttgcggtgagccgagatcgcaccattgcactccaacctgggcgacagagcgagactccgtatcaaaaaaaaaaaaaaaaattggacgtgatagcgcccacctgtggtctcagctagctactcaggagactgagatgggaggatcgcttgaacccaggaggtcgtggctatagtgagtcgtgatcgcaccactgcactccaggctgggtgacagagtggtaccctgtctcaaaaaaatggtaaatatttatagtagtgggttaggtggagcaaagtgaagcagggaagaggggagtccaactttacagaggatagagaaaggttatctcgtcttttttaaatttatttttgtttttgttttgttttgttttttgagacggagtctcactctgtcgctcaggctggagtgcagtggcgctatctcggttcactgcaagctccacctcccgggttcacgccattctcctgcttcagcctcccgagtagctgggattacaggcgcatgccaccacgcccggctaatttttttgtatttttagtagagacggggtttcaccgtgttaaccaggatggtcttcaactcctgacctcaagtaatctgcccgcctcggcctcccgaagtgctgggattacaggcgtgacccaccgcgcccggcaggtaataattattgtaggattcaaggaagaattacatgtgaagatccttgtaagtgtttaatacaatatacacactaacccctccacaaaaggtaattattacataggagaaaattgatagaagtaacttgtccacagatatcacctgttctagcaataaggccaaacttccagcctggtctgtcagactccaaaatggccttcctccttttagaaaagggaaatattagcaagcgttgggacctgaggagagggagtttttgtttttgttcttctaccctatgttctctgatggtagaattgcaaccaaataataataataattgctagtttatttgaatgtttactatgtcataggttctttaaatgcattgatttacttaatccgttcaacaaccctatttattcacatttcagatgaggaaactgacctttagaaagagtaagtaccacaaagattacttcctggtcctaaggggtaagttaactgtgccccggctcttaccaccataacaccgtggtaaatcttaacataatggcagaacaaccagatattatgtgtctcctgctgggatgacaatattaagtagctaccatcaactatgacttttttttttttttttttgagagagggtctcgccctgttgcccaggctggaatgcagtggttctatcacagctcacttcagcctcaacctcccgggatcaagcaatcctccctcttcaccttccaagtagctgggactacaggcacctgacaccatacccttgttaatttttttaattttttgcagaaaaagggtctcaaactcctgacttcaagcaatttcccacctcagcctcccaaagttctgggattacatgtgttagttagcctctatacccaacaactatgacatattataaaaaatgtttagtagccacaaaaattaaaaataatttttaaaaaatgtttaacttagatctaatcaagttaacaggatagtctataggatcagctaaaggaaagcaaaaggcagcaaacaaattctggcagtaggatgttgtaaggacaactggcctctttccttcactaatttaggaaaaggtatttttctaaatttaaatattaagagacataacaaccagatgtagtgtatcatctacatctagatcctagtttggacaaaccagctataaaggacattttgcagaaaatgcctgggtcttgatgttgcatttccagaaacccacctttgtccaggtaccttcagttgattttcctcaagggaatggattcatcagttatgttgtttattttgttttggtttttgtttttttctgagatacgtttgcactctagcctggcaacagagcgagactccgactcaaataaaaaaaaaaaaaagtcagtggtggactgactccatgaaggctgcatgggctggactccaatactggttgacttccaagctgaattgctgggctccatcaattggaggcattttctggagattggagagatcaaggaaaaagccagagtatctcctaccctgacaccacctccaagccagagtatccatcctctccccacccctcaacatcaggctgtctcctacaacctacttggatctaacttgtagtagttgatcctagaccctgagctctggtagcacagtgttgtcctgtccctctagtgtaagggtggcagtagcttcttgctgtcactcatctctgtctgggctatttgactattctgtttggctttttgtctctgccaacacctgtataaaccatttatctggattaagttccctgtgtttttttttttttttttttttgagacggagtctcgcactctcgcccaggctggagtgcagcggcacaatctcggctcactgcaagctccgcttcccgggttcacgccattctcctgcctcagcctcccgagtagctgggactacaggcgcccgccaccatgcccggctaattttttgtattttttagcagagacggggtttcaccatgttagccaggatggtctcgatctcctgacctcgtgatccgcccacctcggcctcccaaagtgctgggattacaggcgtgagccaccgcgcccagcctgttccctgtgttttaaagacttagaatggttttccaggttggaccttgacatatatgtatatatacatatgtatatatgctcagagtgaccttatctccaagtcccaaggggtatctccatcatttcctgcccataggccctgctatcttgtaaagcagtgcttttcacactttttctctgaatgtccaaggcaactgagagagttcatttgtcaccctcattcctctaggtctatagccaaaatccctagtgcccacctgagcttgaaatgcccttgaaatcttgtgctcttgcgtggtgtcctaaaaactcacagttagtaatctacttcataacacatctatgttgttcttaaggtattttacatttaaaatgtattttatttacttatatttgaataggtagtgtatacacatggtagaaaattagaaaaccacaaaaatgtttcctagccacacccttgttcccagtttcttttctttttctttacttcttctttttttttttttttttttttttttttttttttttgagagagagccttgctctgtcgcccagtcttgagtacagtggcgcgatctcagctcactgcaatctccgccttccaggttcacgccattctcctgcctcagcctcccgagtagctgggactacaggcgcccactaccatggccagctaatttttgtatttttagtagagatggggtttcactgtgttagccagggtggtctcaatctcctgacctcgtgattcacccaactcaacctcccaaagtgctgggattacaggcatgagccaccacgcccggcctctttttttttttttttttttatagagacagagtctcactctgtagcccaggctggagtgcaatggtgtgctcttggatcactgcaacctccacctcccgggttcaagtgattctcctgcctcagcctccccagtagctgggactacaggtgtgcactgccacgcccagctaatttttctatttttagtagacacagggtttcaccatgttggccaggctgatcttgaactcctggcctcaagtgatccacctgccttggcctcctaaagtgctgggattacaggcgtaagccaccgcacccagccccttgttcccagtttcttacatatctttccagaaaaagattatccatatgcaaacaaaaatatgtttcctggttctgttttacagatgcatagtatttcgttgtgtagatgtacctccatatattaatcagtcctttattgatgaatgcttaaattgtttcctgtctctttctaatttagtgatgctgcagtacatcattaattcacagacatgcaaatatgtttataagataaagtttgggctgggcactgtggctcagacctataatcccagcactttgggaggccgaggcgggtggatcacctgaagtcaggagttcaagaccagcctgaccaagatggtgaaaccctgtctctactaaaagtagaaaaattagccaggtgtggtggcacgcacctgtaatcccagctactcgggagactggggcaggagaatcacttggacccaggaggtggaggttgcagtgaggggagacggcaccattgcactccagcctaggtgacagagtgagaatctgtctcaaaaaaataaataaaataaataaaaaagattggctgggtgcggtggctcacacttgtaatcccagcactttgggaggccaaggtgggtggatcacctgaggtcagaagttcgcaaccagcctggccaacatgatgaaaccatgaaaacatggtgaaacattctctactaaaaatagaaaaattagccaggcgtggtggcacacacctgtaatcccagctacttgggaagctgaggcaggagaatcacttgaacccgggaggcagaggttgcagtgagccaagaccgtgccattgcactccagcatgggcaacgagcaaaactccatctcaaaaaaagaaaggaaaaaaaaaagataaaattctaggagtgaaattgctaggttgaagagctttctttgcatttgtaattttgaaaaataatgctaaatcgcccttcattgtggttatatttgagagtgcttttttaccgtatctgataaataaaaaatggcattgtgttatcatttcttttttgagacagagtctcactctgtcaccgaggctggagtgcagtggccgagtcttggcacactgcaaactctgcctcctgggttcaagtgattctcatgcctcagcctcccaagtagctgagattacaggtgcacgccaccacacctggctaatttttgtatttttggtggagttgggatttcagcatgtttgccaggctggtcttgaactcttggcctcaagtgatctgcccacttcggcctcccaaagtgcacaggcgtgagccactgtgcctggctgtattataattttaatttgtgtttctccatatgaataaaggtgaatatatttcatatgttaaaaagtccaatgagcctgggcaacatggtgagaccctgtctctacaaaaaatacaaatattagccaggcatggtgtcacacacctgtagtttcagctactcagaaggctaaggtgggaggatcacttaagcccaggagactaaggctgtactcagtcgtgattgtgccactgcactacagcccaggcgacagaatgagaccctgtcccaaaaaaaaaaaaaaaatatttcacagatccttctttgtagattgccttttttttttttctgacagagtctcactctgtcacccaggttggtttgagacagagtctcactctgtcccacccaggctggtttgcgacagagtctcactctgtcacccaggttggagtgcagtggtgtgatcttggctcactacaaactccatctcctgggctcaagtgattctcatgcctcagcctcccaggtagctgggattacaggcgcccgccaccacacctggctaatttttgtattttttgtagagacgagctttcaccacgttggctaggctggtgtcctaattcctgacctcaaatgatccacctgccttggcctcctaaagtactgggattgcctgactgcctttttatattctttgcccctttatctgttatattgttagtctcatcctttttttctttttcgtttttctttttctttctttttttttttttttttgagatggagtctcgatctatcgcccaggctggagtgcagtagtgggatctcagctcactgcaggctctgcctcccgggttcacaccactctcctgcctcagcctcccgagtagctgggactacaggcacccaccaccatgctcagctaatttttttgtattttttaggagagacagggtttcaccatcttagccagtatgatctcgatctcccgacctcgtaatctgcctgccttggcctcccaaagtgctgggattacaggcatgagccaccatgcctggccctagtctcatccttttcttattgatttgtagagagctcttcatatattaaggaaattaactccatgcctcttatatgatttgcagatatttttccacttgttatttgtctttggcattattttgggtagtttttatcctgaaaaaaaggttttaatttgtatgttggtcaaacttatttatcttttcttttttgacttctgggttttatgtcacatgtagataggccttcacctttctaagattatttgtttaaattctctcacacattggctgggcatggtggctcacgcctgtaatcccagcactttgggaggcagaggtaggtagattgcctgaggtcaggagtttgagaccagcctggccaacatggcaaaaccccgtctctactaaaaatacaaaaattagctgggcatggtggcacatgcctgcagtcccagctactcaggaggctgaggcatgagaatcgcttgaacctgggaggcagaggctgcagtgagtcgagatcatgccactgcactccagcttgggtgaaagagcaagactccatctcaaaaaaaataaaaaaataaattctcccacatatttttcttttctttttttctttctttctttcttctttttttttttcttttgagaaggacctctaactgcatctcactgaaagagaaaaaaagaaagacagtctcactctgtcactcaggctggagtgtggtggtgcagtcatagctcactgcagccttggccttttgggctcaagcagtcctcccacctgagcctcccaagcagctggtactataggcacataccaccatgcctggctaataattaaaaaaaatttttttagagacaaagtcttgctatgttacccaggctggtcttgaactcctggactcaagtgatcctcccgcgttggcctcccaaagtgctgggattataggtgtgagccactatgcctagctcattttttctgattcttttattattttatttttttcatgtttatatcctttatccatctggaacttattttaaagtaaggtgtggaagagggatctatgctaatttttcttttcacaaacatcaacctagttatcctagcaccagtttttgaaaatctatcatttttcctaccaatttgaaatcctattttattataggctaaactcctctacattctatttaacctctgggctttctggtctgtttcattggtctattgatttgcctctaccaagtgttttaattattacaactcatatctgctattttaatataacagtctatgtaaattaaccagttgagttacttagctttatcccttcctaaaaaattcttccagtaggccgggtgtggtggcttatgcctggaagaaattttctagttgcatatgacaaaaccctacttaaacctgcttaggtaaataggatatagaggctcagcaagctgggacattgaagggtagatttatcctcaggtgtgattgacttagggcctgaaataatgtcactcggtctctctccttttctcatctctgcttgtttgcttctctttgcacactggcctcattgtcccacgttgcagcctggtttcctccacacagatgggacagcctcatttatctccaaacttccattcttctagcacataatgccagaagccagggaaggacctaaatgggcacacttatacatcaagaatcctccttggttggggatgagtagaaaactgtgattgccagtcccacttaaaccttagggagagaaggaggaatacccaaaacttgggggagtactgttgtcaaagaagaagtataaaaacgcatcctgggcccaaaatggtatgtacagctgcaaccactggtcttgcctaacccagtctgcaaagcctaactcaaaggaggtaccagtttaaggtggtaatttccattgtcaccaccagaagacttgagtccttagttccatagtaaactacaccttcctcaactctcctatatctttccacaatgctgaaacacaaaaagtaatagttattcaacaaatgtttactgagcattctctttgtgttcaggtctctgttggccaccattaataggaaaatgagtaacacactgtgcccatcttcaagtttagtgtgggacataagcatttaaacaaagaattgcagccttttttggtaaggactatgataagacaactttatcaaaaggcagtagcacagtggtcatgagcacagcctctagatccagtctgcctgtgtttgaatcccagtatcaccacaagctgctgctttgatcttggggaagttgcttaacctctttgtgtctcagctttctcatctgtaaaatggagatgataatagtacctccttcagagggtcatggctgtgagggctgattaagatcattctcttaaagcacttggcagggtgtggtggctcatgcctgtaatcccagcactttgggaggccaagacaggcggatcacgaggtcaagagattgagaccatcctgactaacacggtgaaaccccatctctactaaaaatacaaaaagttagccgggcgtggtggcgggtgcctgtagtcccagctactcaagaggctgaggcaggagaatggagtgaacctgggaggcggagcttgcagtaagccgagatcgcgccactgcactccagcctgggtgacagagcgagactccgtctcaaaaaacaaacaaacaaacaaaaaacgaataataaagcacttagcactgcatggtaagcatgcagtaattggtggatagtgttgggactgtcagtaagaataagtacccaaaacctaggtctcttgaattccaaatccaggaatccctccaaacctcttcagggtcacacaggggatgagctgtggaactggagaggcatttttcttctcccaataagatacttcagcttcactttgttgttttgtttgtttttacaccttgtttctactccatcatatcagcttcgctttgtagccatcgttggctgttgactcctccatctgttaagcactcttcagaatctacaattcttagttccattgccaaacctcagggccctgaagtgcaggggagaggctgaattccaaagacagacttgcttctgtactctgagtgatacttccagagctgttgatctgttgatggatgcctcactgagaaagatcataccattgtggccttccctgctaacttttcattttgaactgagagcttgtggccatgaagtggactcagaaggctaaaactggatctttctatttggaaacaacagctggatgtagggatgtaaaagctcacgccaggcctcccaggtaggtgtaaacatagctgtggctgggatgactgtggctggcaatcttcatcccactctaccctgcaagtgaaatcgcttgggaggtgacctagctgctgctttccaaggccatgggtatctggagacaaagctttctccacctagcctgggcaaatgagaacaacactaagactacgatgaggatgcccatctggcacctacaaggtggtggcagacaccacccatctttgcctggctatgtgggaaggaaataattattcgttagttctgctgttactgtcctggctccctcacagtaaacaaagggctcactactgagaatagaaaaggccaaagtcccagggcctggggaacatgttctttgttgaacctctttattaatctaaagctgttggaccaacaggttgtggtgttaggcggaagctgggcaggcactaatcactaaggcagaagaacgggtttggcagggtagttttgagtagcagcttattgaagaggtgttattactcacttttttattttttatttttttgagacaagttctcaatctgtcacccaggctggaatgcagtggtacgatctcagctcactgcaacctctgcctcccgggctcaagtgatcctcccaccccagcctcccgagtagctgggactacagatgcatgccaccatatcttttgcatttttttgaagagactgggtttcacggtattgcccaggctagtcttgaacttctgggcccaatctatctgcccacctcagcctctcaaagtgttgggatgacaggcatgagccaccccgccggccctatgactcactcttgaaatgtcttttcttagatagatatgatctttggtcagggagtattctattagcgcaggaagctttcagtctgattctaggggtggcaagctggaaacaggatcatgagtggcctctatatggcttcatactccagcagaacctgaggttgtggttgggaatgagacacatacaaacacacaaacacacccacacacatacgccattctgctgccctatggcatgttatcttttagtggcttggcttttactgggagagaagggaaactaacatttattaagcacctagtttgtgtcagcactaggcaatgtgctttcattatgttatctgatgggatttgattttgaagctttttttactgataaggaaactgagactgaaggagatgatataatctgaacaagattgcatagttaatatgtgggaaaaagagaatttgagcccaaatagagtccagcgcttacccactttccattgaatacactgcctgtacacctgagaccgccacagtccagacccgagtgcaacctgccccaagtaactcctttgctgcaatggctgaagctcatttttttcacatagagacttcaaatcaccaacatgtagcccccagctggaacgccttccacataaaagggatagctcccctaaaaggtatatattttatgtctttttttttaactttttttttttaagatgggatttttatgttgcccaggctgatcttgaactcctagcctcaagtgatcctcctgcctcagcctcccaaagtgctaggattataggagtgagccaccacacctggcaggtgtatcttattgtatgtaaattataccctcattaaacctgacttttttttttctttttggttgtaagtttattcaacgcaaaagaatcctctccaattttactgaggtagctgactatgtccacaaccaaatccgcctctaaactggaattcagttgctgacccagccccagactcggctttcttgtcggcaccaggtggcacagcactctgtctgtaggtatctctgtcagcttcccaatctccgggggcagatgaaggtaatcatggagatactggataccctcattggtaaggtaccagtagaaatgtctccaggcaaactgttccttcacgtagcctcgggactagagagactgcatggctttcatgacatgaaggttgggcacattcttgtctgccagctccgggtgcttaggcatgtggacatccttcttggccaccatgactcccttcttaaaaaggagttcataaatggcaatccggttcttcttaggcatcaacatctctgcggctgcaggggccggggccggggctggaaaagctaaacctgactttttatttttattcatgtactgatttagaggcagggtctcattctcttgcccaggctggggtgtagtggcatgatcatggttcactgtaaccttgaactcctgggctcaagcaatcgtcctgcctcagcctccctaagagcagcagctggaactacagtcacaccaccacatttgtttttgttttttgtttttaggatttttttctctttttttgagacatgatctcactctgttgcccaagctggagtgcagtggcgggatcacagctcactgcagcctcaactgcctgggctcaaggaattcccctaccctcagcctcctgggtacctgggaccacagacatgtgtcaccatgcccagctagttttttttattatttgtagccaagaggtctcactgtgttgtccaggcttgtcttgaactcctgagctcaagcagtcctcctgccttggcttcccaaagtgctgggattacaggagtgagccaccactcctggctggacatccagctaatttttgaattttggggattataggcatgagccaccatcccagcctatttatttaagtgtagtcaaagcagtgaggaagaaggaaagagtagaacagccaggtgcagtgggtcacacctgtaattccagcactctgggaaactgacataggaggatcacttgagcccgggagttaccagcctgggcaacatagggagatctcttctctaccaaaaaaaaaaaaaaaaaaa

SEQ ID NO: 3353 - DNA, 1778 bp, Homo sapiens
cgagaatctaagtggagtcaaagttctgcttcaccaaggcccacaaaatgggtgagcagcatgcatgggtatgaagaggcaagtaaactgcattgtgtcatccaagtaaaacacagcacggcctcctgccactgacagaccctgtttccataatttctggatgagaaagccaagtcatgtcagtagttaatcagctctggaggaaagtgaacacctataaacacggcagaatgcaatacttccagaaaggcttttaacacctacagaatctaaacattttgtaagaggtggggttaacaagcttgtgtgctatttgggggtggggctgagcatcagaggcaaagtttttcgtaagcctctttctctcgatggattaggcaggaatgactttcctccaggggacggtcccatcttcagaaagttaaaagggtccatttgggatcccagagcctagcacggtgctatgtacaaagcggtggcccaaggtttcttgaatgaataaaaaactcaagagcacagagaaaatctggctctcccaagtaaactgtaatttacattttcatgggattataataggatcttcagtgagtggagcaagaagatagacagcagtaatccggaaggcagcataggagtaatagcaaaagttaagagatgtaggggccacagtgaaaacagctttgtgactgtgggagagtcccagaaacagtatttctttccttatccacacacggagcatggcccaagaacccccagctctagaactctgttattctttaagcaataagtgctctggttcaatcaactgtggtcaaagaccacttcatctgcctctaaagccattccgcgaatagtgtggcctcttaagcttttctcttagctgtacattctcttgtcaactgtaggtttcatgaagcacatggtttccttcaaaacagaacaaaaaactttaaggtaagtcataaggatggtttcctcttgtgaaaaatggggaagttagtctatatcatgtctatggtctctaccagatccatgagtcagagaaaacatgaagcgcatcacattttttgggcaacccatagaactatcctactctccagccatcctaactgccactgtgcctggggctgtgcaatgctgctgcctcctctgttcttatccctgtgtctgctttgggaacgcccccttatcgctgggttctcagcccaggcatctgggacctctggctagaaatcctcaggtaaagacgatcctccttcctgagtcctcccatttcacatcaggacttctaatctaacacggatctcattttcctgagaattttagtctccatgccaacctccctcactataaaatgaatttcttgcaacagggatcttacttgttttgcgtccccagtggctagcacattttgttgagaattcattcaaaatattcaggagactcaaccatataaagatggtgccaattgcccatgtgctatttgggctgccatctgtaggatgtggcttcaagttagagctcccttggcagttttaaaggatccttgttagtagatggttccattttttactttgtgcctacttctcatttgtgaataaatgtccccccccaaagtcaacactagtctaataaaagaagcaaaggaaatgtgcgttaacatctacatacaaattttgtgaaattgctacttgttagaataacataatagagcttatgacataacaatataaaaacaaaaatgatttttagtgaggtctgagttaattattgctttt

SEQ ID NO: 3354 - DNA, 495 bp, Homo sapiens
atgaaagaaacgatcatgaaccaggaaaaactcgccaaactgcaggcacgaatgcgcattggtgggaaaggaactgctcacagaaagaaggtggtggttcatagaacagccacagcagatgttcaaaaacttcagttctccttaaagaagtgaggggtaaacaatatctctggtattgaagaggtgactatgtttacaaaccaaggaacagtgatccactttaaccaccctaaggttcaggcatctctggcagcgaacacttcaccattacaggccatgctgggacaaagcagctgacagaaatgctagccagcgtcttaaaccagcttggtgcagacagtccgtctagtttaaggagactggctgaagctctgcccaaacaatctgtggatggaaaagcaccacttgctactggagaggatgatggtgatgatgatgaagttccagagcttgtggagaattttgatgaggcttccaagaatgaggcaaactgaa

SEQ ID NO: 3355 - DNA, 1485 bp, Homo sapiens
gtgtttcattttctgtttattacttgaaatcacggtgctcgtgtaggtttttttttttttttcaattttatgttttcatacataaagggggggagttgaggacctggggttcacctacgagaacaacggtgggggacaggcagagccaggacaagaccgacaggtggggtgaggaagggtccagacatctccattatcattaaaaaataaaaagtgagtggggaaaaaaatccaaaaactaccccattgaaatggccccagtaggggatttgtccctcccctctggagacagacacccctagggcaggggcactgagaggcagggggtccaaattagaccagcagcggaccccgccacgggggttaatgctacacggagttgtcgccccctgcccaggggattcacagctcagcaccccctcccatcctcgctgcaggaggggcccccagacagtcccaaatccacatccctcaggttgggccgggaaggagggctcggaggggggaactccccagcacccagccattctctcccctttttcaagagttccccaaccactattggctcagtcagaaaattaatagtctataaataccccaaactcaggcaggaggtcagaaaacacgggagtgggggcggaggaaacagcacagtccgccggctggggcggggcggagggcaggctgggggggtagttcccctctcccttcccgacaggaaagggtgccatgcccctgcacccaaaccccatggggacctcagccccagcctctgctaaaacagctttgctctccttgttaaagaaatgaaggaaaatgcaaaaaaaagatcaagaaaagaggataggagtggaagagaaacagtcccctcgttggcttctgtgacctgttggcttgctgtagcccagtgggcgctgctggcctggggtggagaccccgaagtctgcactggggggtggggtgggttctgcgcactgcggcccctcccctcatctgtaaagtgcataatgacatatcgacatttttgacttaaaacctgaatagggtcgggggggaaaggaggcggcggaagggatggggcgcgtttctccgtctccttcactctccgccatccagagagactgctacatattggagctggggaaggttggcagggaggaccgacctggcgcagaggtgaaaggagacagacggaggaggaggaggaggaggaagaggagggcaggagtgaagggtgaaggaggtaggaagcaaagcccatgaagagtccaggaaaccacggtcagaactttttaaaaaaagaaaaaaataataaaaaagaagaaaagaaaaaaagacttctggctgggggagtggccgcctgccctccagggctgggccacgttctctccggggctctcggagtccccgccgccctgggctggggtgcgaggggcgagggtggccgatccgaagatcctaagccaccacgaactctgacttgat

SEQ ID NO: 3356 - DNA, 11739 bp, Homo sapiens
ccgctctccccacccggtaccaggacccacccgggcccgcgctccctgcggcttccagggaccctccagcccccacgcaccctcctgcaaagccgagggttaagctggggaaagggggcctctaggaaggcgacccccctggaaatgcctggcagctccaaaaacactaatgaaactcagctccagcctccgcccctccagttgtgggtggcccctcttgcggttcgtctgaggctaggggactaggcgcatcgcctagcgagactccagtggccttttctgtccagtttgtaaccggaactagaccgaccccggccgccccctccagtgctggggcgggtgaggaatggccccgccggggaggcgggggagggaggcctgggccaccctggggtctgacctttgctccacctcttaggtgctcacgacccagagtggtgccctgcttggtactgccactggatcctctggcttatgaagccgtccaggacaggaagggtggggggtggtccttagttctcttcgtggggtcatgcagagtggtttcctcgaggtcccacgcccgtctcaggaagccagaaacgcaagatgccgggcgctcggcccgaacccgtgccgcggcccaaggggcaaggcggataccgaggcaaggcctaaagggccggactctgaccgcaccctccggacactgcagggctccgccggccagaggcggccttggcgccaaccacacctagcagcggggtccccgggcccaccgatgcgccctcctagccccgcgctccttcgaggggttccaaggtgactcagagacgcagctgacacaattctgaggcccccaggtaagcctggcgataccggatggagaagttacctggtcttgaaaggcccagtccagccagcgagacccgcgtgcgctccgcggggaggcaagcctaaccaggggctcacctggaagcgtccccgccccctggtccttatctctgaatcgaaaccgaacctggacccatctagataattggactgagcaattaaggacgcttcgctcctaactgttagcattttttcctaaggctctcggaggcggaatcagctggaaaggaacattgctaagtaggaatttcaggcacctgtgaactgagcccactcaataatcggccctttcccttaaccaaactcagcaaaggaagaaagaccaagttgctgcggatgcacagagccacgtgggtgcgggtcctctagaaacaggaattcagagtcagtagatatggaaatgttatggtttgcagtcttcggaccatgctgctttcatgctgttcacatgattctcctcggactgcgaggatggaattacttcagtatatttaaatgcaaataaggaggatcccacagagaagaggaagatgaagatgtactgttccatctggaagtcaagattggtgccacctaagtgagttcctgctgcaaggaacttaaggacatcctcctccttcatttgcaggacatcaagggctccggacattgtgaaagtttccctttaagttacgatgggaatccagaacaacgccgtatggacccctctgcaggtagcgtggaaaggacttttttttttttttaataagtagagagtatacttaaaagataaaaagcacagtatagtaagtacataaaccagtaacacacttattatcaagtattatgtattgcacataattgtgttatatttttatatgactggcagtgcagtagtttatttataccagcatcaccacaaacacataaataatgtgctatgacactagtgatgggaatttttcagctccattataatcttatgggaccattgtcacacatgtcatctgtcattgactgaaacatcgttacgcggagcatgactgtagatattctcatacactgcttgtgaaagtatacattggttgggctactttagagggctatttgccaatatttatatgcattctgagtttgagagattctgagaactatgctggagccacttcataccagctaacagagctgattgtgcattcatgtctcattagtagtttgaaatcggccatggtggaagaattcacaccatggaaattggcaaatgctacaaatcagccccacttcctctttttggaagactggttgttaaacatttattagtactctaaagtctatttgacagtgtctacaataaaaaaaagaaagaaagaaagaaaaagcacataacccatgatacagtattcctgttttctaagatatatttgtacatgtaaacagggatgcatgttcaaggatgttcacagcagcattatttgcaatggaaaattgaagacaacctaaaaacccactcattgatagtgtaaaccaaaaagcatctgagacaggtctcaattgattaagacgtttactttgccaaggttaaggaccgtggcccatgctgcagcctcaggaggtcctgagaacatgtgcccaagatggtgggattgcggcttggttttagggagacagaagttatgggcaaagacataaatcaatacatggaaggtatacattggttttggcctggaatagggggacatctcaaagtgggagttgggggctgtttctaggtcacaggtggattgagagatttcctgactggcagttggttcaaagagttaagctctgagtgaagagttgaagtcagcttgagttatggtaaggggggaatgttttggaagccaaggtttttgtcatgtaggtgaaacctccaaagaacaagcttcagagataatagatgtgacagtctcttatctgacctaaaaggtgtcaaactctgtggaaaaacctagtagaggaaggagattctctaaaaaaatgcaaatttcccccacaagggacagctttgcagggccattcaaagtatgtcgaagaaatatattttggggtaaaatattctgatctccttccgggcctgctgtctgtcatgagatgttacatcagagtcaggttggaatttgatcttattgctacaaagagtctgttttgtcggtcttaaaatctctgttttaatgttaatgctggtcagttgggtctaaactccaaaaagagaagggtatataatgagaccttccccctctcttcctgtcatggcctgaacttctaaccacccctcttcctgtcatggcctgaactttttcaggttttttttgggatccccttggctgagggggtacattcagttggttggggagattagaattttgtttttggtttataataggaaactcaaaaacaaaaacctccagcctattctaaatggaacactatgcagcagttaaaattaataaactaaatttatataaactgttgggagaaaaaacttctctaccaatttaggtccaattggtcggtggcctgtgaatcaactgacaatacacagattaacaggagaaaaacgtactacatatgcgaaggtaccctaaagagagtagctcccagaatagctgggggggaaaaaatcacacagccataaaagagaataaaatcgtatcctttgcagcgacatggatgcagctggaggccattatcctaagcaaattaatgcaagaacagaaaaccaaataccacatgttacaagtgggagctaaactgtggattcttatagacataaagacggcaataatagctactagggactactggggttgaaagactaactactgggtactatgttcactacccgggtgacagaatcattcatatgccaaatgtcagcatcacacaatatacctaaagtatcaaacatgcacatggacccctaaatctatgaacacaattaatggctaaacttctaggtgcaaaactagggatggcatttgggctgtaaagaatggcacaggctgtggttaccccagtaaccactttcttccaggactcactcaaggcaatagggacttgcttggtcttgccccttctgttatggttccaggggtggttgcccaaaggtgatgcaagttgattctcccagggatgggtccccagtgagagctctcaagctattcagggaccttcagagccaaattcccctagcattttgttcaactcttccccatgtgtacagggacaaggaagggttttgcattatcctttcccatttgttgaaattacatctataagaactgatgaagagaagggtcagttttttccacctgtctcagggaactgggtgggcctgataactctcccactacatgctcctggccccagattatctggttacttatttttaaacttcctgatattaggggaaaagatttttccctaaattccctataagtgatatttgaagcggtggtacgccacccagcaaatggctgtatccagttttaatggttcataaagtaacttatgaagtgacttgttttctttcaattcaaaggaagtctggggaaaggcaccattcattcattcaagatggggtctcaatatgttgcccaggatggtcttgaactcctgggctcaaggatcctcctgcctcagcctcctgagtagctaggattacaaatgtggcagtttgaaaggcactttcttggtctatgtggtccgcctgtacccagatgatttggagcctcacctttagtcccaccctggccagccaaaccagggtcagcctggggctccaggaaaaaatgaaatgttacatggccttacttgcctttttctgctattcataggctgatattggttgatagtaaatataaacccactgggcaagttcatttttgcacagagtgacaaccgtcactgaactctgttttaagggagggattttggtgggtttttttttttgagacaaggtcacccaggctggagtgcagtggcatgatctcggctcactgcagccttgacctcctgggctcgattgatcttcccacctcagctccccaagtagctgggactacaggcgtgcaccatcacgcctcgctaattttttgtagagacaggattttgccatgttgtccagactggtcttgaactcctgagctcaaacaattcacccacttcagcctcccaaagtgctggaattacaggcatgggagggattttttttttctttaaattgagatgaggtctcaccatcatgcccaggatggtcttgaactcctgggctcaagtaatcctcccatctcagcctcctgagtagctggaactacagctgtgtgcaccacacccagctaattgttcaacatttttgtagagacagggtcttgctatgttgcccaggctggtttctaactccggggctcaagtggtcctcctgcttcagcctcccaaagtgctgggttacaagtgtgagccactgtgctgggccagaatttatttatttattatttttaaagaaccttcatttcctctggcaatctgcttggggacatgcacatgaatctcatgggagaacaagaaaacgtttcctttttgtgttctccactttcccttccctttccagaatctaggccctggtgattcccttcaggaggcaggaaagcgattccttgaagaacaacagccgtcaccttccttcccagttgagccagaaaggccccacagctctgccacagatgctacagaaaatgtttctggcctcaactccccagggagggagtaagccttggggttagttcagttgcacagttccacgtctgttagcagccactggttctcttactccagctatgtttagctttgtttgactatcttccatgggaacacaactgcattagtgttccttttctcagttctccatttcaaaaatttttatttatttatttaatttctgagagggggtcttgctctgtcacctaggatggagtgcagtggcacaaacacagcctcactgcagactcgacctccaagttcagcctcctgagtagttgggatcacaggcatgcaccaccatgcctggctaatttttttattagtagtagagacagggtctccctatgttgcccaggctggccttgaactcctgagttcaagcaatccgcccgcctcagcctcccaaagtgcttggattataggcgtgagccaccgtgccccggtatcggttctccatttataacaacttgtcaccaagaacccgagacccaagcttgggtcaatggttgtccagctaggatgagaataatgtgctggctatctgggtactgtggacagcctggaagccccatgtggcagccaacttactcattttgcacactgcacccagagaagggtggcactgagtggaaagtgaggccaaggtcatcacaaacagcatcaggctctacaaagagtgacagcaacctgaagcacagagacaggtctaacatggatgcaggatgtaagtgacgttggacctagtcttaggtcacatctgcatacaaaaatcctcactacaggaactgtcattatttaaacacatgagcaaggacacagatttttgaaataagcacttattcttttgaagggtctaaaaggtagaatgtagagatggaagacagtagacctgaaattccttcctgaccacggccttgtacaaatcttctgccctgtctgtccagatgtttcctcatttttgaccagatgctaaagcctccaaatcagtcattctgagatccatgccaattcttagccatgattctaaaaatagccagaatagaaataatatacaatcctcatatttatgcttacttctttaatacaaaaacagtgtaataacagcatgaaggaaataatttaatgattttaatttttcagcctaaaattattttaaactaatggtttcaccttgttccacttgagtaatcaaattcatattttcccccttgccatctctcccccacctgcatcctgtgaatcaacagaagttaaaaccctaacaccagtgggaaacagaaactagccaagagcatgtaaaacagaaacaagacaggcgtggtggtgctgaggtgggaagatcacttgagcccaggagttcaggctgcagtgaataatggttgcaccattgcactctagcttgggggacagcgtgagaccctgtctctatattaaattttaaaatataataaaagagaaagaaaatgcctaattacagttcttggtgaataaatgatgtaaatgcccatattttactacctgctcacgtatagcgttagtattgtaatcagatagtttatgtaccaaacttgtaagttatgccagttgggaccatttatctaacaggaagcaggcccaggcaggttcctttgcaacaaaggatggttcaatgttgcatacagttgagttgccatgagagacaattatggccatccccaaataaggaaaacttgattgcacttagataaaaattgcgatttttcaaattttgaggtcaaaacctgtatactctacaactagaggtaagcttaagctaattatgttctatttgagtcttcccttctgctgactaaatcaccatttaaaatatttgtaaaccttggttgtaaagttggacacctaagaattcaaaatagcaattgtcccacaaagccccatcccttccagtattgtgttcttttaggaaagtattcaattatctctcagctgatcctaagattccttctatatcttgtccctttcatttgtttagatatttactatacactttgaggctgggtgcagcggctcatgcctgtcatcccagcactttgggaggccgaggtgggtggatcaccgaaggtcaggagtttgagaccagcctggccaacatggtgaaaccacgtctctactaaaaatataaaaattagctgggtgcggtggcgcatgcctgtaatcccagctactcgggaggctgacacaggagaatcgcttgaacctgggaggcagaggttgcagtgagcagagattgcaccactgcactccaccctgggcgacagagtgagactccttctcaaaaataaataaataaataaaaggctgggcatggtggctcacacctgtaatcccagcactttgggaggccgaggcggatggatcatgaggtcaggagttcaagactagcctggccaagatggtgaaactccgtctctactaaaagtaaaaaaaaaattagctgggtgcggtggcaggtgcctgtgatcccaggtactcaggaggctgaggcaggagaatcgcttgaactcaaagggcggaggttgcagtgagccaagatcgcgccactgcactccagcctgggtgacagagtgagactccatttcaataaataaattaaaaagaaaaaaaaacatacaaaaagatacttactgtacacttcagaaaacagtattttctaacatcggtttagcatttatttccctttaatttctatttatattattttctaaatgttcactcaggtgtaaaaaaataacttcaacaattaatagtttgacatgatgtcagctatttaagatactcaacatcatcctctgcttttcaccaccttcttgcatttgggggtgaagagttaaactacttttttttaatgctggaactctttttgaatcattattaaaataagactgggggaagagaggttatataaaggaaataaagagtctataatggaatttaggcttttgctgttacagctgagaagaactagagcttccaaggaaagcctgacctaagaataaggccaaatcttttgcttcgtatcaacacaacgctaccaaaatctggagttattttctgactttattctgaaagctaacttttagcttggctggactgtttttttcttttcttctctcatctttctctctctctcatctctctctctctctctctctctctccttttctttcttttttagagatgggctcttgctgttgttgcctgaagccccaaactcctgggctcaaggcatcctccttcctcagcctcctgagcagcttggacttgaggcctgtgctaccacacctggctaacgggcaggaatctttctaaacagactgaatttagagtgcttattgctcaagcagggataatttctacaaggtccagttcaggctgagatttttattttgtccctaatttcctgaaatcaaaacaagtggttttaatctaggatcgcacaggtagaaaacctagtggggtctctgggaactttatacctgttttctccttccctggtcctttctccatgcttttattgttaccagggagatgtcctggtttaatgtaagtgtcccttacaaaactttctaagaacttactcccagaaaatacaaaaaatgatgatagccaattaggcaagagagggggtaatttagtcttatactttctcagagggaatacaaattaatacagccttcctggagaggaatttggcaatgtttatcaaagttaaaaactgtgtactaggccgggtgcagtggctcacgcctgtaatcccagcactttgggaggctgaggcgggtcaatcactggaggtcaggagttcgagaccagcctggccaacatagtgaaaccctgtctctactaaaaatacaaaaaaaaattagccggacgtggtggcaggtgcctgtagtcccagctactcaggaggctgagacaggagaatcacttgaacccgggaggcggaggttgcagtgagctgagattgcgccactgcattccagcatgggtgacagagtgaaactctgtctctaaataaataaataaaactgtgtactccacttctgggaatttattcaaggaaagtcaactcttttcctagttctagccttctttctgtacattagattgatgggtcattaactgttcttagtatgtttctgtattttcataatagactataataaacatatatacctttgataataaaaaattaaaaatcatcagtaaatataaaatataccctgttagaaacaacttgcattcagaagtgcttagtgttaaatgtggggaccacctgcaacaaccagtttttggttttctttttaattcttgaaaactcagtatacattaactgtagttcttccaatgacctagggtttgggaatacaattttaaaagcccatggccactcttgtagctattactttcatgggatgacctaaacagagtttcagactatgacaatgatttcctctccttgtggcccatgtgctgttccttcacacttccacagacttccatgggatatatgagtcaatactaaggtgatagctctagttattccttccaaggacatctggaatccgattatctgatgagatattctattgctccattttacagcaggagaccttatcaaaattctcctagattacatgacagcagccctgggaacagaaggcaagtttaaaatagttttttttttttccaaaccacattcctttcttgaatctatttacagtactgtttcaagatgttttctgaagggtgcacaggggctacattgaaaaccttctggttattgtttgctaactgctgggatggttttaatcagagaagaagccaataatttcagcttgggtgttagaaaagctcctgaaatgtctccaaactgatttaggagaaactgcttaacagaagaggacttattcctgtcctgaaacaaactccttagcatggacatatgctgtaatcacagaccaagataaccacattttttgaacatattatactccaaaggcatcttagatttctaaatattatcagtatcagatgacaaaacctgttcaacaaggaccatagcctcaatatgctagttgacagcctccgccgttagaatgttcttggtgtttggtaagttctctaataggacctactttttattacactagtttttcttaaagaaattttttgaaaggggttttattttaatgactcaggtaaaattttctgaggtaaaagacctcacatcagtctcagcagacatctgccccttcccatgatcctgacttgaggcaagtgaagggagtccctttgttgtgaggccaatttagttctaggttccagaaaagcctgagtctctcagtagttcagatcaaaccagatgccccagatttaagcagaactaatccaaatgcccaaatcagtttcagaaagagctcaggttttaactagggtcaggtacatcttttctaggttaggtaggtgctcctatgcctcagctaagtacatagcactttggtcagccctatatttgcatgataaaagcttttttttctactttaaaaataattcctacatgatttatcatgtataaattcttaaaaccccacccaggacaaaccactatatcaaggatttccattgctgatctctctcaccctaatcctattgaatccaagtctctggggatagagccctggaagcctactttttttttttttttttttttttaaatgtaaatgcttttctcacgcctgtaatcccagcactttgggctttgggaagccagggtgggaggatcacttgagcccaggatttccagaccagcctgggcaacatggtgaaaccccatctctacaaaaaatacaaaaattacctgagtgtggtggcatgcacctgtagtcccagctacttgagaggctgaggtgggaggctcgcttgagtccaggagcttgaggctgcagtgagccatgactgcaccactgcactccagcctgggcaacagagcaacactccgaatttaataataacaacaaaaaagtgaatgcttttacaagtaccccttat

SEQ ID NO: 3357 - DNA, 12182 bp, Homo sapiens
acttttgaattctgttttatatcaagctataaaaacctggatcctgttcaacatacatacaaaagcagtactctaaaaaataattattattatattaacaatatcaaacacgctaactcctacacacgtacaaagaccttgggcatcctttataccggccacttcctggccacagctttgtaaggcagtacctgggaaaaggggacggacccaagagagccggccccaaatcctgactcagcactgcagaggcatcagccgggctgagtcatgcctgagtccgaagggccccctctcaggctgagaaggaactttcaggcccagggaggagcagagccttagggggagcacatgccgagcaggaaaacgagctcacattttcctggggtagagcgaggtgcccggcagggcaggggatgaacggagggtgcggtgggcagaataacggcctcccaaagatgtccacgtgacagtccccagagcctgtgactatgttaggttacacagccagtgggaactaaagttgcagatggaactaaggtggctaatcagctgacctgaaaatagaaagacgacctgggttctctgggtaggcgcaatgtgatcataagcgtccttaaaagcggtagagcaggccgggtacagtgactcatgcctataatcccagcactttaggaggctaaggctacaagatcccttgagcccaggagttccagacaagcctaggcaacagaatgagaccctgtatccacaaaaaatatgtagctgggcgtgggggattgtctcaggggactgagacaagaggatcacttgaaccaggaggtccaggctgcagtgagccttgatgccatgaccaggccactgcactccagcctgggcaacacagcaagaccctgtctcaaaaaaaaaaaaaaaaaagtggtggagggaggcaggagaggggaggcctcaatgaggtgacgggaaaaagattcaactacccacagctggctctgaagatggaggagcctgaagtcaagaattacggtcagcctctaaaaatgaaaaggccagaaatgaattctcccctagagcctccagaaggagtgcaggactgccgacacccagatttgagccccgggtcagccttctgacccgcagaactggaagacctcgttttgatccacgaagtttgtggaaacctgtcacggcaataggaaacaaatacagaggccaaagggtcaacagtgagaggtcaagcttgccctgcccctgcccagacctcagccagacttctgggtggcagggcccacggtggcacccccagggcctgtccctgccttggggaagggggagcctgagaggacccaggaggtcttgggcccttcggtagtagacaccaagccctcgggggaccaccctctagttgaggccttgggggatgaagagggagggctcagggccccattgcagggccagcctgtaggggccgtggggccacctggatgtgacgtctaatgctggcggtgctcacagctcgccacaggaccctaaaagcccctgccagacgagagctcatcttttccttctttctcttccagttctgtcttccattccaccattgctgaatcccgctcacggcggccctgggctgcagagggcagatgggtgaggctcggcccctgtctccagagagctgaagagggccctcggccccacccacgaggaggacagtcatgaggccgactgtggaggggctctggacagaggtgtccggggatccctgagcctggctgcactctccctcctggttctttccttgcgtgcacacgatcagctatcgtttacaaagagtccttggtgttgcctggttggctgcccaggatgggagctcctgcccccatcggacatgtaaacaaaccaaggtctgtccagttccagctgacagggcctgcacctccgccagggctaggcagaagtagcatcagagcacaggagacccgggaggaaccgagaaccagcgctgctcttaacagctcccagcggggtgtgcccaaggcttgctgggcactcacaggcaggtcaggccacaggaaaagctaaccaacctttataagggaaaataggggccgggagggctcctgcgcccccatgctgacgtccaagatgctccggatgcgcttgacctcactgttggataggttccccttgatggccaggatagcgctcaggtggcctttgctggcaaagagagcatcctgtcagcccagcctgtcacccacacccctactcaccagctccctgcactcccggccagtgccacagggcccgacagccaacgcccggcccacgagggggctgcacttcactctccctcacccatgccctccacctgatggtcccaagagcagccatgccccagcctgcttcaggcctccgcaccggctgttcccctgcaatgttcttcccaggccctgagatgaccgcctcttcccaccccttaggtctccgctaagatgtccacccccaaaaggctttcttgtctctaaagtcggcacctcctatcattcacaaccttggttaaaccctatttacaacttgtaattgtctgtttctttgcctgattatgtcattagtattgctggccctcaacagaatgagctacttaagggaggactgagacctggcttcccttgtacttcattgcatcctggtaactagaacagaggctgacacctagcagacttctccataattgttggtggcataggtagatggatggtgggtgggtgagcagatggatgagagctagatgggtggagggatgggagcatggatgagtgagtagatgcatgggtggatgggtgggtgggtgagtggttgagtggatggatagctaaatgggtggaggggtggatggatgagtagatgggtggatgggtgcttacatgggtaggtggatgaatagatggatggatagacgggtgggtgggtgggtgggtggatgggtagacaggtgatgagtgggtgagaagatagacggatagccagatgggtgaaggaatgggtggatgagcagatgggtgcttgtatggtgggtgaatgaatgaatgggtggaatggatcagacagggactggacttggcgaagctggggtcaaccctgtcaagacccattcaaacttaccctaacatgtcagaggacccagcccaggaagaaacaatgtccctggcccaccagaacttcaggcagccaagggctaagcctccactcccgaatatgagccctggtcccagagcataggcctaggccgcagaggccccccaggctgggtgaagctggcctctctggtctcagtctcccctgtgagaggcagtgtcaggtaaagctaagagtgtgggccatgcagccagacactaactagccgtgtcaccttggacacatcctgtgagctctccaggcctcctctgtgaaacgggaatgggaagtattgtcctcgtagtgctgtggtgaaggccacaagaatgagcccctggtgaggttcacacagtgactggcacgtgggcagctgccaggatctgggttcccaatgccagccctgtgaggccttggccacagtgatgtgacagtggtcctgaggtgccccaggttctcacctgaagtcagggtagcaggtggcataagtggccacctcaatcttgatggcactggggtcctgcaggcgaatgatctcggccagcgtagggagagcaggctgcagccaggtcgccggggagccctgcaggagtgggtgtggttggagggacccaggggtccagaggctcgggtcagcgactcgttgggcttagagaggcaccagcggcctatctccgaccctgaaagggctaggggagaagaggcagccatttcagaggggcttgggagaggtgggcagcggcttacgtgctgggtgcagaagtgctggatggtgtcagcattggccaggatgtacccagccagctgctgctgctgctcggccgtcttgaggaccaggcgccccttgctgagttggatgatgtactccttcaccaggtgcaggtgcaaggcctccatgagctcctgggagggcaagcagccaggggcgtgtgagctgtctgctgatggggagctcgccacctcccttgaagccttgtagccaggcctccagagagaggcagatgccagagcaaaagactgcacacgtgctcgtgcgtccacatgtgtgcgttcacatgctcatgcgttcacatgcgtgtgtgttcacatgtgcatgcgttcacgtgttcacatgtgtgtgtttacatgctcgtgccttcacgtgtgttcatatgtgtgcatgtgttcacatgctcgtgcattcacatgtgtgtgttcacatgctcgtgcgttcacatgttcgtgccttcacgtgtgttcacatgtgcacgtgttcacatgctcgtgcattcacgtgtgttcacatgtgcgcgtgtgagcacatgtgcgtgagtgtacacagacgtgctagtgtgcgtgtccgggctgcccccaactccccaagacccagccaccagcccagagcctcctcacctcccggaaacagccctgcagctctgagaactcaggcagcctcgtgtctacagtggcgatgatgttttccagggtctccacaggggccgcccagcgggtgtgcgtgaacctcttgaacagtggctgagacaggagaggcaggatgtctagtcacgccctggagaggaagggctgccagccgcagacacgcagacacgcagacacagacacacaccgacacatgtgcctggtggaggggcggggggcactcaaggactcccagggaacccgggccaacctcaggtccctgctcacagacaggaagtgggagccggctctgtgcacccttatccaaggtcacccagtgcggctcaggagccaggagagcctgtctgccggcccggaggccaagtccactgccacttaaataaataaattccttcataaacaagaccttgtgcttggctgggccagggagatcagtaccaggggatgtggggtcaccgctcgggcttccaccacactcaggccacccatggccgctagtccctgacaccgggaagagaacctctccccttccttttgagagaccccccactttacaccctgctaaaggaactacttgttttcacagcattttctgtggatttcttggcccataacagatataaccccagctgccgatgaccctgagcctcagttgctgggagtcaggcgcggggatgggggtggataggaggggctgaggggattgaaggaaaggtgtctgcaggcttgggactgggctgtgtctgaatcggggaggggcagtgaaacttttccaggccctcccagccccaggcggcccctctcaggtgaaaccccaggacatgatcggcggagttcagagcctgctagggtccccaaccgggcatcaccgctgcaccagagctggcccacggtgccgtccacaggcctggagcgtgtcttccccacatctttgcttctgccactcctccctgggggcacctcccagtccctccctgggaaccccccaacactgggctcctgagggcaagaggctcccgctaccttcaggtcctcatgcaggttctggagcagggtgtcaaagccgtggctcttgagctcacccagggggcccagcaggaggctcagggtgtcctggggtacctgccaattctgctccatggacatcctggaaggtggaggcagagaggtcaccccagccctgctcagcctatagccccatacccagggagccagacagccccctctcttcactctagaaccctcaatggctccccattctctatgggatcaagtcctcccatccatgttctccatgccctcaggacactcctccactacatccccttgtaactgggggcaagtgagcctcctccagtggtttgcccatctgcctaatagacagatcactatacctacttcacagggttgctttaaggataagataatgggtgaaacatctgcctgtgtgcttgccccagccagcacttgggaaatgtttgctgctgctgctgcaggccgtggagtcctcacacatgttgctggtttgaattccacttcttggcctaagcagctcctcctccctccaccttccagctcccctctcctgcccgctgagtgactcccactcccgcaagcccctcccaacactctcaccggaaggacaggcagttgttgatgttggcaataacattggccctgtaattcgtcagctgcttgcctctctccagaaattcattaaaggcgcgctggtagctggcgaaaccagaaggggcacattcaggaccagcccaaacactgggaccacagcagcagcctccctgccctccctgccagctcctggggttcacttttctgtttggctgcccatagccaagggaggggccgctagcccctgggcatcatggaactggcttcacaagctaaggcttgggctcctgaagagggtaccagcccatctctgctgctcccaggccctctctagagttgggagaccaggtaggagtgagcgtgtggttggctggagaagccctcagaggtcgagagggagagagcagagagaattcaggtggtggagactaggagtgttgtatgaaggggtggcggggtctcagtccctcctggggtatcctctttgaagctagaggctgctctgctgagagctttgctgatggggtgggcgcaagaggctcccacgttgaatcctggtggaggtcagaccacctgaggctctcagtgccctggctgagtgggaaacaactcctggctcagaatgacagggacaggggtagagggcggggatccagctcagctccccacctgaggcactagggaggggccgtggctctgagagcggtggctacagggaccccatcctgggcacacacccacctcctcaggaacgcaggcagctccaccagcagcacccgctttatctgtgagcccaagtccagcgtgatgctctcggccttggcctgggcctgggaggtgatctgcagggtggtggtgggtgagctgagcaggggctcgcctggacaagggggcaggggacggggaggaaacaggcgggaacagagggggtgccccgaggtgggcatgggtatgcacacaggacggaatgtgcgtggggctccccatgcacgtgcacgggcggtacgtgtgccctggggcagattgcagtacctggatgatgtcgatggccagctcgctgtggcagtggccgtccagcctctggggaggcacatcctcagcccagcgccgtgcctctagctccagagctcggtccatcaactccctcacattggcctggaggaggaggggcaggtcactggggcactatccctcacctcgctcacctggaagacccgtcaagctccctgcccatgtcctgtctgtctccgagcctctcctctgctgcctccctgcccctccctggcccaggtggagactcaccgcctcactggacaggaatgtggcctccagcagtcggatctgcctggggggcaggaggctcccgagccccataccctgcagctcacccaccagcttggggctgttgatgatgtcactgcaggcaggggaggctggcatgaggacaactataccaaatcagcaccaccactcaagctagagcccaggccctcagccttggtctctggcaggcccagactgcccagcacaccctcccgcacccccacccggtccccatttcagatgatgggtcctccatctacttagtttggtttggaacagaaactctgaagtcatcatgcctcctctgactctctcaccaccccccccccattaggtcctgctccaaaatagcccccaaaatcagcagcctcatgccactctggcgccctggccggctcccatcagctccccgctggctcactgcaaaagcctcctcccggcctctctgctccttccctcacctccaacaattccttcttcacccagcagccagagccacctttaagatctgatcttcttcctgctccaagactacctgtcacccagataaaaccctgctcctactcacagcagccctggaatccagccagctcccagcccactgcgctccagccctgcaggtcttgggcatctcaccagccccggccacctcccaatcccaggggtaggccagaatgggcaggaagggctgccccaaactgctccacagacgcatcttggctcactgtcctggcgcctctgcagcgccccagagctcccaggggactgcccagccctggcacttcctaagggccctttgtctgcctagaggtttacaaatgaccttctctctgcccctcacccaatccagatgcagctgtgtccctccgttccccacatttctggcacacaggcttcaacgatgcccccctgggcaccctctcaccagggctccatgcccagcttggctttagttgcctgttgctaaccccaggccagcagaccccgaggtcactgggacagaaagactggcaggcaggggtgcaggtgcccggcatttcctggtgagtcaggacgagcaagcgggaactggctctgggctgggttatctctcccgtggcccctgccctgtgccagttcccctatgccctgctgactcctctcccaccctctccactggaccctttctctatccttctgccagaggctgacccttcaacacgaactgagcccacaggccacccaaggcccccgagacggcagacactgcccacactgtctatacctccaggcttccttcctaaagtttcacactaggatctggggccagcagtggccaagccccacaataacagcccctggactcccccgccctgggcctttccacactgcagtaagcctctctccatgcagaccgtgcgaatgacgggcacgcccagggatctatggagtcaagggacgcctgaggctgtactcagcaggggtaccagctgcacagccagcctcccacctgaggggctccagctctgcggcgggctcacagggtaaccctacacaatgggggtctaacaagacacgtggccctagcccatcacttggaactctcctgcctgggggtgcccgcatagctctgctcagctccagagtgccctggaagaggacatgctcaggagcaccgaccttcctctcaccttctcccctacctgccctatcacccctcctcctgcctcctggcctgattccctggctcagagaaggaccgctggctttcacctcctccaggctggcttccctgacttctccaggcctgctttgggcccatgctctgcacggggcctggcctctgctgccacagcccttccagctctggatggttattgattgctttgccccctcctcagactgggcgctcgtgaatgaaatccctaccattttctgtgcctcagtttccccaacagcagaatgtgactgaggcccaggaaattaaggattccaagagcaacgcagacccagccccagccttatccctgtgtccaggcccagtctctgcctgtccaggctctgccccagggagtccaagtcccacccctgcattctcggacccaaaactctgcaaacaccgacctcactaaaagctgccggcggcacacctcgacacccctcgacacccctcctacagaggacaccctccctgccggcccgggcccagcccctggtctgctcacttggggtagaggttctgcacccagagcagcagcatgtaggtgtcgcgctcgcacagctcgaactgcgccacggcggccaggtgggccgcgaagtgctggtggtagctctcggcgtaggccgccacgacgccgaactcggcggggaacagcggcttcagccgctccaccacggcctccaggtcctccttcatggtgcggcccaagtgcagaaagacgctctcggggacctcggcgcccgcggccggccgctggcccatgcgctcctcggccgcctccgccacgccgcgccgccacagctgcagccagcgccgcgggcgcgtggccgccagccccgaggtccccggccccgccgccgccgcctggcggtcctcgcgctcctgctccgccaccacggccagcgcctggcgcagccgctcgggcggcgcctccagcggccgccgcagcacgcccagcacctggtcgcgcagcagctcgtacagcgcctccaccttgctctggcgccgcaccagctcctcctcgctcacaccgcccgccgccgccgccgccgccagctcccgctccagcgccagcagcggccgcgccgcctccagctgcccgcgctccagcgccgccttcagctcctccactgcgccgggaaagccgcgtcagccccggccccagcccaccgcccaccgggcggggcggccagcgccaagcgggaccgtcctcccctagacgcgcacagggccggcggccaacaccctaaagggtgatgtcggtgtccctgactaggctgaaggcctcccagccccccagattgcggcacaggtgaaagcagggagacagacgcgccttccagccccacttgccggcccactgtgcaagtggctcactcacgcggatgagcgccaaccccgtccaggccccagactagctctaacccagggtcctagagcacctgtggggggcgggccatccagcccctgcctggacccggctgcgtcctcgggctccgctgagctgggctgacccttcttcttcttccctttggtgaagacgcagaacacattggccaggcctttggacttcttcttcttctccttcttcttcttcgccgcctcttcctcctccctatatggggctgccccagcctccaggggtggcaccaggtcctcagaggaggcctccgacatggaggcctctgactctgcctctgatgtggactgcaacttttgggggcctctaggcaagtcgagggtgcctggcacaggctgatggctctagaggccttggaagaaggtcatcatcttcagcatcaccctggttcaggcctgcaggctctgtcccacctccaggcacagctcccgcaggacccccacagcatcaccgccttctcccctctgtgacacgaaacccagagcgcctgaaggtcctgctgcagccccctgggcctcgccccaggtctccgctctccgaggcagctggtgccatggaaagagaaacgctttcggtgtgggctcagcacacttctcactagtgtgtggactgcacacctccttccttcacaagccgccgtttccccgtctttgaaaaggggatgaggacccccaccccacagtgctgctgaggggatgtggccaaaccgcacagccaagtgctgggcgcctagctgggcctcagtgggggtgagtctcctgtgtcctgagtctgtcctgcaggcagcagcgagccggtgcagccagaaaggaagaaggggaggaggggcgttcctttgagccttgccgctggttgggcccactgaggcaggaaggggcctgctgggaggctcgtagaggggtcacagccagtggctcaacagcgccccccagcctcctgctgcccggcctctcctcaggtccactgacctggctcgccttccccgtcagggctgatgtccacacacctcccgggagctcgctgggcccggctccttcagtcctgggcaggatgtggaaggcgcacccatcccccgatgaggacacccgggcacgggcgaggaagtgactcggcctgtgtcgcccggccggggagtcacgccggacctggggcctttctgctgtaatggaggggagacccctgcgcctgccccagccccgccctccctgcctctggcaggcccgggccctcagccagccttggcccctctgcgcccggacgcgcggacgctgggcgcgccagggcctcagtttccctggaagcgtccagccccctcctgtccccgccgcggcgacaggctctttcctcggggaatccggcctggcctcggggtaggggcgggcgagaagccgcgcggagcggcggggaatggacgtgtggaagcggaggtcacttaccgtgtcccggcctggccgccactgtcctggcccgggttccgcaaggcctgaaatagtcgcagagtcagccccgccccgcccg

SEQ ID NO: 3358 - DNA, 1839 bp, Homo sapiens
ttttttggcttctagtacatgtttcttctctttttattccagtgccatcctcactgttagagttcactggcgaatctcaacgctccaccaaaatacaactgtatcaaggatcatcctttggtatcaccttaattggtttgtttcccttctgaccaaacatgtttccatgaggaaaaagaaaatcatgggaacctccatttgatctaaaagagaagaaacaaaatttgaggttgcacaaatagaaactcacagcatagaagtttctataggctctccctagccaaagttagactgttgacggctgctgtgagacctcagttcttgtcttcttagcttaaaataatttaaacaagagacacacagcaaaggagatagagtgtggaacaatttgctgcaaaggaaaaaaaatattttgaaatttaggcgcagggctgggagcagtggctcacgcctgtaatcccagcactttgggaggccaaggcgggcagatcacccgaggtcaggagttttgaggatttggacatctttaatggatatcaggggagagtgggtcatttttctgccttccacactgtattaccttgaaatgacagaagcttaacatacttaaggtttatttctctctcaccccaaacttattaaggttcacgtgttttctccttggtgcctcatgtccacgtcgtgactcaggaacctgggttcttttcatcatggggccatcatgtcaggactctccatttccaggaatattttagattttggagaaaaggcaaacaaatttatttaatgtatatacatggggagaaccaccgagagactgcccacccctcaagagcattcagaagcttacacaccttcctggtggagcaggttatgggaggggagggaagagcgattctgttgaggggattactagggagaatgagtggctcagggaacagagatgaacttgtacatttccttggaaaaggttctgttcaggtgtgattacactcttggacttacagagaggggaagaagaaacaattgttccttttggcatgtctagatcttaggcagataaaggtttgaggagagatgtcaggagtagggagatgccagagagacctcgaggcttcttcagttcagcgtttaaaagcaccacatttgggggtatctgcttctgactcctaacaaggccatgtgactaaaacagtcacctagagaatgaacgatgacagagatgagaagagagtcaaggttggggagatgacaggagccaatggtggacactgaagtggggtgcaactgctgataaactcaagagagaacacaggtaagaaactgttttcattcagattatacccatgtttatttcaaaaacagggacgaagagccttcttgtcgtcagtcacgggctgataggagtctacttttagctaggaacggccaacggaagataattgtgccattttaaatgccacataatgttcttaatcagcaaccaagtgtagaagggagtctgtaaagggcctgaggtcctgattcaatttcttcagcttcccaagcccgctcccaaagagcaggcaggccacccaaatcctgcagcttgtgaaaccggctctggccccagaagggatttatgagcgcttcacttcaaggaataccacccaggttggctggctgcaaatgcgggctgcctattagttctccttcatttcccaggaagtgtgagtgagagagctccccacctcccgataggcgacaatcccagcctcttgacatctctcgcgctgagcaaacttttcactggaggatcccagctgttcgccacctccccgcttgcttgccggcagtctg

SEQ ID NO: 3359 - DNA, 2449 bp, Homo sapiens
aacggtcaccgggattcctggaagagacggggatttgggggaaacggagagggttctgcgaggagacgggaccagtgagacaggcaggaccgggtggaggcgtctctacgagcaggagggcaaggaagatggggcaagacgcggggaggctgcagaggaggagcagggtggggtttggagagaatggagcctgcagaaaggagcggcagaaactggcgctggaaggctcaaaaaaggggccctggaaaggacggagcggggacaggaaagggaattccaaggggcaggaggagctgggcagaggagcccgtgtaaacacagagtggcccatgcccaggatgagggacaggtgcagctttcattctctacctcgctgctcccagtcctagggctcggactccccagcctttccgcagccgcatccacccaccatggcctcagggccgtgacgcgcgtggggagggatgcggctgggggctgagcagcggccatgagtgtggacgggggagggcggcattcccgtctggcagctctgtttgggtttctgacggggcctcttcaaacctccaggggctattctgggcctgtccgagttgggaattccccagagacctggaacttgctctccacagccacagccttggccccgccctgtatctgtgctgccgccagtaaggctgcccctggggagggcggagccagaacctcacagcctcacagggcagagcaaggctggattgacggacaccaggccgagaagaaacccttggggttggcggcagttcttagtgagggcaattcattcaatccagagccagaaacaggattttatttaaaatttattgtaatggggtccgcgcaaaaggaaggggtggagggtggggtacatgcaggggacacaggaacacgatgacatggccagggccacaacttcttctgtcgtggggaagagggatgaaaagacaagaccagggctggagctggggtggaagaggggagggggacactggctgcattcccccgcccccaggaagcacctctaggccctggacccctcgctcaccctggcccctaagactccatctcttctctgcctctggccctcctggctcttcctcctgctccccttgactttttcccctgacagattctcaagtaggacgatgttcagggcctgaccccaaccccccataccaccttatgaaggtacaacctttgccggccctgcttctgcccctcctcaaacctcaccgctttccctctttgggacagctctgatccccctccttcctctcctccctccccctggaaaaaaaaaaaaaaggaaaagaaagcaccaactccccggggaggggctgcagacagcagggggagaggactggaaggagagaagaggaccgtcgagggaagaggctcacaagtccctgggaagacagggcatgggcttacagagaggagagggggtacgggcagtggctgctcgtgtcctctgccacccctgcccactgtccaggggacttcaacacaaccgaggggacaggtttgtgtggggtcaggtctgacagaagaggagcaggagaaacaaatcgttaaaacctagcgaattcccctaagaaaacatttcttcctcctttccttctggaggctccttggttggtagggaaataggagttggtgggaaaagaggggggagaggagcttgtaccaagggactctactccattctcccctctcccccgcaaccaacttggagctcaccagggttgggagggaagtggctgagagctcacaggcaccccctccgcccccgagagggagcccacagctgtgggaggggctgctactgctgccgctgctgccgctgccgccgctgccgctgccgccgccattggacaaacctcaccagtacctgcacaggagaaacaccacggatcacagcgcgatctgaatgggtgcgtgctggtaaagcccggcccgtgtactccacctgccccaggagctggagacaagaccttgtggctgcgcagcggaaaccttgccttgtgacccctggaactggctttcttgactactccttccccagagcagccaagttccactcccgctttccccacacattaccaggaggttcaacctctctggcagatcatctcttccaaccaggacttcttagagtctaatgatgttcattcaggtgtccccccgctgctcccttgacctcttgtaggaatctagacgccacgagctcttggctacagcacccttaacccgtatccgtggcaaggcgtctggccaggcgcccaccctctgcccctggccctcccggcagccctcggcatgtacctttgttgcagagctcacagacatggtgaggaccctggctgtgcaccttcatgtggtccgaaatataagccgagctcagcatcttgccacacacgtgacatggcac

SEQ ID NO: 3360 - DNA, 8944 bp, Homo sapiens
acacggggccggccctgacggcgctcccgggagcagccggtgcgcggcggcggcacgaccccctgcgcctccgaggcagacgagcccatcgggagaaggcgaggcagggaagtgcctgtgcgtgtggaaaagggggtctgtggggcggatgcgagtgcgcgcgtgctcgcggaccagcgagggagagtagagcagtaccgcactctgcgcgggggcccctcttctgccccgtgtccccctctcctccctccgcgggcaaacaggcacgcacctgcctgcacagaacctcagcctctgcccgcgcccgtcgcccctcgtcacttgttccccaggatcctgtaaggcacccgcatccttcccggccacccagctcccttcccctgtcactcactgtcgccttgaacccaaagtgcagcaggcggtccctgctcggagccattttcctcctcttctggatgtgtctagattggggcagtgcggctgccgccgcgcctccgcggttgccgccgccgccgcctcccccgcctcccccgccccagtgcattacattacggggtgctgcagggaggcctggggggccggggccggacgcttgtctccctgtgcatggctcgggagggcgagggtggttgcgctgagcaacaggccaagtgcccgccctggtccggggatggctgcggagctgcacctgaggccgggggtcgggggtgcagggctggagccgggcaacccttcctttggccggggtcggggcgcgcgtccgtgggggtggggcgggcgagaccgaagagcctttggttttccttgctcggccgccgccggcgcccaatgggctgcagcgcctgcctgtccgccaatcagggcgctgtttggtgagagcttcggcctgacgtcactttggcgggagaaacaagcgtgtgtgagcgagtaggcgggggcgttttcccgatggaaacacttcatcagactcccgggctccttgtatagaagctgatctgtgtcatcatattatattatgttttaacaactctggccttcaaggtctcagaatttatgaccgaatttccacgaaggaataacacaggattttgtagttttgttgccccttctatgagcaacaaactacaaaattatgtcctaagagtgaactattagaaactgtataataaattccagcacacctggcaggagcagcagcactgctaattgtatgcttccaaagcagttatgagttggtcttcctcacaccccttttaattagtggttttagcgactgacttgttatgcgtctaagaaattaacaagagcaacaagtgcggcagatctttaagaacaggtatattttagctggaggacatattacccaactcttaaagcactgtacaaactttttctttttttttttttttttttttttgagacagaggttcaactctgtcgcttaggctggagtgcagtggcacgatctcggtttactgcaacctctgcctcccgggttcaagcctcccaagtagctgggattacaggcgcgccgcgccgcacctggctaagtagagacgaggtttcgccatgttggccaggctggtcaggaacacctgactacaagtgatccgcccgcctcggcctcccagagtgctgggatcttttttcttttgtagagacggggtctccctatgttgcccagactagtctgcaattcctgggcccaagtgatcctccagcctcctcccagtgctgagattacaggcctcatgtgagccaccacgaccagcgcgccaccccccggctttttttaatcctagagggggcttcctaaaaccagggacctagcttcagaaactcattctcaggcccacaaacccaggtctgtcttctcctcctgtcccaggtacttttaatgtttttgcttgacttcagccagtggaataaaaaagccttttcattctgtctcatctaagagctgttttctcccagcaaaaactgatgcatttggtgagtaacaatggcaaagggatggccgggcgcggtggctcacgcctgtaatcccagcactttgggaggccaaggcgggcggatcataaggtcaggagattgagaccatcctggccaacatggtgaaaccccgtctctgctaaaaatacaaaaattagctgggcgtggtggtgggcgcctctaatcccagctactcgggaggctgaggcagaattgcttgaacccgggaggcggaggttgtagtgagccaagattgtgccactgcactccagcctgggcgacacagcgagactccatctcgaaaaaaaaaaaaatggcaaagggtagaaaaactggcctacagagtaatagaatgaagacaagtttcacagctccgtcagttaccagttgacccatttcaagtagtactcagggaagacatttactgttgactgactctttaaaattgactggagttttgaacaaatgaaaaaagtattcaaaggctaaaattttattacacacaggcaaattactttttatcaaagaagtttatttgcatgtaaataaacaggttattttgtaatgtttcgggaaaaaaatcccacaacagatttcatctactttcaaaaaaatgaaaaaccccaaagtatttacaaaacggccatatgcacagaaaaccaaatttgaaagatttttttaaaaaaagaccctccccagctgctcctgatgtacatttttaaactcaaaatttaaagctcagttcttatagctgagcatgtttcccaatctagcttctgagatgttaagtacttcctgcccctccaaaactaactcaaggatagaaatgtatggggggcaggggaggaggggagaaggaaaaaaaaatgagattgcccaaggattgtgaataatgtttcgtatactgacatctttaagtgactcaactgtggatactgtatgactcactggctccctgaaagggcttctgagaattcatgatattgctgcacttaattttctgatctaggcctgaagaaagaaaatctttcaagagtcaccaacctcaagcctggttttggcaattatatcctgcgttgtttgtccccaccaccccaccccccacccgctaaaatacttctgttttaagacacattgatattgaacctgaaatctttatgtacatcagagcaggttatgaccaagaacccctaatgttaagtcaaaagacagaagaggaatcaggtcaaactgagaatacataagacaccagcagcagaagataggtagaagttgacttcatgtccttgccttcttttgaaacagaagaatgagtacacctagacaggagggaggtgtcccaggcttggtttattctgcctcttctcctccaccctgtggagaaatgcagtgctccctggttctcaggcagggtgaagcagtttagccccggctccctgttaagcaagttcagatgctgggtcagtgtgggggtgagcccatcgacaattcaggggcttatccttcatccagatcctaactcgggattctttgatctgggatgaagacagaaagagagaaaagcttcccagtttactcattttggtatttgttggccctgcatgggggagctgagcccatgatactattcagtacattccccctaagattctccccactcagaacaaattttaaaaaccacataaatttttttttttttcctgcagaaaccaacgggataggattcaaaactaggtgacaaactcatgagaaatccaacctggctgaatgtctgagaggctgctactgtatcaacatcacaagataaagcactctggtatcacctgcccatatcctccttagtgtcacccaagacatttgactctgatgtggttaattgataacttttcttgctccactttacaatgttttgtttcctacatcttattaccttgggacacaaaagtggcagagttgttgagagctgatgacaataaaaaggagaacactagaggaaatgagacaggaaagaaagccaaagctgattttccaactctatgctgactccaacctgcagaaaaagctgaatatagaaatcttcttccatatatgatgaagtcactccacttacgacataacacacaaaggaatcacctggctttttttttttaacccagaagagttgtgctggggaccatgccccatcccgctgatacagatcctgaatggaataatcaggaatggcacagtgcaggtgtcaatatcaaagtaaggccgcagaatttttgagaggaccctccaaatactgagaacttctgttgcactcgaaacagtctcctggatttctatatttttatgtgaagggctcttattgatgtcccccagaatccagactcagacctatttctccaaaaaggtccaattgggttgctacatagtagcaagggtttatcttcatgctcacctagcattccaggcccccattacttcaaaagtgagcttgaaattgttttaagtgaactatggctgcggattttttactgttttatctcagggagcatacagtggagtgattaaagtttggactccttctccttgtgatgaagagaaacagtgagtccagctcttaggaatggcatcagttctcctgcaaacaaaatgctgggatgcagacttttggcacattgtggaagtaggagaactattaatcctgtaatggttttcatgccactgggtcaggaaggctgtcctacactaaaccttactgcatctgaaaacatgtttacatcccaacaagccaccttagcttttttttttttttttgaaaggaaaatgagattacaagtcaatacctccacagagaggtaactcctaatattcctatgatctctgaaccctatttaaaccctcctaaaataaaaatatcattttggtttttctattatatttaactctaaaggcgggctctgactaatttgcttgggcttgatgctacagtattagcacaagctataagctccctaccaccatataagccttgctcttcggccttccatcattttgaaccctaaacctcatagatttagaacgaaacactgtataaaaacaaacagataaagggttaaaatattacaaataaatagctaaaataatcttccctcccccagtcactcctaagaaacagacaccaaacattacttaagtgtccaaaatgaccaaagtccttcatttgcccatgactcaaacggacaactacctcaaacaaagttgaacaaccttcatgcaaatgcatcaaggaatgtattgctttttcattttctgcccagcccttcatatacatgcactaaaatgagtttaaaacatggcctaaaaatggaaaaagggagaagaaaatatatatgaatatttcccacaaaactgtttccctcccttccctctccctacacccctcccacccccctccctttcttaagcaagtattttaactttctttctggcacaggaacaaagaagacttcctggtaaccagaatcaaaccctgtggtttctttaatagggtctggatatgcctttctaattcacccagcttgatgtcaaagccatgccatttaggattcttaaccaaatcagacctgtctgactcaccccttatggtggtttgcctataaacttatcaatagttttttttcctctggccctgtttcttttaggaaataaggttcctaattcccaatcagggccacatccataagatcatcatcttcctccccaatcataaagtctgggctgagccttgagggtctgtctgcagataagattgtgttacttgtcatagacaaggactggtctgaagagatgggtgatttggaccaactctctggcttgatgctatgagattttttcttgtctcggtctttgtcccggtctcggtccctatctttgtcttttactttcttcttttcctttttgtgcttcttatgtttctctgtgctgtattctggaagtggtcggataccatcgtctgagctgggactattctgataagatttctctgctatggaggagcctgactcactttcactgtccagattctggggggtatatgctggtgacttactatggctgggagagccacgctcatgctttggagtggaaccactgatgagtggagagccatagtttttagaagaagccatttgaggcctaagcccttctccactactttccccaggtttctgcaaagtcactttggctttaatgctaggggagcctccatcatgcttactgatgataatttttgccacacctgtgctccccacattttttgactctgaggtcttcttagaagaatccactgaactcccggaggtggaaacctttgatttgtctttatcacttttctcacgcttgccctgaaactctcctcctgacatgttatgtttggaggacataggatggctggaagaatttgtgctcacccccatctggccgtccagtgggtcttcacccccagggccactggtgacaaccccatgcttcagtttatctatgacagctgtcaaggacggcttcttgtttctgctgggagattttcctttagaactcccatgctggttctgagaggatgacatggaagagccacttgaggaaaaggaggaggaagatgccgtacaggaattagatgatgggggagttttctgggacaacgagcctgaggatcctaaccctgaagatgacttcatgccagagcttgaactagttccagacatatgagaaccaccagaacctgaactgataggggacttggctttagaggatggaggagttccaggaacaggcttcattggagaggcaagcttgtcagagcctccaggtggccttgaatgagaaggggatatgtttggtttacttaaagaaggattcataagtgatgatggctttccttgaggtttcatcttggtgctgctagagccactgctcagtccatgcttggttatgggagaggagcctggcttccccccagactgggatgaatttttggactggctagatccagaagacccctggctagaatacatactgctacttaacttggaacttgatgaaccttctgatttactgcttttcatcttccctgaggtggaagcagatgaggaagaggaggaagaatggctatggtggcttttgctgcctgaggaagacacagaaccactgctggtatactgactgtgagaggaaggcttgcccaccatcactgttcccttaggaatctgaatagtgattttgggaatgggtggtgtggcaacacctgggggagtctgagatcttcctgcactgcctggcgatttagatccacctgtactggtaggtggggtaaaaggtctgttagaagaactatgagatggagactttccctcagtgtctgccttcttccgctttggaggcttatctttgcttttcccatcattagaaggggtccgactgcgcttccctggtttgctgtctaatccgggccccgagagagtactattactggtgccattgccttcctttaccctcttttgagtcttttctttccctaagtccccagtggtcagtaaaggaccctgactaccactgtgatgctccataagatctgcaggagctaaagctttgccggctactgaaataatactgaaatcaactgtgtcggcttggttattgcccttaaacttggtctccccattatcacctccaagcattggcacccccaaagtatttagtgcctgagatgcaaatcctttgaaatcatcattatccccactttggctgctttcatcaaaatattcttctccaaaaccactttggctctggctgttcaataaatcaggattgaaatctactccatcatgaaaaaaatgattggtaggagagtcactactggggcttccagcagcatctgcaataagatcagctggatcagtgtatggattttcattattgttagtttgaaagacatcagagtcaaacagggtactctgagaatgcccagagcttgaagaatctcgaagaggggtgccaatggctgggcaatcatcactagtgctgggaagtttagaagcttcttctgcaatgtctgaaaggatgtcagttacatctgggccaatgctgtctgaactggatagtcggaccatcctttgaatactgggttgggggtgaggtactggttgtgggtaagttgttgggggagtgctacactggcttggagctggagtgatgtgtggcgtatccagcgtgtcagctgtcatgttgacatcaaagatagggttctgtgagtcaacatccattgaaaatagctccctctgaaagtcatcttcagtctggtgctttggtttctcaggtggtaatcttgatgacttctttttcttggtcttgttgctccccgagcatatttccatgcggggtgagccggaagaggagttctgcctttctaaagggctgcttccataaagggttgagaaatcctgggcaggattatctttaagaaggttcatgagcatcgggtggttcttggtgttgccggccatcgaagagacaggtggcggcgtgtgatgaggaggggtcggactcgagccaatggtagaccccccgttccctgtgatttgcaacaaactggtaagaattgggttctgagacaccttgctgaagtcctccccatggcccaccgactcatgccgatctttgatgctcatgctcatattaaacaaggtggtaatgggaccccccggaaaggtgttggttggtgtagtggtaccactcattgggttgttgcctgtggtcatgccataccctgggctgctagccgggggcaggttctttttcaccatgtcttcaactgtctctgcaatgagggacagtgctggggtgtcggcttgaatggtttcagctttcctccgaatagccctcatcgtcacagggatggacatacatctgc

SEQ ID NO: 3361 - DNA, 2683 bp, Homo sapiens
gaaagggtacattcgccagcagttttgccacgagagtacaccgaacaaagagacagggtcatttgtaacctgatgcgtccaccctactgctgtgtccggtttccattggctggaacgggacctcatattctgtatttgtcctgattgggaagcaacttaaaactttttaaaagaggcgaaggcagaagagaacaaaggaaggagaaagtaacttgtggaatggtgagaaaggcatgaggcgaattctcagccatgacaaggctgaaggccagcaggaacaggctctagcgaaatgggtgctgtgtccccttcctgcatgtggcagaaagttgcaaaggtatgagagaggagacaaacggaaaccattctcccttatctccagctccaaatttcccctcccactcttactggtttcttaggtgttgttctagagcctttattttctacagggcgtttgggctggggaagggtcctgtacactcgcaacaggaggtgtagaatgagccctgcattgaatgtgtaagcatccaaagctgtcactgaggtgagaagagccttcattggcagcctcaaagagaaaggtgtgcttggatgtatgcactggacatgccacctaggcctactggacatgccgcctaggcctgctggacagactgcacaactgaggccctgcaactggcaatctcccaatggctttctcacctctcagcatttttccctatttgttttctacgtggactccagaagagttctaacaagccaagctataaagcatggctttaaaagaaaaacaactgtaaggtaaaatccagcttaagtgacgtaaatttacaagcaaatcagattctggaacctcacctttacaaatcttgcaaatcaacgtgcagggaatgtgtttgtttctacatcagaggcacaactgggcatcatacagcctagaagctaatagagcacatggacaaggaacagagcctttagctcttccaaccctcttattttctctctttttttttttttttttagacagtcttgctctgttgctcacgctggagtgcaatggcgcaatcttggctcactgcaacctcgcctcccagattcaagcaattctcttgcctcagcctcccaagtagctgggattacaagcgtgtgctgccacgcctggctaatttttgtatttttagtagagatggggtttcaccatgttggtcaggctggtctcaaactcctgacttccatgatccgcctgccccagcctcccaaagtgctgggattacaggcgtgagccaccatgcccggcccttgttttctcttactgtcttgagctgacatggggataactgacttttaagtgtcactgggcagcagcttcccagcagatggcaagttgccaagaaatgctattaatgtttgactccattctccagttctccataaaaattgactttactaattacaaaaaaaattttattattacaaaacatacaatctcacaaaggtacaatttgaaatacggggacacccttctaactaccacccaggtgaagaaacagaactttgtcaggcaccccagaacccctccaagtgcctcatcacaatgacaactccttccctctagaagtagccattattcttgtatagtactgactgtgtttctttatggttttatcttattttttagagacagggtcttgttctgtcacacaagaacaagtggacaggtggagtgcagtggtgttcatagctcactgcaatcttgagctcctgggctcaggtgatcttcctgtcttagcctcccaaggtgctgggattataggcgtgtgtcattgcacttgaactagttttattttttttttgagatggggtctcgctctgtcacccaggtgttgcccaggcttgagtgcagtggcgcgatctcagctcactgcaacctccgcctcccaggttcacgcaattctcctgcctcggcctcccgagtagctgggattacaggtgcccgccaccatgcctggctaattttttgtatttttagtagagacggggtttcaccatgttggccaggctggtctcaaactcctgacctcaagtgatccgcccgcctcggcctcccaaagtgctgggattacagatgtgaggcaccgtccaccgtgcccagccgagttttattcttgaatcgtgcatgtctctgttcactacagtttagtgcaccatttaaataaatttgttgtcttttaagttcatcaaaaatatttcttttgaagcactataataatgctggtgatggaactcgccaccattattccctgggagcttctggcagattctgtcagttggaatctctaattcttttctcagtggacctttttacttgactcccacagttctttaagtagcttctttttttccagggtttcctttgctctttttttcctttcttgttttttcttcgccgcttctcgtttttctttgtgaacaggactgttttcaccattgtagaaaacatctactttctcttgtaggattttccgagctagctttctgttctgatcaactgatcttgtctgatggcactgtaagagataatattttataatgtgaaaaccacaggatgttaaaaatggacaggacctcagaagtcattaaattcaacctgttcgcttttttatttactatttatttatttatt

SEQ ID NO: 3362 - DNA, 1988 bp, Homo sapiens
aagtttcaagataacttgggattcctgacctgtcagaatgtgacattcttttcttcccacagatcagtaaccctgtacagggactgtgttcacaggatataaggcaaaaaaaatccatcttctcataagagctttagagactcttaggcttctttactaggacagctgagctctaaagcatgtgaacttcacccaccacaactgtttgctccatctcaagctcagaaccctgccctgtctgcctaaccacaagtgagtatttcctgccttgatttcctgacatttctatatttaattcagcttgttaagttccaagaaatcccctggcaatttttattattgacctcttcttctttgcacaggtatccaacccagtatctacaaataaatgcttcactcatctactcctttcatgaaacattgcaaatctttttcttactagtgcttgggcttgctttttttttctttgcaaggaaacatatagatgagcctcaagagatttagaaatcttttcagagtaaccagctgaatgtcagaaagtcatatttggaggccaatctagttagattagataaatagtttttaattttaacaaactgtcttccttttctaactggacctctgatctcacagaagccaacaaagtatttgcagtttataggatctaattttaaaatatgtgaagagtaggcacatctggaaggcagggcatctagatctttgaaaatcaaaaatcccgaatttcacattgaatctgaggtctctaaaagaagggacatgccacaagaccaagccacacaatttttccacactgcacaatgctgtagaaacatgtcttcaaggctagtagcacagcaacaatcagcccacttttaatcagaccatccccaaaggaaatcatattcattggtggtgttttcacagcctttaaactgtgtccaaactgcacctttctcatctaaacttgcaaagaaacaaggagccccctgcaatcacaaccatttattgcaacggctctcagccatctccaaactgcagccctcaccagtgacccagcagccgttgcactcacaaaggacgtgtctctcacagtacaaagtaatgcctggtactcacaaaaccaaagcaatcagccaagatgaaataaaagagagcagagctgcagacctggaggagcctgtccctgactctggactccacaaggagaacaggagacccccaaaaggggttccgccgagcccgtcccttggcggtggtgtcactggatgctgggaagagatggtgggaagagcctccatccattggcgcgtcactaattagacaaggaggccttgggctcccttgagagagtcacggtttctcctccgttgacccgcccttcattgaactcctttacttggatattcagagcgctggacagagatcacttggcgctaacaccctcggaggtcctcacggcgctccgtcggaatgacacagtcggattcccaagctgcgaagggtgagggagggactgcagcgcaggaactgaggaggagaggcccgcgcgcccactggagccgagcggtgaggaataaccggaccgacccccgacggtgcgtgacaggctagagcagcggcgctatcatagctcactgcagcctcgaactggtgaactggagggatcttcccaaccatcttttgtcttttttaagaagaaaaatacaaaagcttttatataggcttacacacagctacagagcaaatctttatcgtatatccaagattatcaaccacttgactgtacaaccaggaatcataacacatttgagaacaaccagtggcaaaataggaaaatgggccaatgaagaagataggtgactaataaataaaaatctgatatcaagtgtaggcaagttgtagggaaaatgggtgatgaacgaatagaacaaatgcctggggtaaacatcattcgaaagcccagaaagaagcttttagacatctttatt

SEQ ID NO: 3363 - DNA, 1751 bp, Homo sapiens
cagcagggttgggggctggccagctgctcgtccgccctaggtagcttgctcatctgtaaagtgggtggggcaggagttcccacctcatggggtcctggcaagcctgcagtatccccgagtggcaccagcctgcttctggggcagagcagtttgtgccccctgaggtaccactgatcctctttccctgctattaggtattgctctcttcctccggtgtttgccttttcagattatagaagtaatatgtgttcccatatttggcgtctctcaggagctcaggaagtacttggctgagtgaacatgtccattgtggaaaaatggcaacaatatggattccatgggtatattttatagaagaatatgaagaaaagcagctacccctaaacccattgcacaagctgttcatgttaattctgtacccgacgctttccccacggggcctcccctcactctgaaatggcatccaggtccatcttgccctccacctctgcatggctctccatgccccatcgcctctcccagatcctagcactgggtccacactctcgccctgtccatttaggttgatgaaagcaggcagtcacccgggtgggccagtcttgcctgtgggaggaacatgcagtctcctgtctcatggtttgaagtgtgccaggaagcctggcccagcccacctccccctggagtccttcccaggaggaataaccccttaggtcattgactataagatgagttcgctcactggatccttcctctctgatgagacaggaagaaggtacacagtgaccagaatggctgagctttcatggaaaggaagctggacccaagcaacagccgactaccgaaggttgcctggagcagtgcagatgtgggaggaagaagggccttggtgcacactggcttttcttcctgactgcaatgtggcattgtgccagctacctcctctttctcggcctcaggaaaatggagagaaagcagccctgaaggtggctgtgacgagggaaggggcagagggcctgacagtcaaccacgcgctatattttcctgttcttccttagggcaagaactgcatggccagactcaggcaaggcctaggtgtgggctgggcattgcctacacgtgaagagatcactccgcgtccctactgcacctgtcacaaagtgccttctgatatgcctggcaaaccaaaatcggtgagcgccagcttgcttccctagaagacatttctaaatattcataacatgcttgctcaaatcaatcaccttattttacatccgctccagggagaaatgaagacatggtcctacgttgttctgtaattattttctatgtaaattttgttccttgttacaattatatatgtcttaggggaaaggaccatttcacatgtgtcacctcatgtgattctcaccacagccctgtgattgctcctgttttataaataatgacatagttccagttgatggccaaagccacagctaacgagaggcagagagagctcaggctcccaggagcttccactctcagaccttgcctcccgggctgccctgagtgaaacgcctgcttagcatttggcacagccagaagcagcaagctagggtcacaacacagagaggggctgtgtaatactggctgcctctgtgctaagaaaaaaaaaaaatcactgtgtgtttgtttattttggtgcaggcccagtgttcttgcttagacttaatactacccttcatgttaaaataaaaccaaacaaaaaccca

SEQ ID NO: 3364 - DNA, 1082 bp, Homo sapiens
catgacttccggttcccgcgcggcgctccaaagctcggggagtggtggtctccctttcctggagtcatttgtgggagttagggtcttatcctgatctttcctcgtcccccgctcccccgtcctccgaggtggcagctgcgtagaagtctggaacgttttttcttagagttccagaattgagactgaagtgtacccagagacacaaagaaatacagaagtccagaatgatcaaatgagatcactacccaatgaaatgatgggccgaggagccagaagttgtcctactacctgctttccaggtccagattccacgagagccttctgggctcccaccagagaccctcagtgaagactctgttgaagactttaagaccatgctagaaagcctcccggcagaggttcaggaagttctgctatgaggatgcagctggccccagggatgtcctcaggcatctctaggaccttgctggacggtggtggctgagacctgatatccacacaaaggagcagactgtggaaatgctggtgcaggagcaattccaggctgtcctgcccgaggagctcagagctcaagcacagagatgtcagcctggaatcagaatcactggctaagtcttgctgcttgcttcttgctcagcctgcatatgagaagtcaaccaagcattctcttggatgcaagatccaactgcacccatgggaaatctgaacttccactttctttgagcttgtctttggttgtaataagaatccatcaaaacccatgtctggatctctctttggctgaggcagctttatttcctacagaaagagtttctctgtcctcttgttaggacaatcagcctgctgctttgggcttttccaagagcctatttttcatctgctggatgcctctttttttttttttttttttttttgcactgtgtgacatgctttaatatatatattttttatgtatccaaagaggtaatcaactttaactttcagaattcatgaatcttggtttggtggcatgaatgaaaggttatgtaaccccaccagtaactcatttggggtgcccttgaaatattaaagtttggtcctca

SEQ ID NO: 3365 - DNA, 1838 bp, Homo sapiens
atgaggaggaggaagcctgaacagaaattcctgaaagggctaagagagactccccaacacagccaagcctttccaaaagccaggaggaggagagaggactccgactccggccacaggcccagggcaacgtgctgggccccggagcgtcctgctccctggggccccagggtaggtgcggcccagctcaccccagctcacggtcacaggctcacatgcagctctcacacagcagcagccaaggcccaggcaggaaccacaggcagggcctggggaacatctctgccccctcccaggccccgtctgtactcgcctagctaaaaagagccactctcgtcattagcagtgtaaaaacgacaccttccctctcagtttggatctggcctggcacacagggtcactgctgagtcacctgtgacttgggggtagggaccagggagggtggacacagttgagtcagaggcaggtctgtgggcagcaatgtctgcctctcccccaaagggagtgagggctgccctccagggacaacctgggcagggagagaagggcccagacctgccaggccaccaggagcactctctacctggggagtagctaggcaaaggacaaatgcatctggcctgtctgtgctgcagagcggggcaaggccaccaaagcatcaaagggaaatggccccaaaaccggctctctctagaggaaagccgaccagcaagctggggttgaagtgtgctgttctcgcctcctgtgcaacagcaactggcaaagcccactctatgggcccagatgagccggcagcatgagaaggctgtgagatttctgatgcacagatgtagaagctctgaggggctctgagaaacttgaaccaaaacacaaaaggggcgtgtgtgacggtggtgtctgcactccctggcgtggtctgcaggagacagaagcaccctgggtctgctgatgccagggttctctcagaccctacttcagcaactggagaggcgtggacatttaaaccttttaggaggccctcaggcctctctgctccacacggaagtcagcagccctctctgctctggctggcttctccaaggcacctcctggccccacctagggctcggggcaggactctctcgtgcagtgagccagcggggtactaactgggctcacttctgacagtaccgctcccagcatgcgctcggcttccagccccagagaccaacactgctaagtaggataagggatccggagccctcgatggcaccctccactcggcagcctgctcccgcaccactccaacccctcccgctcctcaccacgcaaacctgcctgccaacacagcaggggccacagaaagctgccaccagagccaccacagggatatgtaatgggcccagccaggcctaagggcccatcacagggagacgcaagaaagggagcaggtgacagaagcacggcggctccctccacaaagctgcggcccccgcagggctccctccctggtgaagagttccaggaccacagcgggaggggcataaagagccaaacacacccggtcccctcggccacagcaggaccagcacacagttggggcagggcgggcgcatggttcggactgatgctaggaaaaactggtgacaccaggtctgtccactagtctgggcgggactgggttgacgtgcatggagctgggtccccacggcaacgagggcacacggaggcctccacggagcacagagagcaagcaaagcgaccctgaattcctttgtgtttgttactggttttgttctttgtgtggttgggtgttttttttcttcttttcttttaaataaaaatgctgcaaggtttccgcc

SEQ ID NO: 3366 - DNA, 2728 bp, Homo sapiens
gcctgaaccagttaaagcagccgccatcttaaaatgcgggatagaagttagagcaagaaaatgagactaaaccaccggaggtggaggttccgctcactcccagagctccgaaaaatcctagttttttttcaacttaaatcgataatatactatcaaaccacatttcaagtaacgaaacaagggtgttattaaatagaatgaggcaaaaataggtacattagctttcccttactgccatcgcaccccttatccacccccactctccagccaaaaggaaaagggagcttccagaatgccttttacatcagttcccggtgtccctcggataaatagcttcgggtgaaaagctgcaactacaaaatacaggaagtggcaacactgtgtcattccatctcctcccaaacccacttattcggtgtaacctgcccagagtcgactaagagtttctactagactcactgactgaccttcaatacgcaagacttcttctacccgaccctcagtcaagttcgggactcgccagattttttttctctcctccgagttttctttcttacccctagaaggcctagataaccttgatctcacaactaaactaagttttcaagcaccaagaataggaagcgccatgacatctgctggagcgtctctccgcaattcggacccccaaaaaaactccttcttaagcagcaaaaaaataaaataataaaggcgccttaagtcactctcctccacccctaatttgcaccgattccactgaagcactcaggataacacctcacttgccacaagtgttctccgtttcctagctttaaacttcatttcttcaagaagtatatctgcgttctccatccccccatggaagaagtgatccaagaggtattttcagaattatgcttccttcccacccccacgctttcctcttggcccgagccttccttttctcctaccaccccatgcccttgtccccgcgggttaccttattaatccgtttcagcgccatagtgtgtgcttgtcgtctggctcctcactctctcggtgtatgctcaaaggtccggccaaaactcttgattatcccggcggcggggcaggattgtctcgtctcacaccagctctgccagacacaggcgccttttgcaaaaacggagcagatcagcactcgcacaggccccgaagagcccctgatgaatccaggtcccttaagacagccgcgatccggggtgggtggggtggcgtggcaaagccaccaacagcctctgtaccgtgctttcggcccgaagtgggggcgagggtgacgggaagagcggaggtggtggctacaagtttaacttcccggcctctagaaaggaagagacccgggtgggagaggaagaggcgtaggagaaaggggtgggtgcggggcagggtccggagcccagcagaggaggagccggggcctagtcggcgctataccggcgtcactagggcaaagaaaggcaaggggggagggggaagcataagactccggacggacgccgggctgctttcggtttctgtccaaaggtgcggccgggaaaaggaaggaaataaaggaagggagacttgatgtgtattgctatcctcgcagcgagctattctgtgtcacccctgacgccaccgtacactcactccgccttccagcgcgctcccgcgcgcgcccgcccagccacctccaccacgcgcccgcgctgtccctgaggctccggcttaggcgcgaggacgcgcccattccccctcctcctccagcaggagaggccgcggcttccccaaccttcccaccctaacccaccgcacccaataggctggccgctcaagccgcccaggtcccgcactgcccctcttacccggccggccactgggccggcctcccttccctgccctagccgtccacacccacgcgtacagaggggccggggcctccctcaagctgcggcctcggcctcctccccgcgcggcagctggtgcctccccggccctacggggctcacgcgcacgacacagccacaagatgtccgctctgacggaactactgccagctgccacgctccgcccctccccctcctcctgcctcttcaccgccgcggatcagtccgccaacgccgccgtcccgagcacaagaccgatgtgaggccgaagccagacggcttgcttcccacgtccggggccgagtgaatacgtgtcaagcccttttccttcttctcggaacagcaccttcttactaaacagatcggagattggaccaggagggcgggggagggaggaggatcatgagctggggggagggtgaacgagtggcggaaacccttaggctcagagaagcatcgagaaccggaaggagaccatgggaggaaggtaaaggaagcagccgctgcgcgatccagccccacgcccctccccacagcgtcccccagtttcctcacttggtatcgaggagacgactctcgcgagaacttcgtggctggctaaccgaagcggtagctctgcaatgacttaagagcagttttgtgcgcttttcctgacggggttccgcctccaaaatgcataagttctcgcgagacgcagtaaggcaccggctcgaactggggcgggccactgccaggaaagcaacgcccctgaatgcttatgccggtggttggtagaggaaatggaattccccagactgtatcctttctgctggtctccagcatctacagacgttaaaggcccaaga

SEQ ID NO: 3367 - DNA, 2183 bp, Homo sapiens
cgttgcttttatttaatcacttccccagcccttccatcgccttttttgaggataagaaacccaaagttcccagagattaacttgcccaagatcacttggcctggatttgagcctgaggctcagactccaaaacccacactcaatttgctacatctcccaggggtggggccaaggcagctgtgagcaaaaggagaagtatcagcttctcaagggcctagggtttgttggaagggcaaggcaagggcaaagggggatacagaacaagggggcaagtaccagtgcctgggatggacccatccattcaggcagggggtgtggggtgtcccctgtgcttagaaaccacctagcatcatagctgcaacagcactttattgggatctgagtctacagttcacatagggaggtgaagccgtgggagaagcaggggtaaaaaaaaaaaggggggggacttcaccccctagggacagctgcttccaaacctaacaaaaccccagggtaagtcctcgtgctgggcctcgagccagcaactctagtcaaatcccaaggcaccggtcagcatgtgggtcaaggggcccactatggggacatacactcaagaggatgaaagctctttagcttcagaatcagattgccttccccagaccccaccccaaaacaggctcctctcccatctcccccttcacagtgacaaaacacaagcccacatcccagggcctggagtatttgcatgcatttgcatagacggcaacgcaggtccagctaaggcctttttctacataaagtgacatcagtgcagggctggtgattttgctctactgtgtgaaagatatctgaggacaccaaacaagccaggacagagtccaccctccaggagttagataacgctgggatcttgggctgggccaggccaaggccattccctgtggggcagggtgtcagccccggtggtggtggtggtggctatggctgtgcccctccctgggccccgcagctcttgggctctctgcccacctcttcttcagtgctttgtctccaaagaagtggctgaagatgaagtcctcaaagtcatctacttcatcatcatcacctgtctgttgcacagccacctcctccaagctgtcctccagggcatccacaaaatcccggaagcggaggcggtcatgacggaagatgccatcctcaccaaagaaagcaggtgagaggggtagctccttggtcagctgcccagcccagggcagccgtgccaagtatgttcttagcagagaggccagctcctgttgccgcactggggctagctctgtgccaaagaaagtcaggccctcctgccgggcacactcgtccacacctgagcagccctggggtgcccggtacttgggcctcaacagctctgcccaggatggcagggggtcatggctgtccttagtcccttccctccaccgaggttgcttctgcttttctccagaggagtggaagctaccacttttccttgggggttccttcgggccctgtcgcttgccctccttcttgctccccgactcctccacccttggcctgccctccttccaccttcctgctggctccctgtcctcctgacctccccagttcttcttcctttcccggccagattcttccttcttatgtttccagtgctcagccttccggtctctctgcccatcccaccacttttcctttccactccactccctagaattctggaagtgggacttctggtgccaggcctttgaggcattggcagagaccccagggtcctggccccagttctccaggccctgcagtttctgggccaatctgtggcccagctcagccaagccagcatgagctgggtccccgcggctggcatcctgcaagctcctctccagatcctgctgtacagaccccagcagccgtcgctgcctctctaactcttgccttaatgcctgtgcctcagcctccagctgttccttctgcttcaggaagctgagttctggctcctgctccctggggccttgctccctgatggccttgtcaccctgtgggcctctacccccactgaggcacaccccatctgggccccggacacagtcggcctccagcccctggagccgggcccgcagctgctgcagctctgactccagagcccgctggaaggcttcgccctgctgcagagccccccggagctgggc

SEQ ID NO: 3368 - DNA, 1007 bp, Homo sapiens
cctcgcttcttctttgttctatcaatatggtccttgagttgaatgcggacctgtcgctcattaggttggtctcgtataaatggatgcttcatcaattgttctgttgctggtcgctggctgtgattctttaccaagcagctctcaataaatgactggaatttttttgacctgccaaacaaaagaaatgaatccacagataaaacggcgatccaaagaaaagcaaatgtgtaatttctgaaatgctgggactttttctttttttaaggtccaattggctggcatagggatcatccactaatcagaaaacagttgtagcactatattaggcataatgggttcaaaggcatcatcatcatcaacgtgcaattgaggtagcagaaggtagttatgcacatgaaagcatttttgcacaatttatatgtaacattacatagcagaccaaaaggacgcagggaagaaaaagacccctatgggaatcacatctagaagggctattggaataaggaaaccatagctgggcctttaaaaattaggagaaaatcactctggggaaaggatagttcagatatgtaggatgacagtgaaaaactcaggctaggatgagaataatgtatgttgggggacactgaggtgagccacttaaataaggcagaagatgcaagctggaggaaagtaaaaccaaggttggataggtaacagggagtgcatttcgtagaaatgagcaagatttttatatgatgaagtgaactttgattaggcaaactttgtaaccagtagtttcagaatcacttttgaacgctgctttccaaggaataagaacatataagtatatgtgtacctttgtcgttaactcaaggacttagacatttaactttaaagaattaagttcacacccagatgcaaatttatcttcctctagaaaggcaatatttcctcaaagataaaccccacgccagagacctggcaggggagagctggcgagagataccatacctacgattatggca

SEQ ID NO: 3369 - DNA, 1577 bp, Homo sapiens
gggcttcctgctcgggtcacaagcgccagaagcgccggcggctgcggggaaacgtctctggagggtgtggcggaaacttgaggcttggagtccgcgggaccggaaggggctccgtagctcggggcagggtgggcgcgagagagcctagaagcccatgtagccgcgaatcccgcagccccagtacacctccctccgtgcctccccgccttttctgcagagctccgccctggagtgaaggaggagccgtcacctggagctccgaaaaaagcagaagaaggcgctttttatttagccagtgtgaccccgccagggccttctcggttgggtgagcactctctctgaccaggccatgaaaagaaaaatctgtgcgatgcctccccacatgtcacgggactctgacttgcctttgtcgtcagagtttgcagaactttgggggacctgagaggggagtgccccctggacgggccacggctgtctgtggcttaagggcttttggaagggcggagagagggaaacggcgtcctagtggcctgcttcagggccacccacgggccctcccccaacctctctctgatccaacttgtttttccagcctagttggaaacttgtggatgctgtgacctcaagaagacttggcattttatttggaagatagacatctatttgcaactgtcctgagcccctattttcctcccacctttcttggggaaacttgtttttaagggatgccactgtttttgtaacatgttgctcctagctcttagcattcatggtactgttgtaaccgtccagtgggttcactttgtctgctagatagagccgatttatcaagacggggattacaatggagaaagagtaattcacgcagagccggctttgcagataaaactctgcaaagacaatgtctagcacttatatctccagtaactcctgtcaaggtttattgttgcttgttcatcattgcagtcctgactacaagtgtgattgcactttctattgttttgtcagaatttcctgaaaagatacaaaggcccttctgaccattggattggccttagaagagaatcatcccatcgcatttggaaatggacagacaacatggaatataataacatttttcacacatttacaaaacaatttgggaggaggctggaaatcatcttgactgaagaccaccaatggcagcagttcatttgggtacagcagcaagcatcagttaaatgcttgctatcagaggaagtggagaatgtgccttcctgaatgacaatggagtcaacagtggcagaatctacatgaacagaaaatggatttgtagcaagccaaacaattatgtctacagttgccagttatgtccccactgggatactacctagtagagctgtgagaagagggccaccatcctccagactccagaatggtggaatcagcagcagcttccaccatgcccctggaaaaactgcaagtaacagacctgcacatgtatcccctacatctaaaataaaagttggaaaaaatggaactttgatgttaagatgcactgatacaaaacttaaattttggtctcctacattaaaaca

SEQ ID NO: 3370 - DNA, 2590 bp, Homo sapiens
agtctggcgtcatctaggtcgctgctcagggaaatgcggaggccagtaggcttacgtgtttaccgcgtagggcaaagccttgccaaattcccggccagcggagcggcgagggtggggactcacgggaagttaaacagcctcgtcggcgtcctcgaggctccaaaaccaggctctaggcggggacgactgcagccgttatggaggccaccgcggctacggccgcggctgaggcctccccaggtggagcggtggcctggaggggaatcttgatcctgggccagccacctgtcaagaggaggcggagcgtcatgcctctggaagactggatgaatattctccaggagcctgacgaaggcgtgagtaatagggacgtgcgccgccttgttggtgttgatcagtccaccaaggagaagcagctggtcgcagtggccgtacctgtaatcccagcgctttgggaggccgcggcgggaggatcgcttgagcccgggagttcgagaccagcctgggcaacatagtgagaaacccgtctctaccaaaaagaaaaaaaaaaaaaaaggaaaaaaattagtgcggtgtggtggcacgcacctgtagtcccagctactcgggaggctgaagcgggagggtcccctaagtctaggaggtcgaggcttcagtgagcggtgattgtgccactgcactccagcctgggcgacagagcaagaccctgctttcccctcttgtcctccactaccctcaggaaaccaagaaagaccagcgtggagagttggtcgcccatctgctctaagctgctgtgtattcccctgtaatgtaaacatcgtgaaggtggagacccagttaaccttttaggtggaaggccagatgacagagggcggcatctgacccggaaggccctctgcaaccaggccaaatacatctacagggaaccaatgggaaacatctggggaggacaacccaaataagtatcatgcgagcaagggatggtttgagaactttaaaaatcgctgctgttttgcaacatacgaagttgatggggaggaaggacccttaaatcctgagtgggtatcgagtattccaagcaactggagagaggctttgtgcctcaacaggtcttcaacgccaaggagatgacccatcttttgcagtgcatgccttcctacttttggggcaaaagacaaaaatctggaaagcttagaggaagctaaggacaggatttccctcatttttttgtggcagtgcctcaggtgacaaaatgataaaaccactgctgctttacaaagactctaacaccccacttgtcttttagagataaacgccttcctgttttcttgtaatcacacccagaatcaccactgccactttttggattagttttacaatttttttatccatcaaatccgaagtcatttaacaaaaaaaatctggaaatcagaatgttgctaactgtggacagaggtcccaatcacccagattcattattctttgttcattctaatgttgatactgtgtttctccctcaggaaggccctagctttcttcagcccttgggtcagggtataactgaagcatttgaacataatcaagcatatgtttgaccactttgctgactgtattgaaaaaaccctcaccttactctgaaagaagcatggcaacagtacaatattgccgatgctttggtagtgataaaagaggtgatgggtgatataaaatcagccactcttaagcttgctggaaactgtgggaggatgtgtgaatgatgcatatttccctagagctaatgaagaagttaaaaaaaatcttagtgtctgcaaaacaggtgggtttaagatttattgatattagggaaagtgaaattaatgagctactcaagtttctgtctttggtcatcactgagagtctatttccataggaagaagtctttgcagaggaaattgaatgctgtctgatgctacaattcatatggatcctttcctggattgaagcctgacttttaaaaaaggtttcaataaattgcttatacctatgaagagatgcaaaagaaccttcaaaataaagcaaaggacttgaagaaagagaaggaagacatgaagaagaggatgtcatttaggtgaaggtgatggatacagaatctgagtctgaggggagcctggttgacagagagacaaaaaaagaaattttttttttctgactaaaaaaaaaaaggaaattttgttaacaaaatcaagaatttaaaaaaaatgctgtgagagctgatctatgcatctggtttgtgagccagtattctgtgatggctgcagtttttagagatcctagtagctctacacatctgtcttctgctttcctagaacctgggcaccccatggatgactcactgctggttttgtgtgtgtggccatgctggataaggagctggctgcctctgtgaacatcctactcaaggcatcttcactgctgtacatccttttgaaatcccagagatcttcagtctccctgtggattaaggagatgtgcagtatttaaagtggcttcaggaaggcatggaagaggactgagtggggaaagctttttgtgcatgctgctggctacctcc

SEQ ID NO: 3371 - DNA, 785 bp, Homo sapiens
gagttcataatacttcagctagaacttattccttcaaatttaactctgtacccattaaaagtggttttgtgtgcaattaacagacacatgttctacccatacattgttttccaaaattattgtgtggctttaaaaaaaaaaaaacccacacaacaaattgcaaaaggcactgagataacatctgcttctagatcattgctaggctcgaaaaataaagcttgttctaccaggaatgacaagttagaacttagtatttgccaaagcagaaattatatagtgtcagttatttcaggcaaaccttattcggctctcatccccaactatctgtcagaacaattaaaagagatcaaaacagtccagcataactaggcttcattatataagcaaaagtctgaaacctaggctgggaaccatgtaacccaggccaagaaggtactttaaagtgtcttagagttgtttttcaacttagggggaaacaacagattccattaaatcccataaaggatttttttgtgtgtgaaaaagggcctgatgtaatctaggttagactcaggaggctttaacaagttttgtcttacgggtaaatggtggctattttcacagataacatcattactcccatcccttactatggtttatacaaaagaggctggagaataagtacatttttacagccgggtgtggtggctaacgcctgtaatcctacttagcactttgcgaggccaagacaggaggatctcttgagcccaggagttcgagaccagcctgggcaacacagggagacc

SEQ ID NO: 3372 - DNA, 4700 bp, Homo sapiens
ctctagtctaggcgcacgaagggagttgctcctaggtcttgtccgtgccgggttcgcttttctttccttcccgaagcctggcccttagatctactatcgcagagtctgcggccgccaggaagcccagattcgagtgtccggagagtaaccggaagtgctgtccccaggcctaggggcggcgccggcggctgccagggagaggcaagaattgagtgttgtgaatagttctgaactagagaccttttgaaaccaaaaggaagatggtcttgagtctttcttgttacgaatgctatcttctttgagaagtcaaatagtcaggatcaggaatgtatgttttcttccatctggattctagggttggaaataccaagtaaggaattaacatatatgatgctggaaacttgtagaggctcatgattgaaaggcctgaaacagatgtatcttccaagttcttatcaagaaaatgactgtgagggcaacgatgggtcaagaagaccagcggaaaactccctaggagagagccatagaaaatgtacacttcagaagagaaatgtaatcagagaactcaaaaaaggaaaatatataatgtatgccctcggaagggtaaaaagatttttattcatatgcatgagattattcagatagatggtcatatataccagtgccttgaatgcaagcaaaacttgtgtgaaaacttagctcttattatgtgtgagagaacccatactggggagaaaccttataaatgtgatatgtgtgagaaaacctttgtccaaagctcagatcttacttcacaccagaggatccacaattacgagaaaccttataaatgtagcaaatgtgagaagagcttttggcatcacttagtgctttcaggacatcagagaacacatgcaggtaaaaaattctatacatgtgacatttgtggcaagaattttggtcagagttctgatctgcttgtccaccagcgaagccatactggcgagaaaccatatctatgtagtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacgcattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaaatttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttacgtatggcaaaagcattcattggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtgggtgagaatctatgtacatatgtatgagaagactgttctcatagttagttgactcatatggtagagaggactttacatgaaatcagtatgaaaatagttttttagatacccagaagcttgttctgggagaagctagggcgggtcagagtagacctgatgggtaactcaggtaaagatgcttttcttttatctgaactacttaatgattgctttacttttactttttaaaaaattcagaaatccaataaaggaaaggacggtaaccttatgatagaaggtgtggcatgtgttactgttgggggaaaggagtatattgactttgccttggttgatatttttatgcttgtctaggatgggactagagtgttgatagtaacatggcagccttttgctggcagtgaaatgaacttaagaagctagggagtagctatcctagatcaaaactctcccaatagtttttcctttgcaggaccaatcttataaagaaacagcatactcagctttttacttagtgtcagttgaggcatactctcaaaagttttttcccctaaaatatctttcaagttattactggtatttgaaatttcaagtttagaaattcatttctttttaactcaaagtgcaaatttcatataatgattatgatggttttagtgtccatatttttgtgacttcacttatcatctctttcagcagtagctacccacagtcagctcctagtaaaatggctacaggaaaactgaaagaaaagtttaagcctgagtaggcatagagtaaaaaatgcataatgatgcattattaatataagagtaaggctttttttattttgagtatcctaactccaaacctagtgttcttttcactccattatcctgctgtttatagcaaatcaagacccataatgatacgtctttcatttatttcagttctgccaaggaaagagaaaataccttttaatcccagggaaaggattgcaatcaccacattataaggtatatggcgtggaatgcagaattctaaatactagaagggaaaagtagttggcagattcatcagaggcttaaggataagtacttgtttccaatttaaaagtataattaggattgtctttaatgttctctagaaatactataattaatctagagatctatcaatggtcacatctcagtttttttcttccctgagattcaaagacgtgtaataccaatacttcagattcctatagtatttgggactttgtagactagtgaatagatactttgttgctagtccaaatcctctgattttggtttgatttgtcctagcagatccctgaacttcagagagtattgccatttggattcatggagttggcgaactgctacactgctaccttgtgtatggctctaagctttgatcctaatgactggttgatgatcatgataatattagggccagtgaatatagctcatagtgataataaggattctagggtattttttttttcttttagaaaaagatcctggaagtttatttgatctgacatgtttttgtaatatttagaaatagctcttgtatcataaaaagttgcccagtataagacacacaagatgtatttttttctctggtgaaaatcatgcctatcactagtatatgtttgacatttgtagtatacttaaaatagtattgggtgtgaggcatggtggtgatgaaaagtagtccttacggctacttgttagtcattagagagaacatggagaaggggtcaaagttggtatcattaacagggcaatgacttgacccttctttcaactgatcttactggtagttgtctctagtttttaagtaaattaatgatggaccatcccccaaacagagaactatgggggtatgaaacaaggctgaaggcttttaaccatgggagaaaaaggtgttggtattattcatatagcataacctgaggttggagaggaccacttgggagcctgtaaccaaaactagaaggtaacttctgggatggacggaggttcccttgaagcagtgccaacctaaatctacctcaggtaagtagttagattaactttttcaagatttcagaccaaacaagacaacttgtattcagttgatgtattcctatgctttaatgtttttgtttgcccttaattattaaataaacatttgttctgaaaaaaaaaaaaaa

SEQ ID NO: 3373 - DNA, 1863 bp, Homo sapiens
agccttgggccccacgcgcgcgagcgccgcccgcgcccccgccgacctcccaccgccagcggctccgcacccggcgcccgcagccctcgtacctcacaccgctgctccgaaagccccggaacgcactcccgggctctcccggtgcccttacggagggtgctgtgcttctgcccaacgccggcgctcggccaaggcggccgcggagcagcgagaagccgcggaccggcaccgtcatggccgcggatccccggcttccggactggggctccacctcccgcgactccagtcctcgcggctggaggcctggctccgccctcacccgggctggcagggcagcaagtagcgcttcccagccaggttccggcagacacgcagagtggggtaaagagcggttcccaggaccggggacggaactgacagagtgccgggtccgcagggggcggggccaggacccaagtcccgggccctctgaggatgtggaagcgtgcagtgtggcctggcgactgggccccgcacccagccaacatatagctggcattcccatagcgacggcacagagaaggcctccaaactatcactttaggcagcacgccccactttccaccaagccagagatcctgcccaacagtctccgtgactacgtggaattggatttaaagcaggaaagaagtaataggttcattgtttcccacttcctttgtgagattccttggaagttggagaaaagaacaaaggtgtgtggagaaggagcaaaacctggctgaacaaggaaggtctggactttaggatttctatacttctactttatcatctccacttttggaaggaaatattgaccaatatctgtcttttcctgagttatgatcaagtcgatgcaggctaagaaccctgcattgtgtggtgagcttgtgtggtgaggaagcaaaatatctgctccctctgaaaaagtaaaacattagactgtccattcattttgcaaattaagacagacacacaaaaaacagtcacagataaaaccagctgggaagttaacaggaaacaacttttctcccaaggtcaggctgctgctgttgagtcagaacaacgtctttcatagctgcacttttactgagaaaacttgttttttaaaatcatagactgtcagaaaatatgctctttaaaatcatatcaataagaatgggataccctactctttcctggctgatctaaatccatttgacacaaataagcagcctagaagaaaatacaggaaaaaatctaggtgaccttgggtttggcaatgagactttagataaaacacttaaatcacaattcataaaagaaaaaaacaatttaaacttctgccatgcaaaagacactgttaataaagaaacaaatcacatactgggagaaaatattcgcaaaacatttttacaagacttacacccaaaatatacgaagaactcttgaaactcaacaattaaagaaaaaagaaaagcaactcagttaaaagtgagcaaaagatctgaaaacacccaccaaaaaaggcatacagaggtcaaaaaaaatggaaaaatattcaatatcatttatcattaaggaaatacaaattaaaacaacagtgagataccactacactcccattagaaccgctgaagtccaaaaaattgataatacgaaatgctggcaaggatgtgtggcaacaggaactctcattcattgttggtgaataaaaaaatgattcagtcactttggaagacagtttggcagattcttacaaagctaaatatcatttaaccatgcaatccagcaaccatgttcctatgtatttacccaactgattttaaaatatgtctgcaataaaccaccatatgaatgtttata

SEQ ID NO: 3374 - DNA, 3931 bp, Homo sapiens
caacgagcctcaaggtggccaccaaaccgcagcccctggcccttcccaggagtatctggcggacttaccgaagagcagcggcttgaggctgagggttcggatgaagtgatccctgtcggtgaccagctggaccttacgctcgtgccccacctaaggaaaaggcgcacagcgggcagctggggcgccagaccgcgctgcccaagaagggccaagtcgccccggcccggagagcgacagcaggcgagtgagtgggagcgcgcgggaccgacgcagagcagcgccgggggcagcgtggggacccgggctgagcgccggtcctctcgggctcagccgtgcagggcctggagcgcggcggggcagggaggtcctcaccttgatgccctccagccgggtgaggggacctaaggtgggctcgggcccggggccctgggcacggtgttggggcccgggatcgctgctttcgtcgccgttgctgtagtgcacgaagagcagcagcgccagcacgttacccaggtacaggtgcacgaacaccatcagcaccaggaagtaggcgcgcgagcagatgccgcggggcttgcacagcggacgcaccggtgcgtcctcgccgtcgcccagcccggccgccgcctgagcctggcagtggtctggcggcgcccactgcggcctcgaggcctcctcggccgccgcggtctcaggccgctggcctgtcaccgccgctgccgccatggcacccaggtcgcgcgcgcgcccaggggaggggccgcgggggtgcccgcgctgcgcagtcgcccggacaacggccgccaggcccgcgagcgccgcggtcactaggagacggtgcctgggggtgctgagcccgcccggagccgcctgcgtccgcgccgggctcggccttcctgcgccttgagccccagcccacgctggggcttctcttcccaagctgggttgccgtcgggcagagctgtacactctccaagtcagaagccaaggtcccaagcgtagacgcggacaagagcggcaccattaaggcatacactagtgggagcttctcggtgcctgcgtgaagacgccctcttgcctccgggaaaagtatcgtctgcatcttcttgctccaggagcgggggtggggagcgcagcgcggaggaggcagcgctgagatgactcaacagtgcggcatttgggggcgccgcggaggctgggactgcgtaagcggcgatagggtaggacccacagcctcctcgcaggcattcttggagctcggttccgcggtcggtccggatctcccgggaagtctcgccggagtcaggcaggccttaggaagaagctgcctgatgtgcaaggtttcataggccgtcagagggggcatcctggaggagccctggcatcaggaaagtgagccccccatggcagcccgcaggaatgaaccagtgctcagggcagaaaaattctgcctgacctttcccatcttcctgatgatgttaacaaacgacagccactgagggcacaggagggggctctacacaggccaagagctacaggctacagtctgagcacagaaaaccctccagctccagcatccagggccacagctggacacaagtacagaacctggcagccctgcagcccagacaatgcccagggtgtgatttagggtgcagagctgcaactcagatcctgtgccatggcagtatcacaggaaggacttgacggagaggtgaaggctccagacgccaggatatttattccctgtgccaatacagcattcacacctgacctccaggtcctgcagcaggtactctcctcattcacagttagctccccactgttccattctgggttcatttgctatactcctaatctgttctcccaatccaccccacagtctctcccttgctggggacaacacaggaagagacaaaacctgaggaaggaaaaagggaacctgcaaccagccatggacctcatgatcccatgagtcacagctatcctctgtctttaagaatgactgttttatagcttacatggtacctgggaaattgctgacttgcagctgaaatgtatgaataccaaagaatttctatcacaatattcacagatctctgtatcagctctacttggaggtcaagcaggcttgggagagtatagactgctctgcctgccctagagtggaagcattgaacaaagccacaaaaaccccagagatcacagatctaacttttcaatggcccacaggaccaggttcaggacaggtaggacaccaggcaaaccacttgttcccttgcgcttcattgtgcaaaagctggtctgttcctctggccagaccctccttagtacaggatctcggaccacaaaccaaggagtctcgtggccttggattcccagaccctaggatggtatccctctgacagctggaaccaggcaagggggaacacacctcagcctcagagcagcctctggacactctccaggtaacatgaaaataacttgtgcaaacacagcccccatgccagaaagtccagtgccctaggaagggctatcctgaattctgaccctgatgtttgccaaaggagaatgcagcaagacagtgtcaggtttggccaaatgtgaccctgctcagagctataccacttgaatactggcacaaaagaaaggaccaaggtaaagcaaatttatttgggaggaacaattcccttcaaaagtagatccctatctttaggagacaaaaggcaacactgtgatgaacccacaccccctagtttggggggccacaggcccaaccccattctgctgtgggctctagcctcagtagccagatccaggtaaacctcagtttcaagaataaaggtgagccacagacatgcagcaccaccagagacaacaacaccccgtggcaagaagaccatgttctggactgtctccgtactgccacggtaaggcaggaggcatgctgtgaccccttgtgctccatgcccattgcacaggccagttcaattccctaccatctgccacccatgctcttctttgggactacaactctggccaaacgtgaatatggaaagcagaggcccagggccctcttgcagtacagacattttgaggtgggtaggcagcatatgttacattctaagtaaaacagctagagggtaaaacactccaatgccaatttattttcaaaaagggctctgtgttatcctatagtttgccttttttttttttttgtataattgtacaacctttgaaagttacataagttgtaatgatctaatactattaatagccattcagaaaacactttccctccctcccaacaaccatccagggggaaataaaagtcctgaaaagaggccagttcaacatggcctctaccctggtagaaacaaaaagtgaaaagagaagaaaacagaaatcaactaagaggtgttgccagtgtctctcaggagtggggccctggctgttgcctggggtcatgaaaggcagagcctgcagcatgcagtatggcagccgggagaccttgcagccacatcttcctcaccccggcacatccacatcccaacttaggtgtcatggaaatctttcagcagggttctcctccgctgctccgctatatgcatctggttctccaagtcctgcatcagagaaacaaggtgtgtgcttgcatggcccaggcctgggagcaaggagtagccaaagccacaaacaccctccaggacctccaaggagtcaaaaacactgcccttcccattcttagcagcagctaccagtgcacaagccaacaacgctgtcacctattaccatgccagtcctctacctgcaatatagaatccaagaggacagtaggcacttacccctctgtcatagctgtctgcacgctccactttccatgagaggttttcgatctcagcctccagctgagcctgctggtattcaaact

SEQ ID NO: 3375 - DNA, 2446 bp, Homo sapiens
tgcagcagtggtgctggaaggatgacgtagggcattcgtgtacatgcactagggatgtcttcgattcttttagcttgattgattaaaccaggactctgaacaggtttaaaaatccatcctctgtcaaaggttttactgacaactttccatacagttggtcaaaaaataaaaaaatacagaaccacagcagacagtatcttgtacactagaaatcaacataaccggattcccttctcatcgtttaaaaaaaaaaatcccccaaaatctaagaacttagttttggtggtggacaggactttgatccccacccaaatgaaccaaaataacccaggagataattcaaaccaaagtggtagggtagagaggggatcagattttaaaataactgcttttgtgacacaaacatgacgctgggaaagacaggcttgggctaggcagtgtctctgacgatgactatcaccatgtgttcttcttctagcttgcccaatgtccttagtgctgactggaggtactgctgggaaaagtcgcagggtgggaaggcgtagagcatgcctgtgccgtctctgcccttggacccccccactggcaagctgatcacccctgcggcctgcttctgtttcaagtaggagaccaggttcctgagaagccgcctctgcagaccgggctctactgtgggcatcccctcagtgccaagcccactgggggttgcctgggtggctaagaggaccgcatagccgttggggctcccctgcttgatgcgtcgtgtgacctcgtcaagcttgggctggtccagtcgaaggcgctgggcgatcttcagctgggtcagcttgctcccagaagtgtggtctttgaggagactgctgatcaccccctggtccccctctaggatatgcatagacgtggggaagcagctgtttttcaacaccagaagcccattccaacccagctgtagtgtctgagcgtactctgaaagattcttcagctttttggtctcgtgttttggctcttccagaggcttgggctcggcctctgtggtccggtgattgcgctcgctgtctcttgccttcttcccgtgggaagagtctgcagcctcgtggtggtggtggtggtggccccgttcctcagccccatgtctgctgttgctgagggagttgctgctggactccttggtcccttcactggagtggttctccttgcggctgcgctcaggggtgcggtcggagccccgctctgactgctgcccactgcccttggtcctactccgttcctcatatggtgaatgggttgtcctcccacggtcactggaaaggcttctccgtttccgcctctcttcccagggcttgggcaaaccacggtctccatctgccccccaacgctcaccactccggctgcgcactgagcgactgtagccctcaaggctgtttcggcggtcagagcttttactggggctggtccagtccccttccaaaaaagtccggtctcggtctgagtacagaaggtgtgggggcgtcctgtcccgcaccaggtcggcgtccaggttgcggtgccgggtgtatccatctgtgagcagctcataatgcacagggagtggcgagggctggtactgctgggggtaccgagtctcctctgctttggcaaaatccacgcggagcctgcggtctggtccacccaagggaaaacccctcattttagcacaggcggcctgggctgcgtccaagctctcgtactgaatataggcaaagctatctcctttgacgtgatcaatggtccgaatgctcccaaagcggtcaaactctcgggccagagccgccagtgacgtgttaggtcccaggccacccacccagagacgagtggtggggttggccttgccatagcctatcttaatggggttgcgaccaatcactcggcccgacatggccaccttagccctatgggccatgtccaggttctggaacttgaggaaggcataggcaccgccctggccacgggcaggcctcttgatgaccacctcctcgatgatgccatatttctcgaaggcccttcgcagctccacctcagatacgctgtggtccaggttaccaatgaagaggttgcgcgtggcccgctggtcatcctcgggcatcaggtcctcctcacacacagctgggtagccataggggcgcccacggtcgtcgtacagcccgtagtagtccagggcccgctcccgggacagtcccacggcggcggcagcagcggcatccagggcgaaggctgcggcggcgtgacgggcacggggctcccgcaggggcggggcagcgacgggggacagcgagcgctgcttgtactggtagcctccgtgtagcgggaggtagccgagcgggtcggcgggctagagtctcgctcgctctgccgcttcatggcgctggcgcggcgggcgggcggcccgtaggtttctcacagcggcggc

SEQ ID NO: 3376 - DNA, 1900 bp, Homo sapiens
tatatttaaataacattttaatgacaaaatttgatgctctcaagtatcaaaatggaaataccaacagcaaggtttccagggatgtccaacaccacagagcagggaggcctggctgggcctccactgttgaggtcatcatggtgcttccgctttattctgattaacttttggttacacacattgaaaaatgacctaagagagttgttttgagtggcgctttttctcattgtacagctcctgctagcagtttactgcaacactgatttctctggaacctctcagtttccagtcatcattagggctgttactagcaaggacctacaagccagcctcaaaatgtgagagggctgccgacagtcttcctgtggttagctgccacagtgcccagggaccatcttccctctcctcctcccccactgccagctcctgttccagccgcatcagttcctcatttgagagatcttcttcatgggactgcagcaactggtccacagcagcctcagcaacctcttcaaaggccacatttctggcaagggtcacaatgtttttttgaagctgtgcaatgttatctgcctgggaaaaacgctgggcctgaacacactcaggccaaatcttcttccacatgctgttcattagtgctggtttgagctcctcccatgcgatggccatgtccacagcatccatgatgctgtagtttctccaaaattccctgatcatagctgtgtcctcaccatccgctgcttctaggatgtgctgaaaagtccttctcagataatgagctttcaaggtcgagattacaccttgacacgtggtccggattgagtcagctgtactgtcatgaaggtattatactcttgtacttcttttttttcttttttttttttgagacggagtttcactcctgttgtccaggatggagtgcaatggcgcgatctcggctcaccacaacctccgcctcccaggttcaagcaattctcctgctttagcctcccgagtagctgggattacaggcctgcaccaccacgcccggctaaatttgtatttttaatagagacggggtttctccatgttgaggctggtctcgaactcctgacctcaggtgatccgcccgtctcggcctcccaaagtgctgggattacaggcctttgcgatctgactgagcttctcacccgcttcaaatcgtcgtaacacttccaatttgaggtcaagggtaatcgctttccgttcccttttggcactagggatgacagttgcatctgtgggcctttccccaggcatttctgcctccaaaatgtcagaaaatcacagcggtctcaagcgcaagaacgctgtggttcctctacgtccccttgcagaactcggtcaacagaaaacgaggctgcgaagaggctcaggctgatgtcctggagacgtggacgggtccccatgggcaggcccagccccactgcctagcccagctgctgcttcactgtccactccgaggaggccgcgcgggtctcccggtaccgctcgaagtccgcgtgttggggccgtgcggccgcaggcacatacaagcggcctgggtcctggggctccagagaacaaccgaccaagcagacaaacggaactccgtgagggggacactgcggcagaaacgtccaggggcggttttccagtgcagcggagggcggaccgggcgggtgttgtttcgggagctgctttccatggaggaccccagaaataagtgttgatgccgatgcccgatttaagataagtctaaaggcgctggctatccccttagggcccagctgtctgggcagggcgaggctgcgctggcgatcaaaccctcgaacggtcaggcgacggcgtggacacccaagacggggccccagccggcgccgcgcccctgccgcgcctgcgc

SEQ ID NO: 3377 - DNA, 5093 bp, Homo sapiens
ctgatgcagccgccgctgctccacctgcaactctgagcgttgccttctctttaactgccactttgataccgcagtcctttttcctacatgtatttgtaatttatttctgcaacagctagaacttactgtggctgctgtttaccctctagttgggctctactgcgaggcaaggcaaaagtcaggtccgtcggcgccctctcctggtaaagctgcgaagctgcagcaaacagagctaaattggtattttcccgtttgctgcggcaaatttttattaaagtgtaccctatatttatgattattaaactttagtgttcgccagcatttctagcaagttcccaggtgatgctggtagagcacacgcccagaaccaccgccaggtacacaagtcactggacaaggtgggaaggcatcttactcaatcaatggaccttattctaaagcgggaagggcactgagagtatagggagggtatctctcaaatgaggagtctacgacctgcttcaggggaaggccaacaacttcttggattttatgacctgcttcaggggagaaggacaagggaagtacagcgcctacaacaatgcaaaggctagaaggaatgaaggcagggacatggaatggagaatttccatttcacggatccacataaactgaaaaggaacaagagtcggtgagaccaaagagcactgaaggccatgaaccaccaccattctcaacccctgggccaggcaagaaaagccacggttcctggaagggatgacgacagaaactgagtgctaaaggagaaacgcagttcagtaaggggtcagaaaagacttcaggaaggaagtgaagtttggacttcatcttagctcatgtgtggaatttcaaatgggagtgatgtgaatggggaattccaaaaggaaggaaagtgggagtaaaggtttagctgttggaaagcttggggaaaataccaggaaaagtatgtcgtctcactatatgtcatatcaggcaggaacttgggataaataaaaagttggccccgggcgtgttggctcacacctgtaatcccagcattttgagaggctgaagcaggcggatcacctgaggccaggagttcgagaccagcgtacccaacatggtgaaactctgtctctactaaaaatacaaaatttagctgggcatgctggcgcacacctgtagtcccagctactcaggaggctgagacaggagaatccctcaaaaccagggggcggaagttacagtgagccgagattgtgccactgcgctccagcctaggcaacagagtgagactccatctcaaaagtaaataaataataaatttaaaaacctaaacgttgtagataaaatgttaaggatgttttagggcagagctgaaagaacatcagaatatatttaaagtggggaaggtgggaagatggcatgaggccaggagttcaagacaagactaggcaacatagggagaccccatctctaccaaaaacaattctttttaattagctgggcatggtggtacacacctgtggttccagctacttgggaggctgaggtgggaagactgcttgagtccaagaagtcgaggctgcattgagccatgattgagccactgcattccagcctgagcaagaccttgtctcaaaaaaaaaaaaaaaaaaccctaaaaataattctcaaagagccctgctttgtattatcacactctagcaaagttatcaggaattgacacttgcgggtagatacagccaaggaaatggcagctccctgaagagcaggaagcagtttatgacaccaagcaaatctggtttctcgctgggaagggaggctggttttggaagtatgcaacaatttgacttattttcttaattttattttctatttataggcttactgaattattttcatccatgcccttttaaaatatggttggtagaaatttgccatttgagactagaatcccattcggaatcatgtaagtctcttttgactccacgaggacatctttcacccagttttgggaaatctgaggaatggattcttctacagactgataaaatatcacaaggtccaagagtttgtgtgagaaagaggacatcaagtgatggatgtgaacgtggtagacatacaatggaaggcaagaaggtatctcaacacagcagaacaagaccccatgaggagcccagaaaaaaaataaagaaggttcctcactggttaggaattcaaaagcagtcctggcaacctcatagcatctttacctcagaagcaggcagctctggttactccaccattttcaggaacaaggtttttctctccccctctgctgcatttcctctgcggctcctgatccatctgcctctaccttcttcctagcatcaaatttcctcccaggagacaacatgaatgggttaagaagtacccaatgagggctgctccaactggacagcatctttgaaactgggacctcacagatggtcatcacaggcccctgatgcctgggtacccagcgaccaaccccagtctagtctgtctatagcaacataggtgaaggggagtctcaggggctgcctaaagggctcagaatgtggtgagtacttaagactgcatggattttcactgtttacatgaatataggacaagtattcacagaactattagctagatctgtgaacaaaacattaataacattgtatgtccatgtctgaacccctgaaattccaacaaccaccacccgcctaccaacttgcagcaaaccggctctctccacagtcttccccagatcagggagaaacaattccatccttccagtactcagactgtaaaactggattcattctgattcctctctcacacatcccacacctgatctgacaggaaatcctataaactctgccattaaaatatatccagaaacaggccaggcacaatggctcatgcctctaatcccagcactttgggaggtcgaggcgggcggatcatgaggtcaggagttcgagaccagcttggcctacatggcaaaaccctgtctctactaaaaatacaaaaattagctaggtgtggtgatgcacacctgtaatcccagctacttgggaggctgagctaggagaatcacttgaacccgggaggcacaggctgcagtaagccaagatcgtgccactgcactccagaaaaaaaatatatatatatatatatatatgtccagtaatgtgcaactttcacagtctccaccaggatcatcacagtctaaccactgcttcctccagcctgaacttactgcaagaggccactcactggtctccaggcatccactcttgcttcccccacgcaccccaccaccagtgtctattctcaacagagcagccaaaattgtccttttaaacattggttggattgtgtcttctgtctgttcaaaactctccagtatgtccacatggatctcaaaataaaaccaaagttctggccaggcacagtggttcgtgtctgtaatcccagcactttgggaggctgagaagggagggtggctggagcccaggaattcaagaccagcctgggcaacatggcaaaaccccatctctccaaaaaatacagaaatttgctaggcgaggtgatgtgtgtttgtagtcccacctactcaggaggctgaggtggaaggatcacttgaacccaggaggttgaggctgcaatgagctgtgatcacgtcactgcactccagcctgggtgacagaatgagactctgccaaaaaaaaaaattcaaagttcttaccacagcctacaagacctgccatgacctggtccttcctaccacctgtctcatctttgcactctcactcactctgtaccaaccacactggcctcctggatgtttctggaacataccaaacatgctctaatcaccagtctttgcactggatttttcttcattctgggatgttcttcccttggaactccacagggctaacccccacagttcctgcacatctatcaatgatgtttaacaaaccaccccacttcgcctctgcagtattcccaatcgccacacctgccctgtgtggtattttatcacataccatgtaattaacttatttgctatctttaggaaaagggtttttttttaaattttttgtttgcatgttttgttttctttttgcttttggtatctcttcccctggtagaatgaaagctccgtgagaaaacctagacgaatctctgaaacttaatgctcaataaatgtttgttggtgaatgcctgatttacaggacagctgaagcagtttattaatttagaagagcttattaatttagaagttatcaactattgtaaaacttccactgcagtttgaagtttgatgtgatgggttgaaaaaaaccacaattagcaaagtgcactctcctttttttctatttatcttctaatcaccagtctgctctgatgctgattgacacacagatactgatgtgttgtttcccataaattcacaagccagtgagtcagtccttcaggtaataaacagatggctgtcggccaggtgagatgaaaaggcatggttgccatcctcgaggaatttacgtgtagcatgcgtgatttattgcactaaggtataaatataaggtataagaaatatcttactggtttgttgtggtggtttcttgtgattttttctcgtgtgaatgggaatatgaaaatctgtgtttttctaaacgctgccttgaccagcatctagacaaggaagagaaaccaagaactatttctgcaggtggccacatgaagctcgctgaagcagaacagcatgtgagaactaaccactatttctggtacctcaaaagatctgcagaagcttggtgagagaagacttttcaggcagatgatagttaatgtctttacaagtgatttagcacaagtcttctcttattatagaacataactttactggtgacctgaatttgtttttctctgaagtgtctagacaggagcaagagaaactctgaaattagaaataaatatactctcctttgtacaaaacactgaagctactcatcctcccaccagcagacattatgctttgaggggtagatctggtaatggcgagcaggtatctgagc
